United States Patent 9,328,346 (POLYCOMB-ASSOCIATED NON-CODING RNAS) - sequence listing, part 100

SEQ ID NO: 18817 - RNA, 176837 nt, Homo sapiens
cauaagucugugccugcggcacugcguagacgcggggaguucgguaucaguuuacacguugccuucaguaaaauccgccagagguccacccauuuugccuuuuccccuuccuugcccugggagaaauccucccuucacugggagagaacuucucucccagggcggugcgacccggagcuccagcgcccuagucuccacuucguuugcugaaacuugcuuucuaccagcuaagaaccaugcugcgagugauuguggaaucugccagcaauaucccuaaaacgaaauuuggcaagccggauccuauuguuucugucauuuuuaaggguaagaaaaaguuuucuucuuuuucugaaguccuguuuuggaauguuaguuucuugagucaccuucuugaaaagucugcauuuagacagcugaugaagccaagucucuccagcagcguuuguuaccugcgcaggacaggggagaggacccguuucuggggaaggcauuuaauuuucuccagggcuugagacucauggaaugaccugauguuuuagcucuaagagugugauuucuguaagcucuuggcagaaaacguauuugcgaaucacuaaauuucagguaucaacaaacaucuguauugguucaaaguaaguuucaguagucuuagaugcauuuuuucucugccugugagaaauggguaaaggaggaagaagagcaauuaaauuguuggagacaccauuacuccuugaaccagccugacgcugcuuugauugucacuggguuucugggaggugggaugggugaaguucauaguuuuauugaguuuuccugcccuuuugugccuuuguaauuguuuuuauaucuaaacuguuggggagcuuuuuuuguacauucuguagcuuuuaaauugcucauugaggaaagaacucuggacagcuaguuugcaauuuggggaucuaguucuaucuugccugcugaaugaccuugggcaaguuacuucauuucucugggaucucaauuuucuuuucugcaaaacaggcgagaaggguuuagacaagaucaucucuaaaaaccucaugguuggcugagcacaguggcuccucaacccugagccaacuuugggaggccaaggcaggaggauugcuugagcccaggaguuugaggcuacagugagccgugaucacgccacugcacuccagccuggguguaaaaauaaauaaaaauaaaaggcucaugguaauuuuaaaaggcuauuuuucuaugacacuugauugccauugcaggggaggggacaggaaugcuuggugucaugguacaauuugauguaagugacuuaguuuuggcuaaagugggguuucuaaaucucaguguggaggcuuuaucuauuuuguuugucauugguaagacugccaacucacuucuuggcaagagggaugggaaagagagggaaaggcagagagagugggagcauggauagacauguguuuccugaccaugccuugcuacauuucucguuucuuccaggagccugacugcuacucccugucaguuccugaggcaucuauaccuuucgccuuucuguuucccguuuuuccccuuuauuucucuucuuaaaccucucucucugaggaugagcaagaaaaugaaagaaaugaaacucaaagcuggcuggcuggguguggugacuucugccuguaaucccagaacuuugggaggcugagguggguggaucacaugagggcaggaguucgagaccagccaggccaacauggcaaaaccccaucucuacuaaaaauacaaaaauuagccgggcaugguggcacaugccuauaaucccagcuacucgggaggcugaggcaggaggauugcuucaacccaggaggaggagguugcagugagccgagaucaugcuacugcacuccaaccugggcaacagagugagacuccgucucaaaaaaaaaaaaaaaaaaaaaaaaaagcuggcaaauuguugguugguuaaaaaaaaaaucuaaagggcaaaaauuggauuuaaaaaaaauuuaaaaaaauuuuuuugaauaagacugggucuugcuauguugcccaggcugguuauaauucccuugcucaaacuuucuucccaucucagcuucccaaaguguugggauuacaggcguaaacuaccacgcccagcuuaaaauugggcucuuaaaggacaaugagguuugaaaaucuggcuagugaauaucauggacucacguuaugucagaguuuauuuacauguguuagguuuuauuaauuuuuuguuuucuugaagcaguuacauaauagagacauaauaugaagauuuuacauccuucaucauugacauauaaagacauuaaaauauauuuggaucaguccgaucauguaauuauuuaaguauuauagauuauagaggaauuggaguuaauacuauauugaaaucugacuuguuauuugucuggaguuuguaugcauugaugaaacauuuuaaaugaugaaaaauauaucuaagucaaugaaugcaaacaaucaauugaaaguggaaaacuucaguuaaguuggcaaauauagucuauacaaacaauuacacauuuaacuuuagucucuuuucuggccuccuuuuuucauacaaaucgagugguaaagucauucauucauuuagcuaacaagcaaccugacagaggaaagggcacucaacucagaguaggaacaucugcauuccagcugacauuaacucaauaucugauuuaaccaccugggucuccaauuucucagcuguggcaugaugggaacuggucuuuagaugccuuccgucuuuuagauucuaauuuucuaguuccagguauugaguuagcugcucucagcaagaugugaaaugcauugccuuaggugcuggaggggauauagcaacaaacacagcacucuucuugcuuucagucuaugucggugguuuaaaauccuggugauggcaaacccuuuacagguguguucccaauuuugagcacugcguaaaauuaaguaacauuaaguucugacugaacugaggauacuuauagcaaaauacuguccaucagagggaacauggaacaaaggcagacacacuucauaguguggaguggggcaggguaugguaaacuggaaaaagcccuaccaugccuguagucccagcuacucaggaggcugaggcaggagaaucacuugagccugggaggcggagguuccagugagcagagaucgcaccacugcacuccagccugggagauagaacgagacuccaucucaaaaaaaaaaaaaggaaaaagccauaccagaagaucaaggcggcaucaaagaaagucccuguguuaacagaaauauguaaacauuuugccucuuggguaaauaaacaaagucagggcaguaagcagcucuucucaaacuauaagacggugaagaauggccaggggaagugauuguuaauggugaagcucgcauagacacugugaggcccuauuaggcuauagcuacacuguacuugggauugugcuguacugacaaccaacugguuuacaguugaccucaguuuuucguguucaaacccuuucuuucuuucuuucuuuuuuuuuuuuuuuuuugagacuguuucacccugccauccaggagggaagagugcagucaguggugugaucauggucucgaacuccugggcucaagcgauccucccaccucagccuccugaguagcugaacuauaggcacacaccaccaugcccagcuaauuuuuaauuuuuuuuguagagacagggccucacucuguuucucaagcuggccuugaacucuugggcucaagcaauccuccuggcuuggccucccaaaguauugggauuacagguaugagcgcccaguuguguucaaccgugagugacccuucugaggcugucaaauuacucagggccugguaggaacuaggaggaucuggggguugcuguaguccuggugcaugguuguuggugauguucagcagcgcagguguagauuaugaaagccacaacgcuuauguaauuuuucauauccuucggguacaccagguuccaugagccagauccgaauugaggcuggagugagugccugugagccagggguggccauucugcccuaaguuccaugcggacagccaggcugugaagcugaaucuagcugagauuagacuacacagaccucugagaccaauuucaacucugagacuugaugauucuuccaaacaguccuccaaacagaacagguuguuaaaaaacuuuuuaauuuuaaauaauauaauauuuuuaauuucuaaaauuaaaaaugcauguagacauaagauaaacaacccagaagggauuaugcaacuaaaaagugaaaauucuccccacaccucuucuauucuuucucucucccacuguuaguccuucagggucaccacucugaacaauuugauuugaauccuucuugaucuuuugcucuagacauauaaguugucccaacuacugccuguuagcaacaguacugcagugggugucccuguggugcgugucuuugugaauaugcauauuucauuuuuauuuauuuauuuauuuuuuagauggagucucgcucugucacccaggcuggagugcaaugguaugaucucggcucacugcaaccuccaccuccuggguucaagcgauucuccugccucagccuccuaaguagcugggauuacaggcgcccgccaucacgcccggcuaauuuuuguauuuuuaguagagacaggguuucaccauguuggucaggcuggucuugaacuccuggccucaugauccgccugccuuggccucccaaagugcugggauuacaggcgugagccacugcgcccggccaugaauaugcacauuucaaaagcacagcuucuaucuuuguguguguuuguguguguuuuucuuuuuucuuuuuuuacacagaguuucgcucuuguugcccaggcuggagugcaguggcauaaucucgguucacugcaacuuccaccucccggguuuaagugauucuccugccucagucucccgaguagcugggauuacaggcaugcgccaccacacccggcuaauuuuguguuuuuuaguagagacgggguuucaccauguuggccaggcuggucuugaacuccugaccucaggugauccacccgccucggccucccaaagugcugagauuacaggcaugagccacugcaucuggccuuuucuuuucuuuuaaaggugcuuuugcuggaucuugccuuaggcuuccauuuucccuuugaccuaucccuugcuucuguguccaaucucuugaaaaggugauugagcggagguuuucuugcauacuuuuauauuauugugccuuuacaauguggcaacauuacauucacauaaaacauccaucuccuuggguacguaguuguugcuacuauagcauuuuucucauucucuccuuacaauaucccccauuccaucagccagaauuuucucucccuucuggucuuguguaaaucuuuuccuuguggaauggcuacugcuacuguccagauggccaccagauaauugucauguuauuacuuauuuuuuccagauuccugucauuuuacuuggaccuguuuuuggaaugugagccuagauauuucuagaauauccccccucuaauuagcauaucaaacuuuguagucuugagcaaaccaguuaaccucucagagaguccuuuuuucuuuugaaaaauggggcuguaauggcuuaucugaaagggaguuaaucucuagacaucccaaaggcugugauguauccaauagacacauguguauuuuuaguaaaaaccugcuuugcuauuugaaauuauaaaguugauuuuuuuuuucagugggggacauuaacaccaagaauauaucuuuuaaagcauuuuuaaaauaagcuccaaagcuaugcgauuccacuuaagaauggggaaguaacuuccuggccaacauggugaaaccccaucucuacuaaaaauagaaauauuagcugggcgugguggugggccccuguaaucccagcuacuugggaggcugaggcaggagaaucgcuuggaccugggaggcggagguugcagugagcugagaucgcgccacugcacuccagccuggcaacaaagccagacuccaucuaaaaaaaaaaaaaaaaaaaaaaaaaagaauggggaagugaugugagaaagagcucauggauaguauucacugugguuuguccaggcacuuggugcguuccccacagagagccuugguucacccagugagcaccauaggacucaucaagaagaucccuaucagcucaaacugauaaucacacuacucggguauucccauaaaaccacuguauuguauugacaaaacaaucaggaaggcaaaaguguuuaaucuccugagucauucccaucccuuucuggagaacaaggcuuagagacucacugccuaaggaaaguggccccacccuauggaagcaugggaauucucaaagguacacuccccaaaggcacauucugcagggucucagucaucuauaaagcuacaauggcccuuaaaaaauuaauuaacgugccuuguuuuucuuuccuccuucacaacacaucucaccugcgugcccucagcuuaggggugcugguauuugucugguauggguuuuccuuucuaaucacggguguguuucuccuuuacuguaggauuuggcccugccaagaaggugugggauuguuauauccucugcaacacccagcacaucacugauguugaauauacauuuuaaauauugagcauguagcaaagaacuggcaggaaauuucagacaccuuaaugugacaaaguccuugaugcuuaguccugaaagagacccugggaagucauccaauugcccuuuacguuuaauauccucucagguguuugugaaugaggcuuagcaaagaaccaugucaaguauucaugaacccugaguacaaccaguuccuagcaccuguucucugggggcaaauugguguauaagacauuuugcauucuuguuccuggcaaggaaaauaugaagcugccaguuuuauguugaaccuucauacaugaaacguaguauauagaaugccaugauauggcaguggucagcugacucacuguguaauuucuauugaacagcuguucuguugcacuggggugugcuuugagcaggucugagcacaguucucaaucagaaaaaguuaugggacauuugauaccuuaagccuuaucaauuaacuucuuacugggcaugaggguacaaaggcccugagcucuggggccagggaugccuaaaugagaauuccaguggccaucccuaguugcucaugagcaaauacaaucugcagcuucaagcccggucaugauggcucacgccuguaaucccaguacuuugggaggcugagguggacagaucaccugaggucaggaguucaagaccagccuggccagcauggugaaucccugucucuacuaaaaauacaaaaaacuuagccaggcaugguggugggcaccuguagucccagcuacucaggaggcugaggcaggagaauugcuugaacucgggaggugaagguugcagugagcugagauggcgccauuacacuccagccugggcaacaagagugaaacuucaucucaaaaaaaaaaaaaaaucagcuucaguguucuuaauaauaucuccugccuugcagggcuguuugaggauuaaauuaauguacaugugacauugcacauggcagucuauaaaucuccuuaccuauuugauaacaguuucauggagcacuacagugcaccagagaguauuucuggaacuaagucuagaaaaauaugcauaagauggcuuggauuuucaggccuaggugaccgacuaguuagcacacaagaaugagaugcaaaccagaauagacaugaaaaguuacaaucugaguagaugaaagagugaaaaagcuuguggagaaagugucauuuggcuugguuuuaaaggaugaguggaaauuugacagaaauaauggaaaaaagacauuccaggcuuuggaacaguacaggaggaccagagagccauggggaggaguaacgugguaugaauagggauugaacuuuacucaucaaccauuggggagccgcuaggccgcaaugugaacagcagauuaguacuagucagggagacuaguaagaaggcuuacuaguugagucaaaugcuucucagcacagauggagcucaucccaggacuggaaucagaaggaaggcacuaauaaggaaagacacugaggaaacaaccugauuaaauuaaagugauaagggagccacacuggacaggcaaauuuggccauccuuccucacacuguacugugaaauggaacaucagacugccuugcuuccagcuggagugugcacccugugggcgagugcagggcugguugggguagcucagcaagaggccagcacgagggcaguagccaccugaggcggcagggaggccaccaagagaucgaacaaaaacagaaauacaaagugaucuuugaagacaaauuuugcugucuucccaaagaucaaaugggggagcauuuccucaaccaagcugagccaugguucauuugcauaagguccuucucucccuagccuguuguacuaucugaaaggauagggagucaugguucagaauugcuucauuacaaggagcagauacccacuucagcgugcucaaggaaaccuugauuuuucuaaagcuagaaagaaaucuggaguccagaucacagaccucacaagagccagaaucaugucagcuccccucuccucauuucccagggacugugcagccuccugccucugcuucucccugcacauggcagccauuacuuuucugcauauugucuauaauuguuggcucucugcaaauuggcuguccuuagugaggccucuugcaugggcuuuggguugcugcaaggugacugggucuugacucuacauccaacugcaguggcagcgucucgugcaugagauagcucagagaaaaacaccaauugccuugguuuuggucagauguucagcccugcuccaauuaacuguggccaaggggcauggaaggccaagacaaaguggguagaccagaugugucuacucacagggcagccuucugggggccuagaguaugaacucugcagccugucuccuuccagggauuagaucuguucuuuuccaucuuuacucuguugguugacauaaccucucacuuaaaagaacccccuucuuucuguaaccaacacaauacuuggaaagggaugaccuuuggauucgaaaaauuaauuuucacuccugguuuuaucccuaggagcugggugucuuugggcaacuauauuuccgagccuucauuuccucaucuacagaguguggagaauaaucuauaccucacagggagguuguugggagcaauugugauaaaauauauagagaacuugucguagugcugacacagaauguugcaugacaggugcucaugucuucuggcuuuuaugccccacuucuucccccauugcugcagggacauacagaguccugggggacauuuccaagggguggcccaggcuuagcuguucagaauaaacaggaugcuggucagcuguggcugcacaaacagcuugaaggcauugccaaaguagguucuuuguuuuuaauugugguaaaacacauauaacguaagauuuaccaucuuaacuauuuuaaguguacaguuuuguuuuuguuuuuguuuuuguuuuuguuuugagauggaguguugcucugucacccaagcuggagugcaauggcgccaucuuggcucacugcaaccuccuccuccuggguucaagcgauucuccugccucagccucccaaguagcugggauuacaggcacaugccaccaugccuggcuaauuuuuguauuuuuaguagaggagggguuucacuauguuggccaggcugaucuugaacuccugaccucaagugaucugcccaccucggccucccaaagugcugggauuuuauuucuaauuuccugaggaaauggccuacuguucuccauagauccugcaccauuuugcauucccaccagcacugcacaaguguuccaauuucuccacagccuugacaacacuucuuuuuuucuucuuuauuucauaauagccaucuuaaugggugugggcauaguagguucuuagcaacucucugacuuggauuuucagcucacacuugcugcauuagcucagagugagaauugcugcagugcaggccucguccucagugaucagcaggaaggcagcucuccugugauggaaagcccaccucgcaggagcccagcagcagccugaaagagccugguggccucuuggccaguggagcccagcucugagguccauguggccagaguugugcugggaaccauaguagagccaaagacgugugggaaauagccuugguccucugcaauaccaggucuuccaguuggccaccgugccgagccuuuuuuuuuuuuuugagacaguguuucacucuugucacccaggcuggagugcaauggugcaaucuuggcucacugcaaccuccaccucccagguucaagcaauucuccugccucagccuccugaguagcuaggauuacaggagcaugccacaaugcccggcuaauuuuuguauuuuuaguagagaagggguuuugccauguuagccaggcuggucucgaucuccugaccucaggugauccgcccaccuuggccucccaaagugcugggauuacaggcgugaggcaccacgccccgccuucauuucguuuuuaggaaguagguauuauugacaucuucauuuucccuaugagggagcugaggcagagacaggucaggauuuaacuggauuccagaugguccaugcgucuucacugagcucagcauggaugaagaaacaacucacaaccucugacuacacaaccaacucacauaaacaguuccucucucucugaacagauugaguuguuuagugguuggagucauuaggauccagucugaaaaaggaagaaaguguaccaagaacaaaagaacuuaaaaaaaaagaaaaagaaaaaaaaacccauccccccuggggugaguuugcaacagagcaaugaaagccuuuaugacaugcugugacucagaagcucagaggugacauagcuuagcagugaaucaguuccacugauagucaaguuugagccauuuuauuaguggagacuagaaccauaacuucuuguaauguaaaguauuaaaaaucuaauauuugacuggcagggcgagguccacuucauuucaccuccguuuguuaguuuaugaccuucaucaucuuuuucaucucaauagugcagcuuauaaauugaaaaaaaaaauuccuugcccuucucucucuuucuuucaauaaauaaaauguuauguuuuugcuuaccccuccuaacagacugaauucauugcuaggacacucccugucucugucccuccuauguuuagcagcuccuuccucauuccaagcaugaauccauucaacaagcauugauccaagcauugauugagaggguacucugccaggcagugugcuuagcucuguguauaggguggggaacaaagcaaguuuggcccugcccacaugcagcuuauagucuaggcuguaaauggggccagcguucagugaauuaagaguguaggcugggugugguggcucacaccuguaaucccagcacuuugggaggccgaggugagcagaucauuugaggucaggaguucgagaccagccuggccaacaugaugaaacccugucucugcuaaaaauacaaaaauuagccaggcaugguguugggcaccuguagucccaagcuacuugggaggcugaggcaggagaauggcucgaaccugggagacagagguugcagugagccgagaucgugccacugcacuccagccugggugacagagcgacucugucucaaaaaacaaaaaacaaaaaaacaaaaacuucuggaaaggagacauuaucauuauuggcaauuauauugauggugaugguuuacuggcuguuaagcacugugcuacaugcuucacauguacuuaguuauuuaauuuuaacauauuccuuuauuuucuuucuuucuuucuuuguuucuuucuuuuuuuuuuuuugagauggagucucgcucuguugcccaggcuggaguauagucacgugaucucagcucacugcaaccuccaccuccuggggucaagcgauucuccuaccucagccucccaaguagcugggauuucaggugcgcaccaucaugcuuggcuaauuuuuguuuuuuuagcagagacuggguuucaccauguuggccaggcuggucucgaacuccugaccucaggcgaucugcccgccuuggccucccaaagugcugggauuacaagcgugagccacugcgcccggccuacuccuuuauuuucucaccaaaaaaguaaaaauaaaaauaagaaagaaguccucacuugagagcugaacaaacugagucucggguagagugggugaaaugccucacucaaggucuuacagcagggucuagguggagcuggaacacuaaugcuuaccgccaaggcuguaccaccugugcugucccuuaugcagcccugagugcuuggucuuggucgcauccaaaucuggcccauccuguggucaggcacgugaacucagcccacauugcuggcaaucugggcucugcugcuuacucuuggcaguaacuucccuggacaaagccagcccugagggcaucuggucacaccaugcuggggccuggggcauuggugccuuugagcuggacaucucuggucucagaggccuugucuggggccccaaauucccucuuguuugcccuaggguguuggacacauuaugauggcuuccaugugugaaauugccuugcaggguacugacaguguagaaagcuuuuucauggguguaaucuuuuuuuuuuuucuucagagaugcagucuagcucugucgcccaggcuggaguucaguggcaugaucuuggcucacugcaaccucugccucccaggcucaaguaauucuccugccucagccucccaaguagcugggacuacaggagugcaccaccaugcccggcuaauuuuuuguguuguuaauagagacaggguuucaccaaguuggccaggcuggccucgaacuccugaccucaagcgauccacccaccucggccucccaaaaugcugggauuaugggcgugagccaccauaccuggcucauggguauaaucuuaucuguucuccacaacaacacaagcaggugcugaaggcagauauucauaccgauugugcagaugaagauauuuagacucagauaucaagggaggccaaagcuguguagccagaaagaggcagggaaggacuagaagcugggucuugggaugcuugguccuuugcuuuuucccacugcuucauauaugguugguuuucuuugugcuuggcgucuucucauuuuaauuccacccucuguccuugucccaggccccacugacaaacaacagcucacaaacacuccugacucccagcucucccucugaucugcagcaaacaaccagcccagcuugcuaaagcgcccagaggugaaagccaugcacagcauaggaaggaggguugaggaaaguagauuaaacugcuggcagggcccaaaauuccagugaaagagaugacuaaugaugagacaccagggucugaagcugagguuaaauucaacuggaaauucuuggccugggagggauaggaucuaauuaucaagauuuuucacuccgcgcuuugcauuuguuuucaagguuguuuuaagugacuauuuuauuuucucuugauaccaucucuuggagcgaggaaggacagaggacuggauccucccaaagcuugccugaaggaagcaguugauaguucugauuccaacaccugguaauguccccugugucuugggcauggguaugcuuucucauuugauccuugcugcaauucuaccaggugggcuuuuguauccccuuuuuagaggacacucgggacuuaagaggcacuguaggcccuaccuccucagcuggguuugaaauguauuugcugaguacuugagacuuaauucauucucuagcaaauuaugugaaauauacuagucagaagccagagagguugaguggcuccagagccagaagaccuauauucaaauucuggcuuuguuucuuacuagcagguaauccuggacaagcuacuuaacuuucuugugccuugaauaaggaucauaauaauaauagguaacauuuacaaagcccuuagaagagugccuggcagaugguaaacccuauaguugguaggaauuauuccugggcauuagauaccaaucuuuauuaaugaagaagucuagauaugaagagcuggaguaaguagaccaaguucacaccacuggaaggucugaaaaagugacaggucgccuggcacccucugccugcaguggcaguuaagagcacagguuugcugagaaugaugguuuccaguuucauccaugucccuacaaaggacaugaacucaucauuuuuuauggcugcauaguauuccauggcauauaugugccacauuuucuuaauccagucuaucguuguuggacauuuggguugguuccaagucuuugccauugugaauagugccgcaauaaacauacgugugcaugugucuuuauagcagcaugauuuauaauccuuuggguauauacccaguaaugggauggcugggucaaaugguauuucuaguucuagaucccugaggaauugccauacugacuuccacaaugguugaacuaguuuacagucccaccaacaguguaaaaguguuccuauuucuccacauccucuccagcaccuguuguuuccugacuuuuuaaucauucucagcaaacuaucgcaaggacaaaaaaaccaaacacugcauguucucacucauaggugggaacugaacaaugagaacacauggacacaggaaggggaacaucacacucuggcgacuguuguggggucgggggaggggggagggauagcauuaggagauauaccuaauguuaaaugacgaguuaaugggugcagcacaccaacauggcacuuguauacauauguaacaaaccugcauauugugcacauguacccuaaaacuuaaaguauaauaauaauaaaauuuaaaaaaaaagagcacagguuuggaaacaaggcugacuugggucugaagcucagcucugccacuuacuggcucuaugaucucgggcaagucaguuaacaacccugauccucaguuuccuuaucuguaaaaugagcauacucauaucuccuauuuuuguuguuguuguuuguuuguuugcuuguuuguuugagauagggucuugcucugucacccaggcuggagugcaguggccugaucacggcccacugcagccuugaucucuagggcucaagugauccucccaccucagccuccuaagugaguaauugggaccacaggugcaagccaccaugccaggcuaauuuuuaaauuuuuuguagagauggagucucauuauguuucccaggcaggucucaaacuccuggacucaagccaucucccaccucuggccucccaaagugcugggauuacaggugugagcacugcgcccagccucccuuguagggaacagacgugaauguguuuaauaugcccagcacacaacacaaacaccaaggcagucaagccaggugccuggcccuccugggagcccuucccagcagcccuggcagugagcagagcugggacaugaccacgccccagcaucagcuuuuaggaagcagauucuggcugagucauucaaauggacuggacuucacugcagcucccuuggaaaauguggguuugauucaagagccuguacaucugaaaggucauucccagaggccaguggggcacuggguguggagaggggagcagucaccccuccugccuuuuugcuggggcauuucuguuuaucagugauaucagugacuguuucagaaaugucccaaacagccucgcuuuguauccuguugccacuugcccaaaaugccuuucuccuagaaccuguuuggcagcaucuuccuggaacgauagggcagccaagguuggaaagccaaagucagagacacuccuggagagggguccaccugaugggcccugugucccugugcucccccaggugucucucaaguccccaggguggaggcguuucugccagcccuucucagaaacuucucugccccuuguugauaguagaaauuagccagcuccuggaggcugccaggcugccugccagagaggagcagucacugcucacaugccagcugccccagggaaacucagaagccuggaauggagccacguggaagaaauauuccaccagggcggucccagccucacagggcacuuccuccagucacaggggcccugcccuccggagcuccacagccugggaacucccuggggggaugcaaggaggcugcccuggugcuguaauaagaaaucaucuagcugugugcgguggcucacgccuguaaucccagcacuuugggaggcggaggugggcggaucaccugacgucaggaguucgagaccagccuggccaacaugguaaaaccccaucucuacucaacauacaaaaaguagaugggcaugguggcacaugccuacagucccaacuacuugggaggcugaggcaggugaauggcuugaauccaggagguggagguugcagugagccgagauugugccacugcacuccagucaucucaaaaaaaaaaaaaaagaaaagaaaaaaaagaaagaaaaaagaaaagaaaaagaaagaaaucaucugauagcucucauuuguuuagugcuuacugugugccaggcccugggcugggcacuuuguauucauucuuucauuuaaucauuaaagccgccuaguaaucacacuuauaugaacuuaugaaguccaauuuacuccgucauggagaaauuacuauguaguaagcguuguggggggaauaacaauauuaauaauacauagucucagccuucaaggcaucacccucuugucuuaauccuccaacuuuggaaacuaauugcuuuuugucucuuucgaccgggguuugaaucccagcuccaucacuuacuagcuguaugaccucuaauaaguugcuuaaccucucugugucuugguuucuuccucuguaacugggaaugaucauaauagaauuuaucuguuagaguugugaagauuaagugagagaauccaugggaaguacugggaacagugacucaguucagagcacuuaauaauaagugcuagccauguaugggugugguucaggggugugugaaauguuaggcaaaauggcagaugaauucauauggggcuuuauauaucucaaaagaaaggaggcaugacccagagaccuagaaaaggggaagaaguacuucugaaugggagaucaaauguagacucuuggcugaaccuagagaucuuguuguucuauuuugucuaccgaagagcugaguuacuuagggagcuuuuguagacagcacccuaacuuuuccugaggccauuucagaaagacacagcaaucuaaccguucaggacuuggggggcacaucauaaagguuauguaccauaagucugggggaaaacuuagagauuauauaucucgucugaaugcaucaguuuauauaugagggacucugagcuuggggguucagccuuauauuuuccuaagauaacagcucaaaggaagagaagucacagauaugaaaguucagucagaggggcugggccgacaucugugcuuuucccugcaggauuuuuaggaucagugagacgguguguauuuggaagcauuucaaauguguuaccaucguguuacuuccgugggcaccugguguuauugguuggacuagucaggauucuccagagcagcagaagcaaugggaugugugugcauguguuugugcagagacagaaagagagauuuuaaggaacuggcuuaugcaguugugggggcuagcaagucugaaauuugcagggcgggccagcaagcuggaaauucauguaagaguugauguugcaaucucuagucugaauuccacagcuuagaaaacucaggcaggguuucuauguuagagucuagaggcagaauuucuucuccaggaaaccaguuuuugcuuuuaagaccuucaacuguuuggaugaggcccaucuaaauuauagaggguaauuuugcuuuacuuaaagucaacugaguguaaauguuuaucacaucuacaaaauaccucgacagcaacaucuggacuuauguuugaccaaacaauuagacaccaccauagccuagccaacuugacauuaaaaugaaccagcgcagcugaccaccggcacagauguagcaagccagucucaggaguccugaugucuuucaggccuuuuuuuuuuuuuuuuuuuuuugagacagggucuugcucuaacacccaggaugaagugcagggguguggccacugcagccuugaccucccaagcucaagcaauccucccaccucagccuccugaguagcugggacuauuggugcaugccaguaugccugguuaauuuuuaaauauuuuguagagaugggccggguguggugccucacgccuguaauugcagcacuuugggaggccgagacggguggaucauuugaggucaggaguuugagaccagccugaccaaaauggugaaacccccaucucuacuaaaauacaaaaauuagccgggcaugguggugggcaccuguaaucucagcuacucggcaggcugaggcaggagaaucacuugaacacaggaggcggauguugcaaugagccaagauugcaccacugcacuagauccugggcgacagagugagacucccucucaaaaaaaaaaaaaaaaaaaaaaauuuguagagacgaagucucacuauguugcccaggcuggucuugaacuccuggacucaagcgauccucuggccuuggccuuccaaaauguugggauuacagguauaagcaccgcacugggccaggccuuuucaauaagguucugacacacuggcugguaggugaacagcaaaggaaaugguuccgcgcaagagggcgggugguuuggcuaagagagcuguucaguucucccggaaaccuuguuuggaggcuggcauugggguuaauuacugcaguggugaccuccgcagaacugagugagaggcaggcguagcuaaucggaaaacaggaaauguccugaagaacgacuugagcccuugagcacacucagagugugcucugcauuugagucaguuguuauguucugagcugaaaauauuuuauugcuuuccauaggaagaaacagucaucuuaauaaaauuagacgcaggagccagguugggggguagguaauguggagaaaggggagggaguuuccuguaauucaauuugauguucagugccugcagguuuaaccuuuuuuuuuuauuuuuacagagguagaauaaaauaauugacuaauauaaauaugugacuggcugcugauaagaaaaauaauuuaucuacuuuuuuuuuuuuugccugauguguuuaugugugagaauagguuuucaauaaaauguaacauauacacauuuugauaaacaucagagccuccuucuugaaagagauugagcuggguuucuccagaaggguaggagccaaugccagccacuuaguuuuuccuuauuagcuagggaaaugggaggugcagugguuaaaugcaugggcucaggagucauacuagaccugguuagagggcuucguccuagcccugugaucuugagcaaguuaccuaaccauucugggcucucuuugcuucucugcaaacugaggauaauaaaacagugccuacgucauaggcuugccaggaggauucaaugaaaugaugcauguaaagggcuuagcaggccgggcacggugucucacgccuguaaucccagcacuuugggaggccgaggugagcggaucacuugaggucaggaguucgagacuagccuggccaacauggggaaacccugucuuuacuaaaaauauaaaaauuagcugggugugguggcacacaccuguaauccuagcuacucaggaggcugaggcaggagagagauuguagugagcaaagagcgugccauugcacuccagccugggcaacacagugagacucuaacucaaaaaaaaaaaaagguggggggcuuagcaaugcccagccugcagugagcauccccuagagguaaugccauuagcaucaaccucacacaaugagugccaggagcugcaggaaguucugguugaauagcuccaccuggucuguggucaacuggcaucugccuggacucagccacuccccuuuguuuucaacacacaauugaaucauguguucaggaacaugcauugggagaauuguugggccacuugguuuuucucaugaguuauaaaauuuugaaguuauaaaauccaguuucuaauacccuccuccuuuaaguacuuauaucagccaaaugaagcuuagccugguacuugaggcuucacagugagaccauaaccuucccacaaagcccguuugcccccuacccaguucuaugcucuuugguuccagcugguuggguccuggaguguccccagaugugacauaacugguucucccuccuccaugccugauccacccacccuauugugucuacuggagugagcucgucuucuggcuccacauuuucaaccccuccuugcccuugaauucucaucuagcucagccucugcaucuucugugcacacagccugaagucaccuuucuuuccucugaauuuuucugugcauugauaccccucugauagcaacugaaguccuuucucuaucagucccguauagccacauuuccucuccccacuagacccccugagggcaggaaccaugucuuggguauuuuugugucuccuacagugcucaaugccuggcaauuucacaaacauuuguuggguggaagaaugaaggagcugauuaauguuugcggaagaacucacucagugaaccauuucugugggcugagcugugaggucucuuggccugagcugaccagucauuauuucuguuuauucccccucugacaggcaggaagaaacuucaggaugagaaugagacaggcaaaagccugguggagcuuugugcuauuucuuuucuuuucuuuucuuagauggaguuuugcucuuguugccaggcuggagugcaauggcgcgaucuaggcucacugcaacuuccgccucccagguucaagcgauucuccugccucagccacccgaguaucggggauuacaggugcccaccaccaugcauggcuaaauuuuguauuuuuaguagagauggguuucaccaaguuggccaggcuggucucaaacuucugaccucaggugauccgccugccucagccucccacagugcugggauuacaggugucagccaccgcaccuggccuguggcacuuuuuuuuucuuuuucuuucuuuuuuuuuuuuuuuuuuggagauggggucuugcucuguugcccaggcuggagugcaguggcuugaucucggcucacugcaacuuccgccuccuggguucaagcaauucuccugccucagccucucgaguggcugggacugcaggcguccaccaccaugcccggcuaauauuuuuuguauuuuaguagagacgggguuucacccauguuguccaggcuggucucgaacuccugagcucaggcaguccacccgccuuggccucccaaagugcuaggauuacaggcgugagccgccauguccagccagccuguggaacuuuuuaagacuaagaauuaucuuacacucuucuguuuccuguuacuggcacacaguggaugcuuaauaaauguuugugaaugaaugaaugaacaaaugaaucuuuucacacuccccagcugcugacucuggaacaauccugugccuccugagggcagagaggauccauggucccaggcuuggccucaagguagcuugcagcgugucuuccguguucucuguuuccugggucaggaaccaggcuugggacuuguuucauguugacaagcgcugguuuuuucugugaccucccuggagcccuugucccugccuuggcucccugguuggagucuuggggacuuggagacuggaauuuugcuucagugccaucuuucagugaugcaaauccuaccccaagccugggugcucaguuucuauugcauuauuuucugccuucuccuugcuuucccuucuugcugggacuucuuggaaucuccuaucuucucucuugaaggaccgccauggucucaggguccagauccacuccuuugagacucaguucuccacccccccaagccccgguuaugggagcaggguagugguaagguagagggagauuggugguacuauuucaugcuuguugaaugcugggauuccuaaccuuuuucaagcacauuugagaaucugaugagaacaaugagcucuuuccuccaagaaaacucacagaugcaauauuuuguguauuagagcaaauaaucuuggagaguuucaggauacccuggaacgcaaccauaaacuuccuuauggacauuuuccaagacgccaagcccaucacauguguuacauuuacgaaucuucauuauccagcauuucugacagcuuccaauaaggcacuguggcaugguggcaaacacacacaaacacagauuuuggagccagagggauguaguucaaaaucuggcuguuuccuuauuagcugugugauugaaggcagguuaacuacucuccauuuucuuggcuuagaaaugggaaugaccauguuuaccuggaagaauugucucaaugguuagagacacugugguagaaugcacagccuggcaccuagagaugauucuguagagggagcagcuacaauuacacauagaaaccauuuuguccaguucuauuuaaguuaaaaauucuuugcaugucuccuguuucucucaagagcacuuucuuauacuguaaccagagaggaggauugggaguuucuguuagaugaggagagggaaggguggggucaaaauggaagugugggaggggaaguuucuggacagcgucuaggggaccucagagucagaugcagugaggggcucuguaggccacauagagagagcacaggcagaaccagccaggauaggucugggcacaagccgacgaggagcgucacgcugaagcuuaggaagggaagccauugggcuguguguugcccucucaaguggaaaaguuaaugcuuagcagagugagguccaugacucacggccuugcuaugcugaggucuuggaagaaugaggugguuagucccacaggcagcugugugcugggagccaaagcaaugugacauuagcuaaacaaaacccacuaccuccuacauuccacagcagcagaggagaagcaaaggcugaggagugauucaaaguguggccacuaaugugagacugccugggucucaaauccuagcaagaccauuuauuaacugggugacuuauuuguuuuuuguuuugagacugagucucgcucuauccuuuaggcuggagugcagugacacgaucucggcuuacugcaaccucugccuccuggguucaagugauucuccugccucagccucccgaguagcugggauaauaggcacccaucaccaugccuggcuaauuuuuguauuuuuaguagaagugggguuucaccauguuggccaggcuggucuccugaccucaagugaucugcccgccuuggccucccaaagugcugggauuacaggugucagccaccgcacccagccaacugggugacuuugaauguuacucagcuucucaguuuccuuagcugugaaagggggaugaaaauaguaauauauaccuccuaggguuuguuuuuuguuuuuggacagggucuugcuuuguuucccaggcuggagugcaguggugugaucuuggcucacugcagccuugaccuccugggcucaagggauccucccaccucagccuccugaguagcuggaaccuauaggugugugccaccacacagagcuaauuguuguauuuuuguagagaugggguuucauuauguugccuacgcuggucuugaacuccuaggcucaaacaauccucccaccuuggccuccauaagugcugggauuacaggcgugcaccaccucaccuggcuucuccuagguuuuuaagauuagaugaaugccgggcgcaguggcucauaccuguaaucccagcacuuugggaggcugaggcagguggaucacuugagcucagggguuugagaccagccugggcaacauggcaaaaccccaucucuagugaaaaaaaaaaaaacauagaaaaauuagcugggugugguggugugcaccuguggucccaacuacauggggcgccgaggugggaggaucucuugagcugggaggcagagguugcagugagccgaaauagugccacuauacuccagccugggcgaccucgcgagacccugucucaaaaaaaaaaaaaaauuagaugagauaaugcugacaaagcauuuuguacucgaagauuagcuuuuauuuggguagguauuuggggacuuggggacccaaaagaagccucugcucuuuggacuuugcuacaaggaaacuuuaagcacuugcuggauuugcucgugugcucauccagguagguguacuguccaggcucagacacagagaagaaagaucuugugucuucagaaaagguggccucggaguaaaggaagccccaaauuauccgcuggucuuagaaaguuuucaucuacuaaugaccuuguaccgaagccuaugggagggaguccagcuuaauauugaagcuguguuggcaucuuagcacacucagaugcagcaugagcuucagagcugaaauuccagguuuaaaucagggcaucacugccaggugugagcucagauaaacgucuuaacucuuugagccucaauauccucaucuauaaaauagcaauaucagcaucucagagguuagcuuuguuggcuucuuucugcagcaagccagagaugcagaggcucuggguagccuuggugagagaagggcagaacaucacaucccuuaacuccauguagaccuggagaugggaaaaccuuguagaccaaaaaaugccauuucauuuggaaaacugugauucagguaaacacccauccuaagcgaugaauggggagaugugggugcaaguagacccuuggguaauguucuuagaauaaaugaauggcccacgcucuuuaauuuuuuuauaaaugauugcugucucuuccuuuaucucuuuugcagaugagaaaaagaaaacaaagaaaguugauaaugaauugaacccugucuggaaugaggugacuucauuguuuuuucaacuuuguuuuaauagauaagcuauuucugauuguccuaucuuugggugagagguuaccucuucccuucggaaggagaaucucuacauuucacccccacccacuccguuucccuuuguguucaccaagagagcagagcaguucaaggagaguagcucaccagcgaccaucuucuguacagcaguggcgcggcaagggaagccuggacuggcaggagaguugaguucuuaccaggcaccgccacgagcuugcugugugagcuugguccacuuauguugcauaucuggggcacaugugcagagcaagggugggauuagaucaucuccagagucucagaaggaaggccucauaauuaaaaacaugucugcaugugacaaaucaagaguguaucacaugauucucugugugucuagcuggguaaugacauguauugguuuuauguugauaaaagugauguccaguaugcuucauguggaaacuuuugaaaacuucaauuaaucuuuaaaaaauuaacuugggucccacucucuagaggcaacuacuauuaacaucugugauguaucacuaaguguuuauuggaggaauauauuuaaugaaauacgacaucugauaacacaaacuagcagcauauagcaaaugauuuccucuccuacacuuucuugcuauuauauccuaagcauaugcccauauuaauucaaaauuauuuuaauaauucaaaaguauuuuaauucaaaagcauaaaauuauuuuaauaauucaaaagcauaaaauucaaaaguauuuuaaugacugugcaauauucuacugaagacauauaacuuauuuaccuccccccacugucgaccuuauaucuauuuuagaagugguucaguguuuaauauuuucacaaauaagugaaaaaauuuaauucuucccacugaauaggauuuuccuacucucucucugucucucucuuuuaaaccacccaauuauucaugaaacuuuaacuuuuuaacaguugauggccagcuccauuguguuuuucaaaagcugggucaaaccucccuggacaagagcaauaaugaaugucuuuguuauuuucaccaagucacuaggccaugaaggcuccccuccacccacccaccuuucucucccaacuaguuucaauaucucuauaagauaaagacuagaaccuucuggguuuuuuuuuauuuguuuguuuguuuuugagauagggucucccucagguuggagugcgguggcgugauuaagauucaauacugccuugaauuccugggcucaggugguccucccaccucagccuccugaguagcugggaccacaagcgugcaccacacccaacuaauuguuuuauuuuuuguagagaugggcuuuugccguguugcccaggcuggucuucaacuccugagcucaagugauccaccugcuucagacucccaaagugcugggauuacaggugugagccauugcgccucgcuagaccuuauucuugaaugaagugaaacaaaaaacuuuuuaaugccuuggggguuuuuuuuguucuuuuuuuguuuuuuuguuuuuuguuuuuguuuuuguuuuuuugagauggaguuucgcucuucuugcccaggcuggagugcagguugcucaccguaaccuccgccuccuggguucaagcaauucuccugccucagccuccugaguagcugggauuacaggcaugugccaccacacccagcuaauuuuguauuuuuaguagagaugggguuucuccauguugaucaggcuggucucgaacugucgaccucaggugauccacccagcacccaaaguccugggauuacacgcauaagucaccacggcuggccuuuuuuuuuuuuuuuuuuuuuuuuuuaauuaaaaaaagacagggucucgcucugucacccaggcuggaaugcagugguguaaucauaucuuacuacagccucgaucucccagggccaagcgauagcccugcuuuagccuccugaauagcugggacuacagguauaagccaccaugcccagcuaauuuuaaaaaacauuuguagagauuacauccugcuauguugcccaggcuggucuugaguuccuggucucaagccauuuucccaucuuggccucccaaagugcugaguuuacaggcgucagccacucugcccagccuuuuuaaugccuuucugaaacgcccagcaggucucaggcagguugagagggaauuccacuuaucuguaauuuccccagaauccagaacacagccagcuggacuacaagcuccaugagagcaagaggccccuuggguuggucauuguggauuccuagcaccugacagaacuccaagaauaaagcaaauaaaaaaugcauuuaugugagagugcuuccuacuucagauuuugaaucaucccaacucaucucuucaaauuugagauugagaucaagccacgugaccaauggcagagagagaugugcugucaugcgagcuggcauguccucugcagggaaucagccaucuuauuccauuuuguuuccaacauguuuuuuuuuucuuuccuuucauauugcagauguacuuaucaaguaaacuguuuuauaauugaaaccaaacacaaaugaaaugucaaccccaaacccacugggauugcuggugcuggguguguucuuuuuuuucuuuuuucuuuuaagauggaguuuugcucuuguugcccaggcuagagugcaauggugcgaucucggcucacugcaacuuccgccuccuggguucaagugauucuccuuccucagccucccagguagcugggauuacaggcauaugccacuacgccuggcuaauuuuguauuuuuaguagagaugggauuucaccauguuggucaggcuggucucgaacuccugaccucaggugauccaucugccuuggccucccaaagugcugggauuacaggcaugagccacugcgcccggcucuuuuuuuucuuuuuugagacagggucuuccucugccacccaggccagaguguaauggcacagucauaacuaacugcagccauaacuaacugggcucaagcaauccuccccacucagccucccaagcagcugggacuacaggcacacaccacugcgcucugcugauuuuuaaauuuuucacagagacagaaucuaaguuguccaggcuggucuugaacuccuugccucagccucccaaagugcuggaguuacagguaugagccaccauucccaggcuggguguguucuaagagaagcucugaggccacgugugguggcacaugccuguaaucccagcacuuugggaggccaagacggguagaucacaugaggucaggaguuugagaccagccuggccaacauggugaaacccuguuucuauuaaaacuacaaaaauuguccaggugcgguggcucacgccuauaaucccagcacuuugggaggucaaggcggguggaucaugaggucaggaguucgagaccagccuggccaacauggugaaacccugucucuacuaaaaauacacaaauuagcagggcaugguggcaggcgccuguaaucccagcuauucgggaggcugagacaggagaauugcuugaacccgggaaguggagguugcugugagcugaaauugugccacugcacucuagccugggcaacagggcaagacucugucucaaaaaaaaaauuagcuggguauggugguacacaccuguaauccccagcuacugaggagacugagaacuuguuuuuuuuuagaagugcuaaaaauaauuuuuuaagaaguucugaaacaaguuuuccuuccauuccaagcccacuacaaggaggaucaagucaucauuuaauuauuaccuaaucagucaaaggcaucagugacgcuuuaucaaucuuuuuuuuuuacuuuugucauuaggaagcaacuuacugcauuaaaaugagagucucagaaaggucgguauauuauagcauugaccgaccaugguggaacuuaaaaugagaggcauuuuagaaaauguuuucuuagauuauucaucuucuuuguuugauaguaguaugauuaagaagagcagauaauuuaaaacuagccauugaagaaaauguuuucacauauacccugcauuuuauucuuuuuuaauuuuuuuauuuuuguuauuauuauacuuuaaguucuaggguacaugugcacaaagugcagguuuguuacauauguauacaugugccauguuggugugcugcacccauuaacucaucauuuacauuagguguaucuccuaaugcuaucccuccccccuccccccaccccacaacgggccccagugugugauguuccccauccuguguccaaguguucucauuguucaauucccacuuaugagugagaacaacacccugcauuuuauucuugcagcaguugugguagucguugaguccagcucuugaguaugaagcagggguguggucaccugguugaagccacagaaccuagaaagcaggaagccaggaguugucuacagguccucuaagucgacaucugguuugcuuuccugcccccucagcugccuucagguuuagaauuuaaucauuucugcauaacuucaaaagauugucauuggugaaaauaaugacccaacauguaguacuggugcaucuuaguguaaucucugcuccuucuaacagccuuuuuuuuucucuuuuuucaaaaccuuucugugaacagauuuuggaguuugacuugagggguauaccacuggacuuuucaucuucccuugggauuauugugaaagauuuugagacaauuggacaaaauaaguaaguuguuuucaccuguuuuucucauuuuagguauuacuaucucacuguuguuuauuuuguugaagagacacaucuuuaauaacguauuauaauacuuccaauauaaaugugcuuuaauuccaugccccgcucccuucuaagccaauagcagauguggcuaauccaucacagcacuuuuucccaaugacugcuuuuauuccaaaaaagcugcaaacaccgagccaccuagacuaguuuaucaaacuuggcacuuagagugaagccuguucacaugccuacaacuucuuggucaacugcacuuccuaccucuggcaguuuaucugaacuguagugauauuggauacaacccaaaucacuucuucugauuauuuguggccuauacaugucucauucaaguuuuacuuucagccccauuuccauguuaaugucuccuucgccuuuuaaucccaacagaccuaaacagaccuuaauccuugccuuacugccucuuuccuuucacauggggaagggucacgguggugcccguggugacacugaggguuguccucugaguaaaauugggagacuucccaaacagguucccgugggacagaaugaucuuaguauuaauaaauucacccuaguccuggaucuggacuuuggccuuguagacccagucguauguuaccaauucaaacuaaccaaguucacaagagacuaaagguuuuuuucuuuuuuuugacucugucacccaggcuggagugcaguggcacaaucuuggcucacugcaaccuucaccucccagguucaagcaauucuccugccucagccucccaaguagcuggaauuacaggcgugcaccaccacgcccagcuaacuuuuauauuuuuaguaaagacaggguuucaccauguuggcuaggcuggucuugaacuccuuaccucaggugaucuacccgcuucagccucccaaagggcuggaacuacaggugugagcuaccgugcccagcugauacuaauacuuaaaaccagaauaccugcuuauuuuccuucugguggaagucaauugccuagugacagggcauuucuacccuccaacccaugaauuuuccuucaagucauaccacaugggaagccaaauuacuuuguauccucgauuucaagauguuauuguuuauaaaguauacuaucaaauuaauaaaugguuaggggccaaaaaaagcgugauauuuaaugcccccaucaauuguaagaagcauuucaguuuuuaguaauguuaguacauuuaaaaauguaugucuuaggcacaucugauauaaucugaaggcugcagugagagcaaaaauuuaggauaaauuaguugagguagguggucacaugcucugauugcuugagacaguccugguuugcuguccuagcacagugauuaauaaugccccuuuugcagucaacguggcuggguuuggacaguaaauuauuauuauuuuuuguuuuugagauggagucucacucugucacccaggcuggagugcaguggcgcaaucucagcuuaccgcaaccuccgccuccuuaguucaagugauucuugugccucagccuccugaacagcugggauugcaggcaugcaccucuccaccuggcuaauuuuugugguuuuuguuuguuuguuuguuuuuugagauggagucuugcucugucgcccaggcuggagugcaguggcacgaucucagcucacugcaaccucagacuccuagguucgagugauucuccugccucagccuccugaguagcugggacuacaggcgugugccaccaugccuggcuaauuuuuguacuuuuaguagagaugggguuuuaccauguuggucaggcuguucucgaacuccugaccucaugaucugccugccucggcuucccaaagugcugggauuacaggugugagcuacugcacccggccuauuuuuguguuuuuuaguagagaugagguuucaccauguuggccaggcuggucucgaacucuuggccucaacugaucuguccaccucagccucccaaagugcugggauuacagggguacaguaaauuagauggucacuccaguuauuggggucuucugcuuaccggcaucaaaauaagagagucugcacagacauggacucccuggacagugcuuugauaggcacucccaucuucgccuuugaugacauccuuuuuaccauucucuguugcugaccgaugcccccugcauauuuuucuguaacuauauaaauacauucugggccaggugugguggcucaugccuguaauccuagcacuuugggaggcugagguggaaggaucacuugagcccaggaguuagaaaccagccuggguaacauagugagaccccaucucuaaauaaaugaauacauaccugcauacauucuagcagguucuggucccacucucuugcacuggaaacuauucuagcuuuuuaaguuucugucgcauaucucagcugcgaacuauuauaugauuauuuauuccccaccccaacucccaaaagccaguuuuauuucccauauuucaaaguuuuggggaaggggaggagaggggagggccucacacuagccuccugcauguuacuaagacuaggcccuccucuucuuugcuuucuucuuucugcaaaugguaccacuguuuauauucuagaccaggccucuccaacagaaauacagugcagggugcacaugcaauuuaaaauuuucuaguugccagauuaacacaaauaugaagaaaugggugaaaucaauuuuaauaauauauuuaacucagcagauucaaaauguuauuucaacauguaaucaauguguuugaaucacugugauauucugcacacauucuuucucuuacucaggcuuuggaaucugguguuugcuucacacuuacagcaccucucaauucagagacuuaccacauuucaagugcucuguagccacguguagcuaguggccaccauauuggacaggaugguuucagauccugggcuuaaaacuucagaccucucugcacccuaucccucuugcuuuuuuuuugagacagagucucacucugucacccaggcuggagugcaguggcgugaucuuggcucacugcaaccucugccucccagguucaagugauucuccugccucagccuccugaguagcugggauuacaggugcacaccaccaugcccagcuaauuuuuguauuuuuagcagagacaggguuucacuauguuggccaggcuggucucaaacuccugaccucaagugaucugcccaccuuggucucccaaagugcugggauuacaggcgugagccacugcacccagcucccucuugccucuuauccagucuguccucagaucuuauguuuucuuccuuuccaaagucugugcuugugccuguguuucuuccccaagcccacagccaccagccugguugaggccuuccucauuuuaugccuuaucuauuuuagcauggcaaugggcuggccucaaaacucucaucuaugguuuaaaguccuugcuuuccugaagguuacgauacuuaaggaaaguuagaaaauaaacaaauacacuaaaaaauauauacauaauaugucggguaccaugaaugcugugagcuaaagaagaaacuguuauaucccaugaagaaaagcaaaucagaggaaaagggaaaguugucaaggguggggggaaaggagaucccauuuuaugugagguggugauaaggugacaauugagcagagaccuaaauauaaucacaaaaguaauugcaauuuugcaccaaccuaauauaaugaagaacugagccaugcaguucauugggggguuagggaguaggggggaagaauauucugggcagagaauagcaagugcaaaggcccugaggcaggagugcacuggggaugcuggagaaacgugagaaaggcagccaaccuggggcacagugaggguugaaagugcaggaaggaggugaggucagagaaaccacaauauauguggcuuugggggccaaggcacgggcuuuggauuucauccuaaguggaaugagaauccguuaaaagcuuuugcuuaugaucugacauauuuuaaaaggaucacucaggcuuucuguguagagacuggagguaggaaccaguuaggaggcaggaaaacaauacugggagaccauuauauauuuauuuuagacccauugaaaacacaguggggcccucagaugacagcagugauggggagaggucagccccccaccgucaggcucacccuggcacucauuucgggcauuuuugugcauuucuagagauagaguuuguuguaaccaagugaguuauagagaaacgucacacuuugagacuaauucaggaguccuuuauuagcuggcgaacgagagacagcuagcgcucaaaauucucucagccccgaggaaggggcuagauuuguuuuauaccguggucuaaauagggaaggggggaguuuagcugaagcaauuuuuacagaagcauaacuggcaaaaaguuaaaaaauuaauugguuacaaaagcaguuacaaaaaauaaccaguuccagguguaggggcuuaaacuaucacaaagagauaaaugcaggggcuuuaggugccauccaccgagcacguccccaggagcugcuggugcagcuugccucaaugucuuaucgguaagugcauuccuggacgugcuuugagucaguuuacacuagucaugcccuuaaggaagggagguaaaggggcuguaagugaaggaacuaaaauggagucugucuggcucuuucagcuaagagagacaaucagguuaaaacaagguagaguaucacaaguucacgugcagucuaucugaaccugcacauuuucauauuuuucugaaccuaugacaugcauaauucugaacaaagaaaauaugauagguccuguucuaagaggguccuucuaagguucaggggcaccaugcaucgugcugagcuauguugcacuugguguuaugaugccuauugaguauaaagaccaaacgaggcugggugugguggcucaugccugugaugucagcacuuugggaggccgaggcaggcagaucacuugaggccaggaguucgagaacagccuggucaucguggugaaacccugucucuacuaaaauacaaaaauuagcugggcgugguugugcacaccuguaaucccagcucaggaggccaaggcacaagaaucacucgaaccugggaggcagagguugcagugaacugagaucacaccacugcgcuccagcccuggugacggagugagaaaaaaaaaaaaagaccaaaugagcacgugguuacucugauauuaugaugacgggaauuguuaggcauaacagaaaaagguaaauucuaggccaauuaugaagcuggucuugguuacuuuuucaaucuuccccccucccaucuuccaucccccugacauuugcugggcacccagugucuuuaaguuuccuggcucccacugugguacccgcugaggccugcccucugagccacacccugcaucuucugccaauucuuuuccuguacaaaacuuaccuguccuguggcucaguccuucaagguccugcuucaaggcacuuucugagaaauuaaucgggugaugcuauaauagcugcuaauaguuaauuucccgguaacacugacuuuuggacugaaggccaucagugacuuacuugaaggagugaacaagaugagaacuucagacccuauggccaggucauuggaggagguguuuucacuaaaaauuagaacauuaucucucauccugcagauuccacugcauaguuuacugucuugcaguggaaggccgacccugcgucagcucuguaaugaacaaggcaugauuuccugccccuccaccgccucugcucuuuuguaagcagugugccuccccauccucagcugggaaucaugaucauuagcuuaguuuccaccaacuaaccaauacacacaccuuggucagauuaccuguacauuucagaaacaaacuuuuuuuuuuuaaccaucugggaauaaacuauauguguuuucaaaauauuuguguauuuugggcccagauuuucuuuuuggcuuuucuacuaaaguucuggccuuugaggaucugcuuacugcucagugugggaccgcuucccucaccugaagugcaggguuggggcggaaggguuuucuacagcuuaaggaauguccugccuguugacuuuccuguugccauggcgauggccugugcaaacaugagcccucacuuugcaucugcugcuccccggccuauuagcaaacaguucccagcugccucggucagcugggcuccaugcccacacccgcaugggcuagacccaggcagucccaggcucacagcgccugugggcagugacaccuccccaccccucaggcacugggagcggguugccuuguucaguguggacucuccucuuccucacuuuacagucauccaaccagccauucagagggaaugagggugagaaaggagacagaggagccucuuggucacauaaggaacaugaaauguuauuuuuuagaggaaaugucagaguggaaagauuuucccagaggcugaagaaugaaaguucccuuugcaggcagccaaugguuauagcuuugugaggacuuagcaugugccaagggcugugcccagcccuuugcauucauuaccccaauugauccucacacacaccucauaugauggguccuauuuuuccucagagagguuuaguaaccugcucaaggucacacagcagguguguguuagagucagcucaucuauauccaggccuguacacuugacuuuuauguuauacugaaagccucugacuaccuauaguaaacaaaauguagguagaaugaucaauuaucucugcugaaauagaagugauuuuucuuccuaauuuugacaaaaaaaaauuuaauucucaauaucaguguauugcuaccuuuuauaagcuccacccuagguaaaaauuuuaagcauuuuuauacuguugaguaggaagucacuuaugccuauauucugcaauggaccagauauaugaagagacuauaucucaucucauuugcucuucacagugaccuugagaaguagagaguagacuugagccucagagggguggaggcugggacccugaucuguuggcauccuggcccuacccuugaguuccuaaaagugccaucuucaagaaccuguacauguagaaauaaaagauauugacaaguuuucagauuugugugucuguguguaugcacacguggacacacaugcccaggagaaaaaagagguacugcguagaguuuuugcauuugcuguucccuuugcguggaaugcuccuucccucaaacugcaauagauguaaaaucuugucauugggccucaccaugucugaucauccagccuagagcagccccucccugucacucuuuaucuuauuacucuguuuuauucuuccaaagcccuucuuauuagggagcucaugugaguguaagaaugggaaaaggagucugugugagcaaauacaugcuagaauuguguuuuagacaaguacucaggguaugugcugguccacacaccugcuauauguagcucagcauucaccaccaucugaaauguucuuuucuauuuacuuauucauuuguucucucucuacuggauaguaaacuccaugucacucuuguucaaugccguaagaccagcacuuagcacagugccuggcauauaguaggcucuaaauaaacguuuguuggaugaaugagugaacaagugaguuuaugaugcuccuacguggaugacauuuaccauuuaagaagcaccuugcagcuguccugucagcucacugguaaugggccaccaguguggaaucuguccaccucggcucucugaaacagcacccuaguuccaacuuggguuuaagcugcaaaggggucaggauacaaaggucagaacacaagagaaacaaaccucucucacaaagcucaugccauuuuguagagagauguggaacucaaggcugagcucacaggaaggcaggagagcaugguauuugaaaguugggauucuggagccaggcagaagccgauuagagacccagcucuacugauuacuagugggugaccugggcaaguuacuuacccucuccaggccucagaauucucauccuuaaauugacuguaguuuggaauugacuguaguuccguuaugcuaagggauuagauuuacccucccaccugacacaacuaaaacaaaauacaugcaacaguaguuuucagauguuggacuuugcuggcacagaacagugaucucuaagagaugggagauaaaugaggugagcccugagaguucccagcuuaaugccuagagagacucauuuccaugcugcaaugcaagaaaagggauccuuguugucucccagaguuggagaggugcaggugggagucuagagaugccaagguuagucuaaagaugccaagguuacuaguggaccaagaggagagaaacacagacacacacacacacacacacacacacacagagagagagagagagagagagaagaaagaggagagaagagagaggagagacagagagagcacuucagagacuugcagagaauuccccuugaaucuucagcugagaacugagugaggaaacugcuugaggcaggacuagaaagaguuuauguucccgccaaccgggggaaacaccuuguaauucauagggaaggauuuugccucccuaauguagguagaaaacaaucaauagaaacugacccagaaauggcacacaaucaguagacauggacaguaaaacaaguauuauaauucuuuaaaaaaaauuuuuugugagacagagucucacucuguugcccaugcuggagugcaguggcacgaucucagcuuacugcaaccuccgccuccggguucaagugauucuccuaccucagccucuggaguagcuggaauuacaggcacacgccaccaugcccagcuaauuuauguauuuuuuuuaccagagacgggguuucaccauuuuggccaggcuggucucgaacuccuggccucaugugacccgccccccucggccucccaaaguacugggauuacaggcauaagccaccgugccccgcugaguguuggaauucuauucuauagauucaagaagguggagaauugcuugagcaugcuaguagggacauggaagauaauuuaaaaaaauuaacuuggacugcuagagaugacaauuacaaugucugaaauaaagugaccauaauuaucugucucagaauuugcaugucuaguauucuuucugcccuccaaauacauguacuugugcaugcaaaaccaccauuauauauacuuccacaccaaugcagaacaaaguuagaaacaguuucugaauauaaaucucaagcaaggcaucuguuuugccguauuguaggaaggagauaacaaaaaggccugacaauauaccuagaaggaaauguauuccaguucuuguguaagaggugugggcauguggccagcuguacaaucaugagauuagacagaacuuugguuuugcuucuuguugguugggugacucuuggcaaauuucuuaaucuuuauaauggggacugugauacuuccucaauaaauaguagauauagggcaaauuugauauaauuaagaaaaaauuacuucaauuuccugaugaacaacaaaauagcuaauucuuuucuucuagguuuacugugugucagggacgauguuaaaacuguuucaguuacaaucgcauuuaauccuuauaucaacuaugaguccgucagacagucugaucuucaacucacagaugagaaaaauguggcugaaagagguucauuaaauuguaaaaggucacucagcucuuuaaguggaagcauguggauuuuacauagguauguuaaaauccucuuacacagagcccagacuuuccaagguuuauucuguguguguguguguguguguguguguguguguguguguguguguucagguugagggccagggugcuaaaacuugaaagugagagguuguucgggggaauauagaauuaaaggaaaaggauauagaauuaaauaaaaaaaggaaaagaccuagcuuacguugugaaauguacuaacucucggccgggcacggugacucacgccuguaauucuagcacuuugggaggccgaggcagguggaucacgaggucaggaguucgagaccagccuggccaacaugggcaaacccccgucucuacuaaaaauacaaauauuagcugcgugugguggcaagcgccuguaaucccagcuacucgggaggcugagguaggagaaucgcuugaaugcagaaggcagagguugcagugagccgagaccgugccauugcacuccggccugggugacagagugagacucugucucaaaaaaaaaaaaaaaaaaaagauacaaaaauuagccaggcaugguggcgggcaccuguaaucccagcuacuccagagacugaggcaggagaaucgcuugaauucaagagguggagcuugcaaugagcugagauugcaccacugcacuccagccugggcaacggcgugagacuccgucuccaaaaaaaaaaagaaauguacuaacucccuagcuuguuuuaaauuagaaaaaacaaaagacugcguuuggaauaaaauuaauuugguagggcaaagugugguauugcuuauaagacguuuuucauucccuaguauaugaaauaccuugucuuuaagcuuuuauuacuuuuauuucuccuaguuauaaagcucauuucugaccuugccccauguaaaugugacagugggagaagguggucuuucuucuccugggguugguuggugaggaaggauaggauagcccauggauugaaacagguucuucucacuggaguagcuucucaggcuguacaaaaaucuaaacuagaagcagauguuacuguggggcagaacucucaguucugauuucuuuuuaguucuguauuagagcaaugacacugaaaugaucugagcugguuugggcuggcugucucuauacggggagaggcugaacugcacuuuuuggaaggcagauuaaguagcugcugcaauccuguugguaucuguuaagaucuugugauuaaauaagauugggccacagcccuggagaaagauacccagagaggcugaaagagaaaggcaucucauaaaggcaagagcuguaauuaucuucugauggcucuuuggcgggugaucucuuaggacaggaagauuuacaaccuguaaauaauuugcaaggucauuggacuaucuucaaugauguaucagcuaauuuauucaugccacaaauauuuacuaaugccuacuaugugucagacacagcucuagacacuggggguacuccauaccuuuuauggagcuaacaucugaguagagggaacagauaaauacacauaugacauaacagauggugauaagugauacgaagaaaauaaaggaagguaaaggagagaaaacagcagggugaggucugagugggugcugguuuagauaggguuguuguauaaggguuuguuuuggggguuuuuuuuuucgagacggagucuugcucugucgacaggcuggagugcaguggcacaaucccggcucacugcaaccucugccucccggguucaagugauucuucugccccagccucccgaguagcuaggacuacaggcgcccgccaccacgcccgacuaauuuuuuuauuuuuaguagaaaugggguuucaccauauuggccaggauggucuugaucucuugaccucgugauccaccugccucggccucacaaagugcugggauuacaggcaugagccacugcacccagccuggggaaucuuuuauaauggguuaugaaguuuacagacuucauucagauuccacuaaauuggauuuuaugagaauucagcugcagcugacauuuaccucuggucuaacucugaaaagaaaaauuguuucccaaaaggauuugugguauauguaguauuaaggguggggaagggcuauuuaauguagguaagauaaagaacugguuuuaagaacuuuacauagugauuacauagaaauggauguggguaguuacaaaggguucuuaucuauucauucaugcccaccugcccagcccccugcugauucagaccagcuuucacugccaaguacuagccaggagcccugucuucauaugcuuuuuauacaucucuuuuucuagcauagugucugaaauaauaauacaaggugacuguuaagcacuugccauaucauccuuuuaaucccugcaacaauaccauuaaguaggagcugucauuauccccauuuuauagaugaggaaacugaagcucggagaaguuaaccuguacgcagccugagucugaauuagucaggccugccugccuccacguuccuagucaucaggcaaagcugucccuccuuaucuuacaagguucaaguucaugaaagagugaauaaauggauggaugaaaaaacuacuacuuugauucuaacgguugagggaauuaacuggagacagagcaucggaacuccacugaaccaucagagcaggcaggcaggcaggcaggcacagaauuggucaggugaaaauaacaaaauagcaggugaccauuucuucaagaaauaauauucagcaucuccuccaugccagaggaguuagccugcuccucgcagccacagacucuggccucaaugccucacugacccggagggcuuuggugaggagaccugggcuuccacucagcccuuugcagguguuaccugcaaagguaacagugauaccauaguggccagaguugcagaggugggaggggcugggaaaaagagcacaguagaugcuggccacgaaaaucgugcaaauccugccacagccuucaggcuaugucagugauuccaaaaccagggcguggagugagcuaaaaguagaggcgagacuugugccagccagguuugggaaucacgguugaggaucaguguuucuaccuuuuaaaaagccacacccccuuucgaugagcaggaaaagagccgcaagguucucuggcaguccuggccuggagucaggagcggaaguuccuggggggagcgcaggucacuaggccuuccuaggagguuuucauggaguuugccugcuacaguuuguucuauuaaauaauuggacuucgaugcgugguucucaaacgugagccuggauucccaugcugaauguuuucaaaaccacucaagccccccucuccccagaucccgcguugccuucugccuucccuaucccuagcccucuaccuccuccacuuuacucccacagccauugggagucacugucuagaccauuguuucucggacuuccuggguauuaagaauuaccgaaaggaaaaagucggacucagggaucugggaaucugcagacgcccuggugagggacgucuggggaagcacauucugagaaauguuuugggagacgaugcggaggccgagugagggugggcgggcaagugcaaguggaggggugaaccgaggcgcagcccuuugcggggauuuuaccuuagcaauaguuuccugugauacgagcugcugccaugggcguguugagaaagaauuauucagugacaccugguacaguaugggcaggaaggcuucauucaggacugaguuagcucaagugaccccugcaacggagacucgugggaaggaagagagauggggugccacucagauacagcaugggcaaguaggaauugauagccaaggaggaguguggggggucaguggauggaaaauuccuaagaggaaaugucacagucagggggauucuggcuaacccaaccuaacaggauucuugcugaggacaucacgugggggauggcagagaaugagaaacccgaucagauauggagggugaucagaucucacggauggggguuguuugcuaaacugaccgaguaggauucucugcuaacacuggauuucauaaggaagcacaggcuuaggaggaggcucaggagcuccacucaaguuuggccaagcaaagacucuuugucagcugacacggcgucuccuaccagucuaguucacagggagcauccuuggcucuccugccuuuuggcgggggaucagggcaggagcuugacagauacuggcccaggagagggagaagugcuggggagggagaugggguccagccuuggaaccccagggccauaggccugccaaaaugacaaggcacggccaacugagagccccugcuucgagggugggaagcucaccaucuuuuuagguuuccuacaggggaccuaggagcagccuggaaucguguuuguccccagucagguugggauugcuguuccugcuuagaggucgggaaguugagaccgugcugcgaucucuagaggcagaaacagugcaacaugugauuuauuucucagccuccaacacauuuuuuccuuccuucaugaaggaauuuccaaguuacuccuccuccagaaaucaugugggcugugucucugcugcauagaggaacaacuucguauacgugagcuccccugaguaagagucagccggcaaagcccuuacucacuccagaggcaugcggcccuucacauuugcgccgugcuaaaggggagaacauuuuccauuucucuuuuguaaacaaacuauacucugucuauuuuaagaagaagaagaaagaagaaaaaaaaaacaguuuaagcggcucuuaaccaauacuugcaagacuaaguugacugguuuacaauuaaacucuuucauucccccaaucauaacaucucauuuucaaguaguugcucccauuguguaauauuugaugucacauagagacucgacuccaaacucuaugacauucgugggcugaaagacaaaggagcaugacuggcuuuuucuucacuuugaagacaucugcaguuuauuaauuccacaaggaaagcuggagggccagaggacgucgagauucuuucacuaaaaaauuuccuuuugagacaguaguccuguuuuaguguugguuggaguucauggggagacuuacuuuuccaugaaaauauagagcaaggcuucccccucacugucacacuauaauauucuagcauuuuuauagcauuaguaauagaaaagaaaaaagacucuugguuuagugucaccuccuuuaaaggaaauuggcuuauggucagaccaaacuguucuuauccccuguguaagaggccaagucaucauuucccaguuuuucacaguauuuuguauccaggcaacgucacagaaaauaggcccagccaggagugcucugggagucacugcagagcucagacuuauccauggggcguauuuucuucaauucacaaugaaaacuccuagaaguucuguuugaauuuuuccugaagucagcuuguuguaaaaauguuuuugggauuaaagucuuugcaggccgucaucuaaacacacuaucuuuacuucagaaaaaauaauaaauaaauaaauccaguuuucuuuuauguguccccccuacaaaagcaucagaauuuuaggagaaagcaaaucuuucuuuccaaauaggauauggaacuaaagauuucuaaaagaagaaauugagguuagccuuuauaauugguuucuguuauuuuacucccuuccuggucagugaucuguuacuacccucucugggggaagggaaacuagcggauacugauugggucagaauggagguuguaaaaccacucaaggccauaaaaggucagcaggaaggcuuuguguuuuagguaagccugcucuuuccaguuaaccauaagccccacuauuguauuacauagcacgaguugcauuccacauuucuguuauuggccuaaccuucucuccugacacucuugugugaauucuaguuugauucacgacauuauaagacaaucucuuugaaggcagaaacccugccuagcauucuagauggucuaacacgaacauguucuaggagauuuuuuucccucuaaauuagagaguaggacuuuaaaaaaaaaaagagagaaaauaauuuauuauuauuauuauuauuuuugagacaaggucuugcucuguugcccaggcugaaaugcaauggaacauucacgacucacucagccucccaaguagcuggggcuacuggugugagccacuacaaccagcuaauuuuucauuuuuugugugugccaaggcuggucuggagcuccuuggacucaagugauccuccuaccucagcuucccaaaguggugagaugacaggugugagccacugcaccuggccagaaaagaaauauuuaacauuagauaguuuccuguagacauauauagaaagcaucacauauacaagccuagcaacagauuguuagagcuggaaagcauuugagaaauuuuuugcuucaauccacuuguuugcaaauaacgaagaguugggugacuuagccaaguacuucaagaaaguggggacacagaguuaugaauagaacaggaguuguuuucaaccuggggcaguuuugcccuccagggaacaacuggcaaugugccucgaaguuuuugaugaucacaaaugguaucuagcugaacaguauagccucccauaaaaauaauuaacggguucaaaaugucaguagugcugaggucgagacacgcugguccaaccccaggcuggcccucuuucuacuucagcauugucccagcauguugcacuguuuguucuaagauuuguuuauugaugacagagauucaggucauuuugacuuuagcagaagcaaaucaguacauauucaagugugcaguguugcugucuuaguccuaggguuaggcuaugaauuaugaaauugcaaggaaugaaguccaguuuguuuccacaucuuucaucgcauuuagacauuuaauaccaguuggaugacuuuuaaaccucuaguuuuuacguuuugauuuucuugaaaacucaauuugcugauuucaugacuuaaaaaccauggaaauaaauucuccuuaauacucgugcuguguggcugagagagauguggaagagauuuucggggcuuucaccuuguuuggaggcucaucuguuuugucugguggagauggaguaaugggugucuucaguaugucacgggaauaaaaaucuaaguaaggagaaaaaaaauacuccuguaaaaaagccuaaaaaacauacugaucuaaaaacauacucuguaaaauucccauccaaucuuuuuuucuguuaauguaaaagauaguuuuauuuuuaaaauuuccuuaaaagauaauuuauuguuuugagaaaaaaauaauaacaauaaauuaugguuuuguaacauguagaaguuaaauguaugacagcagcaggaaaagcaauaacaacaacaaaacaggagaaaauucccaccaauucucagcauugacugagaauuaauuucuguauugaccaaaaagggcugaaaaguucccuauugucccucuggaggcaaaaauuuucuuuuccauugccaacuacagauucuuuuuuguuuuuuuuuuuuuuuuugagacagggucuugcucuguugcccaggcuggagugcaguggccugaucuuggcucacugcaaccucugccucacgguucaagugauucuccugccucagccucccaaguagcugggauuacaggugcgcaccaccacaccuggcuaauuuguuguauuuguaguagagacgggguuucaccauguuggccaggcuggucuugaacuccuggccucaagugauccacccaccuuggccucccaaagugcuaggauuacagacaugagccaccgcaccuggccccaacuacaaauucugcuugugauauuagaagggaugagaguccaucgcaguuguugaucgucuugugugguguucuuuacaagaaagugcacuuuuccaagaaaccauguacagggggcuccugucauuggguaaauugggugaaacagggugcuauagcaauuuccuggucuugugcaauauccuauucauagaaagugaaggcacuuauuaauauugccaagucucuggaccuaugugguuggguuacagaccccagcguuaaaaucuaguccuauuucugaagacugaagaggauuggggagaauaauacaguugcugcuaacaucuaucacuuccaaaagaugugccuaugcugccauguggcguacccggagcaccucugagaaacaacuuuuacuuucuaauuuuuaaauauacuguauuauauuuuaaaauaaaaugcauuuccacaagaugaauuuuccugauuaucauguuugcccaaaagcccagaguuacauagaaauguucaauuacaguuuccucacccggauauuuuggcauaaggaaucucuucuaucacuuuaaggacucaauguuuagcuuucuauuuuuaugcuaaugauuuucuauguuaucugcuaguacaagucagugccgauguagacaggauauaaguaaguaacaguuaaaaauucuaaauauugggccaggcgcggcggcucacgccuguaaucccagcacuuugagaggcugaggcagguggaucaccugagguugggaguucuagaccagccuaaccaacauggagaaaucccaucucuacugaaaaaauacaaaaugagcugggcuugguggcgcaugccuguaaucccagcuacucgaggggcuaaggcaggagaauugcuuaaacccgggaggcggagguuguggugagcugagaucacgccguugcacuccaggcuggucaauaagaacgaaacuccaucucaaaauaaauaaauaaauaaauaaaacauucuaaauauuucuucuguccguuuucgggauacauacugaaagcaugugacucucuugucuuucugauuggauuucacacaaggaacuuccucgcuuuaccuacucucauucauguuucauguuauaaccccaauuuacaggcucuuuuucacagguuacauuuuuauauagacuggcuaauguguguucuauauguguuuuugaucauguuccccaacuauaaaaauguuuugaguauuaauucucaauauauguagacuuauuuauucuuuccuucauucaggaaccugcuguuaaguaucuacuauaaucugguacuguguuagaguagugaguaaaacaggcaagaaucccugagucgagggggcuuuccucaugagcagagacaugaggguacuucuguaccaauauguuagguaugauaggagauagauggguaaguggcagaggcugauauuauccaccaaguucuaggaagagagaaguacacacacugaacguuugaaugcugcaccaucaaacaggggacagcaagcuaacccuaucagugaacuagcaaccuauuuacaacccuagaaggucuacuuggggggauauuuucacagugggcaaagauuuauggguccuuuuacauuucuauuacagagaaaugccuuccucucuuacugaauuuuguccuacuuuucucucuuccuggauucuggcgggggguaguggggugcuauauuuagucuuucuuuuuucuuuuucuuuuuuuuugagacaaggucucacucugucgcccagccuggguacagugauacaaucauagcucacugcaagcucaaccuccuggguucaagugagcuucccaucuuauucuuccauguagcugggauuacaggcaugcaucaucacaccccauuaauuuuuuaacuuuuuguagagauggggucucaugaucuugcccaggcuggucucaaacuccuggacucaauugauccuucuaccucagccucccaaagugcugggauuucaggcauaagccacugugucuggccacucuauucagucuuuaccucuugccccucuaucucauucaugacuguugaaauuucaggcugagaguggugacucacgccuguaaucccagcacuuugggaagcugaggugggcagaucaccugaggucagaguucaagaccaccagccuggccaacauggcgaaaccccaucucuaggaaaaauacaaaaauuagcugggcgugguggugggugccuauaaucccagcuauuugggaggcugaggugggagaaucacuuguaccugggagguggaggcugcagugaguggagaucaccccagugcacuccagccugggugacacagcaagagucugucucaaaaaaaaaaaaaaaaagaaaagaaagaaauuucauaggcaccagaguuugacucuuguaauggagaagugauggcagauauguuuacugccaaaaugcccugcgaggcuaauagcaaaauggcccacaucucauuauagugacuucaaugauuuaacagaugaagagguagggguugagagguccugagucauuggaagccuaucuccuacuuaggcugcuaugugcuuuccuguuuucccugcagauuaauuggcacggcgacuguagcccugaaggaccugacuggugaccagagcagaucccugccguacaagcugaucucccugcuaaaugaaaaagggcaagauacuggggugaguguuuucucucuuauugaauggcuuugaagugagaugauugagcaaaauuucauuaagaaaaaggucuaaggccgggcgugguggcucacaccuguaaucccagcacuuugggaggccagcacuuuuggguggaucaccugaggucaggaguucgaggccagccuggccaacaugccgaaaccccaucccaacuaaaaauacaaaaauuagcugggcauggugguuggugucuguaaucccagcuacuugggaggcugaggcaggagacucgcuugaacccaggagauggagguuguagugagccgagaucaugccauugcacuccagccugggugacaagagagaaacuccaucucaaacaaaaaaaaaaaaaaaaagaaaagaaaaaugucuaaauugucagaaccaauugguaaaaaagaaaaaagaaaagaaaaggaaaagguaucaauugguaauuagcuaaccacacacacaaaaaaucugguuuugagauuuuucuggugaucuuucucaagugugugugcuuuaaauaaaaaacugggcccguuugcaaacgacauggaccuuauuuuauacuuucaaucacagaacuagcaaauuugauagauuugauuuucuaugagauaauucuauagagugagggugacccccucuagguguagcucugugcuuagccauguggguguuaacauuugugugguuauguauaauucugugugucagauauucuuugaaacauucuguagaaggcaguucauugacauaagcuuggaauaugaagacuguaauaucauaaucuuuuuuuuuuuuuuuuuuugagauggagucucacuccgucacccaggcuggagggcaguggcaugaucucggcucacugcaaccucugccuccuggguucaagugauucuucuaccucagccuccugaguagcugggauuauaggcacgugccaccaugcccaguuaauuuuuauguuuuuaguagagauggaguuucaccauauugguuaggcuggucucgaacuccugaccucaggugauccucccacuucgaccuaccaaagugcugggauuacaggcaugagccaccacgccuggccucauaaucuuuauuacauugggugcuggauguuuucuggucacagccucucucaauaaguacaucuugcugggcgcgguggcucacgccuguaaucccagcacuuugggaggcugaggcgggcggaucuugaggucaggagauccagaccauccuggcuaacauggugaaaccccaucucuacuaaaaauacaaaaaauuagccaggcaugguggcacgugccuguagucccaucuacuugggaggcugaggcagaagaaucgcucgaauccaggaggccgagguugcagugagccaagaucgcgccacugcacuccagccugggcaacagagcaagacuccaucucaaaaaaaaaaaaauuaaaaaaauaaguacaucuuaauauuuucugaugcaagaccagaauucucuuucucuagugcaugugcuuuaaaaaaaaaugacucaagugucgcaagucccagauuucauauaauuaauaagaagcacucauaaagauacuguacuuggcccauaacuuccaaccccuucauuuuccaaucaauuuauuuuucuugggagccugggcaaagggagagaaauuuacauuaaaagaugcagucccuguaagcaaagcuaggcucucaacagccauaugagagaaaggcaguuuugcugaucuggucucuaaaacuuauagauuugccacaaaucagcauuguaaucaaaacacacauuuaaaauguuggcuaucaucuguuuacccaaaaccuagcugagagaaaugauucugaggaaagaugguauaagucaaugauuuuucugccuucuuuuuuuaaagcacagaagaaagcauauguagaccccuagaauggcagaacuguugugauucaguggaguguguuaguccauuuggcacugcuauaaaggaauaccugaggcuggguaauuuauaaagaaaagagguuuauuuggcucacaguucugcaggcuguacaagcauggcaccgauaucugcucagcuucuggugaggccucaggaagcuuuuacucgugggggaagguggagaggaagcaggcgugacacauagugagaaagggagcaagagagaagagggggaaggggccagacccuuuuuaauaaccagaccuugcaauaacuaauagaaugagaacucacucauuacugcaagaauggcaccaagcccuucgugagggauccgcccccaugacccaaaaacucccaccagggcccaacuccacuauuggaggucacauuucaacaugagauuuggaggcaacaaacaucugaaccauaucauggaguaaggaaaguaaauggccucaagcccugcccccuguaauuccucuuacccuuuugggggucccuggagcaccucugggaauccugagguuauagaacacagcaugaaaaccacagaucaagggggugguugucuguguguucuucuagguuugaaaaguuugauucuuagauucaguuuagcaacuaagcccuucagugcucccugcguucagccaugagaugcugcucuuaugauucuuugugugcugugaaacuguggcuagggucguauuccuuauccuguucagucccuuccagagcaguaguuccaagacacacgaugugccaguauaugagggaguauucacugaugaacagaaaaauggaaaaagggcaaugcacuguguguguguguguguguguguguguguguguguguguguguguuuaccagauguaggaaaaguggcaaaugaaagcauaggauguguauuuaaauucacauacaggcugggcaagguggcucacgccuauaaucccagcacuuugggaggcugagguggguggaucaucugaggucaggaguuugagaccagccuggccaacauggugaaaccccgucucuauuaaaaaaaaaaaacaaaaauuagcugggcaugguggcacgugcuuguaaucccagcuacccaggaggcugaagcaggagaaucacuggaacccgggugugaggcggaggcugcagugagcugagauugugccauugugcuccagccugggcaacagagugagacucugucucaaaaaaaaaaaaaaaaaauucacauaaaaaacgaauaauuucucaguguaacuauguccuaaauaugauguccuguccagauguccagauuuuaucuggucaccuugugugugugugcauauguguguguguacgugugugccauccuuauuugcaaaggacucccuuuauucugagguuugucucuucucauuuuugguguuaaaaugccucucuuuuauaaaaugauugugauaguagaugauaguugugggcagguguuuggcaaaauacaaguuagcaacccaaugucgauuuccccuagcaaauuguuugaaauuuuguggguccaugaaauuaaaaaguacuguauacagcaaacucugcccuaaaauaaugcuccaugugagaaauugaucucagcucuuauaaguaggaauaacauugucucuuguaaggaacuaguauguuuccuucuguugguagugaaagcuacauaauguuuucaguuucccuuuucauuuggcucuaggcauuucggaggucacagauuaugcaacagaaauggcaauuauauuuaacuuuaugguuugcauauuuguuuccucuuuagccagauucaauucuccuuuuuuuauccuauuuuaugaaucacaacuuuauauacauguuuuguuagucacuuuuuuuuuuuuuuuuuuuuuugagacggagucuagcucugucacgcaggcuggagugcaguggcacgaucuuggcucacugcaaccuccgccucccgaguucaagagauucuccggccucagcccccugagcagcugggauuacaggcaccugccaccaagcccagcuaauuuuuguauuuuuaguagagaugggguuuuacuguguuggccaagcuggucucaaacuccugaccuugugauccacccaccuuggccucccagugcugggauuaaaagugcaagccauugcacccagccuuguuagucacuuaaaguucucucuguuuuuuuuuguuuuguuuuguuuuguuuuaagacagagucuccccgggcacgguggcucauuccuguaaucccagcacuuugggaggcugaggugggcagaucacguggucaggagaucgaaaccagccuggccaacaagaugaaaccccaucucuacuaaaaauacaaaauauuagccgggcaugauggugcacgccuguauucccagccauucgggaggcugaggcaggagaauugcuugaacccaggcggcagaggcugcagugagccgagauugcgcccugcacuccagccugggcgacagagugagacucugucucaaaaaaaaaaaaaaaaaaaaagacagucucguucuuuugccuaggcgggagugaguggcacgaucucagcucacugcaaccuccgcccccuucagguucaagcaauucuucugccucagccucugaguagcugggauuacaggugccugccaccaugcccaguuaauuuuuguauuuuuaguagagacaagguuucgccauguuggccagguuggugucgaacuccugaccucaggugauccacccgcuucggccucccaaagugcuaggauuacaggcaugagccaccgugcccagcccuaaaauucuucuuuaaaaagaagcaugaaaauaaaucucagcaauucauaaugaaauaagcaaugagcaaacaaauaaauuaaucauuuacagugacccucuguaauuguaauucugugaugggagggcaucuccagucuaggauggaggugugugacaauucacaccugcuugucacaacuuuacucuguugaugagguggccccuuagcaaggauacacuuggcaaccugugacagggagcuacuuccccacccugccuuggcugucagugggaggauaggaacagucgagcuugugucccucuccccguuuccagccucgcuuaccuacucccucucucuuaccccuuccaagacuuuggcuccugcugaagucacuugcauugagucuauaacaugcuggugcccugcacugauaauauuugcaacgaauuauuucuacccaggccaccauugacuuggugaucggcuaugauccgccuucugcuccacauccaaaugaccugagcgggcccagcgugccaggcaugggagguaagcugacccuucugaaggcccagccacccccagggggaggcugcuaaagacacacaggagagugucuggagaaacccugccauugaucacaagccuguagcucccugcccacccagacaggggccccgagaggcagguggggcugccugaauugggacauugcaauuguuuaugaaaugcccuucaagguagaggggaagggugaaccaacccuuuacugaacaaccucacggugagcacaaaaagcacaugccggcuccagcagaaugucccagggcuuugcuucagguuuguggcuuccaccccauacagugucuccaggcuguuuggcucaaggaguggccccucugcucuccucugugugucuccucaccucccaaaggugccaccaccgggcucugcucucagcaccagucucaugggcauggcuuucgacuggaaccuccuucacugucuccccuaaccccggccccaucuuguccccaaacagccccagguccucuaagcaauugcuucucuucagcauagcccgcauuguccuuggucucugacauggguugccagucauucagggccaucaggugccagucuaggugggguuggggcugagggcucagggagggagggccuacaagacaaucaguccucucaugcagcugagucggacccccucucaguguuuucccaggaugacgugaugcuaaaagucucugucccuuccucagccguaagaugcaugaccaaggcacagucucggcaugugucccaggaagggaggggccccuuaucucaccacacucaccugcuuccuugaaacucucccuccuggcugggcgugguggcucaugccuguaaucccaacacuuugggaggccaaggcaggugaaucaccuggggucaggaguucgagaccagccuggccaacauggugaaaccuugucucuaauaagaauucaaaaaaauuggccaggugugguggugaaggccuguaaucccagcuacucgggaggcugagacaggagaauugcuugaacccaugaggaggagguuucagugagccgagauugugccacugcacuccagccugggcaacagagugaaacuccgucucaaaaaaaaaaaaaaaaaaaaaaaaaaauggaauucucccuccugggaggaaguccugcacuuguugcugagguggcuccucggggcucaucuucuucuugcuucucuugguugggaacuuggcucuccggccgcccgaggguucacuuuacaccugcagcagcacccucccugccuguccugcccagucccaccugacuucucaucuugcucagccugaccuccgccccugccccugcuuaugcacccauuaugaauguuuuggcccauuuuuugacuaaguaguugugaguuuccagugaggguuagguggcuuccucuuggugacaagacugagauggccccagcacaucagcagcaugcucugcccaucgcccucuuccuagcggcacccugagcauucuacuuggcuuuggacacucagcccugcgggagcgcugcaguggcucaagaacauccauggcucccuuugcuuccacagcagugaugacaaaaaaaaacaaacaaaaaaccacgaaacacagaggacacaggccagcaccaguaacaccaucaggggcagaacugaguggucccacccauuucccucagaccuccgcugccgaugacuauugucaccagcauuuguaucugugugggaaaggcacuaggcgcuuucuggccugcacaaggcagcccucauugaugggcuaucuggaguagccucugaauuggaaagaucagggcaucuuucuucauacugucguuucuccuaagcuagacccuguuuauuaguuuccuaggucugcuguccuaaacuaccgcaaacuggguggcuuaagcaacagaaauauucucucgcaguucuggaaaucaaaagucugaaaucaaggugucagcagggcuaguuccuucuggagccucucagccuuucucccagcuucuguugguugcccgccuuccuuggcaucuguggcuuguagaugcgucaccccagucucugccucugcugucacaugguguucuaccugugugucuuggugucuuuguugcuuuuuuccccucuaggauauagcuccugaguggcucaaggaucuuccucucuaugugucuguuuuugauuuuuugguuuguuuuuuuuuuuuuuagacagagucuggcucugucgcccaggcuggagugcaguggcacgaucucggcucacugcaagcuccgccuccaggguucacgccauucuucugccucagccucccgaguagcugggacuauaggcgcccgccaccacguccagcuaauuuuuuguauuuuuagaagagacaggguuucaccguguuagccaggauggucucaaucuccugaccucgugauccacccaccuuggccucccaaagugcugggauuacaggcguaaaccacugcacucggcuuuuuuuuuuuuuuuuuuuuuuuuuuucagauggagucuugcucugucaucuaggcuggagugcaguggugcagucucagcuuauugcaaccucugccccuagguucaaacaauucucgugccucggccucccgagaaggugggauuacaggcgcccgcgaccacacccgcuuaauuuuuguauuuuuaguagagauagaguuucaccauguuggucaggcuggucuugaacuccugaccucaagugaucugcuugccuuggccucccaaagugcugggauuacaggugugagucacugcacccgaccccucucuguguguccauguccaaauuucuuauaaggcacuggucauuggauugggacccacccgaaucaaguuaagauaaggucacuguggauuagggugaguccuaaccuucucuuaagguccguaaccuuaucuuaacuguacagaaaccuuauuuccaaauaagaucacauucugagguuccaguggacaugaauuuugaggggacaguauucaacccaguacacuggcagauaaaagacaauuucauauguugauuccauuccaagagccaaaauauuaaauggguccucuuguguuaccccuucugccaggccuuuaggaaaaaaaaaauacugugguucauucaaguaaaaagaguaaacuuaaagagaucagcgccacaccauuuguuaguauuuauaaaguaagaacauugcuugcuggguuuauuuuauuuuauuuuuuugagauggaauauugcuuugucacccaggccggagugcagugacaugaucucuguuuacuguacccuccgugucccagguucaagugauucucaugccucagccucccaaguagcugguauuacaggugugcaccacuaugcccggcuaauuuuguauuuuuaguagaguugggguuucaccauauuggccaggcuggucucgaacuccugacuucaggugaaauacccaccuuggccucccaaagugcugggauuacagguaugagccaccacgccuggccccaacuauugaacuuuuaaaccugcuggcgagaaaaucccugccacccaaggcuccuucuccuuuccucuugguuuaagccuuuguuuguagcaccagugcucccagcaggacaguagacugaaggaguccaccauccccuuaggagucuggcucacagcgggcucagcaccagggaacugcacaagcgcagcccagcucucccacggaaguucuuuagaaucccugacuuugcucagcuaagacaggaaaugaaccaaaacuuggguuccuuguauuuggauuucaaacaaagaaggucaccaaguguuggucugcaaaugagcugugucugcagggcaauuuuauuuuuaaaugcaagaugacagagugaaauuucuauguuugaucuuagccaaaagucugagaaguaaugugaaauuucuuuauuacaaaaaauaaaccgggcucuuugaucuggaagugcugccuuuguucuauaaaugaauguuugccggggcucggucaaagguggcauucugugugucggcuuccuaaucuggcuaagagaaacuuuccuucagcauuuaaaaaaaaaaaacaaaccucuaauagccucgacuaucuagauguuucaagggaaaacauuucuuuucccuaacauagugucuuagucuguuugcauugcuauaaaggaauaccugaggcuggguaaguuauaaagaaaagaaguuuauuuggcucaugguucuucagacuguacaagaagcauggugccagccucugcuucuggugagcgcuucaagaagcuuccacucaugggggaaggggaaggggagccagcaucacaugaucagagaggaggaaaaugagagagaaggcaagggugccacucucuuuuaaacaaccagcucucaggugaacucauucauuacugcggagaagccaccaagccuuucaggagggauccacccccaugacccaaacaccuuccaguaggccccaccuccaacacuggggaucagauuucaacauaagauuucgaggggacagauauccaaauuauaucacaugguaauucaguucaacugagcaaaagguaucuuugagcaccuacugcaacccccugcuagggaagacaccaggagaaaaaacaacuuacaaucuugggggaauauaagacaaacaaauaugagacagagaacagcaagacagccauaccucuuggcauugcauaccuuaaugacauaagcaggacaucuggcccagaauuugcuuuuuuucccuucaauuaacuuucuuucuuucuuucuuuuuuuugaaguggaaucucagucugucgcccaggcuggaacgcaguggaguaaucuuggcucauugcaaccuccaccuccccgguucaaacaauucuugugcucagccaccugaguagcugguauuacaggcaugugccaccaugccuggcuaauuuuuuaauuuuuaguagagacaggguuuugccauguugcccaggcuggucuugaacuccugaccucaagugauccaccugccuuggccucccaaagugcugggauuacagucaugagccacugcacccggccucccuucaacugacuuuuaaagaaacccuaaaacuuuaccauucuauguaaaaguaaugucugcuucuucugauuuauauauuuucaaauucuuaaaauuugagcuuguuuuucuuuccucgagcaaaaaagaaauaucugcuuaauaaaauguaaaugucacagagauacaugacacggaaagugaaaaucucugcgucccauccuccugagauaaccacugccagcaacuucugcuauugauuuuaaagguucuucuccacauaguggcuccugcagaggagaaauuagaaguauuuaugcuggaauacaaaaguuaagauuuuuaggaaaauuugccccugccauuuguagaagcuagcuaugaucacauaucacaggaagugaacaccugagggcuucuuuuuuaaggaauucuuucuuagagcuuuuauaugaagaugacaaaagguagagaccuuagggcacugguggcuugacugaaaguguguguugucaaagauguucuuuucacugaccccccuggaagacuguucccaugacagaggggagggcugacccagucuccaggcuugaccugaaaaccuguuaccauggcaacuuaauucgccagaugucagucugcuuaacuggagccuacauucccguagcuggaagaaacuauuuuuaaaaucucacgucuauuuuugaagcaccaucuguuaaauuugcgcucuguccaaacauagacauucaaaaacucauucauagccagacuucacugcuucaaaugucuuucauuccacgaaucccaaagucauuugcuuaaaauuaauuuuuuuaauggaguuuuugcucuguugcccagugaucucagcucacugaaaccucuaccuccuggguucaagggauucuccugccucagccucccaaguagcugggauuacaggcaccggccaccacgccuggcuaauuuuuuaaauuuuuaguagagaugagguuucaccauguugaccaagcuggucuugaacucccgaccucaggugauccgccagccucggccucccaaagugcugggauuacaggcaugagccaccaugcccagccuuaaaauuaaauuugauccaguucagaaaauauuuauugacaccugccuaugggacauacagaggugagaaagccauuguuuuaccaccaaggagcuugcaguucaguaggaagguaagagauaaacaugaauaacuauagcccagagcugaauguaauacauuccuccagagagauugaccaaauuguuauauaggaaacaauugcuuucagaaaguacuuuuucagcuguguauugcaacucuguauucauggugccuagcacagcccuugagaagucauaauuguuaauaaaugcuugguugguugagugaaugaaugagugagugaaugauagaugggcacugaauaugguuuaaaaauuuuuuuuuaagaagggcauuuuggggccgggcacgguggcucaugccuguaaucccagcacuucaggaggccaagguggguggaucaccugaggucaggaguucgagaccagccugaccaauauggugaaacccugucucuacugaaaauauaaaaauuagccgggcgugguugcaugcaucuguaaucccagcuacucuggaggcugagacagcagaacugcuugaacccaggaggcggagguugcagugagccgagauugcgccauggcacucuagccugggcgauagaacaauacuccgucucaaaaaaaauaaaaagaagaaaaaaggaagggcauuuuggggaacacuagugaauaugccaaagcuccuggcucauucagaaguguguugaaagugaagcauguuccugaggguaguaggucccaggcugggauauuuguccuugaugggaagaccauggggcuccaugaaagguacuccaugacaagggacugacuuggucagagccuaacuggaaaaugauccaugugccagaagauuguugcaggcacuguuuccaggauuggguuucuaaucaaguggcuuugucuaguaaacugauuauauuaguccaauuuuucucuaggauauuuaggaaaaucaaagugcucaucauaaacaagugguucucaacauuuagacacagugaaaucaucaagggauaucucuaaacgugcagucaucuggcgcccaucuccagagaguuuaauauagcucaucuggaggggagccccgagucuguauggagagccugaugcaggcagauuucggaguucacuuugagaaacgcugcagucguacauuuugccugcugaacgugauguuguccagagggagacauagaucucugggcuuuguuaucuagacuggcucacagccugauuccucaauugccccgcaggacugcauuugcaucccugcuucuuagguuccuccaugguaccuuugcucuggucuacauauuggaacaugcuagaaaauucuuagggcacauuuauuguuauuuacccaggaauuggggugggguaaugaauugcuuacaguaggacacaaacauuuauuuauaaaacuuuuaacauuuuagaaauucagaaaaaaauuauucuacauuccagcuaagaaaauguguuaucuccaaaauauuacauguuuuccugcuucaaaacuuacccuuuccuguucugcauuguccuuuuagcuuacacugaagauaauaugauaucagcccuuuguugugcuugggcaaugaccuuuggcucaaagugauaaaauucuggcuuaaccaguaccaccacuuaacaagacuucaucuugaaaagcagaauuaggaucaaaggcagaggccaggcaccguggcucaugccugaaauaccaggacuuugggaggccgaggcaggaggaucacuugagccugggaucacuugagacuagccugggcaacauaaugagacuccaucucuccaaaaaaauaaaaauaguuagcugggugugaugaugcacgucuguaauuucagccacucuaggggcugaggugggaggauuguuugagccugggaggagaugagaggagaggcagaauguuuggauaaagggggcugccaggggcugaaguggggucuguguuccagccaggaggaucccaguccagccagggugaccagcaagugcuccuuuuccucagccauuccuaggaguugccuucacugggaagcucuaacagggaucccccucccuggcaaggugcagacaaagugggaugauggagguggggggacaaugaccugcagcucuggugacaucugauaucugagugacugauaucccacucucuucugcuugguagggagaaguggugcuagagaacaguaugggagccuggaggaagaagggacauugauaugcacuggggaaaggcacaguuggggaugccaaaggcaaacuugacuguaucacgagguccucuagggcugccaacucuucagcacugaguggguggacagaugccauguaggcaagugucauuaucacaagugacugcacacaagggcaguuggcaggaauauugcugcugagcgucuggaaagaggaucacaauacaucucaggaaugauuacauugcuggagcuaugauggagaaccauuuccaaauguuagcggaaacaucacaaguaaagaagaguggaucacaugcaguuacugauauucagaaaggagacaggucaguguuggaugcagugagaagcuuuguaggauuugaccaagugacauuauaauuauuggagaggcaggauggcauuccuacaagggaguugugaagagcuugucauagccggagauggacagugaggaaucuugaaccacugugaaucaacagaucuggauuugagcauuggcuccacuaucaagcugugugacaguaggcaugucacuuaaccucucugagccucaaguuccuuucuuacaacaucaggagguuggauuuaauaauauguagggucucuuccagcuccgaaguucuaugauucuauuaaaauggccuggucauggccgggugcaguggcucacgccuauaaucccagcacuuugagagacugagguggguggaucacuugaggucaggaguucaagaccagccuggccaacauggcaaaacucugucucuauuaaaaauacaaaaauuagccaggcgugguggugugcgccuauagucccagcuacuugggagauugaggcuggagaaucccuugaacccaggaggugaaggaugcagugagccaaggucaugccacugcacuccagccugggugacaaagugagacucugucucaaaaaaaaaaaaaaaaagccugaucaaagccaggguucauauauuauaagaagaugggaugagagaaguuucuuuuucuuuuucuuuuuucuucagauggagucucgcucuguugccgaggcuggagugcaguggcgcgaucucggcucacugcaaccucugccucugggcucaagugauucuccugccucagccucccgaguagcugggauuacaggcgccugccaccacaccuggcuaauuuuuuuuuuaaauuuuauuuuuagagaagggguuuugcccuguuggccaggcuggucuugaacuccugaccucaggugauccacccgccuuggccucccaaaguggggauuacaggcaugagccacgacgcccggccgagagaaguuucuuuggugauuacuucuguuugcgaaugccaggaugagcagcugcgcuuugguucaaauaggcugaaucaaagagcagaaaguguuucaaggauuaaaugaacaaaugcugcagaaaguuugaguaagaagagaccugaggcuggaccguuggauuuugcaacaugaaagucuuuaguggccuagacaagagcaguuuugguggacuaggagggcagagggcuggcuggaagaagcaugagaaucagagacagagugaagaaugugaguaaaaaugauucuucugaggaguuugcucccaagaggggcaggaaaaauggagcaguaacuguagggggcaccguggagucaaugaaaguuuuguuuuuuaauauucugggugauauuucagcguguuuauauuuugaugggaaugauccaguagaaagggggaaaccgaugaacguauaaagaggcaaaacuccuuaaguagcaacaggagauaggaucugugcaaaugcggaagaguuggcuucaagucagggagcacagauaguucagugacuaauuguagcaggagagaaggcaacagauacagguagaugauugauuuggaguuggaaagauguggaaauuaucuucuaauugccaauuuucucaaugaaauaagaagccaggucauuaguggacaaugagaaagauagaaaggguguuggaagcuuucaagaugcaaaacagguggccguucagaaagguaaagugauuugacugugcugguuaauuaguggccaucucagaccaggauucaggaaaguuuugggauagauaucuuggaaaugugguaagauggccaggcagcccugugaggacacuuacaguuugugaucaggaaauuaaagugagaucaguccagugagaugugugugcuucccagccaaguucagcuggcugggugcagaggugaagucaguggaggguugaauaaaccagguaagcacagugaagugagagggggaaagggaucgaggggcaugcaguggggugguugcaguguuagguggcaggaucuaaccugggguagggguaaagcaaagacauggaggaaguggggugcagggaaggcagugugcucauuagauuggggcugcuugugggcuggaguaagagaggaagcaaauuggaaagauacaaaagauggccucucagccaggcgcgguggcucacgcuuauaaucccagcacuuugggaggccgaggaggguggaucacuugaggucaggaguucgaggccagccuggccaacauggcgaaaccccgucucuacuaaaaauacaaaaauuagcagggcgugguggcaggugccuguaaucccagcuacucaggaggcugagguaggagaaucacuugaaccugggaagcagaggcugcagugagcugaaauuguaccacuacacuccagccuggaugacacagugagacuccaccucaaaaaaacaaacaaacaaacaaacaaaaacacaaaaccacaaaaaacaacaaaaaagauggccucucuaguggacugaauaguggcccucuaaaaugcaugucuauauggaaccucagaauaugaccuuauuuggaaacagggucuuugcagauguaauuaguuaagauaaagucacacuaaauucagugacuguaguuucuuguuuguuuguuuuguuuuuugagacagaggcucucucugaugcccaggcuggagugcaggggcaugaucucagcucacugcaaccucugccuuccagguucaagcgauucuccugccucagccucccaaguagcugggaccacaggugcacgccaccacaccuggcuaauuuuuuaauauuuuuaguagaaacggggcuuugccauguugaccaggcuggucuugaacuccuggccucaggugauccacccgccucagccucccaaagugcuggguuuacaggugugagccgccaaaccuggcccacuuguucuuaugagaagacgggaggacacagaaggagaaaggcugugugaccacacagaggcagagacuggaguuaugcagccacaggcagggcaugcucaggauugccgggagccacuggcuaggaagagacaggaaggauuuuucccucgaggcuucagagagagaacgucucugccaacaucuugauuuuauacuuguaagguuuggaacugucggggaauacauuucuuucuuuucuuuucuuuuucuuaccuuucuuuuucuuuccuugcucugucacccaggacagagugcaagggcaugaucauggcucacugcagccucgaccuccugggcucagaugguccucccaucuuagccucccgaauagcucagacuacaggugugcaccaccacacccggcuaguuuuuaaauuuuuuuuguagagauggggggucucccuauguugcccaggcuggucucaaacucuugggcucaagcgauccuccugcuucggccucccaaaguacugggauuagaggugugagccccugcgccuagccagagaauacauuucuauuguuuuaagucacccaguuugugggacuuccugcgacagccuucagaagcuaauacaaccagcagcuuccuguucagugggugauuccugacuugguguggcccucugugguugugaaagaguugcucuuuguagauccacuuggcuguggaucacauucaggccugggucucacgaacagggccugccagcacaacugcuagcauuucacucaugacacagcuugcacaucaggguguguuuaacagugccauaggggcccccucauucuuuguggaacccauagcauucuuuguggagcccguaccauuguuuaauccucugcagcuuccugccacauaaaggggagguuuccugcuugaauauucuucugcugcaaggcacagaggcuggcugucaccauggcuuaggcugguuuccucugacccaucccuuuagccuaaagucugaauagcagaagacguucuuuguuaucugcaggcugauucuagagcauccacugagaauguaauaaguacuuguccagaguccagcauugcaaagggguaugauugaccccgacuuuuucuccugcuuacugccauaaacaaucaccagccuaaaaugcuguaauuauggcaaggaggaaguacaaaucaccagccuaaaaugcuauaauuauggcaaggaggaaguaccacuuaggcccaggaugauggaaggaaguucgucuucgcugcuuggaggaacccaacagcugucagccccagccauugcucgguccaggacagguuuaccgaggggaagcgccuggcccccagugcuuccccgaggcuggugccaagguugggaggagcaccccuucagccaucuggguguucuuuccugagaguuguucaguaguuuuuccaaaugugaaggcacauuugugccugggauccuguuccccuucccauuuguuuacucauuccacauuuaucaagcacuuucuauauacuuuguguaaugaguucuguaaggcauggggcagaaacaaagaagcaaaggcaagcuccuugcuucugaaaugccugggaguaggggaagccuauggguugacaagcaggugcaagacuauguggugaggacuagaaagaacaauguguggcggguaggagagagcgggacuaacuccaucuggaagagguggggagggcauguuggaagacaguaaguuucaucugaaacuuaagaaggagaggaacuuaccugguagagaguaggaugaagaagauuccaagagcuuggauccaggugcccuaagagagacagcagguaagcccuucuuuugaagucucuucaagaauaggcaagaggagguccagaucaucuugcagaggacaaagauuccuuaucuuugacuuccaugagguuuucccaguagccugaaaaagauguugagguacuaggagcauaacauguccuucaccuacagccugguuuuaaacccaguuuuauaccagagaggcagugugaaaacuugguccugguuuuagcucagcuucuaauaacuuaaccacaggcaaguugccuuagcuuucuggaccucaguuuuucugucuguaaaauggggugaaggguagguuggaucaaggaucucuaaggucccuucuaggacaacauucuguggguccauggcuacuugaaggaagugugaagugaggaucuacagaguguugagucaaaggaucagaggacagaguagggagucacacucagugaguaggagacaaaaacaggggcccacagaagaaccugaaaaagcagaucgggggaggagagcugcaaugaucuaaaaauauguauaugagcacugguguccaaggcuguggaagauccaauauggagauacagaaaagggcacggagcuuggcaaagagaggugauugacuuuugaagaacagaagccaggcuaggaugggcgaagcaugaaugaauggaugaugaggagcagggcccacccugggcuaaauugcaaagcagugcauguggaggcccccuuuucccuuguggcugccucuuccucacuuugggaccccugccugcugugcugcccauggacugcuccagugccccauccccacaccccccauagcugguuccaggaaguguccugugcuccagaagaagccccuuccaauugcaguggucugaaugguugugucccuccacaauucacacauugaaauccuaacccugaacgugaugauauuaggcagugaggccuuuagggaggugauuaggucacggggccagagcccucaugcaugggauuagugccgugaucaaaaugggcucaagggagcuccuuugcuucuuccaucaugggaggcagagaaggcuccaacugcaaaccaagaagugggcccucaccagacacugaauccgccggugccuugaucuuggacuuccccaccuccagaacugugagaaauaaauuucuguuuucuaaaagccacccagguugugguauuuuguuauagcagcccaagcaggugaagacaccaaccaaaacugauuacacagcaaaacuaaaaaauaaacaguuaauuuauugggugcuucuguaugccagauacugugcuaaaggcuucgccuauagauaauuacaccuuuacaguaacccugugguaaauacuauuauuuuccccucuuuacaaaugaagaaacugaagcuuagagaaauuaagaaacuuacucagacucacauagcucgaaaguggaggguggggaguggauugagccuaggccacguggcuucagagcccaagauuucaagagcuaugcuacauaguaaucugaugaaacucauucauaccaggaugugaaugacugacaggugacuguccuuggaaauuaaaucucuuucauaaucuugcaucguagagaaggaguuucagaauccaaaagcaggguucuagacaggguggcuugucuucuaggcucucuuagauuauauuguacagauuaccagaaguucuaacucuuuguguauuaagaaaagaaaagcuaaaguuugucagcgaguuucaaagagcucgugaauaaaagaaagaggagagguaguaggcagaguugauuuuugguuuuugguuuuguagggagagaaagaucugugucuacuugaaggcagaggaaaagcugcaauagagacggaacccccagagguacacaagagagaggagacauuuggggagccugaaaauaaucaggagguaguaggaucugcaaauauucaggagguagcaggaucuaaugcauggcagaggguugagauuuucacucugcugagcaggguaaaccuuuuccugagugcagagggaagguagagggauaaaggaggggacacguguguguuaaagugacaaaccaggaggaggaaggaagagcaagaugaucaccuuggugcuuggcaagaaaaugaggagaguuucucuucugccauuaggguggaaagagcaguugugaauuaggaggcucaagcaggaaacaguacaaauagaucacgagcagaucucuagagagaagaucugcagugggagggauggaguugaagcuugucauugcaagacugcaguguuccgugauguuucuuccuuuuuccauccuaacacuaaugagaacucagcaaucccuggcuggguccaacggugccaucuccucucauugucccugugaucucugccauucucuuggucucuucgaaggcaaccugagcaacagccccgauguacugugaacacauuuuccuaaagaauuuuuccaagucacaagaagucccaagucagugucaccaagaggaucuccuucaccugccacuuuaggaacacuuaaaacauaauggcagacaaaaccguguccuggaaaccugagccuuuggacauuuacaggauaagggcuaucccucacuggguuucuuucugauauuuuaggagauggggaagaagaugaaggugaugaagacagguuggacaaugcagucaggggcccugggcccaaggggccaguugggacggugucggaagcucagcuugcucggaggcucaccaaaguaaagaacagccggcggaugcugucaaauaagccacaggacuuccagguagcaacggccuggcguucugcuucuuuguuuaaucuuuauauugcccaucuucuggcaauugcagugauguuucaguggaccuauuccaauggacaauggcucaaccgguaaagagagaugucaguguauaaacccaguaagaaaagcucuccaucuuucuucugcaggcacaaguggguuuagucuagccagcugauggucuccagagaaauaaaacuauaauucuccuucccuuuggcagaaggaaagagcuaaucaaagaauagaagcgcaaauacuguguuuuucgcagcucugggcccugucuuagauuuggaaggcagcuauggaguuaguucaucacuaggcucagcaagaccaggugcaugacuggagucugagcagugaccuccaccugcccugcccuuucccaggccggcuuugaaugauuucaucccuacagcugcucuuggucucuauaacccaaccccaguucccaucuugggaaugacccuagguggcuccacccaauugguagcaccugguauagcacaaagcugcccuggccugguguuagcaauccuaauaggugaaggaaaugaagcaacaccugaggauccuaaggaucccacgugcugggaaagguuggguaaccaucccccuucugugcugcagauccgcguccgagugauugagggccgacaguuaagugguaacaacauaaggccuguggucaaaguucacgucuguggccagacacaccgaacaagaaucaagagaggaaacaacccuuuuuuugaugagguaaagggguugagagggcauguuucugcucaugagucccacuggggagggaaacacgggagcagcuucacuggugaagacaccacugaguuccaaguagagaucacaggaacaaaacuaggugugaccaugugaacgcauggcagggucuuggaaaaagcccuggaguuuaagcuucaugguaaacccacuucugcuauuggaaaaggagaaauagguaaguaacaaauauagcuuuuuuuuuuuuuugagauggaauuucgcucuuguugcccaggcuggagugcaguggcgugaucucggcucacugcaaccuccaccuccgggguucaagugauucuucugccucagccucccaagucgcugggauuacaggcaugcaccaccacaccuggcuaauuuuauauuuucaguagagguuucacuauguuggucagucuggucucgaacuccugaacucaagugauccacccgccaacaaagugcugggauuacaggcaugagccaccgcgcccggccagcauuuauuuaaauaaaauuguucacuugggacaaucuaaaagauaucuagcuuuuagauaucuaaaagcuaaaugaugugaagauccaaggcuaagcagguauggggguacacaccuguaaucccaacacucaagaggcugagacgggaggagugcuugagcccagauuuucaagaccagccugggcaauauagugagaugccuuuaaaaaaaggaaaauuaccugguccccucugucagugguucucagagaugcuguugccuuucugguguuuuugugauaacuucuugaugaucccuucgacccuuaugagagaggacaugaugucuccuaaaucuaccuuugcuuauucuaauuagcagggugucucugagggacaacucucgugacuaauccaguuuuuuagaggugucaaaacguacuuggcugcaaaaauaauauauguuaaaggaaagcaguuauuagcacacaggggcuuuguuuguuuugccccccauacugauaaauuuuuuuuuuuuuuuuuuuuugagacagagucuggcucugucgcccaggcuggagugcaguggcgugauguuggcuuacugcaagcucugccucuuggguucacgccauucuccugccucagccucccgaguagcugggacuacaggcgcccgccaccacgcccagcuaauuuuuuuuuuuuuuguauuuuuaguagagacgggguuucaccauguuggccaggauggucucgaucucuugaccucgucauccacccaccucggccucccauagugcugggauuacaggcgugagccaccacacccggccuuuuuuuuuuuuuuuuuuuuuuuuugagacagagucucuguugccaaggcuggagugugguggugcaaucucagcucauugcaaccuccaccucccaggcuaaggcaauccucucucaccucagccucgcaaguagcugggacuacaggcacacaccaccacgcucagcuaauauuuguauuuuuaguaaagaugggguuuugccauguuucccaggcuggucucaaacuccuggccucagguguuccaccuaccuuggccucccaaagugcugggauuacaggcaugagccacugcgcccugccucccauacugagaacuuagccuguucuacugcccucuuuuauaacacuccucaaaaauacaugauaccuugacaaucaucucaaaugccacaaaacuccaugacugggcuguggggagaaaugauauauuuagggaacuuuucagagucuuggccaacugugcugaggagacacauuucugggauuccucaggccuaugucuccugcucuguucuccagcccaggccugucuuaccacacuaccucuucauucccuacggcucuaaucccagcucuggcguuuguccuuuuuuuuuuccuacuucuuuauucagaaaagaaaugauuucuucuaugccgcguuucuauuucuuccucuucguucaaacuggcuuccagcucugcagaagguccuauuuucuucucaccucuaaccucuaaccucuccccucaaaggaaucgcagacgacagcaggcagccaaguacaguaguauacacauucucaugagagguaggggcugcacagagauggggcacuggaaauggacuucagggaaggcagagagauucacguuggagggcaagacuggauggguggggaggaggcaagaugcuggauuacuugggccuaacgcguaaacccugucuaugcauugauaaugcaggcuuccuguugacucagcugcauucccaggagcccagcaaacaucuccaccuuccucagaauuuucccauuuuaaugaguuugagggggauuagaccucuuggcaaaagagaaguccaguacauuaaucgauaaaaaaauuuuacgggauaggagaaacaaaaguaagaugauaaaaacaaauauauauauauauauauauauauauauaaaagagguuuacuaaaaaaauuucuagccuggccaggcgugguggcucacgccuguaauacuggcacuuugggaggccgagguggguagaucauuggagaucaggaguucaagaccagccuggacaacauggugaaaccccgucucuacuaaaaauacaaacaauuagccgggugugguggcacacaccuguagucccagcuacucaggaggcugagguaggagaauugcuugaaccugggaggcggagguugcagugagccaagauugggccacugcacuccagccugggugacagagcgagacucugucucacaacaaaaaauuagccuggcauggugauggguggcuguaaucccagcuacucgggagguugaggcaggagaauugcuuaaagccuggaggcggagguuacagugagccaagaucgugccacugcacuccagccugggcaacagagagagacuccgucaaaaaaaaaaaaaaaaaaaaaaauccuagccuguauauaucuuuuuaaccaaguaauauuaaacuuguuaucaccaauaauaggaacaaaaaugaugugguguccucaugugagauaauggaaguaaucaacaucaccugugucaagucuugucaaauggccaauuugcauccgacagugaggaaacauucacacaaaucuagacugugggauauucuacaaaacaacgggcaugguggcucacgccuguaaucccaguacuuugggaggccaagccaggaggaucacuugaggccuguaguucaagaccagcccgagcaacauagugaaacuucaucucuauuuaaagaagaacaaaaggcaagaaaaaacacaagaaacaaaaaaggaaauagcacuguucuauauuuuuauauagcuuccuuuuggaagcugaagagacucaaaaacgaaaugcaacguaugauucuugcauagauccuagauuucuuugaaaagcuaaaguuuuuuuguagggaugauuggagaaauuugaaaauugacucuguuagauguuaaauuucuugguuaugauaaugguguugcaauucuauaggaggauguccuugcucuuaggagaugcauguaaauguauuuugaaggggugaagugucaugaucucuaaagcuuucuugcaaauaguucaguuuaaaaaagagauaaagcaaauguccaaaaauggaacaauuggugaacauaggugaaaggugguauuuauuuuaccauucuuucagcuguccuguagauuagaaauauuccuaaguaaaaaguuggaggaaaaagucucaguuggaguaaguguucaaucuuuuaggauuaacauuuauuagccuaacaugguuaaaccuccuauauaccuaauauucauaucccaagaaucaaccuucuuaaaauuagcuuuuacaauguggucaauauugacuuugcugaggcacuaacuuaaucuaaugggcaaaauugucuugaaaggugcuuucuuggaguaaaauuagagucacuagacacuaauagagcuaaagauauuagagaaauuuaaaacacacuccaggucaugccagcucuaagcgcucauuuugauaagcauugcagcaugaagucaccuuggaucuuuuucccuuuuuuuuuuuuuuuuuuuuugagauggccucucacuauauuguccuggcuggucuugaacuccugggcucaagcacuccucccaucucagccuacugaguguugggauuacagggguguaccccgauaccugcuuagcuuuggaucuuuacauuauuuagcuuuuagauaucuagccccaggugaacaauuuucuuuaguuaaguaaaugcuauauuuguuacuuacccuuuucuccuuuuuccaacaugaagaaguggguuuaccaugaagcuuaaacugcagggcuuaaacuccaggccuugccauguguucacauggucaaaccuaauuuugaauuuguguuuugcauuuuuuaggagggcccccaaaauuauaguaucagauuccccuaacccgaauccccuguuaacauuuaaacaucugcucuauuguuuuggcaguuguuuuucuacaaugucaacaugaccccuucugaauugauggaugagaucaucagcauccggguaagggucagcaaguaggaagguacugcucacucacugccaggcaaagccaaucauuucuucacuacucuucuuucuuccagguuuauaauucucacucucugcgggcagauugucugaugggggaauuuaaggugagugacaacagucugcuucauucaacuuacagaaagaugagaacuuucauaauagaaaucugauuccuauguacgcaucuugguggcaucuugggaauguguaaggguucagcaugaugacacuugcugaaggcugcuuggggcuugucuauuuccaaaguauaacagugaacagagcucucaaagcaagaugcccugaagcugccauaucagggcccuucccaggguuguaucuggauggaagcaaauccacugccacaaagggaagggguguugaccauggcaagaaguccaccaucuaccuccacuuacugggggccccaaagcuccaucugcaaagccaauuaugguaaauucagagugugaaaggaaagccaaacaaggcaagagguucagggugcuucuauaaguagcucucacuggaaugaaaggacaaauacuugguuggcuucuucccagcaauucuacauggaauaggcugccucuccaagaaaggagcaccagucacuagaaguccuagaggaugaucugggucaggcagaccuguguucauacccugucugccaccaaguagccacaugucccagaggaacucaaucucucugauccuuaguuucuucaucuguaaaaugggaucauugagaaaauuaaaugagauaguauguguaaagcaccuaguacagcaccuggcacauugaagugcccagucaaugguuauauuaauaguagcauuagcuggaggagaaggaggaggaggaggagaacuggacaggaaauugggccaggugaauuucuguaggaugaccaauggucccacuuugccugggacuuuagugguaaaacugaggauaacccaggcaaacugggucauauuggucacucugcuucuguggucccuuccagcccuaagacuagcucauucauucaauagugacuuacugagggucuuccaugugccacacaucagacaaggcacuggggauacagagaggauaagacggaaauguugggucucaaggaaauuuaaguguaaucaagacaugauauuuaaauauaaugauggcuucuuuaaagugacuagacugauuuuaaaaucuacuuagacuacuuucgauuauuguuuucccagauugauguuggauuuguuuaugaugaaccugguaaguaauguucuccccaucaauaugaagucuuaaauucauuccuucuaacucugaagaugauucuaagaaucaagacaauuugggggggaucaaagaauuaaaguuaaaggaauuuuuuaaaaaauauuuucuuaaugagggagaggagaggauacuuagugggaauaaauaacaguagcuuagaaaaaaugucuaauuuuuuaucuuaacauucaaaauagaugauuucuauguuuugugaggauauuuugaucuuaucaaaauuaaauuauaaaacucguugguacaacuuagagagucuuguuugaguuacacgaggacagaauggugggggugggguguagggagaguacaaaacagaagacgugaaaguggacacucaucuggggaauuuggugugucgugaagaggcuuccaagaaaaugcagcuuaucuuauggcagaggaaucacagacuuaucaguaccuuuuuagcauguccauuuccuuuuacuccuucucuauuuuaggccaugcugucaugagaaaguggcuucuucucaaugacccggaagauaccaguucagguucuaaagguuauaugaaagucagcauguuuguccugggaaccggagaugagccuccugugagucccuacauucucuacuuucuacacuucucacuaaaaaagaaggccaagaguuaagcaugugggcauggguaauugugaaauggagcacagcuucccgucaauacccucagauucccccuauucuucagaagcuguucuuuucuucaucauggaauuauuguucuagcuuacuuaaacucuuaucugaugucuaugagugagcauuuaauugagaaucgaugaauguguuuuuacaacguccuugccucauuagaaagacugcuuuuaucuagaaagcaugaccuacuugcagaauuaggcauugcuaccuaaauaguuagugauuauucuaggaaacuggguggcaaacugcagaauauaaguggccagagagaaguugaagggacaucaggaucacacacacacacacacacacacacacacacacacacacgcacaggcucuuacuauuuggugcucauaaaaugacagaaugauacaaaaacaugagcauugauuuuguggagcaguuuugagguugaaggaaaacugguggcugauggcaggcugaacucuuaagccccaaacacaggaaaucuuaauggaaacgauucugaaugguuucauuuuauaagcauuaauuuggcuuuuuccaagugcugcuuuucuguauguauaauuuaaaucaugugccccuaauagccugagagacgagaucgugauaaugacagugaugauguggagaguaauuuguuacucccugcuggcauugcccuccggugggugaccuucuugcugaaaaucuaccgagcugaggacaucccccagaguauguacugauuuaaucuugccccagaauuguugauuaugugugugaugaaauguguuaaaaaucaaacuuuaauagugauucgugucccuaucguauguuuuucuucugaaagggcuucaugggcuuauuuucauucauucuggcccaguugaaagcuaccugagcaggcucauggcacagcuaguugguugcugaucauguuccuuguugaguaccugccuuuggcccauuugacucucucucuugcuauucuauaucuucucuuuauucuagaggaugcuaaagagauaugagcagucagcacuuccaaccccuuuuaucccaaaugaaaaugugaacuguuauuaucaaaucaagguguuugcuauccagcuauaaaaaaaaaauagcagaaauuagcugggcaugguggcgggugccuauaaucccagcuaccugggaggcugaggcaugagaaucacuugaacccaggaggcggagguugccgugagccacaccacugcacuccagccugggcaacagagugagacuccaucucaaaaaaaaaaaaaaaaaaaaaaacaugcugagcaaaggguaguaaugucccaaugacuagaagucugccacuauuguauuaugaaauauauucagcaagagacugguugcauuuaagggaucgcuucuagugauuccauuuauaggaacuagugugguuaucccucugucacugcugauggcccagccuccuauuugccuugcugggccugucugguuccugcugggcucugggacaugggacccuucuccaaguccccaggaggcugcacucacuauacaggccauggaucucuucaggauuugcugcuuuucuugggaauccuuuuccucuuuuaagauccuauggucuuaaaagauaguauuguagggccuccccauacccaccuuucucucaaaaaugugucaaaugggcuggaggcagugggucaugccuauaaucccagcacuuuggaaggccaagguaggagcacugcuugaggccaaaaguucaagaccagccugggcaacauagcaagacuacugucucuauuuaaaaaaaaaaaaaagaagaagaagaagaagaaagaaauacauaaaauaagguaaauuaaaauccugaucucuauuuacuuuuuagcuuaacuauagauuguaguugauuaaauauauuauuugugauuaugucaaauuuucuugaauuucucugaaacagacuaggacuauaucauuuugaccuagagcaccuuucucccaauugaaagcaggccugaguuugagaaucaucuuuuacucucacugaaugaacuuuguuguauuuuuuuuccuccauaaaagaucaaguuuuuguuuuauuuuauuuuauuuugagauagagccucacucugucaccuaggcuggaggcuggcauauacuggcuugaucuuggcuaacugcaagauucaagugauucucaugccucagccucccaaguggccgggauuacaggcaugugccaccacaccuggcuaauuuuguuuguuuguuuugagauggagucuugcucugucaccaggcuggacugcaguggugugaucuuggcucacugcaaucuccgccucccagguucaagcaguucuccugccucagccucccgaguagcugggauuacaggcgcgugccaccacacccagcuaauuuuuguauuuucaauagagaagggguuucaccauguugaccaggauggccuugcucuucugaccucaugauccaccagccuuggccucucaaaguccugggauuacaggcaugagccacugcgccuagccuguugcaacuauuuugauguauaagagaacuuuuaaaauuuugccaaauuucugggaauugaauuuaauuucugcuguauaacuauuaccuuccaguggaugaugccuucucacagacaguaaaggaaauauuuggaggcaaugcagauaagaaaaaucucguggauccuuuuguagaaguuuccuuugcuggaaaaaagguuuguacaugaucuaaaugcagaugcugcuaguaauaaauaucuaaaacuacugugcuuuccuuggagugaauuccugcuuacucuuuguuaaaauagcccccugaugagccaggcacucugagggaacacagauuaucugagucugaacacgccagacuucuccacagguuuauuuuggaguggaaaguaugcagaacacaaauuagaaaauucaaucuuuugagagauuaaaauagggaaggcuaccacugaauuucuggaauugcuuuucagguccaaacguuaucuuaaccuuaggcaagcucucuggccagccacacccaucccugguaaauguuguaggacagagacccccccccagugcccuguugccccuuccugucauguuucucaccuuccaugccccaguaaacuguugaaaccagagaaugggucagggaagccccaucccacuccccugaaaauaucugggagacucuugguguagggacagcuauaaccaccacuuuuaccuacagagauggucaaagauuggagaguugagaguugggugagauucuacaguagaauaauagcacaucauggacaguuauagacaaaaagaacuagcaucuuuuauguguucgaaccauauaauuaugaaagcaagauucggcaaaccacauacacauacacauaugacuggugcuuuuuucuaaaagauucagugggugugguagaaaagccuucagcucuggggcaaaaugaggccugaauuaaauucaggcuuuaccccacuucauaggcaggcaaaucguuuacccucugaguuuccauuuccugaacuauaaagggagauaauaacaaucacaggauuguugagagguuugauucauucaaaaagucauuaaguaccagauucugucccaugugcugggauauagaaacgaacacaugggaauagaagagacagacaauaaacaagcaaacaagaaacugaauaauuuuaaauggugcccagugcuacaaagaaaacaaagcagggacaagaagugauuggugcaggggaggaguguuuauccagguuaucaggugagacuccuggagaaagugacaguugagcagaggccuggauaugcagagauuggggagggaggcauccaggcagggagaagggcgauggaagggccccaaggaagaaaauguuagcagggaaggccugcccauguggcugcgguagagccagcaagcggggaaaacuaggaggucagugagaaguaggguugggacaguagggcuucaucagcccagggaaggauuggggcuuuauuugaaguguacuuugagggcccccugaagauguuacacagaagugacaugaaagucaggaggcaagagaggguguggaguucagauagacaaccgcagguguccuggggagaaacauuucaggaucagcuugaagacauuccaggaucugcuugaagacggaagugucaggguguggcugauucugguucugagccugaccaccugaaugaagagcgauggaaagacuggaacaagagucaguuugggguagagggcagggaggcuggcgggcagggucaaaagaucugucuggauguguuaaugguagaugcuucccaaacgguauguaacaaaugcucuaucaaccuuaucucuugcuuuuuuacauuaaucuaauguuagaagccugacaauugaaaacuaauuaaaaaaagguuaaaagcaagcuccuagugccucgaaacagcaaugauuaauauuaaacccaugucauauuuuacaaaucaucaagaaaaauaaaguuuaaccagguuccuaaguauauaaguaaacugcuaaagucauaaucuaguaugcauagauuguaaacuuuuagaaauuagaaacuugaaaaccuacacuuuugcuuuggugauuuuacagguuuguacaaacauaauugagaaaaaugcaaacccagaguggaaucaggucgucaaucuucagaucaagguuugacuuuauuuucuuucugaaaaaguaagaauacuuacuuaauaauuacuaaaucauugagaaauaacuacuuuuuucugucucauuuuuuuaguuuccuucagugugugaaaaaauaaaacuaacaauauaugacuggugaguugaaaauacguaugugucuaauucaacauaaaauaaacauuggauauugugaaacauuacucuggauugucucuuucugguauuuugcuuuccuuccagaggagaggauaaauugcuccuggaacugggcguuucuuaaaacaaaauuuaauaauaguguuacugcaaaaaaagcuucgauuauuucgguucaacugcucauaaacaaaagaaggggaacgugcugaaaaugccccaagauaagaaaucagggauuuaauuaucauuaggcuguccagaauagacuucagaaauacagucaagcauuucuugggaagaaucaccaaaacauucugagagcaauucauuguuauuguuuaaaaagaaaaugguaaaacuaccucaaugaaggcaaggaaaaguccuugaaauguucugauagaauuuuuaguagaccagccuucuagcacugauuggccauaacaagaccauucuuggaauguucuaguuggauguagcauucagcaggcacccuuagcucccugacaguggaaacaugacaaauaucguuaccaucaucaugaucaucacaaucauaauuauguaaugugccuauaauugauuaauucauuuuaugacaaugguauugaguguagccauaggcacaucucuuggccucucuguacaauugcaauuucauaacuucagaauaaauuaccuuacuagaccaguguuuccaaagggugacuggaggaccaucuguaucagaaucaauugggauacacuuauaaaugcaaauucuuaguccccacucuaggcuuauugaauuaaaaaugugggcaggagaugagggugagaagucucuaguugauuacuaaguacaauaaaguuugaggcccacuagacgugauuauuucugaagucugggguauuuuccagcucuaacuuuuuuuuaauuguugaaaugaagacauaucuuccuagauggagcucugaaccuuuuauuuuuuauuuuuuuauuuuuauuuuuuacacagggaccgucuuacuaaaaaugauguaguuggaacaacauaucuacaccucucuaaaauugcugccucugguggggaaguggaagguaagucacucaacagaucuagaacaagacuggauacagaacuuuucuccagucugagaaaaaaaugaacugggguagccaccucacaguagguuugguuucuuagaagccaaaugugaugaaccuagugaaccauuucaaugauguuuuggugauggccugcaaaacaauuaaucauugaaguauauaaguaaacugcuaaaaucauaaucuaguaugcauauauuguaaacuuuuagaaaaaaaugaaauuuacaguuugaagauuuucagcuuucuugcucccauccaaaacuucuuucccaauagcgguuuuaugaaauuuuugugucaauacagagagcuagcaccuuauuuuuuagaguggcauugacccaaguccacccaaauauaaaauaauacucccuucucaaccgaaucccuuggcaggaacaguaaggucagaugccaaugaaccauguaguccucacucccuaagauaauguguauuuggucuuuacucugacaagcauugauagccaacacauuguucuuucuguuguuuuccaaacaauuuucuugagaacuauuugccuauaccuggcauuaugguuuugugcauaugccagaaauuguaacagggaaugaaggaaagcaguuaagaugauaagagaaaaaauuaauguuaacacaguaauaccagcagcuuauuuauuuuuugagauagagucucgcucugucacccaggcuggagugcaguggcgugaucucagcucgcugcaacgucugccucccagguucaagcaguucuccugccucagccucccgaguagcugggacuacaggcgcaugccaccacgcccagcuaauuuuuguauuuguaguagagacagaguuuuaccauguuggccaggauggucuccaucuccugaccuggugauccacccuccucggccucccaaagugcugggauuacaggcgugagccaccguguccagcccaggagcuuauuuuuugugaccaaaacaaaaauuauuguaauugccaauagauuaaauauauugagagauuaaacacaugaaacaaagugagagacuuugagacaaaauuuuaucuugggcaacucaagguuccucucauccuuaucuuguuuaaggucuuuuuauagguuuugaaaaaacauuguuaauucaagcaauggauaacauaaauaagaaccugguuauuauauauauacauauaauacuauauauacaugcauauauauauacacacuauauguauguauauauaguauuagauauuagagagaagguaaagaagguauuagagauauggugaagaacauauagauuuccucucuccagaagugaaaaaaaaaagcaaucagaagacgaggugguggccgggcccaguggcucacuccuguaaucccagcacuuugggaggcugagguggguggaucacgaggucaggagaucgagaccauccuggcuaacacggugaaaccccgucuccauuaaaaauacaaaaaauucuccgggcgugguggugggcacauguagucccagcuacucuggaggcugaggcaggagaauggcgugagccagggaggcggagcuugcagugagccgagaucgcgccacugcacuccagccugggcgacagagcaagacucugucucaaaaaaaaaaaaaaaaaaaaaaaaaaaaaagacaagauggugaccaaaggagauauaguacaauuauaaauguacauggcugggcgcaguggcucaugccuguaaucccagcacuuugggaggccaagguggguggauccuuugaggucaggaguuugagaccaggcuggccaacauggugaaacuccaucucuacuaaaaauacaaaaauuagccgggugugguggcaggugucuguaaucccaguuacucaggaggcugaggcaggagaaucacuugaauccuggagguggagguugcagugagccgagauugcaccauuacacuccagccuggacaacagagcaagaccccaucucgaaugaauaaaugaaugaauaaacaaauaaauagcuauauguggcauuauuuuaagcaaaugguagaagguaagaaagagauuccaucugaauguucucugcugaguagcauagugauuauaacacuggagcugcaaggaaggaaauguaaucacagaccuuuccuuuucucugcagagaauauuuauaugguugcuagaauguaagcacuauuuauuguauuuugauuuuuaaaauuuaaccuauagccaaagcucugaacaaaguguagaugucaucacccauuacaguguaaaaguguggaagauagagaugagaagcagaaggaggaaggggaguggagguagggcaggggugcuaauagucucuucucuucaagucaggaaucuaaauaugacuauagauggaaucacaaaggugaccauuacacgaaauaaaaaucaugcuggaacuauauggggggaggguaaagaugacugaaauccauuauucaugagaagucauuaaauaauaucuaaagauaauuauucagaaauaguggcauaagcauuuugcuuagugacauggugguaacauccagaagaacuaaaaacagagauugcuacaagcaguuuuagcuucugucucuggggccucucauugcaggcccugcagaccaugggguuacagggccuuaaaauaacaacgagcugucaacaucgcccuccccccgacaaagaaacaaaccaugcuuucaaucaaauaaugugcaauaaacuccaggccuuugcuuacacagccucagaccacauuuacuuggauuuucugauguuggucccaacuaagccguaagauaaguaaauguuuuauuaaaaacgugaaaugcugguaacuucgccaggcccccucuguccccgggaagcuagcucuucugcuuccuggcugccuuggugcugggugagauugaguuauucauguguggugguucugcccgggucauuuugcauuuaaccgaugagaauuguauacauuacaaaagggucauaugugacuugggucugaauuugggauuuuucugguguugcuaaaucacauaccuggcacuggauuugauuaacguuuucaaugucuguuuuauaaugcccguguucuucuuguuuaaccagucauauuuuuacuauauagauuucucaucuucgggaacuggggcugcaucauauacagguuuaugcuucguaauuuugcucucuguuauaucuuccuagcuaauauuaucuuauuaagaauguaucgacugucuuuagaacuuuuuuuugacauuuugcugucucaacauaguuuugcuaaaguaauaauuuuuguguaagugccauacgguuguccugcacggcuaagcuuaaaagaaauaugcuaaccaggcuuugcuccaugucccaugcuuucagcuaaaugcacaccaucguauuuggcuuuauugcaaauaauugauugugagauauaacauuuucuguuauuguuuauguucaguaaguagagaaauggaccacuaaaucaauuguucugaaauguaucaaguaacuuucccccaauuucaacgugaaucucuagguugaaaaauacugaacguuuuuuacuuugcacccugaagaucuucaccucccccaaaaugagggaucauaacacauucuuugguuugcacagaacucgucauuuuuugcaaguuugcucaauacugucacacacuugaccaucacaauucuccuagggcagauguuuuuguuccccuaauagaugaagacucugagguuuagagagguucauuaucugucagauaagcaugauucgcccugccauaauaaucucccaggguugugguaagaagggaaagagauauugcaugugggaaagcuuugcaaacucugaagcugugugcaaauauaaggugauaucauguaauuauguaauugacacaaugcccaauucuuauuugcuuuaaacaaucuauuucauuauaaucagacuuuauaugaauauuaaguaguccuuagauuugcaguggacuuggcagaugugcaagcacuuuauuccuuuauuuguuuaaccaaucaaugaauauuuauguaguaguaucacaugauagaaccaguaguagguguuuaggaaaucaaaauaaaacauacuuaaauccugccacucccccugaaaagugauacuuuagucacagagaugugcagcuauguaggauucuagaaacuaaaacauacaguaauuauuuguaggaauccaaaacaugaaggggauucaaaaagguaaaggaggcauggaaaauauuguuggaaaguggguuguagcuaggucagaggaaauccuugauggccaggguaaaggauuuuuauuuuauuuuauauaggcuuuucagcaaggacauugggaaguuugauguguccacugugcauuaaacggacuaggaaacuuuggaggcaggaagagauuuagcuuaugagagaauggguuuucuuuuuuuguuucuuucuuuuuuuuuucugagauggaguuuugcuccagucaaccaggcuggagugcaauggcaugaucuugguucgcugcaaccuacaccucuuggauucaagugauucuccuggcccagccucccuaguagcuggaauuacaggcaccugccaccaugccuggcuaauuuuuuuuguguuuuuaguagagaugggguuucgccauguuggccaggcuggucuagaacuccugaaccucaggugauccgucugccucagccucccaaaguacugggauuacaggcgugagccaccaugccuggccuagagaauggguuaucccaggagacuauacuaagaugugagcacauagaaggagaguuccuucuguuaaugcacaaugaaacaagucaaagggguaacauaccagaaaagagauuuguuggacaaaaauaauuaagccccuggcauuaagcugauaugcaguggaucauucuugacaauuuguguuucaaucccuggggaucuuuaacaaaaagcaaauacacaugacagcacagucauucaagggaaccagguggaggagaagugagguuagaccaaaggaauggaugggguaguggaggguguccuuuucugagcuuugaaacucaagaucugggguuaaaucugccaauuugugggacuuuugacaaguugcaucacuucugugggcuuuggcuugcccauccauaaugugacaugacuauggugccauagcuuuaacauccauucuuacuggaauauucugugauucaacuucuuccucuuuuuuuuuuuuaaaucuuuuuugugugugauucagcuucuaaaaauaacuuccuuuucucucugugagucucugcuuuaauucucuauucgcacccaacaucccuccacuaaaacaaaauauucuagcacacagaaagaaguccaaacccuacuuauuagugaucaauuaaucgucuuugcaauguuccauaugccacaauggauaaagccaagccaauuuauauguucauguauaauagucauuccuccuguuuaucugucuugaagaugauaacaugauucagagaaaucucuguuggagaaacuguuggucccucuuuguguuucauaagagauuuccaaacaagugugacauguggcauccuaggcuguuaccaagucucaaccuuaggcugcgugcacuaguuuuguacaucuuaauuuucuaaauuuucauuuaaauguuucuuuuuuucuugcugucuucacugagauugcuauucagcucuuuucugccuguguccaugauuucugucuccccacaaauguguacacgcccauuuaaacaugcagagagcuucacguaaugaaaaugacugugcaguauaugucuauaggguuagguaaauuauuuauuaaugggcaucauucugaugacgcugcuccacauuuaucuuucucccuuaguuuuaagcauagaguuggaaagggccauagauaugaucuggucaaccucaucgauagcaggaauuauccugagaacaugcugaaagauaggcugaagccuuugccucaacauuucuucuaauugucccuaaugcagccugucccauuguuugucauuucgaauucacagaaaguucugccuuauacagagugaaccaaagcugaucucccuguagcucccagcagugguccuuacucugcuucuggagacaaguccaucccucucccauggggggccauucaggcuauugaaggcaacucuuauauuuccccacccucacccgcaguuuccccauuuucagcuauuuaauuauauugcccuuagugcccuucauugaggaguugucuugcuaagaccagguagcaaaaauaaggagcuuaucagaugaccaccagagauagaaagcaaugaaugggaaucuucaugucauuuaugaauaucacauggucuuacaaccacaggcaggcaguuuauuauuacauauaaaauuuaaaaaugucuuauauuuuuaacagcaucugcuagaguuauacuaacuacugaagauuaaaugacacuuuagaagaacaaauaaaguucauaaaauaugucauuuaagugacuucccaaaacaauauaaucuuuugccccaauuggcaauggcauguuuaauacaaugcccauuauaaacuugcaaaaaugugaaggucaacuucaaagucuaauugcucuuuauuuaaauagcauuaucuuuuuauaaaaauaaguuuaucugcgcuacccccaaauguuuuuauuuaauauuuuauguagcaauaagaaaagagaaauauggcaaaccucauggugcuuacaacuugcauuaauacaacuaacucccaaaauggaggaaaauagucucaccuaacuaacuaauaacuaauauuuauuucaauagauugaauguuaaaagccuaacaccucaugaugauguuucucucucaguaaacacaggagaaacagagguaggcuuuguuccaacguuuggaccuuguuaccugaaucuuuauggaagccccagagaguacacgggauucccagaccccuaugaugagcugaauacuggaaagguugguuucucaauuaaggugguuauuaaucagcauugguuaaggugauuauuucuucuuauaaugucugaucaaguauugcaggauagaaguuucauacucccuaagacuuagaaugcaaagauaggaaaagacuguggagaucaucucacugggggauggccaauggccaauggccauuucccccaacuucuaugcuuaugguagacaucaauaaucaaugcuggcucucuuuccuaauaagccccugggcugccuuggaauucuuuucaacaucauauuccaggaauuuaccaagcacuaggcaguggcaugcacccugaaacccuuuauuacccuugaucugaucaauccuuucauuucauagaugaagacauggaagcccagagaugggagaugcucuuuuuaccacaacagaagccaaaugucuuuuagguuaucucccaaggcucaagaaagagaccaagcuagagagaaaaagcccucagaggggaaggguaaaagacuggcuguggagguggggacccuuccguccuuuccagaagguucuauugccagcacugcuggguauggugggagaaguauccacucuucauccucaggcucagcugcacccagaacuucuuccuccuacaucuuccuccuuuacuuccuggcuauucugagacuugcccugguugccagcauggcagccucccuauucugagaagaggagaaaagcagccaaguuaacccagauaaaugcagagcuucccugcugaaguacggugaagggagacuuagagccccauccaccccccaccccccaccucccagccuccacaaacuccuucuggagcuagagcaugguuugaagaccucugaccuuggucacagcuaagaucuuuuucagcccuagcaucccaagguacucuuugagaucuguccuaaagccaauggcucucuuucaaacaccagagaccugaauccagcugggagaguugccgacugauucauuucgaagguuagggccaugggaaggagaaacuuuuugcaguuguauuagccugacuagagacacagaauucuuuuugcuguugcugccuagaggaauaauccuggauuauugccuuucagggggaaggaguugccuacagaggcaggaucuugguugaauuagccacuuuucuugagaagacaccaccagauaaaaagcuugagcccauuucaaaugaugaccugcugguuguugagguaaauguuaaagugugaguaaugcaugguauagaaaaggagaccuccagggacugaagggguagcugggggagucggaaggcaacccaacucacaaugaggcccucaucuggauguuucuacaacagcccuaugaggaucgcuucauccuuugagauguuaauacccuauugaaaacuggcaagaacacugauacccacaaacugaaugaccuguuugcuaacuggcguugggggucauggggaaguggccauaacagccacuucuugcuggcaccaagagcuguaggugccaccucuacucauuuccauuuucagagguggcuggugggccucaggcuucccagcacaggagggcaggugugcugagggcccacacugcaauggcugugaaccccgcuuccuccuugaagacaggaaaucuucccaguugacuuccccaaccauuucugagaauccaggucgaugccuguguguuccacaaaucugaaucauuugccagcacagccagcucauggaugccccucugcccgcggcccuccuugcuggguugcaaaucaccgccagccccccagcugccccaggcugcuguugcccucuguuccaagcacacaggacaggcccugcccugauuucaccacuuuacagcagaaaccaaacagcaacuuuuaaaaagcuuucacuuucaguuuuugggauaagaauacgaaaauacaguaaaaagggugacaacgugguugcgaaauguggcuauucucaaagcucauggggucaggcugguguucugggucccugacagucagccuuccugucuacucgcagccugucuccuuguggcaggacuggguucuccaugcucucccccaaacucccgugguacccagaacacguuuucaucugaguccaggcccaacugccgugaguucuccagcgagccagggccuucucccucuagucgucugaugucugccuguuacaucugcccccuuugcaggaugauugacagggagaauagccacacccuuuaacagaaacuaucccuucuuccccagagcaauguggccuugcucauugacucccagaaggcagccguaucaggagguuagcauccaaagcagucuguucuggauuccucagccuuuacauguugggaacaucugugguccagugcuugagcugcaccaauuucauuccugucuccuccuuugagaggaaaggagcaggcuccugagacugcccucucuccaccccccagccucaggaaggaaccuagcaucaccacagcagcaagccacggggcauccguguaacuucacauggggaaaauaaauaguucuuccccaugaauuacuacagcaaagaugaucauuuguuuuguuuuuuuacuaaagagacacggagccaaaagucaauaagguccuggucauagucuuucuauuccacaacauuacccacucugaaguccaggaauugcaauagaucuugaggaaaaauuaagaaaaggaaaaaagagggcgggagagugagaaaagggacaguuugcaugcuaguuacagccaggaucaugcaaaagaauagccagaaaccacuuggaggccuccguggagacacauggugguucuugacuugaguaguuacagauuggaguuagcucuugaaauauugguuggaauucaggguuauucagaaaugccaccauggacacucaaccauuauaguaccucuuuuauuugguuccaucaccagaauguaauuuaaguucaugcugcuucucuuuguuuuaaauaaccauaguugcagggagaaggagaaagaggcccaagaaaauauuuuuuaaaugcuuuauuaacuggaaugcaaaaccaaauuaguuuucuucacugcaaauaguuaaacacauacaggcaaagaagcuuauuucauuaauuuaguguaaaagcaaaaaaaaaaaaaagucaacaauauauauugcccacaguauaugucaacagaauaaaagaacagcuuuuuauugacugguaaaacagaauucauuuucuuugcucuaaauuaaacacagacagcaaaauagcucaucuuuuuaauuaaauaaauauaaaucaaaagugaaaugaagcaaaaauuuuaaaaaccuaacaguguuacagaauaggagagaaaugaggauucugaagacauagccacacuucaagcaacaggagccccaggagagagugaaaugagcagaucugugcaccugccagaaggacuuaacgaaugcagucaaccuacaaacaugcucaugacccuugucugucuugcaaagguccucuguucuggauuaugugcagcuaacaaaacuuuuugguaaagcuaaagaggcugcaacaaaugggcaaauuuuuugccaaacugccaagugcuccccaucuuucuaaagcagagcugagcuauugcucccggugggccuggucaagagaggcugcagugcaggagggaugcagcagauucagccuggccacuuccacaguaagaaucaggcagacagaagaucaaguguugccaacccaguguuauucuaauacccgcuggcuucuggaaccucugcccugccacuaaaggacuccauuuuuugucuccaggaucaagagucuguucuuggacugcuuucucccugcuccucuuuccccauuuuccuuggaugugaccgaauguauuuugggagcauucuaugcacuugcauucucucuccuacucaacuacaaucuccuugagagcucucauuggucuggcccacauuaagggcucaaaaauauugcuagaaacagcaccuucagguucuuccagcugcuccaucagguaucagcucccuucaguagacauaccgaagguggcaugcugggcaguguucauugguaccugaucuugucacugaccuuuaaugucccaugccuuguguguccacagccacuuucaacaacucuuagcccuuaucgguaucuugcuugacagaaaucaccuccuuuugcaaaucgacugcugaaacucuacuuuauaccaccuuauccacaaggugcacuagucacugaugaucagaaagagagccccaaggcccuaaccccaccuaaguccaauagacuacaacuuacauucuucuuuuuuuuuuuuuuuucugagacagaguuucacucuuguugcccaggcuggagugcaauggugugaccuuggcucacugcaaccuccaccuccuggguucaagugauucucuugccucagccuccugaguagcugggauuacaggcaccucucaccaugcccagcuaauuuuuuguauuuuuaguagagauagaguuucaccauguuggccaggcuggucucaaacuccugaccucagguaauccgccgccagccucggccucccaaagugcugggauuaaaggcguaaaccaccacgcccagcccaauuuauauuauuucauuuucucuuguuguaggcagaucuugucccaggcucuguacuucucugaaugguguuuauuguuccuuccucucucuaccucuuugugcccugagggcagagaggaagugggaaaggucugagggagcggcagaauucucagcugccugaaucaucgaggguagccuggcucuggcacaggugagcagaugguagcguugccccuccuggaaucugggcuugcacagugauccagcggcuccaucuucagcggcuugcucauagugagucccuucucuguugggaauugugcugauggccagaagcccaaacuauugcuuuuagggcucagacucuccagggugaggguccuaucagggauucugugggucauuuugcaagcucugcgugagagcauccaugggguucuaauggaauccuggcuauguggaggccuacgggguagagccggcccagcugggaguaucauccccguaguucccaccccaccuccaagccuccccaugauccuucuccauccugugcagucccuggcuuaacagauggcucuggcuuaaauaccggucauuuucuccuggguccugacucaggccacaaauuauguuuccuauuuuuagcucuuucccuuuucuccuaucauccuaguugguuuacaaagaaguuaugcuguauguaguuaugacuaauccaaauaacuuccuacuuuuucauuuugacacaauucaaacccaaacccagaauuuccacaucauucuggaccacggguauuccagggggcuucgcuguggguaguuaagcagagcucuugacaaguagcgugcacccccaauccucccuuaucaaggugacaguggacuaagcuagggaggcuuuuagacucacaaugcucccgucaaagcuuccucaggucauucaaugugcagcucagguuacaaaccaguguuuagagagacuuuuuagaaagauugaggccuagaggggauuugacaaaacccuauuggaggguucuauuauaccaugucaaaaacuccuuuaaccaaaauggagacucuguaauagaaggauguccagggguucuucaagaccacaagcuucagucacugucagaaguucuuaaaacaguccuuaaaaauuuaaaaauuccagccaggcacgguggcucaugccuguaaucccagcacuuugggaggccgaggcaggcaggucacuugaggucaggaguuagagaccagccuggccaacuaugguaaaaccccgugucuacuaaaaauacaaaaauuagccagguguggugacacacgccuguaaucccagcuacuugggaggcugaggcaggagaaucacuugaauccaggaggcagagguugcaaugagccgagaucaagccacuguacuccagccagggugacagagcgagacacagucuaaaaaaaaagaauuaaaaauuccacuucuggguauauacccaaaauaauugaacgcagagacuggguaccaccagaguucuagaauagacacaggaugcggaucguauugcauggcagaaugcacgggacauaaugaaacacagcaaccuaaaccauugcauggcucuuugguaaaagaaggcacagugccugaagaucuguggagauauggcucauaaagaaggagauaugccagcugagcaaggauuuggggcaggauauggauucaagagauuuuaugugcccaugaaggaaggcuugaagggcucauggucauuucugguaggcugauaggcacucaaugugguuaucguugacccuaucuucaacucucuuaguaaaccaguaauuuaaaaagaaaaaggaagguuuaauuucccauuucaauuuaaaauaaauuuacccaguuuccuuauuuuuauuuacaucugacaugaaaaucuuuauuguuauuucugauuagaaaaucaauaguuuagcugggugcaguggcacgcaccuguagucgcagcuaguugggaggccagagggucacuugugcccaagaagucgaagcuguaguaagccgugaucaugccauugcacuccaaccuaggugacagcaugagacccugucucaaaaaaaaagaaaauagagaaaaaaaaauuaaugcuucauucaaaaucauuaaaaauguauaaguuagaaaguaaaguuugccauaaucucucuaccuucuucaacauaacuacuguuaacaauuugaguuauauuccuccagaccuucuuuaugaauaugccuuuaugaauauuaaaauaucuauuuaauagauuuacuuaaaauauacucucuuuuuuugagauggagucuugcucugucacccaggcuggaugcaguggcacgauaucggcucacugcaaccucuaccuccugaguucaagagauucucgugccucagccucccgaguagcugagauuacaggugugcaccaccacgcccagcuaauuuuuguauuuuuaguagagacaggguuucaccauguuggccaggcuggucuugaacuccugaccucaagugauccaaccaccucgggcucccaaagugaugggauuacaggcaugagccaccguacccagcccaaaaaauauacucuuuuuucaugguugcacauauggaccuaauuaagucuuuuuaugaaccuucauucuauuuuauggauauaacauaacuuguuuaacaaguggucuacugaaagacuuguguacuguuuucauuucuuccccuccauuucaaucaaugcugccaggaacauccuagugcuucuaucuuugcucacuuguaugagugcaagaggaacagcuggguccaagaacauucuccccugucauuuaauucagcacuaauuauuagguguagaauugcgucuccuagaaauccacauguaaauaagaacaaauggccuuucacugaaccuuaugucugcucauacuuuauagaaauaccagcgaaggcggaaguacagccugucugccguguuucauucagccaccauguugcaagauguuggugaggccauucaguuugaagucagcauugggaacuauggcaacaaguuugacaccaccuguaagccuuuggcaucaacaacucaguacagccgugcuguauuugaugguaagauuggcacuaacaguucucuccacacguuuacaaugggugcaccacgggaccggaagcaagcacugugucuucccucuggcacuguucuacgcagccuaugguuaguggaaaggaaaagguugaaugaggaagagagugugguugggguucaggcaccuuaaagacuggccagacccaagaaguugcaggucccauugccagaggcugaaccccaaugcuacccucuccccacccagcuuuaacaaugguuuugccauguaagaccccaagguagccacugugcuaaguucugagcuccgcaaagcagcuccuaccccuacgaagccccaaaucuuucuuaggcugaguaguggaaaaugaaugggacucuggaucagcuacugggaaaucaugcuucuggucuucacucuguuacucaccagcuugugaccuuaaccgugucacugaauucuaacccucaguuucuucgucuucucuggaguugacaugaggauuaaauagcuguauuugaacaaagaugggugagaaacagucccugauuuuaaggagcuuacauucuaguguauaaaauaaaucauaauagaaagcaaaguaugagaacuuccaauaaaacugucaacaaaugguuugagaguacagagaagggagagaggaauacugaucaaauuucccaacaguauugccagaguuuuaacuuaauuuuuguacaagcaguuuuaaaauguaagacauccuaggaaacaucagcuaauaauucuuaaucacaguaaggcucuaguaccaaacccuauguagccagcuaaagcuuuccaagaacagaaaauucuuuucuuuugccccaguuccaacaaaaacauuuauuuagaauaacaguuuuuagggacuaacauguucagucuagcuuccuaugucaucuguauuuucuacuaccacguuaagaaaccaucuuugauguucagaugcauggcccugaaucacuaaacgauccugagauugcugugcucaguuuacuagggugucucagagaaaauuucagaacagccugaaugaaaaagagcuuccuagucuucaguugcuuaauugagucaaauuaaagaaccagaccaccucaagcuauuccccaagccuguggauuaaucagcagcucagucugcacaucucuuuaauaaacaugcugucuauuuuaaguguucaguguucauugacccccaauguuuuauaccaggcaacuacuauuauuacuugccuugggcccacaccaagccaguuguuacccugacuucauacugggaggauauuagucaucgccuggaugcggugaacacucuccuagcuauggcagaacggcugguaaguuucucuuuuucugcauuuccuuuucaccaagcagggugaauuagguauuaggauggaggccaggccacuauaacacaagaaagugcuuaguacagugaucaauaagguaagagcaaugucucuaggaacaguggagguagaugguccuaaguuaguauggagguucagugguauuggagacccaggcucuuacccccgguugcucugccaucacucaggaguuaucauugucugcaugguagaggcagcucacuacuacaucugcccuccagccugaggggagggcugguaaacaguggggagaagaugacauaggccuuucucuugaagggaaggaugcagaagucauacucuuaauuucuacucacuuuccacuggccagaauccagucauacagccacaugugacuccaacgaagguggaaaauguuagucuuaugccugggcaggcauaugcccagauaaaaauuuucuuacuuuggaagaggggaggauuaaaaagguaggagugggguggaacaggaacucauaguuucugccguaauuuuuguguagagagaaugguucauuccaauagcaauaugaaacucugagaacuuugcaguggaaaucuccacugcaggaagagguagcuuugaggaaccagugucugacacauuccacucuugcugcagacuagaggaacuucuuuuguuuggagguuggggauuuccuugggugaaaacugcauacauaugauaucugugauuaucugucuaguugacauuggucaacuagauuggugaggagaagggggauaugucugugauauuucuaauuaagcaaaaauacuaaguuacuugggccaggugcaguggcucacgccaguaaucccagcacuuugggauaccaaggugggcagaucauuugagaucaggaguuagagaccagccuggccagcauggugaaacccugucucuacuaaaaauacaaaagaaauuaccugggcauggugaugugagccuauaaucccagcuacuaggguggcugagacaggagaaucacuugaacccgggagacggagguugcagugagccaagauggcgccauugcacuccagccuggacaaauugagacucugucuaaaaagauaaauauauacauauauauauauauauauauauacacacacacacauacacacacacauauacacauauacuaaguuacuccuaucagguagugcuaaaauccaucuggcauugguguuuugauuucaacauuauguuaauauuaauuuuuuaaagaucuaaucucuaccagggcuggaccaaaacauaugggguuucaggaguauacuugaucuaaaacucgacggcaaaaucugaaauaucauuuuauguuauaaaggcaaucugggaggauaacuauagguuuaaauugacuuaaucauaacuguccugaaaauaaaguugcaauugauaggcaauguacaucucaaaggcauuuguggagaauuaguugcaccuguguucuaauuguguuugagaugcucuucagcaauuuucauccugguucuucuuaucagcucucuccacugaccaggcugccuaaucuggacaggaugguggcuuucccuuuucccugauuaggacuuuugacagucaugguaggcucuuccucaacuucucuguuggcaggugcucaauggaauagaaccauauguuuugagcuuaucuuguacuuucucugccccaguccguaaaucgcuauuucuccaagcagcuuuuuccuuugaguggggaauagcauuuuagaaacaaaaucuggguauacagugcucacuacuacugaaauaucauugcuucuaggccuucucagcaaacgaauuugcacagacacauguaugucuauuuauuucuauaucuaucaauauauuaaaagcuaugacuucauaaagauacuuccaauuccaguccaauaccacaagguuuauccuaguccucuguauuucuaugucucuaacuuucuucuccaacagugagaaaucuggccuuuguuauccucaauauauuuacuccuugguucaauccuaaaaucuguagauaaaccacugugaaaaauaagccuacuaauuagaguucaauauguuuauggguuuuuuuuuucugccuuuuaacaaaguguacauagucaaaauacuguguuccaaaaguuacuuggguuaguuuaguguaauuauguuauucaucugaaauguaauuagaucuguuuuauuucugguuauauuccacuuuaggguucccucuccuaucuuugcugguuucauuuuauuuguuuuuugaauauacaaaaauauuuacaugauuucacagguuaaacuauaugaaaagguauaauggcauaaugaacaauuaucaauuauuuccucucuuuucaaauucuucagcaaacaaauauagaagcucuaaaaucagggauacaagguaaaauuccugcaaaccagcuggcugaauuguggcugaagcugauagaugaaguuauagaagacacgagguacagugaucuuacgccuaucucagaauuuucauccaggcgcuccucccugaaauucuaagacuguaaauccuguggaauuguuucuaguguuugucuaagaagugauuuugaauuauucaaacuucguaaaaaguccucacugggaggagugccugaaucaccaccaggaaaagcuccacuuucugauuuggugccaguucucaaguagccuagggaggcugaggccccacucccagaagcacgucccaggcagccucaggcaagggauggggagcggagaaagaagcaagccugagccucugcuucucaucaacccaagaaugacccccacccuggagaagggugacuucuggcuccuacggagaaugggaucugggaguggagcauugauuuuaccauucagaacaauaucucuaauucauaaacauauuuuuagaaacagcccuuuuacuugcucuuuuacugaaugccugaugaacacuguggccaagccucuguuaggcaaaaccaguagauuugacuugaaccagcggaccuuucauaacugauucggggaaacagcucagaucuuuuagcauauggaaaucaaagggggaagugauucguuccaaacucauuuuaaauauugguuaauaaagcaguggacagggaaguuccgaaagaaaagcauauugaaugcuuuccacaagcaaaaaggccuuuauuccccacacugggcuaacacccuaagucacccugucuucuugugccuccuagugguaaagccagguaauugaaacgcaaccaaaaucaaaguacugcuggggugcuuguuuaaguucugaauguuagagcuggguccuaagggaucauguccuucagucuccuuaucuuguaaaugagaaaacagaggcccaaagaggagaaaugacauaucugaugcccagagcuggguuugccaacucagccccucuuccugccauguauuucacaguagacaucuauuuguucaaggccccaagugugacuuuugaacuaacagcuuccagauaucuuuuugccucaaagucucacucuggggaauuaacccuucaaauacaaugccguaguuauuuaugaaaccaaacagaaacauuugguaauaacuuucauggagaaauugucugugaauuuuaagauuugcagagcaaaccacagucaucuauuuauacuucugauaugagcuguuuuugaggaaucaaauuggaaucuuucuaaacuuuauguaacaggaaauucagugucuaagggaaguugugcuaggauuuucuucauugaagaagcuaggugaaauucaagugaguggaaauucuagguaaggacacugugaaucagagcuucgugaaccugguggaaauccucacccugugucccaccagaugccauggugggaggcaaggccuggcagcagaaggcuaauucuggcucuagcucagccauucucaggaacccuugggggucucaucacaacacauccaaguucucauauugaauggagauuuggccuacaugguugguucauaaaucuuucuggaguucaugggccccuuugagaaucugaugagaugauggugauaauaaagaugacaacgagaugaugaugaggauggcaacauuguuuagacguugcuaugcaacuauucuaaauccuuuccauacagcaacucauuuccuucucacaacagcccuaaaaagcaugucccacauuugaaaauaggaggacaaggaaguaagugacuggucaagacaauagaacuaguaaagaauggagccacgauuaguacccagguuguuggcuccaaagccuauguucaucauuacaucacacuacguguugacacagauagacacaguuuucuuuauaaguuccagaguuucacagaccuucgagacccacccauagauugcuuaaaggcccaggauucccuaaguuaaguaugcuucagcuaaauggucucuagccucccuucuucuuccaucauuuugugguucuguaaaaugauucuaggaagcaaaagaagggaaagccaguuucucucagcugccacuguuuccaucuucuuuccagugacuccuugggccguagguuaaacccuaaggccuaaaauggcuuugggauuuuaaucucccuguauuccuuaugaacaucaagagaccggcaggucugcucuggcaaugccagauacacucuacuccagcguaaaccaggcagugcuuguagauucaguuaggagguugaugugguuugcaagauggaaauccaacauaaauguauuugacaguucugaagccuaaaauuagguuauucuucaaauccucuguuucuuuuuuucuucauuuuucuagauacacguugccucucacagaaggaaaagccaacgucacaguucucgauacucagauccgaaagcugcgguccaggucucucucccaaauacaugaggcggcugugaggaugaggucggaagccacagaugugaaguccacacuggcagaaauugaggacuggcuugauaaauuaaugcagcugacugaagagguaggacuuuuaaacuacacaaacgucaccugauauggaagaagggcucugcgaaauggcaccaagaauaggaugguggaaagagaaucuacuacauuaucuuggauauugagcagcucugacagauuguaaaaaucagggaguaacugggcugaggaugcuaaugaugaaugugauugaaaucagagcaggggaagaauuuugaguuggugaucuuggaaaugucuucaaaaguggacaaaucauuaucauuuucaugguacugucggagaauauuuugaauggucuuugcaguucacaggauuaaaaugucagcuuuggcugggguugggaagaccugaauuugaaccuugguucuaccauguauaacauugggcaaguuauucaaccucucugagccucaguuuccccaucuguaaaauggagauaaacauagcacuuacuaguuagcuuuguugugugaagauuuuaaaaagaugguggguguacaaauguccaugaaugauagacuggauuaagaaaauguggcacauauacaccauggacuacuaugcagccauaaaaaaggaugaguacauguccuuugcagggacauggaugaagguggaaaccaucauucucagcaaacuaucacaaggacagaaaaccaaacaccgcauguucucacucauaggugggaacugaacaaugagaacauuuggacacaggguggggaacaucacacaccggggccugucagcgggauagggggcugggggagggauagcauuaagagaaauaccuaacguaaaugaugaguugaugggugcagcaaaccaacauggcacauguauaccuauguaacaaaccugcacauugugcacauguacccuagaacuuaaaguauaaaaaaaaaugguagguguaaagggcuuagcacaguugagggcauacaguaagugcuggauaaaugcuggccuccacuaacuucgguggacuagaagaaugaggaaguaaggagacgacuccuccugucucucagaaaucagaggguuggguagguagucauauauuuguggguagaaauacgcuugaaaaagcacacaggauuauagguaauuucauuuucuacuuuguaugcuuugguacuuucacaguguucuauaguggacuuaggcaguuuuuuuauaccacugugugccaauagggacauuugcauauccagcucuggaagcuggauuaucuucuuuauaauaaaaaaagagguuuuugaaaacaaaauuaauauuucagauuugacaaauauuggauggugagccagagacucuuuauccuguaaaauauaugcaaucuguaaccuuuugacugcugcugguggcuuucuucaaaugaugcuugagauaagauggaauauuuucuaagauaccucccagagaagaguaggagggacuuuugcuaggugaagcugcgccucugcuucucgcccuucccuuuggccagccacagucugccucccagcccugcaaacucacagugcgguccuagaagaugggagcucaggaauuugagacagagcccuaaccacagcguuucuuugcuaaaugaaucccugaggguccagccugcagggucuucggucccucuccauuuagacuaaccauggcugugcuuccucuuccauccaauccucaugaccagccacagaacagcaugccugacaucaucaucuggaugauccggggagagaagagacuggccuaugcacgaauucccgcacaucaggucuuguacuccaccaguggugagaaugcaucuggaaaauacugugggaaaacccaaaccaucuuucugaagguacauaucuucacugugucaugugaaacacacuaaaugcaaaagcuguauuccugagaagggucugcuuuauaucauuugcaaaucauugaaugguaagggugauugggaucaauucuagcccauccuggucccucucucuggggcaauaauucugagagagagugaucugagguuggccagcuuucaaucaaggacaccuccuuagaugucuuugugacauuaauauaaacauggcauugugaaugcuuugcuuucuggcaugaauauuucacuucuaauauuucacacaaggcaaugccuuucuuccuuucauucuagugaauguuggggaaagaaagagaaagcaguagggaugguucauggaaucuguugcucuaaccuaaugagcaauagauugaaucaauuucaauuugaugaaccaaucaaauugaacauuuuugacaaucguaacuuuagggaagagauucugaauacuuuuagagucauagacucucuuaagugccugacgagagccacaggccuucuccuccagggaaaugcacacugcauguucagcuaauauuuugcauagaauuuaggagcuucauacaacccauaagccuguuccagggccccguauuaagaacucuguguguguauauggggaaucaaaggugagccuagggccgaaacaaagaaaucagaauaguucccaucuauauguuuugacgucaucucucuggccaaccccaacuggaguucuuugcauuugggacagagaaauaacaauuaagaagagaaaaagcagaguuggagagaguguucucuucaaacaaggagauucugcuaacuuuuaauaaauuuacucauugcucuuuaaucaggaggguguaaauagaaucagagugauuaucuucuuucaagugucucuugguagaauaaauuuuacuuaagauagaaccacaauuauaauugaccucagcaguggguggaagcaaacugauuaauaaauaaagcuucacagggggugggagaggagacaaaggcaccuucucuguguuagguuuuagaaguuaguggauaaacagcaaaaugcuuuuaagagaauguuuuguauauuuauugauuuuguuaauacucauuacacaguuuagggagcuguuuaacucaugaguuuuuuuggucuugagaucccuuuauacuuuaaaaaaaaagguugaaggccccagagagcuuugguuuauguggguuauaccuaugaauauuuacuauaauagagaucgaagcugauaaauuuuuaaaauauuuauugauuuaacuguaacaauaacccguuacuaacauaaauuacaucaauuacauauuuaauuuaaaauguuaauaaacuacauauuuuuacaaaauacauuuuguguaaaaaaucagaaagcagagugagacuguuuugcauuuuugcaaacuucuuuaaugucuugcugaacagaaacauaacuggauucucucaucuucuugugcauuuaagcugauggaauuaguuauuugguugaaguauaugauaaggaucuggcgucacauagauauguaguuggaaaagggaggaguauuauaauaaccuuuucagauaauuaugaauauucaucuuugauauaacacuaaacucaagugguagcuuuuaaaagguuaauugcagugugacaucugaaaccauaucaaugaauuuuucauacucagcuacguuaaaauccuuggucuuucuuggacuuugaaugacucuuuuauucaugcaugauuuuguaacauaauguacaaucauuuggaaaauucacugaguuauguagaucacugaguuaugacacauuucaucauacaauauugaaaaaaacacacuuugaaaucacauuuguuaauaucacuuaucagaaagucuauguguugggaagcuaucaaacuuauuguuacagauucauguuuuccaacacucuauuauuuuacgugaaagcuggaauuuugucaucaccaacaaauaaagaguuauuuuccuuggagugagagguucacuuuguuuauguuuaaaaaaaaaauccuugccccauacucaaauuggaauaaccauguuuaccugucaaucgcaguuuuaaguaaaagugauauuucauuuuucaaaaaucuaguucaacuuacaacucaaaaaauugcacaagagcuuuuucucaagacaaccaucauaugccaauaugcagcagaagugcuucgcauguacuucccaucucaucacacaaaauauuaacaagacauguauucaagggucgagauuuaauaagauugguaaucuuggcugggcacagugguguacgccugucaucccagcacucugggaggcugaggugggugggucguuugaguucaggaguuuaagacccaccagggcaacauggcaagacccccgucucuacaaaaaaaauacaaaaauuagccaggcaugguggcaugcaucugugaucccagcuacucuggcagcuggggagggaggaucgcuugagcccuggaggucaagggugcagugagccgagauugagccacugcacuccagcaacagagugagacucugucucaaaaaaaaaaaaaaaaaaaaauuaguaaucauuacugcuugaucaacagaauccuuuuauuuuuauguuuuugcacauaaaaagggaaagauaauucuuuagugaaacuggaauuuuguuucuuuacugagauugcuguuauuauuacuauuacuuuuacuguuacuacuagguccaguuuggcaauccggccuugauuccugcuacagugcaggaguuuuuuccacuguugcuuuugcaccaccagugcaagugucaauacaguaaagaagauaaauaccauguuaguguuauuagaaaaauuguuuugaccuuguggaccuccugaaaaggucucagggacaggcaggaaucuauggaucacacugugagaucugcugcuuuaauugugauuuuaaucuuugcuguagggucaucuggaaauguuuuaacugaagcaaacauaaaauuagacuggugaaagcaaugauuagauguucccucuguuuuuggcuuuaacuuaaugucacagucuuugcugugccuaauguaacaucacaugcuauuguucaucucacaguauccacaggagaaaaacaacgggccaaaggugccuguggaguugcgagugaacaucuggcuaggcuuaagugcuguggagaagaaguuuaacagcuucgcagaaggaacuuucaccgucuuugcugaaaugguaccuuuaaugauuucacuaucuuuucuucuuuggucgggggaggggcacuuuuacuuuucaccuuuauggaaaacauuuacauaccaaaaacaaccacagcccuccuuaccauccccuaaaaucccaucgaagggaucuuaaccuaagggauaagagaagaugcuccugagauuuuauagucaacauuggaacacaccauggugauuaacacuuuugugugauaauuccaagagaugacuuagaugccuuccacuucuaccacaaucuuacuagcaauacugaaaaugggugucuuucuagcucucaaaacuagaacucuguaauaaucuuauugguuccugaugcugggacacuaaguagaguauacacacacacacacacaccaacccaggagaggggacacuugagauguucagaucuugauaagcuuacuugggguagagugucuuaaaaccccugaagacccauuucacacuuaagggaagccucagauaggcuuguccaggggcaaaaaaaaaaaaaaaaaaaaaagcugucugaauacuucuaaaacaauagagauaauuuguaaaaccuucacugagcuuaaaauccauguaguuaaugaaaagucucauuacaauuaaaccaaugaaaauaauguucacaaauguuuacagcuaaaaguagaauuguuuugauuuuuuaugcuauuuuuaacucaagugcuuauugacuuaaauuuaccagauguauucggugggucucuucugauaacuuucagaugaacaccacucuacagauaggccuucaugcuccaagaaaugaggugaagacugucaucauuuuagcuagucuagaaaucuauuccugcuacucacugcuauaccugacaacugguucaggauuguggcucugaucugcuugcuaggcaagacaacccuugacccucuuuuauuuuuacuuuuuauucauucagcaguuccuggcacauaacaggucccaauaccuguuuauugaaugaauaaauaaaugaugacaauuuaucuguccuacuguccacccaaccauucauuccuccaucccuccaucuguccaucggagcuuuuagggagugguggcuucaugcuaggcacugagccagguaaccagcugcugaagaugaugaagaagccaagccugguccucaaggaucucacaaucuauugcaaugauugcaaaacuaggucucuuguuaagcaugcagacucccaggggcacccuggggauucugauuguguagcuuggguuagggauuagcagcaguggugauuccaacauggggcgagaguggggaccacuuuaagaaacaguagaaugugugggaaacauacaagcccuugcagcucaggcuuagaggugcuagugaagauagagggugugcuggaggccacuagggaggcccugaauggaggauguugauguccagccagcuggauuguguggaguaggggcuucauggcauagguaaggagaggcucauuccugccuuccuguaggauuucuuggcaucuaccugcccuccagcucuguggcugggucuaaacuggagaaagcagcccugagcaaugaucgaccagcccagggcuuccuuccacucuuucccauuuuuggauccuucccugcauagagugaagccugagcuucaacuuauguagagagaugauccacucauuucuguuguucugugugacucaccuguugaguaccagcagaggcacauuaauaauaauggaaauuuuacuggcucuugccuucaugugcuaauaauacuagcacguaauuuucuacaaaauucccccccacccccgagauuucugggagucuaugaggugcuucacaugugcuugcucaugaauacuuuuuucuuacuguccugccccaguccugcugacuaaagccacagcccucaaagccacuugaggcucccaucuccacugcugcugauacccucuuguccaugccaagucuuugccuggauuuuacuaaggcuaugcuggcuuccaagcagaacaggaggaaugucuugcucuccauucuguguccaugucaugugaccccaagccuuaaggucccuuaggauaacaguuccuuuaguuucugccugaagcucaucuccccuccaggcugacagccaguaucugagauaagcaccauuguguccucuugauuccaauuuccuaaucaggcccccacucaaaucuccuccuuucuccuucagccaaaagcuuuccuauggcuuaugcaaaucaucuucucaguggauucaucagcagacaauuggaaauucuaguuuggauccaaacauggacacccaccacacuggcaaaucucuacccuuuccaugguugccaugaugaagagcagaccgucauagauuuauagauucuaacuuggaaaggaaugcccuaaaagccagagucugccauugccauucagccugcuucccagagaggccuuggucuccuugccacauuccagauggaauuaaggcucauaacuuuuaggucuaauaagggcuggguauuaaaggaccuucauguuucagauggguuuuuugguggacugccugggaaauggcaacauuaauuguauauuguuucuacagggaaaugugccccaaguucucagcaguagacuuacaaauaaauuuuauaaaaucugcucauucauaagcugaggacuuucauagguauuuaaaagauaagguucgcgaacuaucuugagccauucaaaauuauaauagaagcaacuaggaugcuauaucgcuauuuacaaagcacguucgcaaucauuugcacauuuaaacuccagaaugacucuauaggagagguagcauuauccucagauuucagaugagaacacugaguccuagaaaguugaaugauuuauccgaaguugcauaaucaguaauagcucaaguuagguccauaccuucugagcauaaagcuuuuuucugcuuucuguaguugucuagccuaaguccucgaugaacuugaaaauguaugugcuagcuuuauuuuuugcucucugaugguguuucuccaauuuuaucucuuuuuuaauaguaugaaaaucaagcucucauguuuggaaaaugggguacuucuggauuaguaggacgucauaaguuuucugaugucacaggaaaaauaaaacucaagagggaauuuuuucugccuccaaaaggcugggaaugggaaggagaguggauaguugauccugaaagaagguaaguuguccauuuucugaguaaaaaggauagcaaugaaaucuuucucuagaaauugcuaaauauauuauaucuccgucaucaucuugauaauaguuauguaacacccacugagcagaacuaaguccauugaaauuuguagaaaguugaaagauguuccaccauaagacaggcuaauauaaaaagcaccugguaacuaacauuuugagaaauuauuaugcuugacugugucaggcagugugcugggcacuggcgucaucuuacuuaaucuuuacuacagcccuacaagggaggcaguggcaagaaggaucugagauuugacccuacuugcaagcgaacaaggucccccgucaguuucacagaugccgacacaugacuccuggguuagaauaaaagaacuuuauugcccacagcaauagcaaugccagaguauugauauuugcucgacuuuuucaugcccgaauucccacagaguaacaugaagagggccagaugacacuuguacacacaguggauugaguuauaugagagaacucuaggcuuaggggacuugaaguuuuuauaaugggcaguaagcaggcuggcccuuugcugugcagagagagacuaucuuaguguuccccauauaaacaucuuugagaagauagcccauaacaaagguagucagugccugagcucacaagaugcgcagaaacacaagagacucgcagagaauuaucucccaacaaguaguaguauuaucuccacuuugcaaaugaggaaacugagaucuagaaagauuaaauaacuuguccaaaggcacauugcuugucaaugguauaguaggggcuagaauccaagucuagcgugggcacccaaaccaguacucaacuauuaugcuagaaugucugcaagaaaugguaggagguauacuguaaguggaugaauuucauauaugugaacuauaucucaaaagcuguuauuaaaaagaaagaaaaaaauaaacaguagaaggugguaaagaugguuccccuggagucugggggacacuguagccuguuugcuaaauguugccaguaacauuagaaccagcauucccucuucuugccaucuuaugacagcagccuugaguugggagggaaaaaccuugugaaguugaauuuuaaggccuccaacuagaguuuggucucucuguuguucauuuccuguaauugcauaggcauuagggagggaggagggaagagaaaauacugcucucuuaagacccaaacgugcuugcuugcaugugauugcuuucaauucaggcagcuugcucuggguggaguugggggaaauuggugagggaaaggaaaaugggguuugaauuggcuggaaggaaggaagguuagugaggacagggaaaggguagggaaauugugauagaaaaagcagaaggucaaagcaugucagggcuggauggaauccuacaggcagcagccagggcuuuuauucuccuucuuugaggcccagagacgugaugcccaauucauauaagugauugggacuguuuguuuuuuugauuccuuuccugugcuggauucuaggggagaauacagcagagaaaagaugcagaaacaauaaagggaaaaaaaacccucauuugaguagguaccuggcagaagacuugagucaaaguuggagccucuguaacuuuccucugcggguuguccaaagaauuccaaauccaagaggaaaauuaacauggcagagagucaguauggauuucccaaaugcccaaauggaguuuggagucugaaaugaccugguuuggcugucuaccuaggaacucuccagaaaacuuaaacuccucccuucaguuuguguuauguagaccaagcaagccacauguggcuucaugagaccgucuacacucuguuuuaaaaaauaguggggacagcucccuuuucuuuugaacuguuagccaagaguuucauugagauaaagcugagcagcccggaacugaaacagaaacauggaaggcguugucuguggucucuguaagaagcugcccacaauacuguuuucccagaccccauccucauuacugagaaggagcaaccuuguuaauuugaggaguucuuuaugauuuaggucacauuguuccagcaggcucuuucuucaaaggaaugucaaaagcgauuaguacaaagaggaauuuggagucagaaccaacagggguaaagcgaggagggaaguggugccacucccaggguguagaugcuuccugaguguuggcaaucgccgaggcugccgguuacccggucuccuuggguaacuugagcccuccccgccccacagcuugcugacugaggcagaugcaggucacacggaguucacugaugaagucuaucagaacgagagccgcuaccccgggggcgacuggaagccggccgaggacaccuacacggaugcggugaguggccugcuccggagagaaacucucaccugucaccucugaucgugaucugcggggaacccagcagccaccuggcuugggcuuuaaccucuccuccgcuccaucuuauguucugaagagucuuccacuuauagcuuaagccacacaagugccacaauaaguauuuucuuuagaauagaaaugaggccuauuuaacucgauguuggaacaugguauaguuuggauugugcaaauuuuuuagguaaauuuuuauuauuaucuaauuaggguucuguuguuguuugaggguuuuuugagauaggcucuuucuguuucccaggcuggaacgcaguggugcgaucauagcucacucuaaccucaaauuccugggcucaagcaguccuccugccucagccuccccaguagcugggacuacaggcacaugccaccaugcuggacuaauuuuuuauuuuuuuguagagauggguucuuauuauguugcccaugcgggucuugaacuccuggcuucaagcaauccuccagccucagcuucccaaagugcugggauuauaggcaugagacaccaagcucagccuaguuuuuaauaguauaacaaaugaaauguuucugucuuuaaaaaauccaagcagcauuaaaggaaaucaaaaguaauuauucuccccaauccauauuccacuccccaaagauaaccauugaugucuguuuucuguucauaaacaaggauauaacuuccuuuuucccugccuaaauagaauuguguugcacacacaguuucauagcuuguauuuuucacuuaacaauauaucuuggacauuuuuuaugucaaugcauauagaucuaugagcuuuuaaaaaaugguugcagaauguuuuauuauauguaccuacuauaauucauuuaauccccucuuucugggcauuuaggugcuuuugguuuugagucguugguuuuuauaagcaauguaacagugaacauccuuaaacauacauuuuuguauguuuaugaacguuuaucuguagggaagauccuugcauuugguuggucuagguuuaaaugcauauaaaauuuugauaaaauuuuauaaccuucaaaaagguuuuauaaauucauauuuucaacaaaauuacaagaagcccauuugccuaaauauucaucaucccgcuuuauaaucuuugccacaugaauaagugguauccuguuauuucaauuuucacucucuuaauuuaaaguaaagcugaguauuuuuucauguuuaugggccgccuuuauuuccuuuacuuaggaacuuucuuuucauaacucucuucauuuuuaugcaaacuuaagucaauauuuuagauaaauuuugcuaauuguauauaauuaacauuaugaaccuccaguagcauuuccccauacucaaaaacaugugucugccggguguggugggucacaccuguaaucccagcacuucgggaggcugagguggguggaucgcugaaggucaggaguuugagaucagccuggccaacaugaugaaaccccaucuguacuaaaaauacaaaaauuagccaagugugguggcaggugccuguaaucccagcuacuugggaggcugaggcaggagaaucgcuugaaccugggaggggagguugcagugacucgagauugcaccacugcacuccagccugggcgacagagcaaaacucugucucaaaaaaaacaaaaacaggccaggugugguugcucacgccuguaaucccagcacuuugggaggccgaggugggcagaucaugaggucaggaguuugagaccagccuggcuaacauggugaaacccugucucuacuaaaaauacaaaaauuagcugggcaugguggcgcacaccuguaaaucccagcuacucaagagguuaaggcaggagaauugcuugaacccaggaggcagagguugcagugagccgagauuacgccacugcacuccagccugggcaacagagcgaggcucugucucaaaacaaagaaacaaacaaccaugugucuugaauguuuuacccauucucugauggguucuaucccauguaaccccucauaaagagaguugcaccauuucauaauauuaaguugaaccauaagaaauugcugagauucaaccacuuugaccuauaacaacagcaauuucacaugauugaaccuaguacuauucccuaauaguaaaaacaaaagguaguuuaaacuaauuuuuauuuagcaguugugaauaaauaaagauuagagauuuuucugagugaaauggaucucuaagaugguaucuaaguaaaggugugaaugccauaguuaaaugaggaacuauauuggacccuuugccucuuacugacacuauggcuuaccucucuucuuuguuuuuauuuuuguuuuguaagaacggcgauaaagcagcaucacccagcgaguugacuuguccuccagguugggaaugggaagaugaugcauggucuuaugacauaaaucgagcgguggaugagaaagguaacauuguacaucugugaccugauuggggcucugcagcagggccuugguuaaccaggauaaaguuuccuugggagggaggggccucacuucuguuggucuauggcaggaguccccagcccccaggccagacugguaccaguucauggccuuuuaggaacaaggccgcacagcaggaggugagcggcgggcaagugagcauuaccaccugagcucugccuccugucagauccguggcagcauuagauucuccuaagagugcgaacccuauugugaacugcacgugagaggggucuagguugugugcuccucaugggaaucuagccauccucccucuaccccacaacccuguccauagaaaaauugucucccauggaaccgguccuuggugacagaaagguuggggaccgcuggucuguggcaucugggucaugugguaccgucugugacuaaccaaauguagaauccaagggaaaggcaaguguauggacaagugcuaagugagcaggggguguuaagagugaaaaacaucaggugauggggccaacuggucagguuuugagaugcuuggggauccaggaugagaauuugggagggagcuggagucaagauuuucucuauucuaaccacaccccauaaccucccugggaacaucacauucagggccccccugacgcagaaaagagaacuguaaacuacccuuaaagucuuccuaugcagcaaugaugcagacuacugauauagcuucugauauuugucuuuuucugaaccauaauuaaaguuaagugaacaauagcauuuggaauucucaaaagagaaaaucugauucauuacuuuccuuaugcauggugcauagaacuggcauugacccagaagauuucaaaucaauuauaagcuccucacugaucucgaugcacacaccagaucucagaauaaucguuagcauugacugagcaauagcugugugcuaaguauggcccuaaugcuuugcauaugucauuuugauaguguuaaaauacuguaacccuauaaucccacuuuacaguggggaaauugggccauaggcagguuuaccaacuugcuggaaacuuauuuaguuaacagccaacauguggcgaugcuaggauuugaacccaggcugugcaaccgcacaguccacacgcuuaccugcuguuucuuccugccucuugaacugugcuuuauuccuaagugcacucaguuaccaugaaugacuggaagcauaaaaguaggggagaacauggccaccaaggaggcauuuugaggagcugaaugggaaugaggcuguauucaguuuggcugaauaacccagcaaagugaaaacagccacauauucggucaugauaguacagaacaucugagggcagggagagugaacaaauguuuccucgagguuuauuuggugaucuggcaaaugcaucucuucuggguaaccauucacaaacucuguuccaggcugggaauauggaaucaccauuccuccugaucauaagcccaaauccuggguugcagcagagaaaauguaccacacucauagacggcgaaggcugguccgaaaacgcaagaaagauuuaacacagacugcuucaagcaccgcaaggguaagagaagcaagggaagggagcuggacuggggagcucugcccuccugacuacaaagucccagcuaacuagccauuucugcagaaauuauuugcaaauccagagccuaacacuccacucaaggguucucaaagugagcccaccccagccagcaauaucaucaucaccugggaauuuguuagaacugucccaccccaaaccuccugauuuagaaauccugggggcaggcccagccaucuguaguucagcaaaccauccaggugauucccaggcaggcuaaauguugagaacugcuacagagguguuaaauggaaaugauuuuggcagcauaaucuaguaguaguaauaggucaggacuuggaacaagauguguaaagauucaaacccugacuucccuuucuuucucaucugcaaaaugggaauaauaucuaugccuuuuaauuaggguauuguaagcuuuaaauggaauaauaauaaauuaaauagaacaguaacacucaauaauaaguggcauguauagaaguggcuuucuauaaugcuagguacugaguaugcaucaucuauguucuguaagguuuggauuuuaugcucauuuuauagauaaugcucacagaguuuaaauagacuugcucugggccaaguguuuaguaagugacaaagcuggugcuggaacccgggcuaaguccaaacaggaacucucucuauuccacagaauggguaacuccgguaggcacuaugacauuauuuuuauuagauggugagcuucuggaagcaaagauggagccacagucaucuuuguauccuccuugcuaacucagaaauaugcucccaguaaauaaucuagucaaauaaaugagcuaaugaaugaaugagucuuuuuuuuuuuaauuuaaguuccgagauacaugugcaguacaugcagguuuguuacacagguaaaugugugccauggugguuugcugcaccuaucaacccgucgccuacauauuaaacccagcaugcauuagcuauuuauccugaugcgcucccuccacccgccggccccaguguguguuguuccccucccuguguccaaguguucucauuguucagcucccaccuguaagugagaacaugcgguguuugguuuucuguuccucuguuagguugcugaggauaauggcuuccagcuccauccaugucccugcaaaggacaugaucucguuccuuuuuauggcugcauaguauuccaugguguagauauaccacauuuucuucauccagucuaucauugauggacauuugggcugauuccaugucuuugcuauugugaagagugcugcaaugaaaauaugcaugcauguaucuuuauaauagaaugguuuauauuccucuggguauauacccaguaaugggauugcugggucaaauggcauuucugguucuaggucuuugaagaaucgccacacugucuuccacaaugguggaacuaauuuacacucccaccaacaguguaaaagcuuuccuauuucuccacagccucaccaucaucuguuguuucuugaccuuuuaauaaucucuauucugacuagugugagaugguaucucauugugguuuugauuugcauuucucuagugauccgugauguugagcuuuuuuucauguuuuuuggccacauaaaugucuucuuuugaagauuuaucuguucauguccuuugcccacuuuuuaaugugguuguuuuuuccuuguaaauuugcuuaaauugcuuguagauucuggauauuagaccuuugucagauggauagauugcaaaaauuuucuuccauucuguagguuaucuguucacucugaugauaguuucuuuugcuguguagaagcucuuuaguuuaaugaaugucucucuauuguuuaauuauccccgucugacagggugagaaguuucugaaggugcuugaacgcucuucuuccacacgagggcaccaaguugaagcgggaagaacacugagccaucaguuagaaggcucaggauaugguccaguucuaacgaguauuucugaggcuuugaucauguuuccuaaccugccuuacucuuggcuaugugaaauuuuucacugcuacuauuuauguuacuagagggucagguacaagauuaugcuuaaccugcauuuuacauuuauuuaaagugaaaaaauagacccaacaauaauuacccacauggagcucucacuucucaggucuugaauauuauuccacauuguuuuacguuuauuaaauccagucauauuuuuaagauuuuaaaucaaacuucugccaugaaaaugucagcugcaugaaagcaaagacccuaucucuucuucacuguguccucagccccuaacacgaucccugucacacagugggcacucauauuugucgaaugaagagaauauaacauugaaaacugauaccacugguaaaucaauaguucuuaagcuaaaaaguaccacacgaauuuguuauuaguuauuacagaaauaacauauucugaucacuuaauuaucaguuauggcagcuauuagcucaggcaagacauuuaaaccugggagggggcauuuaauuuuuuuccuacauauguaaaauggagauacuaauguuuuacaaacuauaucacaauagcaacauuuuuaugaaauaaugaagugaggaaacagaaagcaauuugagaaagaauccacuugcuucacccacccccaaaucugaaugaggugcaccuccugaggguauguccacgacugugcugucauugccugguuaucucucugcacuccugcaguccaucagcucugcaaggcagagguccugucuguuuuuuucuuuucuguauuccugacucuagcucaguacuuggcacagaguagauuuugaauacuguguaucuguugauugaucauauaaccuguuuuaucaaaauaaggaauaucaucaucaucaucgucaucauuaacauguuuacuucuguuuuaggccauggaggaauugcaagaccaagagggcugggaauaugcuucucuaauuggcuggaaauuucacuggaaacaacguaguucagauaccuuccgccgcagacgcuggaggagaaaaauggcuccuucagaaacacauggugcagcugccaucuuuaaacuugaaggugcccuuguaaguacuagguugccagagcgcagaucauauugguguagagaaaauauaugaguguuggauacagcacugccaacuccauagaggucccuguaacccugguacuauaagauggcaaauauuaacagguugagggaaagccacacauccugggugcucaauaccucguguagaacgaauagaccauuaacacaggaguguucuaagaaauacugcugucuacacaccugcuuuaccuaguguuuuccaaauauaucuguuccaggacccuuguuucaggugacaccuauucacaucccaggcacaaguucuuugaaucacaucuuggaaacugcaacuguucaacaaaauauucauauguauauucauaaauauacagaugucgggggaggaaaucagaagucuagcucacaaaauuagagagcaauacggaagaacauacugaagcacaguaaagaagucgggggaaaaagcaggcagguggaaggaaggaauaggagaauggcagugggugaucuaaaacaauaggguggucaggagccauuucccaacagccuauguuuguauuucugcacucugaccccacaguauucugcugcugcugcucuuucucuuccuuaucccauccuuuuacucccuguuuauccucuacauuuuuccuuuuuuucccuuucuuucaguagcaggguuuggcaaaccuggacuggagguaggagggcuggcucccacuuccugcucggcugcuuuccagcuaagcgacuucagggaagucacuugcuauccugggacuuauucaucuuuaaaaaugggguguuugcacgauaacaucuuuaaaaagcuagaauuccauuuguuauucuugccucuugguugguugauuugcuuuuaggcaguguuuauugacuucucugcuaauugacucuguuaauugacuucagggggcagacacuaccgaagauggggaugagaagagccuggagaaacagaagcacagugccaccacuguguucggagcaaacacccccauuguuuccugcaauuuugacagugaguuuuguuuuauuuuugauuuauuuuauuuuauuuuauuuuuucaagacugagucuggcccuaucacccaggcuggagugcagugguacgaucuuggcucgcugcaaccucccagguucaagcaauucuccugccucagccuccugaguagcugggacuacaggcgcacgucaccaugccuggcuaauuuuuuguauuuuugcauuuccuccauguuagccaggcuggucucgaccuccugaccucaggugauccacccgccuuggccuaccaaagugcugggauuauaggcgugagccaccacacccagccagcagugaauuuuaaacaugacuuugugaauuccacuucuguaacucuuaucuuaaggaaacucuucaaaucacugaauaugauuuuuaaaaucucuucaugcaaacgugacuuucauuuucauccuugaugaaaggaguuuuuaaaacuacaguugaaaaccauaucacauauaaggugaaggguggucagaucacugauauuaacagucuaucucauaugugcucauucugucuaguaagcccccaaaauuaaaauuuuaacuauaggaaaaaaggcaccaaaauuuaaauaaugguugauuucaauaauaauuuucaggauuuuuggaaugagacagaccugcucuacaauaauauuagcaaaugcuuauauaggucuuagcaugggcuaggaccuguacauauuauaacuuguuuaauccucuuaacaacccuguaagguaggugcuauuauuguucccguuauacagaagaaggaaccaagguacaggaagauuaaauaacuugcccaaagucuuauggcuuguaagcacuagagagauuugaacucagguaguagagcucccagaaucugugcacggaaucauaaugcucugcuaucucacaaagagagagagagagagagagagagagagagagagagugaaugugugagugauagagacagagagaauauaauaauaaaaggaguaugaauauuuugaaaugucaaagaaucuuuuagauguuaacuguuucccagaucugaugcugaaguaguauagaaagccccguuucuauagcugcuggagacccaguuucauuuuaaaggucugugaugauaagcaguacccuaaauucaguuaguuuauaacaaagguaauguuuuccugauugauacacuuugcauugagcuuacuguaguauuuuuuaaaaauaggauuuuuguuuuuaagaccgagucucacucugucacccaggcuggagugcaguggugugauuucagcucacugaaaccucugucuccaggguucaagugauucucgugccucagccuccugaguagcuaggauuacagacgugcaccaccaugcccagcuaauuuuugaauuuuuaguagagacacaaguuuucaccauguugaccaggcuggucuccuaacuccuggccucaaacagucugccugccuaggacucccaaaguucugggauuacaggcaugagccacugcacccagccuaaaaaauaaguuuuauuuuacaggaaauagaacuacuuugggaggccacaucaucacuauucuaugugcucuuuacuguggggaacuauaauagauucaagugacccauuuaucagaaacauguauuuuuuccaaauauuccaguaaaauagcaguuuacaguguuacgcuucuuguaaguaaucuuuauccuguuuuuuuaggagucuacaucuaccaucugcgcugcuaugucuaucaagccagaaaccucuuggcuuuagauaaggauagcuuuucagguaaaggaaaaaaaaucuacaugcuacacaugauuacauagcaugcuauuuugcuucuguguuucgagugaaugcuuuuugucauuucuaacaacaaaaacccuuuacauguugagguuauuuuugcaugcuugaagcaaacugcucagucauuagauaaaucaucacugaaugcuuuaggcaccauugcuggguccuaguaauacauagaagauacuuuugguacuaauagauauuaauugauuaaguaauaagaagcaccgagaaagugauuucucaucucuguuuauauacauggcuguguuuucaucccuggacccucagguugauugguaaguuaagauccuuuaaguuuuuuugcaggcucuuucaagguaucaaaaagaugauaaguuugcccauuugccuacagcaccaggcuuugagcaguuuggaguucauuuuaaccuccuccucugccugcuccccacauucccaauaccauaaaaccaugaggcuuuuucuucucuugcacugacacccagcugcuuuuguugcuucggacugguucugagaggaaggcuauuggcaagggacaggggaggaggggagaacaugccugucuggggauuugaguccuugccgcugaaccauggauaguucaggcuaucuggggagaauuccaguuugggacucaaagcccagcagaguuucccugggccuucuaugaaaacaccucuuaacccauuucccauuugccccgagaaaugagugcuggcagcgagcugcacuuuuuuauuccaaacggaaaguuuguuaaagcauuugacugacacucucaugugcucacaucaauuuugaagcguguuccaagcacuaauauuuaccaauauuugugaaugguuuccuuuucuuagaaauuugagcagauucaagguuaucucugcaauauacaucuccaacagggucuuugaagacauuuucaaauauuuuccaccagggggcacucuaucacugaaaguuaaaaaaacaucuuuccaaaguucuugacuaaagcuucauaaaacucuaagcacauuccuugcaguuugagauagaagaauuaucaucagggcaaaagcaaaggguucauaugauggcuccacugcuagaaaccaagcacuuuuggcuuauacaagaguuucaggcuagauauuguguuauuuuucagauaagucagcccccaggcaacugcaaaaaguuugaugaaauuauuuagcaaggaggagaacauggauuauuucuccauacauaauauugcuuucucuccauucuuaaguauagugagacaaaguuuucugcugucacagauuguaaacucuaugagcaucugagcuuuuccggcugcuguuauacucuugagaccuggaacucaauaaauauuugcugaauaaaucgauuaccaucaacauuagaaacaacuauaauaaaaacuagcauuuaucagauacuuccuauaggacaggcucugucccaaauagcuaacauuccuuauaucauuucauccucucaacaccgugaagcagauauuacuuucauugcauggaggaggggaucaacguuuaggaagauuauuuuuucccucaaaguuaugcagcaggggugaaguguggguguugaccccagguguaucugacugcagagccucacucaaccaugagugcaguacuuuugcagagaaaaacuaugggccccauuaaccuugguggggacauacucuaaagagugaccucucaguacacaucagggucucgcuucaggugccucugcugcagugccagaaccuuccauggggaacucccugcucccuagaaacccuaucuccaggcagguggucagagcccacugucauuauauccagaggaaaagaauaugguugcacugagugguucuggggaguuagauuuuagccguggccccguuguuauucucuuuuucuguuuuagauccauaugcucauaucuguuuccuccaucggagcaaaaccacugagaucauccauucaacccugaaucccacgugggaccaaacaauuauauucgaugaaguugaaaucuauggggaaccccaaacaguucuacagaauccacccaaaguuaucauggaacuuuuugacaaugaccaagugguaggucguuuagaauuucuaagauaacuuggggaugauggagauuugaagggaugauugucggggaauuuaaggaucacuuuguuucucuagggcaaagaugaauuuuuaggacgaagcauuuucucuccuguggugaaacugaacucagaaauggacaucacacccaaacuucucuggcacccaguaaugaauggagacaaagccugcggggauguucuuguaacugcagagcugauucugaggggcaagguacauugcuguguucuuccucauguauucugucagcugcuuaaaaugcauguuaauucuaggcacuguuugcuugaacuaaagugaggcauugacauauccauguuuguuucacaggauggcuccaaccuucccauucuucccccucaaagggcgccaaaucuauacauggucccccaggggaucaggccugugguccagcucacugccauugagguaugcugcuccccacguguuacucaucaaaucaaacggaugugacugcaggacaggaaucuuuuguauagaacauagaauccugcugcauauuuucuugcuaucuccaacuuccuuuacaacuuguccaaaaacuggagguauucaugggaguagaaggcuuguugaagcaacaaggacaggucaauucuaacauuccugagggcaucuaaacuccucauuuacugggagccagcagguuucugaguuuuucaggucaacuggagaccugggagagggaagauggacgagaagagaaugacgguguauaugcugagagaugggggcauggcagggaggcagagauggaaguuggaugggagcagugagcaauguugacaugucagauacaagcugaugaccccaacaagguggcuugauagacagugucuggcccacucucaagacuuuccccguccagucaagcagcuguuaacaccccaagauuucccuucucuggcuguccugcuaagaguucucaaaggcugaggcuaucacuucgaaaugcuuccaugucagacaccguguuaagaaguuuacaggugggcuggaugcaguagcucacgccuguaauuccagcacuuugggaggccaaggcagguggaucacuugaagucaggaguucgaggccaacccggucaacaugguggaacccugccucuacuaaaaauacaaaaauuagcuaggcaugguggcacacaccuguaaucccagcuacuugggaagcugagacaugaaaaucacuugaacucaggggguggagguugcagugagccuaguucgugccacuguaccccagccugggugacagagugagacucugucucaaaaaagaaaaaaaaaaaguuuacagguggucaucaauauaacccuaugacagauaauacgaucagucuuguuuguagaugagacauagggaggugaguuaccuugucagcauugacacagcuauuagauggcacagccaggauuugauuccuauacucuuaacugcauugcuuuuuuaggggcucaggcaggagaaagaaaggggcaaaaccacuuucuuuggaugaccuacaagcuuacuaggauaauguucaaauuaaucuuaaagacuuugccaguaauuaagacagaauuuuuccuuuugaauauuauuuuuaaagugcugaguuaccuuccccucucuuuaaaucguuuucauagauucuagcuuggggcuuaagaaauaugaaaaacuuccagauggcuucuaucacaucccccagucuuguuguggaguguggaggagaaaggguggaaucgguggugaucaaaaaccuuaagaagacacccaacuuuccaaguucuguucucuucaugaaagugguacaguaucgauucucugugaucacccaugcgcguugaaauaugaaaguaugugccucacacacacacacacaaacacagaguuuauuuccaaaaccugacaaauagaaaaacccugccuuauauucagcuugucagugacuuuuuccccuuaaauucucccacuguagugaugauuucuuaaagcuucaaaauaacuccaguggcacagaaauaucugugagcaauacuuacuuauuucuccaguaaacuuuccaucuauucagcuaucuauuacaagcuguuggucaaccccaugaaggcagaauauuaacccccagucaugcauggaccagauauacccccuacaacugugcauggaccagaaccuucuggauaaggacuggcugucuggggaaggggcagcugugggggaagguauauggggugauagggccaugaccuuggcagcccauaacugugccccaccuccaggugccccugggauggcaccuucuuugguccauugaggcuacccucugguuguuaaagaugugagagcaucagauccaguucacagcucuccaucacagaccccauaauaccuggggugagaagaggccacccagucuuuccauuuuuaaagcaguuaauuucuuaacuuuaaaaaaaaaaucuuucuuuuuuacucuauuauauaaauaggugacauaaagacaguuucuuaccuugaaguguuggaagaccuagaaccuuccuuuccccaccccagucauuuuccugaccuugaugucuccaauacagugcucuugaacucuagggucacgugcuuuaaccucuuauuuuacauuacagaggaggaaacugaggccuaaagaggggaaaugauuuauccagugucauaguguuaggccacaccuucuauaccacagugacuauguccuaacuagugacagcugcaguguagggcuuggugcauucuuacuugguacaccucgucuuuaauccugcggggugaacauuuucaccucucuuaugcccaccuuggggaaaagcaagagguaacagauuuacacaaggggaugucgcuagcaagugaguggccagaguuugcacauagguccuuacaaccccaaugcccaugcuccccucccuaucaugcgacagacggcgagccaccgggaugcugccagccagggucccaaagugguugucccugggccacuccaccuauccuugucuacuccccacaccucccucaccuuccaaguucuagucuggaaucuagccuuggucagcagagaugagaaaaaccacucaggugaccccaguuucuauuccugugucaagccagagauagaaauucaccugaaccacauaccaaaugggccccuaggucagcucaugauuccccaaucaggcauugucaccaaagccaccaaauuccaugagagggagccagggggaguugaggagaaaguagcaauccauuuuuacacugaauuuccagggcaaagagacucucagccacaguuauuucccuuagaaguucaguuuugucuugaccauuucuaaagucugcucagaacuuggcuaguagaugaccaaagcccugggcuaguuagccuugugcauguccccucccaggaagcagagcacagggaagaguauagggcagugacugagaguaaagagcaugggucagugauuccacacuuacaggacacagcaugggucagguacuauucuaaguacucuucacauagaguaauucaacaauguuacuauuacucaugaaauaaugggggcauggaaggguuagccagguaguucaugguggcagugccaggauuugacccaggcagucuggcugacagcucacgcucuuaagcacggagcuccuugccuggcacaugaguaacugaacuauugcgaguccucugggcuguguggcagagagaaucuggacugguccaucuggggaauuuuucucaaagcugcccucgucuggucuugagaaaugaaaccuaccuuugugacccccaguucuugcccaaggaggaauuguacaugcccccacuggugaucaaggucaucgaccacaggcaguuugggcggaagccugucgucggccagugcaccaucgagcgccuggaccgcuuucgcugugacccuuaugcagggaaagaggacaucgucccacagcucaaagguaacaugcaaggcugugcauaagucugggggcuuuucuuuuuuuuuuuuuuuuuuuugagacggagucucgcucugucgcccaggccggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgcccggccgucuggggacuuuucaugcauggcucugauuuacucuuuacaaaccuacucaagguaaguccuggauucauugucuacauuuuacggaugagcaaacugcgugaguugcgguggguuauggcacuuuccuaagguucuaucauucguaaguggcagagcugggcuggaaucucggccuuguuuuagggguggguggcaugcucgagggauuccucucugaagcguccugcuccugggugaauguaagacuucuuuugaggaaguguuaagugcucaugaauguucccuauucaccuuucaacaagcagcuugcaaagcagggagagcuguucccacaucagugauggggaugaagucauuuccucugccuuucacugaaugguuaggaagcacucacugacugccacgugcuguucuagauaucuggggacaguggggaccaagaaaggcauguuccccucucacaaagcaaaaguccagcagggaaggcaaacgaggaagugugcaguugcaguccagugugauaaauaucuugauggggaaaacaggaagcucccugaccccaugaacacugagagaggaggagauuuuauuucagauugcuuuccaccuguuggccuaccucauuaucacauauaauuaauauguaaaugauagagcagggcauaauacuuacuuuagauuuccauaauaaauaauagcuagugauacagcauuuugcaauuacccauucaauaguuacuugcuuuuagcuuaccaugugcuagggacuguguuaggggcugggggcuacauugcaucagugcaagagaucccagggccccuggccucauaaauuagacaccgugggagggcuggaacagccucauucggcugauccuugguggcuucaagacugaagcagaugucuucuauuuaagcagcugugucacuaacuaguuccauuaaaacuuucauaagugugaguacugauuuuacagagccucugaaauucaucugcuguguaggucugacuaagcauccuggaucccugauucagagaagaggaaaaaaauccacagucacauuuaagcaaaacucuacaugugcuuauuaagaaaugucccauauaaaacauuuuaugcugaauugacggugccuaaaauagcauuuuugauaacaacaaggauuguuguaauugcaggaauuguuucauuugagguuacuaaauggagagaaaccacuuuccuggcuuuuuuuuucuuacuguuuucaugagagaagguuuuuugguccaaauaugugaaaucacccagaggguacaaaugcuacacgcuuucucuggccccagaaucacuuacguggaccuguuugugucuauugcucaggggugggcugggucuaaggcagacugcccuggcuagcaauucuauguaaucaauguagaguguggucaaggcuucagagagccccagaaaaggaaaaucugguccuuucauaaaaccagugauagguuaagaguugagggcacuuggauggccucauguuggaagcacacagaauaacuuucuccuccugucccuugggcuuuguuuccaugaggagggugaaguggagaacugauccucuaggaaagaacuuauguucaguuguguuccugugacccugcccucugguugucuuguucuguacuguuggacuugucaggaucugcaggggagcuuaucuuggaaguguagagacugcuuacaggucuaggggugccacguggaucuaaaacuaccucacacaguaacugauauaucacagaugcucaggaaaugucagucuccccuccuccccgcuaucccccugaugguuccuccaggcucugguguggugguuaaaacacaagcuuuggagucagccaaaccuagguuacuuacuccccaacuuaccacuaauuguuucaccugaagcaagugacuugcuugcuguuagcuucuguuuguuuuaaaauuuuuaaaacagggauaauggcacauauucuacaggacuauugagguacuaagugaggucauguaaguaaaguguuuagcucagugcccagcacaugguggguaccgaaaaagguuuguuguuucuccuccuuuauguccuguaugucaauugccagggugguuaagcagaaaguucuguuggcuuggcagaguuuguucugucuagguucuggccuucuguuaaaugucuuccuguuuggugcuuccucaauaaaugggagauguaccucucauccuacccccgccccagggugaggcuuugguaucccccaccccuuuagcugaaucaaauguaguaagcccagggacuacuccugaguccaugcucuaacccccaaauccugagucacagauauucugggaauuguacauaaagucagggcaugugucuucucccucugcauacgcuguugagaauaagggcugaauaagccacugcaaccucaggccugaaauauacaacaauccacccugcuuuucuuuuccuuuccuuucccuucuuuuuuuuuuuuuuuuuuuuuuuuuuaauuuaaguucugggauacaugugcagaacgugcagguuuguuacauagguauacacgugccauguugguuugcugcacccauuaaccuguuaucuacauuagauauuucuccuuccccuggccucucaccccuccuuucccuucuuuuucuuauuuuucucuucuuuauuuucuguuucuuaggaacaaacuucaagaaaagaagacuccuuuagauguaggcucucuguauguucucacuuauaaguaggagcuaagcuaugggaauacaaaggcaugcagagugguacaauggacauuggagacucagaagggggagggggauaaaagacugcauacugggcacaauguacacuacucaggugacaggugcacuacaaucucagaauucacaaccauauaauucauccauguaaccaaaaaccucuuguaccccaaaagcuauugaaauuaaaaaaugucgguuccccacuuacuccugcacccucuaaagacauguauugacacaauuguuuuuugagcacuuucuguauaggcacuggacuaauugucuaaaaacaguaaugaacauauaauccccuagaaaaugucuaaaaccauauuauguuuggggaaacgugauggauuguugguuuauuuucuacauucaggaguuguccucucuauucuguaagucccauccaagaauaaacucuaccauccacccuauggcuguuaaacuugaacuuggaguagaauguucaccacuguauuucucuaaguaucuuagauuaagaaaguauuugucuugcagccucccuucugucugccccaccaugccgggacaucguuaucgaaauggaagacaccaaaccauuacuggcuucuaagguaggcuucagagcugaucaguggaugcugucaguuuuaucuucuaugcuuagaugucuaagcauuuggugaauucagucaaacaacaguuuguugcaauuauaaucaucagccaauccauuuauugaggacugaguacagacaagagucuaaaucuugcacucaucaacaguuaugaugacauuguguagacuaguagucuucaacccucacuaauaagucacccagaauacuuaaaauaaaacccaugcccaggccccaccucccaagagggagagggaccuagauaucaguauguuuuuaaaucuccucaaaugauuuuaauaugcuggcaggucugagaaccacagguguggacagucugagaaagaucauuugcuagaaagcgaagucugagaagcaaauuuauagcauugcaacauucagaucagagauaacaugcaacacgccagauucuucccccuacauaaagcagaauuguuugauaaauuucuaaugaccauauuuaucaguguaugggacacccagguuuuuuuauuuucacugugguuuugaagugaagaaauugguugaaauaaucacucaaggcccuauuuuagaacuagcuauuccagccacuucuacacgaaggaaagggggcaaaaagccucagcccagaaaaaaggaaacaccaaauaucucccuguuucucuuggcaguuaugaugaacauucacagcguguuuuaaugugcaaacuagcccaaaaaugcacaugauugcacuuuaauauguuauguccauaaacagugccuuaaaaaaaaaaucuacuuccaucccacugcauuaaacucacuaacaacuggaccauauaaaauauagucuccacagccagcacugugcagcaguguguuugauucuacucucugugaauccuacacagucacaaacgacaauaucaaauuuccaaucucaugggccaaaacuacugugaucacuuuguaaaccaccccaaauaucccuaauaagauaguaguagccuuggcagaaguuaauauacuuaagaucuuuucuguagauuuuuacaacugcucuagaaaaagacaguuuaagaucucgcuguauaaucugccuccagguuugccaucucucaucgucagucaauucuuauuacaugccuucaguguacucaguagcccuaagaacaacugaggaacaggagaagaauaaagucaacaagcuaugccaguauuuucguucacuucuuaaccauaguuaagaaaugugacuauguuacuguagcaacacuuuaugaaaguucaguuuacaucauagaguuaaacauugcaacauagcaggauuggugaugguaguaucagucauucccacuguauuguaaauugcuuuaaucagcucgcucuccuaacaucuaauugagguacacuguguugauaagaaaggcugguugaaaucucuaaaaaucugaguccacuuguucaucacaguagacaucgcacaucuguacaaagucaaaugaacaaaguugcacuuugaaagagccaauaacaagcuugcugauguccuguauuacauguauauguaauguacauguaaugugcauguauuaccacuuccucaauucaggccuuguaucuggguaaauggagggaaugccucaaaaauaacuaugcuguugcugggggcuggaggcugugucucugagugacagugucacacuccggaaacucauggcauuacucugugauguccauggaaauucuuaacaaaugggcugagcacuaucacaagaaaagugagaaauaagucuucggggaaaauuggucaagugcuagccagauaacauggacauguguacauggccaucucaacaauuaccuuccaauuccagugcuuaagcaguaugucaacagcacucagcaaaauggcuucuccagcgacagugcauguauguaugauaagcaaaugcaugaggcugccugggacugugggaccuuggccuaaagacuugaauuauucuuacaacucuuuccauuaguagauuuuggagugaaaagugaucuuuaaacaaacgugauuguuuuaagccuaaaagaagaaucuucugugccauuuaaugauuugauucccauugcaaguuuauuauuagauauaauaaagcaagucacaucaguugcuuccauaaccuuuccacaugaacuaaugaucauguaggcaugaauaaauucucccauacuaauucuaaaguuuaaaaucagcaacuugucuuaaauaaugccuuuuaggccgggcacaguggcuuacgccuguaaucccagcacuuugggaggcugaggcagguggaucaccugaggucaggaguuugcgaccagccuggccaacauggugaaaccccgucucuacuaaaaauacaaaaaauuagccaggugugguggcaggcgccuguaaucccagcuacucgggaggcugaggcaggagaaucgcuugaaccugggaggcggagguugcagggagccgagaucaugccauugcacucuagccugagcaacaagagcaaaacuuagucugaaaaaaaaaaaagccuuuuaaaucaugaacuauuauuuuccuugaaaugguuugaauugugaacaaacagauucuaaaaaucugaucucaggaaccauugagaauguaagaguacuuuggaaauaaaaucacucucuccaaaaucucaauucagcugugaugauuuaacccuuaaucuugcuuugguaugaaucuaauagaaagaauugauauaucuaucugucccucugccucucuuggcaauugcauugugcugaacaaaaaucaaucuggaaaauaccaaggggcaccuacggaagcagcuccauggccucucacauggcaaccggaggaagagcccuucaggaugaacauaaaguuaggaucucagaaaggggucuaggcagcaugucuucaaacugcugcugaggacgagcuuggcuaaugcucuaacagauaccagaaccacauucaagccccccuucccaguucuucauucucucaucuccuggaugggcccucagauugggguggguucuccauuaaaaaaaaaucacaugaaaggauuuggccaauggaaacuugacauccucauaauaaagcaguuuugauggaugaguauuuauuuggugcuguaacauaggcauggcugggggguaccuguaugauaacauugcagucaaacauaucuugugacaggacaguuuuuuguggggaggagaauuagaccaaguucggagauauauuuaaggaacuaaaacgaacguaagaucugggguagggggaugagcagcuccacacccugcuccugugugagcugugugcucccgacugggaaaugucuaacuccaucgaaaacaugagaugaggggcagggaaggggcuacuuccaagccuuucauuauaauacuguguguaaccuuuugcauauuuucagaaaagaaaccaguaagguggguucaguugugggcucauccugacuuagaaaauuuuaaauaauuuagcccauugaaauguugauaauauaaggcaugcaugaauaauaauuuuugcuucuuucucuuuaaacuucauguuccuggggucuccauaucuaugugaccuguuauaugguuugcccucuuccucacgggacaugugcacgagcagcugacagaaaagguaacuaugguauacauuuugcuacauuuaagauucauguauuuucugcccagaauuuuucuuuucuuuuuuugagaaggagucucgcucuuucacccaggcuggagugcaguggcgcgaucuuggcucacugcaggcuccgccccccgggguucacgccauucuccugccucagccucccgcguagcuggaacuacaggcgcccaccaccucgcccggcuaauuuuuuguauuuuuaguagagacgggguuucaccauguuagccaggauggucucgaucuccugaccucgugauccacccgccucagccucccaaagugcugugauuacaggcgugagccacugcgcccagccugggaauaauuuuuuucuaaaucuaggggggccgggcacaguggcucacgccuauaaucccagcacuuugggaggcugaagcaggcagaucacuugaggccaggaguucgagaucagccuggccaacaugcaaaacccugucucuacuaaaaauacaaacauucaccaggcgugguggugagugcuuguaaucccagauuuucgggaggcugaggcacgagaaucacuugaaccugggagguggagguugcaaugcagugagcugagauugcaccacuguacuccagccugggcaacagagcgagacucugucaaaauuuaaaaaaagaacuaaauccauguguagguugcugacccauaaaggggaaguaauucuguguaaguauguguaacacacacgcauucacacacacacacacacacacacacaaauaagaagcauauaauguaacauauaauauaacaugaauaaaaaguagccuuuuaaggccgggagugguggcucacgccuguaaucccagcacuuugggaggcugaggugagcggaucaugaggucaggaguucgagaccagccuggccaauauggugaaaccccaucucuacuaaaaauacaaaaaguagccucguaugguggcacaugccuguagugccagcuacucgggaggcugaggcaggagaaucgcuugaagccagaaggcagagguugcagugagcugagaucaugacacugcacuccagcugggcaacagagugagacuccgucucaaaaaaaaaaaaaaaaaagugguagccuuucuugucccuucuuccuuucccccaagaggcucuacugcaggugacauucuguguuuuuuuguuuguuuuuuuuuuuggcguuauuauuuccaagguagguuaaaauaagcaaagagggggucugauaagaaucuauucuuguuauaaaucugagugggaggccuucuauaguuugacaauauuccacaagugacucugacaugcugucccuucugcccaaccaaggacuacccauucaaaccagagauucccaacacugucuacguauuggacucuccuggggaacuucugaaagcuuauuggaugcccuggucucaccccagacugauugcaucuccuaggauagguugggagcccuggucuaacugaaccaugaugccuccugccuuucguuucacguuuuauaauuuucaaagcucuuucuccuaaagaucccauaugauuuccagaacaacuuuuggagguacauggaggcagguagaugaaggcagcaugugaaugcuuuguccauuguguuauuauugcauucaguggaugaagaaauugaugcucagagauguuaaacaacuugcccaagccaguacagcuugaaacauaaggguauggcuuauaacauaaaggaaggaacuugaauuaaaaccaguuuuuccaauuuuuagcuagugaguauuguauuacaaggcauuacuggcuaaaagggcuaagaaaaugagauaguagaaaacacauauuggagguuuucuuuaaauuuauauguauauguaaauaugaagucaauagaauaaaaauguaaaaaccaacaaauuaauagacuguguguaaaagacauaagaacauuaucuaguaugauugugggcauuaaagccaaacacauuucaucggcccagaauggccauuucaccucuagcuucugaguaggagagucgugaaugcuuuguccauugugcauguaaacaaaagucauauaaucucacuuuuaacagggucagaagaaccuauuucuucuuaacuauuacaaaugcauuuuccugcaucgauuggaaauccaggacaucacuaaagauuuuuccauuuuggcaugucuuuaggaggaagaaaucguggacugguggaguaaauuuuaugcuuccucaggggaacaugaaaaaugcggacaguauauucagaaaggcuauuccaagcucaagguaccuggaucuaugcugcuauggguggagaaucaacauccuuugaaacuggccacaggcagagcuaagaggaugacuaaaaggucccuugggugggugcuaaugagcagggcccaggaaaaccucugucuucccggagagcccucuugcaugaguuucggcuuugccaagauuccagggacuugaggacagcuauugaguuaugguuacgugacugccacauuggggcuuggaggcaucuggcagaugguugggaaugggcuggcaccacacuaauuaggccacgaugauccaguuugacucagggaaacccagaagucauagugcucuuugcagaaugacacaagaugucaacaugcuuuguuguguacuuugaacagggauugguuucacaagcugaaaaguugaaucugucacauguaugcagcauaaaaucacagccgugagaacauguauacagcaggaagacaagcgacugagcuaggcacggcugacuagcucugagcuuucuguucauguuuugaauuuucuaauucuucauucaauuuucagccuguaguguccucaagcagaagcagugcuaaaguuuucagaacaguguauaugagaaaaaaaaacuuuagaaugagaaauaucuggucauugaaauaauuuuccccaucaaagcaaaaaaaaaaaaaacccacaccuuuucauguuauugucauaacuucucaguguagcuuaagaaauacuagcauauaaaggaccauucauucagaaaaaugauccaaugaggcugaaggaucagccucacacuccauccucccucacucccucuucccuuccugccugccuucuuuuccuccugccugccugucuuccuaccuuucuuuccuuccuuccuuccuuuccuucccuuccuuccuuucuucucuuuccuuccuuucuucucuuuccuuccuuucuuuccuucuuccuuccuucuuuucuuccugccuucccucccuucuuccucccuccuaccugccucccuuccuucuuccuuuucuccugccuucuuccuuccuucuccuccuucauccucuucccuucuugcuuuuuaaauugagaaauauuuuacauacgauaaagugauccauucaacaaguugugauuauuguauauacccuaugugaaccaccacccaaaacaagacagaacauucccauucccacagaaaacuuccccgugucccuuuccagucaauuuuccacuauccucaucccuccuaggagcaacugauuggauuucucucaccacaaacugauuuugccugauuuuacacuugcucuaaauggacuuguaugauuuauguuuugugugucuggccuuuuauccccacguuguaguuuugagacucaucaugugguuguguguauucauaguuuuucccuugucauugcugaguaguauuccauuguguggauaugccacaaguuauuuuuccauucuccugauaaugaagcugcugugaacauucuucuaccauguguacguguuuucacuugucaucaguaaaugccuaggaaugcaaucucuagaucauagaauagguggcuacuuaacuccaaaagaaacuaccagacauuuuccaaagugguuguaucugucuacacucccgccagcgauuugggaguuccggucgccccauccacaaccucaggcccacuugauacugucagcccuuuugauuuuagaccuuaccugcauuuuaaugagaaauuaagacucuguuggugguuuucagauauauaauugugaacuagaaaauguagcagaauuugagggccugacagacuucucagauacguucaaguuguaccgaggcaagucggaugaaaaugaagauccuucugugguuggagaguuuaaggugaguaagauguguguuggucccguuuaaaauccaccuucauuuucuauauaggccuagaauaaaggacaaccaggcucuagggaggggcacauccugcagccucugagggaugcuggcauuuucuauauaggccuaggauaaaggacaaccagggucuagguaggggcacauccugcagccucugagggaugcuggaaggugccagaaaggaaaagggggaggggggccagagcacucgagccaucuccgcaucucuuccugccucccugcucacgccaagcagccuugacugagccaucuccgcaucucuuccugccucccugcucacgccaagcagccuugaauccuaagauacagucucuccaagaucuaguuccucucuucauccuacugccccuaccaugcuuucagcaggaucaucgugacaacuucucacuugacaguccuugucaccuuucucgucacacuccucuccagccuccaugcaaccaaaucugaucuucucucuggacuacugaaaggcuuugcuuggguuuucacagucaagucgcaacuccuuucaaaggcagagccagucuuucccaagcuacaugguccccugccucccucccccucacacacuccacccuccugccugggagagccucgcccaagccccggacacaccuuguccucucaauaagucggaggcuugggacaggcucuucuuccuucccugggugcccuuucuaccugcuuuguggucugacgaaguccuacucauucuuuuaagcgccagcucaaaugucacucucuuugucaaguguucccugauugcuucgggcagcgugacucacuccugcucugggcucccacaggucuggguucaugccuccaugaaagcaucuuacacauggaaaguaucugcuuuauaauugccccucccugcaaccacgcuuggcaaagucauggcagaugugcugcugcugcuuuauaauccuuugccuguagcagacauugcuaagggacgagaggaugaugccugauguguggucucaaauccuucucaguacagccucccaccaagcaaucacauauggcacaagagccaacccuacugaacaucgcugugccagacgggagucuuugaguucuuuugugggucccuaguaccuggcacauaguaggugcuuauuccaugcugcuugacugaauaaagaccacuggaacuaagaccuguauguucugaauccggcuucagugcuuucuccugguuuuaaggcaaaauauguggccucuccagcaggucuuguuggcucgcuccuucaaaauacaauuuuuguggcguuacuauaugccuaguccuguguuaggcccuggagauagggugaugaacaagacuuuaugcuccccucacccgucucuagaagcccacagucuaaugaaggaucuagagaauaaauagauuaucucaaugcagaggccagugcugugccaggggugaguaugggguuggaugagagcacccagaggacauaccaagcccaggagcagucagggagguuuccuggaggaagugacaccuuucagcugagauuugaaagauaaacaggaguuugccugggagugggagguggaguacagaggugcuacaggaaaagcggaaucacuguugguauuucguuggguuuaaaauguaauuauuguuauuccuaucuucaaagaaugugcaguauuucacucuuucucaccaccaccuccuccaucacacuggcccauguucuccucuugacucccaguuucugcucugcccucucuucuccccugugagcucucaaauaauuacuugagaaucauuucacuuucccuacuggaaauaugcaaagugcaauauacauuauuucuuucacaaaaggcagccuuccauccuucaaucccacaccccuggcggaggaggggacuucccaggagcccucuaccugggccacccagggcccugugaguccuucugucucucucuuuuagggcuccuuucggaucuacccucugccggaugaccccagcgugccagccccucccagacaguuucgggaauuaccugacagcgucccacaggaaugcacgguuaggauuuacauuguucgaggcuuagagcuccagccccaggacaacaauggccugguaagaguuuggguguggggccuucuccuguagcaagauaauuacagucaucagccacaauaauugucauguucuuucuuucugggcgucuguuaucucacuaggggaaagauacuccaucaaaacaauguauucaggaggauuguccccauggggauuuaucuaagagcuugcggggggcuuaagguccccugguucauccuucucauuuuacaggugugagccaggacucccccccgcccccugccaccaccccugcacccacacaacuggcugcaugccacccaaaggagagcauugcucccuugucuuaggcacggggugccauggcggccaccuugucaucagcugggaguggguguggaggcgagcugagucugucccugaacuugacuucaccuugcgcccuacaaugauguaacaucccgucuauuuugucccacagugugacccuuacauaaaaauaacacugggcaaaaaagucauugaagaccgagaucacuacauucccaacacucucaacccagucuuuggcagguaauauacauucuuaaauguuuuucuggccuucauuucuccacggaacaugcaugaagacucuaauauguguccaacccuguccuaggcucugaaacuguguuugugaacuagauaaacauucuagacaggggagcagguaauaaauagauaaacccaaaauaaaagaacuucacagaagugaagaagcuugguucugauagcuugcaggguagacagacagcauuaguacuaguguuauaggagcacaggccaguuggaguuuuuccggggaccccccucccaccuggcugucugcggagcuguuuauauaaaacaucucaaaaaaaucucgcaacucugaggugcuauuauuauuccuauuuuauuuuuuuuuaagacagagucuugcugucacccaugcuggagugcaguggcgugaucucggcucacugcaagcuccgccuccuggguucacgccauucuccugccucagccucccgaguagcugggacuacaggcaacugccaccacgcccggcuaauuuuuuuuguauuuuuaguagagacgggguuucaccguguuagccaggguggucucaaucuccugaccuugugaucugcccgccucgcccucccaaagugcugggauuacaggcgugagccaccgcgacaggcugagacucaguguuuaauguacuuagcuuuuaagagaagagugagggccaggcacgauggcucacaccuguaaucccagcacuuagggaggccgagguugguggaucacaaagucaggaguucgagaccagccuggccaaccuggugaaaccccaucucuacaaaauaacaaaaauuagcuaggcauggugguguguaccuguaaucccagcuacucaggaggcugaggcuggagaauugcuugaaccugggagguggagguugcagugagcugagaucgcgccauugcacuccagccugggcgacagagcaagacuccgucucccaaaaaaaaaaaauaaaagaaugaggauuugaacucagaccaucugaccccagugucuguguggcacgccacggucugauuuccaucuccaugucaaacuuauuagcugcucagggcagggauuaccaacccgacuguacaggugcagaaaacagggcucccagagcucuauuaauagaggugggguaagugauagagccgagauuuagcuagaaauucugcugacuccaagccccaugcuuuuccaaccgccuuggugauguuucacauuuguggcaaagccaucaccuguagaaaaauguucucugucugagacauuugugaaaaugauguuuuguucucagaaccuugcugagugagagaauacuguguucuuauuugcugcguggcauauauuuuuauuucuggcuuuauuaucuugcccauaugcuucuuuccuucucggguuuguugguuuguagccuuacguauucuuucucugucaugugucacacacacauacaugcacacaccugcccaccccccacccccccuacgccccccgcaugcugcacacccaaggccaugcacccgggccagggaauggaaguaauccucuggcaccgcaauaugaucguuuuccuuuucuuccacugauccagccccgaggucuagacaggaaaaggcacgcagggcaggaaggagggcucccgugagggagacagggaagcagggaaagccagcuuugaagggagaaaggcaacccugucugaauugcucgucucagaggagccaggcacaagcuuaauuaaguggcaggaaaagucuugcucggaggcacccuggaaggaaggggugcuguaggcucugcucggccaaucgcugucuggcggaugggcagacuuccccucauccagcaggguggagccaaggagaugccggcucugcagcccccagauggcuccaguccauggccucagucuuaggggguagcuuucuucuccgcagagacucuuggggacucuggaacaggaauucaggaaggaacaaccuuuccuaugugcguggccguuacucagaguccuauccaucauggcagaucaccuucaaaagaauaucggugucuuccacaggauauuaauugauguuccaagaaaaaaaaauauuccuuaguaaaaccaagacacuuggguuuaaaaguuauaauugcaggacuucucagaaccuuuaguuuguccagaagaacugcaaaagaagugguucucaaccuuauuugacugaagaauucuuuccagagaccacauaugauuugcuucuuggaaguugggauuggaaaugugauguuugggggcacauguggguaaggugcuucaugugucaugacucaagcaccuuuucucacaucuguuuucugcucaaauggaucaacauuccuggcucuuugggcagggaccaguccacacaccagagugcaaggagaaggggaggaggcagagaggaggccucucacagcuucuccuucaauagaacauauugagcaccuucuccgggacugucccucuguggauagugcagauacagagcccaaagcccacccucuagcauacaucgcccacccaccacagaagcacugucugacucuuucucuucaucucaggaguguuugcauuuucauauggguucuauagaaaagccuuaaagaacuggagccaagggcauacccagugggucugggagaagaggggagccuuuggggcacccuacauaucacacccuauggugaaucacacucacuccccuccccugugcuucuguggggugagucaaagauguuccauggggcaguggucucuauugaggcagaggagggaaccuaggaggggcacagguagggggcuauaagucaggguacuugugccuuacucaucucugagcuggguggaggugcucuggugaacagcuaaugggcaugugaugauaaaguuaauaauauaauacaucauuauuauuauacuggcauuggagcgaugcacucaugucagaugcucucuaaauauuucuucacuugacacuuauagcgacacugaugggagggauuauuaucaccacuuuacagaugagaaaacuuagcacagagaaguaacuggucuagagucccacagcugguaagcagcagagguaggauuugaagcuaggcauuuaaagcccacagguuucccugagcaagcauauguucucuucuuguucuuauuucuaguauguacuauuuaucaagccacccaccaccacccacccugguuauccugcucagauguccuccagcagccauacuacacacagccugggaauucugugcacagagccccaguuuuugugagguacucagauggaucaugaagauucugaccuugcauuuguuuauuuaggauguacgaacugagcugcuacuuaccucaagaaaaagaccugaaaauuucugucuaugauuaugacaccuuuacccgggaugaaaaaguaggagaaacaauuauugaucuggaaaaccgauuccuuucccgcuuugggucccacugcggcauaccagaggaguacuguguguaaguugcuuugacuguacaagaggcacuuugcugccucugacauuggcaccuggggaggccuaggcccucuaccuuagugccuuccuucacugagccacugcuccuaucacucagguauggauuucaaucgcaggauuauucuagggaaucuccgggccaccucauggccccuauucacaucacaguguguguaaaaugguggcagcuggagcagugcugugcgcuggggaauggcacaguuagcagcccagagaccaguucccuugcuccccgucauugagccccuccuggaugucaaggacugaggacuggcaacguuugauagcagggauuuccuguccuugggaaauagggauucuuugugcccucuacuuaauuuugugacucccucuuccccugccugguauacagugucuuuccacaguaucugauuaagacauagcuugcaauuucuaguuuaugaguuugccuauuaugacuagagugaucucaacuccucacuuuuauggaggaggaaacugagggcuaaauaauauuaaauaaauaaauacauuuguuucucugaggccaaaauagcauauggguuuuuaggacucugaaauagauuucuaggccaaagucagaguguagcgcagauuuucugcacccacuauaugggagcaccuaagaguacaugagcauguaugugugaaucugagaagaaccugcaggcuccuccguaacuccgagccacgugaugcuauucacaguucuggagucaauaccuggcgagaucaacugagaccaacacagcugcuucaaaaugucgccagauucaaaggcuucccacaacccauccuuuccgaagaugggaguagaaucagauauggaggacgagacuacagcuuggaugaauuuggugagcaccuagcuguggauuguaaacugguacaaaguauaguaacccauauauauugcuggguuugggggagugaauagacagagccaguacccuaauuauaccacaugagacugugcacgugacacuaacaacagccacgucagaguucugcugucuugucaagugucaaaguggacacauuuucuugucugcuguuucacuugcccuuuuuagauuauagccauuagagcuuuauacaaaguacuaguaaugaacuaauuuccauguaaugcauaauuagcuaaaaaaaugcccauacaguagugcaggaauuucccuuccagguuuaucccaucauuuguucugucccuucucccagaagcuucagggauguuaugguuggcuugaagagccugcuauguucccauuuggcucauguucaagcuuggggucuugcucuuucccaaccagcaauuuauaauccgaccuguccugacgcaucaacagcuagcuacacuaugacaaagacugcaguaagcaucauagagcaugcgaacugugcuuccauauuuugcacgggggaggguuacccagagggggcgguggcaagggcaugggauauccagggggagcugaacaaacgugcacaggaagaaaagugcuuucugcuccucagcuugauucgugacauuguaaaaaacgauguuuugaggccgggcacaguggcucacaccuguaaucucagcacuuugggaggucgagucggguggaucauuugaggucaggaguucaagaccagccugaccaacauggugaaagcccaacucuacuaaaaauacaaaaacaaacaaacagaagagccgggugugguggcaugcaccuguaaucccagcuacucaggaggcugaagcaugagaaucgcuugaacccaggaggcagagguugcagugagcugagaucgugccucuguaccccagccugggcgacagagugagauccugucucaaaaaacaaacaaacaaaaaaacuuauguuuugucuuuccauuuuaaagaggacuugguaucagggaugauuagauguuuaagaaauguugaugcugcuucuaacgugaacuugcaaacaggauuggaaauaaauugggaagcaucauggucuaaugguuaaggguacccccaaacaaucaaacaacucccccgucauggggauuguuccaguuacuauugauauauaacagaucaccccaaacuuaguaacugaaaacaaccauuuuguuuuccucacaguuuugcggggucaggaauucaggacgggcucaggugaacaguucuggccgaggcuggccaugagcuugugccacaagaguauauacagaaugcucccacuuaccggaucuggaguucuggucccuuugcuauuggcaguccacaaguuagguuugagccuggguggcucaucuccugugguugcagucagauguuggcugaggcugcagucaucugaaagcccugcucgggggagcagucaggugguccacacacacagcuggcaguuguguuggcucucggcuggggcugaugaccagagcaccuacacaggccuuuccagcaggggagacugcagacccaggcuccuuacauguggauggugucccccagagugaggguccccagaaaaccaggcaggagcuguguggccuuuugugucuaagccuuggagucacacagcaucuuuucuccauacuccaguguuugacuacgucuccagauucaaagggaaaugacacagaccccaccucuucaugggagaagugucaagagaaucuggggccuauguuuuuagaauaucacagugguggccagauacaguggcucacaccuguaaucccagcacuuugggaggccgaggagggcagaucgccugagcccaggaguucgacaccagccuggccaacauagugaaacccucucucuacuaaaaauacaaaaauuagcugcgugugguggcacaugccuguaaucccagcuacucgggaggcugaggcacgagaaucgcuugaacccaggaggcagggguugcagugagccgagaucacgccauugcacuccagccuggaugacagagcgagacugucucaaaaaacauacaaaaaacccagaauaccagugaugccagcugcuguaaaaacugaaccuccaaauuuccguguucuaacacaaaaaaaguuuauuucucauugauucuaaguagguauuccuccagguggguagcugucuuccaagcagugcuccaugaacccaggucccugccgucuucuagcucugcaguucuuaagugcaggagucugaggcugcuguuccuuuuugcagccagaagaaaaaggcacauagagacuccuacccaggagggauuuaugggccagguccggaggagauacacaugucacuucuacccauguuacccucuggcugaacuuggucacauggccuccucuaacugcaagggaggcugagaaacaggcaggccaugagcucgugccacagaaguaaauauauaacgcucccacuuacccguucugguguccuggccccuuuacuauuggcaguccacaaguuaggcuugagccugguugggacagggcuccuggucagaagcucuuucugucaacucuuccuucacaagucaaaguuugcauguuggcacugccuguccauuuuggcaaagucugggaugaagugcuggaagcagcucuaggcaaucuggcugaacuauucccaaauacucauuccugcuucaaugcugcuuuccauugcagaagccaacaaaauccugcaccagcaccucggggccccugaagagcggcuugcucuucacauccucaggacucaggggcuggucccugagcacguggaaacaaggacuuugcacagcaccuuccagcccaacauuucccagguaaagggccuucccucccuugaagaccauuaucccugccccaaaugcaauggcaguaguugacauuuuugcgccuuuuaucuucuuugaauacuuugagaugcacagaaauagaaaugagacucaaauuagcgucauaucaaaagggaauuuuuuuguaagaauuuucagguaacucucuaaaucuagauaggagauuggccaugacucagaacaaaccagaaccagggucucucugugucucaucuguuucucugagucuauuucaucugcccucuugcugugaucaccuuccuaugaguccagauauuacagagaguccuugagugcuuguguguuguaaugcagccccaucuacuucuaaaugcauagggauuuguugcccaaacuuggcuccuuugcccaccaugggaccacugagcuccagcgaggugggcagggucugggaaagugauugagcucggcccgguucaggaggugccaucugagacuacaguaucagggaggcgaggaccauguggauagcaaugggggacauuccacuccagaagauggagagcaguuuccacagaagcaaagcaagacauggccacugacaaaauaaucuauguggaagcuuguuauaaugaagauguccaggccaugucugcagagauuuggauccaguaggucuaggguggguccaggaaucugaauuuuaacaaguaccugaagagguucugaucacacuuuaagaaauauuaaucuaggccgggugcgguggcuuaugccuauaaucccaacacuuugggaggucgaggcagguggaucacgaagucaggaguucgagaccagccuggccaagauggugaaacccugucucuacuaaaaauacaaaaauuagcugggcgcgguggugggugccuguaaccccagcuacucgggaggcugaggcaggagaaucacuugaaccagggagguggagguugcagugagucgugaucccaccacugcacucuagccugggugacagagccagacucugucucacaaaaaaaaagaaaaaaagaaauauuaaucuaauggaugcaaauauuguugacccugacagcaaaacuauggacacgcugauugcaaaaggguuggccugggcuuucuagguuguuuugucacuuccuucuugcuuuuauuuuguucuacauuuccauuucuuccuuuucuuacucuuccuuucaccaaagaacuuauuccuccuucuuucucuccucucaccccuuagccauaugaggaguuucaagaaaugacagagugaggaagauuucuccccgggaauccacaaacccccaucacuucugccuccagcauuagccacagacuguggcuggguuuggggagacacuggacgccuaauauucuguagagugcuugaugaauuguagagcccugagcccuagagauuaguugcaggagagucaggaucauaguaaaauacauccuuuucaagagcuccacuuaauguauuuugaucacaaugcauuaggaagccaaucuagugguuuccuuggcaacuuucuugaagaucaguuuguuuuugucugaagacagagucuacagaacacucaaaaacaguuugaagaauauaaauugguuuguacgguugauauaguuuuuucguggcauuccugaccugucuggaagaacauucgagucagauggaugggccaagucugugucagucaaagagcugagcaggaccucaccaagauggagcacaaaugucagucuaggcuuucaccuccccuuccugcuagccacuuaccugguggugggcacuaaugaaccaauggccaggaauccuuaccuuuugggaacuguaauauuaucauuguuugagcuccucuuuugaaaaugccauguuguuuuucuuuuacaaaauuaaauaccauuuucacuaauugcauucauuacuuugauuuuauauuuugagguaaguagagaaacccuuggguauggcaaaauggggauuggugucaggugggcaaugugauggauagaaugacagccugagaacugcuaaaggcgaaggacccaauuuuaagucauuguaagaggggggaugugcgcgcacgcgcgugugugugugugugcacgugcgugugccugccugugggauguguauguugggguuggguuagugaugggaagucugcaguuuuauuaaccaggcgagacccagacuaugauacaggugggcaugugcagccgucagagaccccugagugagaauggaaaguggguggccuaaaugacauuguacauaaaagauuaaccuugguuugcucucuuccacuucuugccuuccauguggacuaauaaauuagagagaccaaagaaagaaauaguuucaucuaagaaauaugaaagaaaauugugacuucugcuacccaucauauaacuucaguccucuuuucauuuucaaaugguuuagggaaaacuucagauguggguggauguuuuccccaagaguuuggggccaccaggcccuccuuucaacaucacaccccggaaagccaagaaguaagucagucauccugagacccugauacauacacugggcuggggacuugguccaggaccagaaaaaaaaguaccuuccaacugugcuucuugcagauacuaccugcgugugaucaucuggaacaccaaggacguuaucuuggacgagaaaagcaucacaggagaggaaaugagugacaucuacgucaaaggguaagguuagcaugugagagacuuugccaagcucagggaaacagacucucuccuucgugaguuuucauuacugaauaugcccaagauaggauucuugguuuuuugagguuauuuuaucucauuaaugugaucuacuuagguagcuccuggaaagcaaaggagagagagcaagaccuguacagacuuuguuuaugaggaaagcuauauaaggauuauaagaacugauaaauauuucuuuguuuccuuuuugacaaaauggauuuucuucaguuucuuaagcagauguauuauuucugggacguuuuagccauguaguuucuuuuuauuccucuuugauacccugaauaacuagccuuagaaacacaaguaaagcucccaaaauuucauuuucuacauauuuuauuaccagcagcccaugucuauggaaaagaggaaauguucgcagauuucaaaggaaguaauuuauucucccaaccugcacugagugccagcauccaacaugucaagugucauuguuguucaauauucucuuacuugccuaauucaauuaaaucgucucuguggauggcuaugccuugaucauaugccucgaucauagauguugcgugcaguacagcauagcgacuacauucuggugcuuucccuacugucugggcaagguaguuagcucgcuguuccucaucuguaaaauggugauaaugauuauucuuccuucccagggauauucaggugauccaguuauccaaagcauuuaggacagugccuggcacauaguauuguugcuauuccacguggacugaguuugauuccuugauacaugaaagauaagacuugcgacauuuaauauauucauaaagugagaacaaaguuucaccuauaaucccauguggccuucaaucaaaacuuuguuaaagauauaauuaguaucauuuagguucacuauaaacagggaauguuucaucaaguucuucauuauuauuuuuggaucucauuaccauucucuagggaaacuaaucucagcuaauuauauauaugcaaauuuauuugacuaucauaagcauuauuuuuuuuuuuuucaaaucagggaaacaaacucaaguaauucugaacggagagaaaacuccucuaaucagagaauaaagcucaacuuaaaguaccuugcaaaauuuggaauaaaaaucuaaauacgacaugugaaaagaugaaucgugcauaaauaccaugccuagugcuagacacagcuggguauuauauuacauaccaagcuauacauauacauacaugcacacaaauacguauaccuauaggagcuguuugacuugucuuaaaguaugaaaagauuuauguuuaaaauuaaaugugaaaauucaccaaaaaaagagaggaagagcuguaagggugagcagucuaggguaggaugauggugacccuuaggggugggucaggaggugaggccaccaaggucauggccaagagaaugugaacucuccucagugaguuaccuuaaaaguuaauagucaaaacugggcaugguggcuuacgccugcagucucagcuacucagaagucugaggcaggaggaucacuugagccccguaguuugaaguccaggcugggcagcauagugagaaccuggcucuuguaaaaaaaaaaaaaaaaaaaaaaagguuaauagucaaaaggaaucuuucaacucauuuaucuagucaguuaauugacuagcaaaaaggaaaacuacugcaguugauugguauuaauaccacuacuaauaguaggacuuaauauuuucaagugacuuugcaaucucugugguucuuugaggcagaguaacagauguggacuucgcaaucagacugaccugggaauccuacuuaguucugucaguucugggcuaugugaccuugugcaaguuaauauauucucucugaaccucaguuuccucuuccacaaaauggagauaguuacgcaguuguugggaagaauaaaauaaugcauguaaaguaccugguucauagaagaugauaacuguguguuaaagguaccuccauucccacucugccccugcuaaaccauaaucuuuucugucugcgugucgaccaugugaagggcgcacauaucauuaaucuuauuuuacagaugcgagaugaggcucagagaguuuuuccagccaggccugccuccuaccaugaaucucuaucuaucugugggguccaggcaucaauauuuuuaaaacguccccagucgauucuaaugugauucuaaugugcaguuucgagaaaaccaugcgcucucuauugcuuugacaguguaaaaucgaauguuacccccugguuucaaacuagaagucuucccaguagcaacaacuucuuucugggcacacucauucauucauucauuccuucaguagguauuuaucuagugucuacuaugugccaggcacaagcagaagaaaacuucucaaacguuaaaaguuaagauguuacugaaaugaaugcucauagauaugcauguggaaauaagagcugacaucuuccuugccgguaucauuaauauuaucauagugaauuuaagaauaauuuauaaaaaggaagcuguaagauuacuugauuugugcuucuuugguuugcuuaaguaaaauaugggaaaggaaaugcuaaaauuuugagcuaacucauauucauuuaaccuaucagcagugcugaaagacacugaugaguuauaguugugaggacuaaagucauagccagcaggcuucauuguacccaaaauagaagcuacauuguugauauuuuccagaaaauuucaccuuagcccuguuaacugaagucuaaaggguuuccugcuuugguuuuaggggaaugauauuuuauuuggccacaaccuguguuggaugcaauagagcaccuccccuccauaaaucacccccagcuccgaagauaacuggaaucugcccaagaaaagugcauuaauucuccugcucuuugcuccccuaauuacugcacaauuuugcggcuacaugacuugucaaucacgugaagcuaagucuguuugccucugccuuucagcuggauuccuggcaaugaagaaaacaaacagaaaacagauguccauuacagaucuuuggauggugaagggaauuuuaacuggcgauuuguuuucccguuugacuaccuuccagccgaacaacucuguaucguugcgaaaaaagugagcucugaaauaugccgcugggaaguggguaucauggaucuuccuuaacucagaagcucauagaaugcuggagcugcucaggaucucggaggucacugaguccggcuccuucucagcagagauggggaaucugccaccuugacacuuguccaaggucacacugcuaggacagguauuugugucauuaggaagcaugaggagcacaacuuucuuuccccucacauacucacauacugguggcgaaggauaaaggguagaaguaacgguuuuguauuaguauaaacaacaacccaaguguguucuuuaugugauggggagacugaugucuucccaugcuaggcagagucaagcagaggcccaguauuaaaguggguauccuuccuuaucaaacuuccacaucugcuuuaccucccucagaggcacugccaugagggcucagggcccuccuggucuuaacuaguuagacuuucaguuacagaacucaacucaaacuggcugacaccagaaaaacgauguauugguucacauuaccaaaaaguccaggcuucugcuggcuuuaagcccgucuggaucccacagugaagugauaaugacuuuagaaauugguuucacccuccacacucuuccccaggagacaguggcagccucagcucacauccuguccuccccgcaaaccucagcagaaagagaagagcgaagcccucauggggccaaccagaguucuguaauugggccucaaugucucugcuuuugggggucaugugccuaucccugaaccaaccauuguugcccagggaugcucugauuguccaggcucuagaguuagugacagaggcagcuucucuaaaauuuggggaaaaggggaguccgcuaaggaaaaucugggugcuuucauuccaaaaaagggggccuagaaccugcauagucaauaacaacagaugucuucuauaggugcccuguuccauuccugccuccacauucugucagcuuccuccucuccccacaccugaucagaauguaccagccaccagcccugugucgcauuaggccuacccucugcuggcccuacucagugcuaaugcuguaguaagcacuauuuuuuguuuuuuugagacagaguuucacuguuguugcccaggcuggagugcaauggugcaaucucagcucaccacaaccucugccuccuggauucaagcuauucuccugccucagccucccaaguagcugggauuacaggcauguaccaucacgcccagcuaauuuuguacuuuuaguagagacgggguuucuccguguuggucaggcuggucuugaacuccugaccucaggugauccacccaccucggccccgcaaagugcugggauuauagguaugagccaccgugcccagccagcacuguuuuaauaccagugggaugaacgccuucaaaggggacuuuuuucuuuuugagauagggucucacucugccacccaggcuggaguguaguggugcacucacagcucacugcagccuugaccuucugggcucaagcaauccucccaccucagccucccuaguagcuggaacuauaggcaugcaucaccaugccuggcuaauuuuuguauuuuuuguagagauaagguuucacuuuguugcccaggcuggucucgaacuccaaggaucaagccauucucccaccuuggccucccaaagugacaaaggggacuuuuaagaggcacagaagcucaaugugauaucaaaaaugcacacuuucagaugguguggcaucagggcugaugguggggaucagggcuuuagguaugguuaccuuuccuguuuacccacaucuagggccagaccuccccacacccuguggugcuuggagcaugauccuacccaggacagucaggcagcaacagauaacagcagagugggcugccgagccccucagagccaggcuuucugagcccugcaaaggaaaacauuccuggaauaugaaaaacaacccaguaaucuuccuucaaauucaugaaacacugggaaauucccuuuucacuggggccagaggaacuuagguguaccugagcuguaaagauguuuagucuuaguuaacauugucugaggcaauggaggcaagaacuugaaggacacuuaccuagucuuccuucaaccuaccucuagcaugaggaucugagggucuuaagugaccacaagcaaacaaaagccagugguuuguuuuguuuuguuuuguuucugagacggaaucucugucgcccaggcuggagugcagugguaugaucucagcucacugcaaccuccaccucccagguuugagugauucucgugccucagccucccagguagcugguauuacaggcaugcaccaucauacccagcuauguuuuguauuuuuaguagagacgggguuucaccauguuggccaggcuggucucaaacuccuggccuuaaguaaucuacccccucggccucccaaaguauugggauuacaggaaugagccacugcacccagcccaaugguauuuuucaaaggccaaaaaucccagacauucuaaaucugcacugauaaaagagcagaaguagaaucugggccccagucuccuuacccccauguaaaaugagagcauacucagacaucugugugggugggaggguggguagaaaguugcugagcagaagugacaccccggugggugauacugugggcugaucuagaaugccuggccuuaggaggauaaucuaaauaggacauaguggucuuugguggggagaugagucacucuccaacccccagguggcagcgggaagucacacugauagggacauggcaggaaaucuucuuugggaaaaaccugggacauuccuucaguugcccagcuugugauuuccuggggagccugacugcucucuguacagauagaguggaaggauuuaggcccaagggagugucagggugggggugcaaaggagagaaaggccccaggcuuugaugcugucuuaaggagccaaaggugaguguuucagagucaucaugaucauguuucuuuuuguuuuaggagcauuucuggaguauugaccaaacggaauuucgaaucccacccaggcugaucauucagauaugggacaaugacaaguuuucucuggaugacuacuuggguagggcuuacauuuggaucauuguuucuaagaaacuguacuuggaauuaguggggucaaugaaaacuuggaagcaauucuuuaaaucuucaauacuuuuugguaaugggggccugguggggggacaggggauacacccagugcuugugugagcucuuggcagugcagccugacagugagugccaucccuuuucaagggcucuggugagggucuugcaccagcuccugucugucugugaagacucaaguccuguuucugcagggggaugccacacuccuacauccacuuucaaaccagccacucucuccucagcaccugggaaucagcuccuacccuccucaaccuguucccaaguuaccaagguccccaacccccccgccauuucuccugucccuaggcccauucuccucugugguaagggcacuaguucaaugcacccuuagcccgggcccuucccucuccuggcacacuccucccucgccccccauggcacugugcucuccagauuuucacucucccaggcucuggucuugucacauuagccagcucuguuucugcaucccacucuauuuuuuuauuuuuuuauuuuuggagacaggucucucuguuacccaggcuggagugcaguggcacgaucauagcucacugcaaccucaaccuccuggguucgagaaauccuuccaccucagccucccgaguagcugggacuacaggcauacgaaaccuggcuaauuuuuuuuuuuuuucacuuuuuaguacagacgaggucucacuauguugcccaggcuggccuugaaccccugagcucaagcaauccuugcaccucagccucucaaagugccaggauuacaagcauaagccacagcgcccagccucccacuuuuugaauacaggccuucccugagguucuucugcucuccuccaacccgccaaccacccccuccaaggauuuacccacucucaccucaguggaaggucaugcuucaacucucaccuuuccacaaaguauggcuccuaaaccaggacguguagccugcgcucucauagugccugcaguacagucaaaggaaaucguugugagggucauuccugauuccuggccagaaccucccaccuuuauaucuggcuggcagugagccuguacugugacugaaaucucacucagcauuucuucccugaccucaccccugcucuccucaggaacuuauuuagcagcucacaaccccuccauuuccccagccacccaggcgaaagcacccggaguccucugugguuuuccuccucucuuuucuccccacgccccgccagccacuccauucuagcaaugucaucuguuuuaucacgcacacuuauuuucuuaguccugugaucucugccacuugccaguugaaacucacuuucugcuagccacauguuacaguagccccugacuggucucccuguuuccacgcugcuuccaggggucccuccuggcagaggaaacacccaccaaaggcugugucuuauuuaucccuuuuccccgcacaguaccuaaugcaaugguuuugacuaagugcuuaguuaagaggucagcaaauaaaugaguaugcaaguaggcuuacauaaaguauauggauaguaaauucuaggauaauaaaggguuugcccuuggcuuuguuuguugagacagagucucacucucucacccaggcuggagugcaguggcaugaucuaggaucacugcaaccuccaccuccugggcucaggcgauccucccaaccucagccucccaaguagcugggaccacagacacgugccaccaagccuggauaauuuuguguauguuuuguagagacaggguuuugccauguugcccaagcuggucucaaauuccugagcucaaguaaucugcccaccucggccucccaauauugcugggauuacaggcaugagccaccaugccuggccuucccuuggaauuuaaacaaaacuaucagacaacaaauaaagagaaugacugugucucaaaaugccaagugagcacauaaccaaaaggagaggggagacaaaagcagucauaggucaagaaaggcuaaggucacgugucuuauggguccacuauaugcugaaggguagucccugagccugacaguuuaaagagaaaaugccacaaccuccuuguugcucuuugcugccacugcugaaggccagacucuugccccagucauccauagacuugaccccacaucacagauaccauuuucuuaaggaaagggcucacaggaguucccaagcccaaaacacacuuuucccuuaccguggaagugguacuaaagaguuaauguggccgggcacagugggucaugccuguaaucccagaacuuugggaggccaagguggguggaucacaugaggucaggaguucaagaccagccuggccaacauggcaaaacccugucuccacuaaaaauacaaaaauuagccgggcauuguggugcacaccuguagucccagcuacuagggaggcugaggcaugagaaucgcuugaacccaguaggcggagguugcagugagcugagaucacaucacuguacuccagccuggguuauagagagagacucagucucaaaaagagugaaugccuuacaucauagaagggacaaugugcuucuccagacacucugauugaggcuaggagucucaguuccuggugagcguuuucuguugagucauguuccuucucaagcuucuguuucugagguuuuacuaggagagucuuggacaugcacauuucaugcagcauccuguguugguuuucuguuuuguuuuuuuugagacagaaucucgcucugcugcccaggcuggagaacaauggugcgaucucugcucacugcaaccucugccuccugggcucacgcgauucuugugccucagccucuugaguagcugggauuacggaugugugccaucgugcccggcuaauuuuuauauuuuuaguagagacgggguuucaccauguuggccaggcuggucuugaacuccugaccucaagugaucugcccaccucagccucccaaagugcuaggauuacagccgugagccacuuugcccagccagcauccuguguucuaagcaccuauugucuuuacccaaagccaaaugaccucucugcucagggcagcucagaacuaaaaggaaaacauuucacauccaagggccuugaguugagugaaaauugugucuguagauauuucauuacuuugaguuuaaagaacucuguuuaugcucauaucuuugagaaagaaaacaggagaugcugugcaguggacggcuauuucuucggccauuuuccuuccuaacuggaaagacuuuaaauguccaccaggcucccuuucucuaacucaccauuuaccuguucaaaaucacugugugccucucuccugauaagaacguucuguucacuugugaacaacagcugauccacuugaagcucauuuggacuuacuguuguuuccuuggcuagguuuccuagaacuugacuugcgucacacgaucauuccugcaaaaucaccagagaaaugcagauuggacaugauuccggaccucaaagccaugaacccccuuaaagccaagacagccucccucuuugagcagaaguccaugaaaggaugguggccaugcuacgcagagaaagauggcgcccgcguaauggcuguaugaacauuuccugguucugguugaaaaucguuuaugccuuuuaucauuuagguuuugcccuuuauccauagacuuacuccagauaaaaugaggaaguuuuaaauuggugggaguuuaaguuaugggaacaguuugucuuugggauauguuugccuuugucuuacaauauaaggugggagaugcugugagcauguguuuggaguuggaggaaggugaagaaguuggaauggucaaaaaguagaagcccaggugguuucacuauauuuuccuuucuucuucaucagggaaguuaauuaaugcuaggcuucuaguacaauuucguauggaaaagggaacuucacauuugaauuuuucucauuaaaaaaaaaagguagggcugggugugguggcucaugccuguaauccaaggcagguggauuaccugaggucaggaguucgagaccagccuggccaacguggcaaaacaccgucucuacuaaaaauacaaaaacaacaacaacaaaaauagccaguagugguggugcacaccuguagucccagacacuuaggaggcugaggcacgagaaucacuuggacccaggaggcauagguugcagugagccaagaucgugccacuguacuccagccugggugacagagugagacucugccucaaaaaaaauaaaaaagaaaaaaaagagagguggaagaagcaaggugugcuggcauuaguugaauaagaaggccauaaauuacaagcaaguugaggaacucaagauguauuuugaucuagaagcaauaguguggguuaccaugccauaucacgaaagacuaccuaguucauuaugcauuauuaaaaauagcuaacauuuuugaucauuaauuuugaaccaggcagcaugccaaguaccuuacauucauaaucuuuuuaaaaacaaccuugguguauaauuuacauaaacuguauucauuuaaaguacacaauuugaugacuuuugacagauguagacacucacugaaccauaaucaagauccagaaccuucccaucacccccaaaauuuccuugugcucucucucugcaguccauugcucccucccucccuggucccaggaaaccacugaccugcuuuccguuacaauacagcaguuugcacauaaccucacuuaguucugcugacaacgccaugaaguagacauuguccccacuuuagcgauuccaaaaacagucuuggagagauggagcaacuugccaaagucagaaacccagcuuugucugacuuguaaggguagaggucaucagggcucuacucagggccagggcuucccaaauuguuggugaccuugcugccuuuccuggcucuuagaaagucuguuacaaagucuguuacaaucuuagguauggcucacuauaaaagugggcagguuuguugcuuuuuuuuuuuuuuuuagagaugaagucucacucugucacccaggcuggagugcaguggugcgaucucugcuuacugcaaccucugccucccaaguagcugggacuacaggcgcacgccaccaugcuggcuaauuuuuuuuuuuuuuuuuguauuuuuaguagagaugggguuucgccauguuggccaggcuggucuugaacuccugaccucaggugauccucccgccucagccucccaaagcacugggauuacaggcauaagccacugcgcccagccaaaagugggcaaguuucuagaccacuuucacuuuggccucacuguucucauuugcacaugaggacaauaauaguaccuuuguaggguugccaugagcauuacaugagauaacccauguagaacauuuaaacggugcugggaacaucacucaggaacccgugagcagggagaaaacauucauucacucacucauucauucauuuauugagcuaguguacauggaguaccuacugaaugccagccacugugcacaguaggugacaaugauugauaggcaugaagagauauggcucuguucucuuacugggagccuacaauaaugcucaauaaauguuagauauuguuauuagugguauucagguuagucuggguccaagugaaguuacauaggaagguguguggggagacaaggagaccaaugugagaauguuagagugagggggauacagaaaaugaaaaguagggagugggggaagcaauuuguccucaaaguuucccacacagagucaguucagaaacacauggaagaggaaaugggaugaaaucucuugaggaaaacugaaggcaaucuaaggauuguuuuacaagaauaaaaaucauugcucggggaauacuccuuggguugaaguaaaaauauuugugaaacaugaugucauauguuuaaccugcucugcuuuacugaaggggaaaguggagaugacauuggaaauccucaacgagaaggaggccgacgagaggccagccgggaaggggcgggacgaacccaacaugaaccccaagcuggacuuaccaaagugagaggccuucuuuguucucccacuccccaaacaccugcaggcugagagccccccuucccauuggcuuaaugggauggauuagcuuuugugguccuccuaaucugguauuuaauagugguggguggggguggagagguuggugaucuggcuucauuuuaagaauucuccuuuccaggaaaccaaaguucagcaucuuaggaagcugucguagguuaaagagccuuucucagucaacgaaggggaacaguauuuuuucuugaccuuauuaaugugauucuuuauuccugaaacuguguuaugcucuggaauaaaauaugcaucccuccugaguuggguaggugauacuguuucuuugcaaugcagucgaccagaaaccuccuuccucugguucaccaacccaugcaagaccaugaaguucaucguguggcgccgcuuuaagugggucaucaucggcuugcuguuccugcuuauccugcugcucuucguggccgugcuccucuacucuuugccgguaggagcccuuccuuggccccuugucuuggcuuucuugugaguugcaguugguccucucccuuggcaucugcccugaccacugugcagaagaaugacccgcucagcagcaugggguuguaacccuucugcuuuggggaaauuuaaaguaaugugucuuguaauuagaaucacauucucaggguuucacaaauuacgggcagaacuuuucuuuaugaucugaaaauaacuuugguuucaggaauucuaggagaaaucacucaggucucggucagugugugucuggacuauggccagcguuuccagcugaucuuccugccuucagacuuucuuguuccaaaccauccugcauccuaauuccuuguccuagcuucaagaauccccaaaucuggguucauugugggucuacauauaccuuguguuccacccaaacuagaucauugaucccaaccuccccaaauauuauugcccuuaccuaucuggaugccuuugccaauuuuguuucucuguccacauuuaucuaucaaaaccucacucauuuuuuaaggcucaugucacguauaaccucccccuuaaauguuccccuaaucaccccagucauaaacgggaguccaagugggagauuuggcagcuugccuagaaguaguaccucccuuccuccauccagaggauguauugcgcaucuacgacaggcuaggaauuaaguuauagugaugauuaaauuauuggcaugauuugugcccaagagcaguucauauucugggaacaggcagccacgggaacaaggacacaugacuaagggaggugagcuguuauggagacagaaacaaacaaccgugggcacccccugcuaagacaguuccuccaaggaggggacauucaaguuugccaaguggagaagggauaguccaggcagaggaagccaugcucagaaguugggccaguggcacugaaugucacaggagacauucaaaagcucuuacuccaaaaacacauuaauaauaauaucagcugggcgagguggcucaugccuguaauccuggcacuuugggaggccgaggcgggugaaucacuugaggucaggaguucaagacuagccuggccaacauagcgaaaccccgucucuacuaaaaauacaaaaauuaguugggugugguggcacaugccuguaaucccagcuacuagggaugcuaagauaggauaauugcuugaaccugggaggcggagguugcagugagcugagaccacaccacugcacuccaaccuggaugaagaagugagacucugucucaaaaaaauaguaucguagccauacaagcagcagggguuuugugucuucauuuuuccccaguauaguacuucuaguuugucaucuaugaguauauguacacuauuauacagucguagcuggucaaacugcuuuuuuuuuuuuuuuugagacagagucucacucuaucacccaggcuggaguacaguggcacgaucucggcucacugcaaccuccgccucccagguucaagcauuucucaugccucagccucccgaguagcugggauuacaggugccugccaccacacccugccaauuuuuguauuuuuaguagagacuggguuucaccauguuggccaggcuggucucgaacuccugaccucaagugauccacccaccucagccucccaacgugcuaggauuauaggugugaaccaccacauucggucccaguccaacugucuugaccauuuaaaaaacuucuauuuuuuuuauuuuuuauuuuuuuugagaugggguuuugcucugucacccaggcuggaguacaguggcgcaaucuuggcucacugcaaccucugccucacagguucaagcgauucuccagccucagccucccaaguagcugggauuacaggcacccaccaccaugcccggcuaauuuuuuuauuuuuaguagagacgggguuucaccauguuggccaggcuggucuccaacuccugaccucaugugaucugccugccuuagccucccaaagugcugggauuacaggugugagccacugcacccggucuaguuaauucuuuuuccugauuuagauucuguuggcagccggguacaguggcucacaccuauaaucccagcacuuugggaggcugaggcgggcggaucaccugaggucaggaguuugagaccagccugaccaacauggugaaacccugucucuacuaaaaauuuaaaaauuagcagagcguguuggugggcgccuguaaucccagcuacuugggaggcugaggcuggagaaucacuugaaccugcgaggcaaagguugcagugacuggagaucacgccacugcacuccacccugggugacaagugcaaaacuccgucucaaaaaaaaaaaaaaaauucuauugguuuaaaccagugguuacugcagggcgugguggcucacgccuguaaucccaccauguuuggaggccgaggcaggcggaucacgaggucaggagacagaguccauccuggcuaacacagugaaaccccaucucuacuaagaauauaaaaaauuagcugggcaugguggcaggcgccuguagucccagcugcucuggaggcugaggcaggagaauggcauggcgugaaccugggaggcggagguugcagugagccgagaucgcgccacugcacuccagccuaggcgacagagcaagacuccaucucaaaaaaaaaauaaaaauaaaaauaaaccagugguucccaauuaggggagauuuuugcuccccacccccaagaggacauuugccaacgucuggagacauuuugguugcaacaacuuggcgggggggugcuacuggcacucgguggguagaggccagugaaagcugcugaacauccuacaaugcacaggacacuccccaacaagaaagaaucaucugguucaaaaugucaauuuuuucucaagauugagaaacccuaacugaaaaacauauauacauacauguuuuuuuaccacuguuuuuguuuccuuuccagaacuauuugucaaugaagauuguaaagccaaauguguaacaaaggcaaaggcuucauuucaagagucauccagcaaugagagaauccugccucuguagaccaacauccagugugauuuugugucugagaccacaccccaguagcagguuacgccaugucaccgagccccauugauucccagagggucuuaguccuggaaagucaggccaacaagcaacguuugcaucauguuaucucuuaaguauuaaaaguuuuauuuucuaaaguuuaaaucauguuuuucaaaauauuuuucaagguggcugguuccauuuaaaaaucaucuuuuuauaugugucuucgguucuagacuucagcuuuuggaaauugcuaaauagaauucaaaaaucucugcauccugaggugauauacuucauauuuguaaucaacugaaagagcugugcauuauaaaaucaguuagaauaguuagaacaauucuuauuuaugcccacaaccauugcuauauuuuguauggaugucauaaaagucuauuuaaccucuguaaugaaacuaaauaaaaauguuucaccuuuacaccuggcuguuuguuguaacugugggucaagugaggaaggaggcauuuuucuggccuuguuuuuucagugaagagaaugcccuggcauaccucuuggccauauacccuuuauaaauaugcugcccaauuuuagccaguaggucaaacugaauauaacauuguaaauaaaagcuaacaguuggcuggacagagcgguucacgccuguaaucccagcacuuugggaggccgaagcgggcagaucaccugauguugggaguucaagaccagccugaccaacauggagaaaccccgucucuacuaaaaauacaaaauuagccgggugugguggugcaugccuauaaucccagcuacucgggaggcugaagcaggagaauugcuugaacucaagaggcggagguuguggugagccgagauugcccuguugcacuccagccugggcaacaagagugaaauuccaucucaaaaaaaaaaaaaaaaaaaagaccgggcgcgguggcucacgccuguaaucccagcacuuugagaggccgaggcaggcggaucacaaggucaggagaucgagaccauccuggcuaacacggugaaacccugucucuaaccaaaauacaaaaaauuagccaggcgugguggcgggcgccuguagucccagcuauucgggaggcugaggcaagagaacggcgugaaccugggaggcagugcuugcagugagccgagaucgcaccacugcacuccagccugggcaacagagugagacuccaucucaaaaaaaagaaagaaaaagaaaaagcuaacacuaaagguacuuauucugugcacggcaguguuuuaagugg

SEQ ID NO: 18818 - RNA, 2735 nt, Homo sapiens
acgcuuuuaggagaaagcaaauuacuauuuuuaaugggauaaaaccagugacgauggaccgagacgaacuaguucugcgcucuugagcauagauucucccugugugaagugcggccccuccugcccugggacaacgggauuucacaaaggagcacagcccccuugucauccccucgggucucacucugucgcccaggcuggaguggaguggugcaaucauagcucacugcaaccucagucucccggguucaagcgaucgucuugccucagccugccgaguagcugagacuacaggcgcacgccaccacgcccggcuaauuuuuuauuaaaaaauuuuauacagacagcggaguggggggggggggggguggucucacuuuguuucccacucugaucacgaacuccugccuucaagugauccuuccaccucggccuccuaaagugcugggauuacugccaaaaaucagcagcacagcagggaguguuaacgggagagaugagaggcacgcccagguugaacgcugagauuaugaaugcuagcggaccggcuuucagaccagacugcuacccuccagccugauaucuaucuauugaucgauucuagcucuugauuagccgcuuugagaacguuacugcugagagaagaagcacaugaaauguuuagcagggccucccuuucucuccuagacccagcauaaacucgcuggagauuuaaaacaguagauacacaguagcaaaacauccuagguacacaauauuguacaaagguuauaaacucuagauuaggacuuucuagauuuaauuccuuacugcccugacuagaugugucuccuuggauaaauuuauuuaaccuauuugagccucgguuucccgauguguaaaaugaugcaaauaauaauauuuacuucacagcucgguuauaaggauuaaaugaggaaauccggccagguggaauggcuaauuccuguaaucccaccacuacgugaggacggggagcgaggauugcuugaggucaggaguuggagaccagccugggcaacacagagagauccacucucaccccacccaaucccugucucuaauuuuaaaacuuuaaaauuuuuuuacaugaaagaaauucauguaaagugcuuaacauuuaguaaauguucaauugauguuagccauuguuaaacaaaaggcaacacucaaauguuacugaauagaauggaugagaaaaccauguggggaauuuuaaagaaucagagaaacaaaaccaaaacagaaugcaagauaacguuugguaccugcuuccaaggagcucccauuucugaagggaagguaaacuaaaguaucaagugggauuagggugggaaaaaucagggcaaaagauaaaucaucgugugaacauuauucauugcccagaguugaggggcaaaauuaauuuccacagagauuuacaaagauucuuaaagagauauagagaaaaacauuucccuguucaccuucaagccaaauggggagcaaaaaaugggggagagggaggagggacccuggagagagguggcaccuggcggacuggcaccuggguagccagcacccaggccugcugugccagacacuccaauuccacaccugcccuccaggaccuucuuuucuggcuaaaggucgcccugugaguggggaccuugaggaagaggagcaaacaagaggcucauuggccuggggggcuuguuaaauucccuaauugccauugcuagcccugaaaauuaauguuugcucuuuacagauaggagcugccagucaugagguugugaagagcugguaguuuccacaagaucucacaaguacuuugauguugauaguucacucagggauagucuaggaugaagauugggaaacucaucuuuauucauguaaagagaaauguaacagccaagcagacuagauauuuaucuaagcaggugagcucauuuucuucccaguaggaaccuguucuugggaaaccaaaacaggaucaaaaggcugcugaauggguuuaaagauauuaaauggaaauagggaggcuguuguagguuagagcaccuaucaccuuugaagguuacaucuuccaaggcaaugcuaaugaacacacagggccucaccagcguguagaucugcacuguccaauacaacuuucugcagugauggaaaggucccuccugaucuauccaauaugguagcacuagccauagauggcuacugagugcuugaaauguggccaccguuauugagaaacugaauuuuuaacuuuauuuaaucuuaauuuaaaaacuaaaaguuuauuuauugaaaaacuuuugauuuucuuauuuuuuucuuuuuuuuauuauuauuauuuuauuggaaaacuuuuaaguauguuuggaacaaccuggguacaaaaaccuguuuuuucaauuguaaauuuuaugaaaucuacauauagaucaaguauuucugaggaagauuuuauguccaaauugaggugugugaauauacacagcagauuucaaaaacuuaguaugaaaaaagaauguaaaauauugcacuaauacuuguuuauauuauuacauguuaaaaugauaguauuuuugauauauuggguaaaaugaaacauauuaaaacggaucucaccuaauguguuuuacuuuuuuugaugugacuagaaaauucaaaaugauaaauguggcucauacuauauuucuauugcacagcacuggaaugcacacaauaaa

SEQ ID NO: 18819 - RNA, 9896 nt, Homo sapiens
augaaaaacuacuuggaugaauuauuccaaaauuccugcacaaguggaccucagaaggcagacggaggcgccaauuuggcauggccagggccugggcacucacgcaccagggagccucgcggguccgcucucgcucugugaggccacggucuucccgccagguugacucgagccuccugccagagccacuggccccggaggccacccuagaccgcagcuggcggccgcuggcacgagugcaggguaacugagccagggccgcuggcgcauuuggccuggccgaggccaccccgcgcggccgcuccacugugcccgaggcuguccuggaggugaggccggcccacagggacccugcccgugcccgggcuccggugagucagggcgcguuaugcaagugcccccggcgccuccccuucggucuuucaccccgcgcgguuacgaaagcgcgacccccuccccccggcgcuauaaagcagcggggcggccgcggcgcgcucgccucccucgcuccacgcgcgcccggacucggcggccaggcuugcgcgcgguuccccucccgguggugagucgcggccggggccucggggccggcggcgggaugggccgggguggggugggguggggugaggugggauacggcggcgggggucggcugccgggcacugacggaggcgcgucucccgcagggcggauuccugggcaagaugaagugggugugggcgcucuugcuguuggcggcgcugggcagcggccgcgcggagcgcgacugccgagugagcagcuuccgagucaaggagaacuucgacaaggcucgcguagguaucggcccagggggcccaggcggcccagguccccaccccauccccgcccuccccgcggcccgccgugcgcccccggacgccaaaccccugcugucauccuucucacaguucucugggaccugguacgccauggccaagaaggaccccgagggccucuuucugcaggacaacaucgucgcggaguucuccguggacgagaccggccagaugagcgccacagccaagggccgaguccgucuuuugaagucaguggccgccggggcagcugcgcccuuugcgcuccaggguuccccaagggcccugccugcugaucgccacgugggcauugugaagggaagggagcaccgaauggguggagggagggaggaagcccuuugcccggcuuggcugaggauccccuuggcuuuugcaguaacugggacgugugcgcagacauggugggcaccuucacagacaccgaggacccugccaaguucaagaugaaguacuggggcguagccuccuuucuccagaaaggaagugaguagucagcucugugggacugucuugggaauggggcgccuaccgggccaaaucgcuggguuucuucuccagagguaccuacccuuaggaagaauggccugcggaaaggucuggaagugucaggaacccgcagcaccaccugagguuaggggaacaagauugggagcagcuaccuacccccuccccaaaccucagcucaagaaaccuggccuaagcucaaaaggaccuuucgguuugucaggugucauuuuccccaccagccacugugccaaggugugugcuuucuccaugcuuucuccuccugucuuucacaucaccacuccaccuagcucugcauuuccuccgucucuuugggcugaaucccugagacagcuugacuaucuggggcucccacagaggccgagagagcccuauccaaggacggagggaacacugugcauagggguggaugccucccaagugccuggccugcugaugcugagauucugagccaggcacagugugcuguggcuguggccucuucccuuuccacuaagcugugaaaaucagauguggaggggagugauguugaggacuuguagaagaacauccuaaaauuuggccuaaucaugagaaaacagugucuacaugcucuuuuucccauuuuuuuccccauuuauccuaaguuucaaaucaggaaucuacuugguagcuagagaauaaugcaggccaggggacacauaucauggaaucuuagagagggagaguuaaccuuuuggaggggguucaauauguagaugaauaaacugaggccaagagaacuuugcccaaggacaugcaacaaguuuguuagagccaaugucagaagccaggcuuccaaaucucaggccaggaucagguggcccugaacugcagggacuccuaauccagaccagcuuuugcaaaguauuguuugagcucuucugugagauaggaccaaggguuguucagggagacucucucugcucggugauccaggguagaaguguccuuuauuguaacccuuugcucuccauauauggcacaccacccucuuggacuuccucuaaaguuguguguuggaugaaauugcauuuuuaaauuuuauuuaauuuuuaauuuuaauuuauuauuauuuuuuuuuuagagacagggucucacugucacccaggcuggagugcaguggcgccaucauggcucacugcagccucaaccuccugggcucaagccauccuaccaccucagccuccugaguagcuggaacuacaggcaugggccagcaugccuggcuaauuuuuguauuuuuuguggagucagggucuccccagcuugcccaagcuggucuugaucuccugggcucaagccauccucccaucucggccuuccaaagugcugggauuacaaguaugagccaccauaccugguagagaaaaagcuuagaagcuuuauuuuuauuuauuauccuuggaaauaauaaaaauuauuucaaauagugcagcaaaacaucccaaagugauuuauuuagaguaaaauauacuuuucugauaauggauuacaaaaaucaauaccagagguacaagauuauuaauuuuuagaaagaggaaacacauauguucuauagcauuuugagaugugcuccuuaauggacuaggauucuguuggcaaugccuuuaggcacagggucagagaggacccaaugagaagggagcauuuuguuucuugccuccucccccuaucaaaccagauuaguuugcuuuugucucuuguauauugguauuuuaucaggauuucauuuggagggcgaaaaaguacugccaucuugaaagugauugcuauagauauuaagugagaugacuauaauauggaaggcuuaaggauaaauuccuucuuagguuacauuucaaaaaagaagcugugcaguguuguaguuaagcccgcccgguuaaaauuagaccuccuaaguucaaaucccaacuccaccacuacuuguggaacuuuagauauguuccuucacuucucugugccuauuucgucaucugcaaagugaaacgaucauagaaccuaccucauagaguuguguuacaagaugcaaugagucaacaggcagaaagcacucagaacagugccugagacaugaguucuuuguaaguguuugauaugauggcugcuuaguuaucucccuggucgugaaaucauagcuuuagauucugggucuagaaugggaggacccauggagaccacuggguucaagucucuuguuuuagaagugaagaaacuggggcccauagagaagugacuggccuaggggcacagggugaauuuuuggcacuuagugacaccucuuaacccauggcuuguaaaaaggcacaaacaaugccuuuguuuucugaguaucucgcaaauggcauggcuugaugcaccuaccuuguucuguuuuacaugcuuguuuuggggucaucuuaacaaacucuacuuucauuccucgugccaguuucuucccugaccauggucuugcuuuaaacacugacuuggacagagggauuugaaggccacuccaagagugggcugcauccucagccucuccccugcuccacacacugcaucucaccaaacggauguguuuaaaaugaggugcgcuuauggagagaaaguaacucagggccaagcgaucaugaaauuuguugucgaauuauuuuaaaauuaaaugugaucaaucucuacaguugaaugucaguguuaacagacugauguggcuugcugcuccagccuugggcaugcuccauacuggucuucccuucuggcuccaccagcagcaagcaggaugucucagggguugaggauacuaccaucagcaggucuugguugaauacaggcuagccucccugagauuugacuuccuucacuaugaaauggggauaaagaauaguuucuauuucauagaaucauuggaaggacuaauuaagguaauuugugaaaaugcuuagccuagugcauaguaagugcucaauaaauauuaguuauaucaucauuguuuugugcucuuguagaaagaccuggacaaagacucuccuuguguccuucugucagaugaagucugucacucugcuaguaaaggggcccuugucagacugaauaacaaugcaagccugaauguuuacauuaguguuggucaaagucaggguuccugcuccaucuauaucuaaauacacuagggugcuuguuaacaaaugcacauuucuggacucaaacccagaauuauggagucagaaauucuaagggcacggcccuggaaucugcauuuuaaguaugcuccuuggguaugcuguuucugcacaaugaaguuugagaaccacuggucuagauaauucaaucugaagagcuuggcuuacucagguaucaaggccucagacuccacucacuuuucuggggccuguugggguauuuugacaaugcaucagaaauagcauugaaucuguugccuggcuggcucagcuggacuguuaggccugagaaccacagggagcuucccaccuggucuugcugcuuuagaugauuggagcaugcagguuuagggagcugaaaggacacaugccaggcccacagcagugagcaacagaacagaccaauggaaccagguugccugagacagcgcccucuaccaagcauuuucuuugguuuugggacuggcaguccaaaccgcuaaaccagucuguguagguacaguauacacacagcugcagcaugaccccacuuccuaggaugguagaggggaggcaggggcucccagccacacagccacugccuccaacgcucucugucccuagcuccacugcaugcgguuagcuggagucuggaaauggcugggggugucugguucuccagaggagcccugcccagcugccgggugugaggagguuagagaaccaaccucauucucgcagugcucuggcaguucaucucuugcaaauacucuuaaaagggagagccuggucaaggucacuaugauuuaaauuccucgucuuugaauuauucagccaaaagagccuggagauuaaccaaaccaacuuaggccuucuuuuaaagucaagaacaguagccaauuuuacuaaauccaaguauugaaaguuacuuaauuccucugucaaaauuuaaaugauggcgaccauuuuggaggaaaaaaaaaaaaaaaaaguuaagcugccgaucggccaagcuaauagcugccuggaucaugagucgagguaacauuucaaaggcaaguguuuuugugucugagggugccugugacagacacugugauccucguaaccagggaaagaaugacuucauccaaggaugaggaagaccacccagauacucuggagccugugaggggagucagugguuagggugaggcccagcaggcagcccuguggcuucuguucccagccuuucugcugaauaacuuuaugguuccugcugagcagucaugguucuggaacaucuccucagccccaccucugacacuguuacccuggaacagccucaaggcacaggaguggcucauucuccuggcaggccuagggugaguugaagagaggggcuccacacccacuccugugacagccccccugcagagccuggguuugggcugaaccccauccuaggcuggcacuccagggguucucagagaggcacacccagaggcaacuuaggaccagcauuccagguggccuuacacccucuaacgcugggggauccaguucccucugcgcuucuccaacuggaacacugcagagggagcaucaccccuugcuccaacaccugagccugagauggagacacaaagccuuuuuguuucuugccccucucccgucaguguacugauugucuggagacagugugguguagaggugaagcaugugggcucugggaucacacucccuugcuugaaucccaguucugcccugcucuuugugacccuaggugaauuauuaaguaucucugugccucaguuuccucaccuguaaaguagaggaugauagugugcaguuuuggaucaaugugagagguaaccgagaaaacaaaugggaguguccauacagugacuggcacauaauuaagugcucagaaagucccaaucaugguauugugucaacaagaagguuaaauuaaguagagauguggcacuuuuaucucaauacagggugacacuguucuuucucuguggcaaaucgcucacauacauucuuuuuuucuuucuuuuuuauuuuuuuaagacagaaucucacucucacucaggcuggaguacaguggugcaaaccuagcucauuguagccuugaccuccugggcucaaaacgauccugccgccucagccgcaaguaguggagaccacagacgcaugucaccccaccuggcuaauuauuuucauuuuucauagauaccaggucucacuauguugcccagguuggucucaaacuccuggccucaaguuacccucccaccucagccucccaaagugcugggauuacaagcacgagccauggugcccggccacacauauacucuaauuaacauucuuuccucuccugccuucguugauauuuuuaccacuuucauuuacucuuauucuucauggcuuacauuucagccuugaggaauacauauaaucuaaauucaguggcucagcucugccucugugaguugugaagaggacaaggucugagaaggaauaucugaugccagauggugggccucuuguguccucaaggcaaaaccuacucuuugccggcacaaagaagugaguagcauuaauaagcagaauuaggauggagccagagaagccgugaccaugggcguggcauccuccagaggacugagagagcggggggcagcccggucagugaguugauuaggaaccagcgauagagaucgagaaagacauaagccaauauuggggguaacauaaguugguggccaucagauauuagccacaaaagacacagauauuauuggagaguagauggugaagcgacaguagaacgguuuauucugugguuuugaugagcccacauucuuggugguucuuuggaaagaugcugucacauuaugcugacauaaucacagggacagaugaugauugaagugaaugagauuucccugacuccaagauuuuuuucaauaaaggagaacaagauccuuucugauuugccaaauuuuauaaaaguugucagaauucucugaaguguccugcuuccuaaagaaauaaaaccagcuucuggaagucacuguguucucaggccuggucgugaguuucuccgacaucugagcccaugagggaaaggcauugaucggcaugguggcuuucuggcuugcagaugaugaccacuggaucgucgacacagacuacgacacguaugccgugcaguacuccugccgccuccugaaccucgauggcaccugugcugacagcuacuccuucguguuuucccgggaccccaacggccugcccccagaagcgcagaagauuguaaggcagcggcaggaggagcugugccuggccaggcaguacaggcugaucguccacaacggugagucaggagcagggugccuucuggcucuuccugcagggcaguggguuuggacuaaggggcccacgugcuagugaaauucauuuuguccguaccccagagaaaacagggguucuugggagccccuuucugaggccaaauccagauccugcuuggccagauuuuucacuggccuucucauagggcucaugcagguguggguaaaggccuuuguccaguucacuggcacuaacacugccgugggcucucuuuucuuuuuauucugcuuccucgggccauuucuguggucaccccuggcuacacugccccaaaaaaccauugugacugaauuaagauuguuugggauugagcagcccaguaaagaggugggcaguucauguggccauugacguaaaaacuccacagggggcaucaauguaguaagcuccaaagagaaugauuucaacgcaccuucuuuuuucuauaugaaaccaaauagccaugacauugucuagcuggguuuccucaguuggggguuuugagauucucuggaacaaccauaggaucuuuuaggagauauuacccuugucugaucuugauuuuaaagccaggaacauugugcaggaaagagcuccauuuaguuugaguggacacucacucauugcuaugggauacuggguuucaaaauccaaauacaguaaugcuaaaauguagagaaacaaaaugggccaggcaugguggcucacaccugaaaucccagcacuuuuggaggccgaggugggcugaucacaugaggucaggaguucaagauuggccuggccaacauggcaaaaccccaucucuacuaaaaauacaaaaauuagccaggcgugguggcaugcgccuguaaucccagcugcucacgagguugaggcaggagaauuacuugagcccgggaggcggaggcugcagugaguugagguugcaccacugcauuccagccugggcaacagagcaagauucugccucaaaaaaauaauaauaauaauaaucaaacaaaauggagcauuucuguuggucacgaacugacccacuacaccaaacagaugggaacuuagaccaaaaucaaauugauuuugaagcuucacccuucaaaauuaaauguagggccagcaaggauuccaccacagcagggcaccguaggaagcagauuaugcacauuguacagaugagaaaacagaggcugacaaugaggaagaaaguugcccuaaaucuuuaauagguagcugaguuggaugcaaaccuagaguuuugugacucugaagucccuugugccacaccaucuggugacacaugacaugagacauagaagcacuuuauaaaaccaucaccagugugucccaggucaggcugccuuggcucccacuuccugaaagcugaggguggccuccgacacuuugaaaugcaauaaggcagacuuaagagaaaucaaaggaagcccuguucauccagcaagucauauucucuccacccccauuacguccagagaaaauucaguggguuucagaaacagccuugaagguguuuaugaauuacagccaccuguauccguaaggguugcaaucugcugugaugcauuugaauuaagaagcauuugaaugaagccagcucuaaggccaucaugauguucauuaucuacauaaaaacuggguccacuuucugucguuaauggcuuuguuuuguauuuuccagguuacugcgauggcagaucagaaagaaaccuuuuguagcaauaucaagaaucuaguuucaucugagaacuucugauuagcucucagucuucagcucuauuuaucuuaggaguuuaauuugcccuucucuccccaucuucccucaguucccauaaaaccuucauuacacauaaagauacacgugggggucagugaaucugcuugccuuuccugaaaguuucuggggcuuaagauuccagacucugauucauuaaacuauagucacccguguccugug

SEQ ID NO: 18820 - RNA, 35671 nt, Homo sapiens
ggagaggcugaucugaagcgcugaugagcugcucugagaggauccuccgaggaggcguuacuaagguuacuagagagaggacggcaggugauaggcacgguaaaacaaaauauauuuucaaaugagaggcgugggcuaagcagcaagcagugccagcgguacuagaugccggauucccuagaggggaaaggaaggaggcccagggaaaaacugggagccgcgacuuggcgaaagcuggaagccucuucgucccuuuccgggccguuucucccgcugcccuuguuucccggagcuguucuggcuguagcacaaggucggcgcacucgggggacggugccauuuagauguaacacguggccgugucggaccggaaguggugcccagucgggacccguagggagaggcggguugcgggcggcggcggcggcggcggcggcgguggugguuguggcgaggcugugcggcagggcgcacgggaccugugcugcagcggcucucucaggccgugggucgucgcugcagcugccgggaaagaaggaaacgacgacuccgggggcgaacuuggcacacagggaggaagggaaagggugugugaggagggcuguggguauauuuggcaucagggagaaggaccucaaaacuuguuuuucauauaguacuagcugaucgucggguuuuuuuuuguuuugguuugguuuuuuuuuuuuuggaugacagauucuggagacaccuggcaucuccguuuuugaguuucuccccgcucuugucaguugauucguaggccugaagugagugagagcuuuuuaguucaaccagugaguuaagauagguaugggucggauggagcggccagcgaauaaagaaaugggagagugggagcaagaauaggaagucguguccuggggcgagggaaaagaugaugaugaugauguaacauuuacuggguuucacuguacaagacaccguuaaaacccuuuagaugaggcaacucuuuuaaucuccauucguaugaggucagccaucuuacuagccucuuuuuauaaaugaggacacugaggcuuggagagguuaaggaacaggcccaaagaaagacaaauggaaagugcagagccaagcagugaaaucuaguaggcugauccuagaauauaucucuaaacacacuacagcugucccccaucaagauguaaagaacgugaggacauaggacaaagagugagaggacaauauggcuugaacagaugugguaagacagcuggaguugaccuaaaaaaggguguaaaauccagguguguaaggcaauaacagauguaagggaggguagaguuggaacucgggcuuucaaaccuucaucuccaaccuuaacuagcaucuuccuaucuaggauuuuaguggggcagagaagagagguauauacccacacaccuauguuugaaaauggaauuacagacuuuaaagguuauuuaaagauuuaaacaacuuaaagauuauuucauguagcuaucuuauuuaauagaugaaguccagggagaugaaaugacuuauucaagguagccaggacuagaaacaugucguuuacccuagauccaaugcaaugaaguuuagagaguucuuuccucuuuuuccagcugcacuugcugucguuauauuaguuuuaacaauuugauauaucauuuaaccuggacuguuccuuccagccauguaaauuaguuauguaugacaucaaauaguccauccuuccuucuuaguguguguuccaaauucagugcaaagcuggaacuaggagcuucuuccaauacaauugaguggcaacugaggucuuccagcauuucuaagaauuucaguucuaaaaugaagucccagcauuuugggaugcugagguggacggauugcucaagcccaggaguuugagaccggcgugggcaacauggcgaaaccccuuaucuacaaaaaaaaaauuuuuuuaaguuugccaggugugauuaugcacuccuguagucucagcuacuuggagaggcugaggugggaggauugauugagcccaggagguugaggaugugagccaucaaggcgccacagcacuccagccugagcaauagagcgagacucuccaaaaauaacuggauaaauaaaaugaaacaagagaaagcugacuaauccaaagggcaaggugguuuaccuuaaagaaacucaaaagaaaauggaaaucucuacauauauugaaaaagauuacaggaaaauuuucaucaauugaugauguacuguucacaaauacuguaauucuccuggaauauaguaaaucauauuccagagaggaaauuuggaguaauugaaauugugggcgcaggaaucaaguacagcagauuagccacuuacuggauuuguaaauagauuuacuuaacuuugauuacuucauuccuaaaugaagauaacuuucuaacuugcagaauuagaaguguuguuuguaaaguauuuaacacaaugucuagaacaaaguuggugauaaacacacagugauuauuacuacucugaaucaaaagugaaggauugcuaaaccuuguaagcagucacugcagcuuuuaggccugguuuuucagugaaaagaucaaagaguagccuucuuuguucaccuaaugauaauuaagggugaaaaauguugaugcauuuccugaaagguaugucucuuauuuaaaagcgaaugaaaguuuuagauggcuagauggccugugaauaggaaucugcccacaaugauccuuuaaaacuauuguggcuguuuaagauaacuuauuuuugaauuauuguuuccuggacaauuggcaacauagauucuaaauagcugacuuuguacuccuuuacagaugcauggucauggaggcuaugauucugauuuuagugaugaugaacgcuguggagaauccagcaaaaggaaaaaaagguaaguaauuuuuuuuuauugaucuauuuuucacauccuuucuagauuaauaugaaguauaaauaaacaagagugaaauuuuugaauucuguuuacaugugaagacaauugcucuagugaaugaauuuuuguucauuaagcuaauacauugauuaaaaauuggagaacaauugugggaaaaauaaaaauuaauucugcaaagggguuuauugaaagggaaagaagaguuucagauuucuggaaucuuuucagaaaucagugaaaccuuuucauuacauauauuuuucauucaacugucaaggacuguuuauuuguaaauguuguagcucagaaggggcuugaaugguggucucuugccauuacuugccuucaaagugaaguuaauauggaggaugaaaguauaaugcagcacaguucuuacgcauacgugaaugagcagacuaaggucacgggaagaaacucaaggaagguuuuuuugaauugcaagagacaaaaacucuuagcacauaaagccugugcguuauaagcaggauacgucuugguggagcugcugugcguaggagcauuguucuuagcuuucagugcauagaaacucaguuuuauacuuugacucaggagugguugacugauguauacuaaccaaacuuacacggcuguugacugauuuuuuuaagcaaauguauagaaauuggcuuauuauuucacacugagagcaauauauuaggcauacuaacagguucugaacauuuuuauaggauacucagucucugcaauaaaggauaguacuaauuauaauaaauuacauuuuugaugcuuuacauuuucuagauuuuucauucaaaaauacuacuuuguaagaauagaauuugagcaaaucuaguuggauacucugcuccaggauuauauucaucacuauaacuagggcugacagucuauggcaggguguccagucuuuuggcuuuccugggccacaucggaagaagaauugucuugggccacguacuacaguggagcacacacaauugugaaucuguugguucacauuguuggccugaagcagugcugggccugcguaaaauacacuaaugauagccaaugagguuuaaaaaaaugugaaaaagugucuuaauguuuuaagaaaguuuacaaauuuguguugggccacauucaaagccauccugggccacaugaggcccauggguugggcgagcuggaucugugguuuguguucucuauaaucagccuugcuuuuuguguaucauuaauuaccaaaaacuuccuuaucacuauguuacagauagagaaaugaagaaacaaagagauaaauaauugaaucuuauuaagauuaagguaguaauugacagaauuaggauuugaaucaggaagcuaggugauaugacacuagaguccaugcuuuuguuaguuucaucuuccccguguuauagguauuaaaauaauguuaagguauuaauuaagcuauuuaaggaaauguaaaauaucucauuaaagaucagugagucuucuuaaaguuaagacuuacauucuuuaaaguauauuccaguuaugaaaauauaaagaauuagaaaauaaccuuugaaaaaagugaacucuuauuuucuucuuaauauaucaggacaguugaagaugacuuacugcuccaaaaaccauuucagaaagaaaaacauggaaagguggcccauaaacaaguugcagcagaauugcuggauagguaugguauuucagugucaauucuauuucuugguuuaaguugcuucggauuaggggauuugauuauguuaauuugaauauaaacauuuugaauuuucuuaaaaaaauuuguuuuaacagggaagaagcaagaaauagaagguuucaucucauagcuauggaugcuguauccuuuuuuuauuuccagauuuuuauaacuaguagaauauuuuaaaaucugcuuuuuuguuuuauaaaaucuugugaagucaaauaggcuuuuuuauuuuuaaagauaaguauuuagugauguaggauuuugccauuuauacuuuuggguacaauucucuuuuacuaauauauaggaaagauuuagagacaaaaauaauaaaacauauuacuaguacucuauaaauagguuuauaaaguacaugaaucugcaaauauauuuuccaaauuguuuuuucaagcuuucaacauuuccuuuuccuauacuuaucuuuagucucauuuuaauuuauucucuuccuaccugguucuuugcuauuuaaggucucuauaaaacuuguauuuaaaauuaggucuauccagucugucccuggaucuaaggaaaaaauaaaaauaaaaugaggccugccuguggacuguccucaggccugccauggcuuuaauuuuuaggcaugacuuaaagcuaucuuuaagauaaacccugcuuccugguuauagccauuugucaacucaguuuuuuaauaagacuggcugaugacacuaacugcuacgcuggccauccauacugcuguugagaauauuggagaauuuaagagauaccaagcaaaaacugaaguauuuuuggguauuuauugcugugaucagaauugggagaaggagacagugucaauuugauacgcccccuaccuguaaucaucuguuucacugugcuauuccaauauuuuucuuuuaaguuauagaaguaccauugugucacuaauugauuuauucuucuuaucuccuaacccaauagcuagcuuuuccauggaucucaucugccauuuguuccuuuagcauuuaaacauuugcucugccuucucugacaccuacugcauugggggcaccuaguuauagccuggugagagugaaaguauggguacucuuuuuucuggcauaggaggaguuggagccacaguuuuuuuuguuuguuuguuuuuuguuuugugugugaggauuuauuuuauuuuauuuuucuuuauuuuauuuuauuacuuuaaauucugggauacaugugcagaacgugcaggauuguuacauaggguauacauguaccauggugguuugcugcaccuaucaacccaucacccucacccuuccccgcccaccggcuccagugugugauguuccccucccuguguccauguguucucauuguucagcucccauuuaugggugacaacaugugguguuugguuuucuguuccuguguuaguuugcugaggaugguggcuuccagcuucauccaugucccugcaaaggacaugaucucauuccuuuuugugguugcauaguauuccaugguguauauguaccacauuuucuuuaucuggucuaucauugauggacauuuggauugguuccaugucuuugcuauugugaauagugcugcaauaaacauacaugugcauguaucuuuauaauagaaugauuuauauuccuuuugguauauacccaguaaugggauugcuggaucagauguuauuucugguucuagguccuugaggaauugccacauugucuucaauaaugguugaaccauuuuacauucccaccaacaguguaaaaguguucguauuucuccacagccuugcuagcaucuguuguuuccugacuuuuuaauaauugcgauucugacugggaaccacaguuuucucuggguuguuugacaagaguagaguaguuauugucucaaaguugucuugcuaggcugacucuuggucauuugguuagagagaacagcuuuuguugacgauuuuuuaguccgugccuguugguguuuccggguugucaccuucuuuaccuccaauucuaggauacaugagacaaaaagaaaaccuagggaacucgcuaucaugucauaccauaggucuucaggaggucccuagcggggcgccuucuuccuuccaccuuuuagagucuuuuuauguuugauauauaauguauaaggauuuuaguuguuauuaguaugaggaauagggagaaguacaucuuugccuacuccaucuucccggaagcaaaaguuacacccaccaccuguucuuguacauaaaauuauauuggaauacagccaugcuucauuuauauguugucuuuggcugcuuucaugcuaaaauggcagaacugagcauuugcaacagagaccauauggcuugcaaagccugaaauauuuaccaucuggccguuugcagaaaauguuugcugaccccagcucuaauagguuacaugacuugccauggucaugugaccaguuagugguagaucaagagcuagaauccagaucuccagguauuugguuuuucugucucucucuuuuuuuuuuuuccugaaauauuaacugguuuguuacaauauggaaauaccauaaucugauuaaauugucuguuaguacacauuaugaucaguuaaaucacuauacauguuuaauagucacagagaauauuguagaaggugagguuagcuauuaugugcauguuuggcucuagagagagugcuguugagcuuuuuaaaacaaaaaguaaaaugcucauauauuuuguuacaaugcuuugaaaaaacauggcauuuuauucuuugaauuuaaaagacuauaaaaauugauuuuuuauauuugcuuuuuugaaaguuuaauguugggauuuaauuauaaauuauaaauauaauuauaaaaguugcaucuucuauuuagaggcuuuaucauuacuaaaauagauaaauuauauuuuaugauaaugaaagauaaauucucuacuuuuagaaacuauaauuuuuaaauuuuucauauugugauuauuagaaugaguggugguaggaggcuauaugcaguucagcaauagaauaagaagcucuauuucuccccagauggagguauauuuuuaucacaagaguaguauaugcuugaaaaauagucaaaagaaagccuguacuuuacaaucuucacuuucaacaauuuaauauauacccuucuagauuuucugaauguguaagcauguauagugugugaauauuuuuaaaaagcuaaauagacucauauugugcuuuuuuuuaccaccaaucagcaauauauuaugacaccaaacagcuccuaagagaauaaaauccuuaauuuuuugcauuucaguaucaaagacauacaaaguucguaaaugacuauauuuuauacuaugguggcaaaaaagaagacuucaagcguuugggguaaguaucaggaaguuuacauagaagggaauguggguuaugggaaacuuuaaagacccacagcuacugugccuucugauucugucauucuucccugcuuucuauuccggugugccuuuuuuuuuuuuuuuuuuuuuuuuuuuuuuuaagauggagucucacucugucgcccaggcuggagaacaguggcuugaucucggcucacugcaaccugugccgcugugguucaagcgauucuccuaccucaggcucccgaguagcugggauuacaggcuccugccaccaugccuggcuaauuuuuguauuuuuaguagagacgggguuucaccaucuuggccaggcuggucuugaacucgugaccuugugauccaccugucuuggccucccaaacugcugggauuacaggcgugagccacugcaccuggccccaguuucuuuuuuauauuauaagguagagauaccauccacagcuccugaguagcucuucaugaaucccauuuuuuuggacaggccucagguagacucuuuaccugcugagccgggcacaacccuggugauaaaagaauaucugaagaauacucaugugucuucuuggcaaagaucuuugaaauaaggaaauuuuuauaccuugauguuugggauugcuuuuuaaaagauagguaaacaagaacucucagucuagcauuucuugcacaucaaaguccuucccauguuuaaggcucuucuaucagaacuuguuuuuuguuuuguuuuguuuuuguuuuuuuaaauuuuuauuuuuauuucaauaguuuuugagguacaggugguuuuugguugccuggauaaguucuuuaguggugauuucugagauuuuagugcacccaucacccaagcacuguaugcuauaccuaaaauguagucuuuuaucccucaccucccuucuggccuucccccacauugagucccuaaaguccauuauaucagucuuuugccuuugcauccucauagcuuagcucccacauauaaaugagaacauaugauauuugauuuuccauuccugaguuacuucacuuagaauaauggccuccagcuccauccaaguugcugcaaaaagacaucauuucauuccuuucuauggcugaguaguauuccaugguauauauaaaugguguguguauauauauaugguauauauauauauauaugguguauauauauaugguauauauauaugguguguauauauaugguguguauauauauaugguguguauauauaugguguguauauauauaugguguguauauauauaugguguauguauguguguauauauauauauauaugguguauauauauauauaugguguauauauauauauauauauauauauacacacacaccacauuuucuuuauccacucauugguugaugggcacuuuggucaguuccauagcuuugcaauugcgaauugugcugcuauagugugugugugucuuagaacuucuuaguuuuaugugagguuuuuuuuuucccucuaacaauuuucugaguugguaggacucugagaaaauuuaguaccaccucauuuacccccaauuuaucucaccuaucaauuuauccuauaucucccaacaaucacuuuuuuuuuuccuuuuuuuuuuuacccccagacuguuagcauuuuauuuugaaaggucaaucccuuuggcuuucuuccuccuuuacucagucuucuaccuaggaaacuaguaaaaugagauacggaaaacuuuucauauuuuuuaaaauuaaaucucagcagagugguugguuagaaugaaacuuauuuucauucacuuuauucauuuaguguuuagucagguuucucauucuagcuuugguaacuuagcaccauuuguauaauugaaaccaaugcuacagacagauuccuuauccauuuaacuugcuucuguaguaguauuuuuauaagugccuuuugaaaauacugaaauauuuuuauaaauaugugaacaaauuuauacucaccaaaaaacuaucuucauguauuauauuuuuaauaaaauuuuccaaaacucacagagcuauuuaaccuaaauuugacuacuuuuguuuuuguauuaaauugaaaaaguucuguuuuccagggaaaaugacaagacagacuuggauguuauacgagaaaaucauagauuccuauggaaugaggaggacgaaauggacaugacuugguaauuagccaucagaggcguaaugcaucaaaugcuuuaguccuguuucuccuguuuucugagugguuuuuuagucaagguguucagccccuucauagaacaguucugaaucaaggacauaaaaucaagccuaggauuauuugguucuuuugguaauuuuuggcaguuuuaacugacuucucauuguuugacuuagucuucaaaaaaauaacauucuuuuuuacaguauuguguguuaucuuguaauauguuauuauaugcugcuguuuuagaaaaaagucauaccugaaaauguuuuuuuaaauccaaacauuacaaaggguaaacagugaagagugauucuccuucuuauuugugacugucaguucuccaauuucccucccugagugaaccacuuuuaauaguuaauauccagauauuccaugcacauguaaguaauaguucucuuaaaacauuaauauuuauguaguauguauucuuugacaucacuugaaaguagcaaaccaugguugaguuucuaaauguauaauauuuauauuuucaugggucuagggagaagagacuugcuaagaaauacuaugauaaauuauuuaaggaauacugcauagcagaucucaguaaauauaaagaaaauaagguaugcuuuccacauauuuauggaaagagguucuuauucaaguaaaauauuaacuuuuauuauacugucaugccccacauuauucuuuuaaagaugcuaauucuagacucaguuguccugcguuuaugaugugucauuuggaccauuuaaccucugcagcuguggaguuuacaaaaggccuauggaaauuuaugaaggacaaggaugcuuuuuuuuguuugugagcugaggcaugaaaagucuaaaauuaaacgcaaguggguauuggauccuguuucauccugacucuagucuagagccucuagugauuguaaugaaugacuuaacucuacagaauaaugucuuauuucacagaugauguuugaaacugauagauuuuaaaaauugauuaccauuuauagagauccagaugcacaucuucuauuacauaaaugucuauucuaguaaaauuaacauuucaaucagugcuaauuaguaaugacagauuuccuuucccacuuuacaucuuacuuuaguuaauauuuuuauuuuugguugggcgugauggcucaugccuguaaucucagcacuuugggaggcugaggcaggaagauugcuugaggccaggaguucaagaccagccugggcaauauagugagacuuugucuccacaaaaacuaaaaaaaauuagccaggugcaguggugcaugccuauaguucuagcuacuugggaggcugagguuagaagguugcuugaguccaggaguuugaggcugcagugagcuaugaucgugccacugcauuucagugugggugacagugagacucuaaaaaauagaaaguuacuuuuauuucuaucucaaacaucaaauuauagcuggaaaaggugacccaggagcagaucucaguuagaaaugugagaggagggaauguugcauaaauauguguuauagauacuguauauuuguauuaagaaaaaaaccuauuuaaaaagcuaucuuguauuuaucuaucaugaagauuuauuugucauuuaaaucauuugaucucauuagaaccaggguugauuuaauaauuuuuucaguagugccuuuaauauguguguugcuucacaguuucuuauagaaaauaguaauaauguucauuuuguauacccuauuuauaaacccgugcacuuaauuuauccccagaacugcuguuucuuaugaacuaguuauggacucugguucacagcugucuucucuguaccacaucugguucaaaaagcaccacaguaauuggaguuacuuaaaguuacuguauuguaaaucaagugugaaaauuaugucuuucuaggagcauguaacaaaggagauuuuucagcccuggcuuauucauggauuguucuuaaguuguuguuuuuuuucuuuuuuucauuuauuuuuccccaccuccuaauaccaucauaauucuucaguauuuuguuguuguugucaguaucuauugaaacuggacuagguacuguggguuaauacauggugacuacuuuucagaaaaagcuagucuaguugaggggagaaaauauacauaaauaaaaauuaaauauuugaguucucaauuuuucaaaaauggauaccacuagaaaucguacuuuaaagaaaauaaucuugaaaaaauguguauuuuccugcuagaacaugaugagugauuguacaugagaguaaaugcagcaagaaauccgauaugacucgcagauucugaccauggaugcugagaaaaauacagaauuuggaggaggauuuuuuuuguggggggaagauaaugaguuugguuuuggcauaccauguuugagguguuggagaaagaguaaugccuuugguucccucacuaggaugcauuuucucuucucuuuauuuauacaaagacaauguauuauucaguuaauuaaaaccagcuccuaauauauauaguagauacuuuuagagcauuuuuagugaauuuccaccuuugccucuuacuccuauuccuuucuuuauugcauuuccccuuuuuaguuggaucaauguaucaguuaggauuagguccagcugcaaggacagagaagacuccccgaaaaaaaccacuggcuuaaaugagcuggaaaguuuauuuuucuuauacauaaaaguucaagucgauggucauaaagucagaauccuucuuguuuacugcuugcguacgugaccucauugugaugagugcagagugagaagaaaaggaggcucagcaccaaauccugaauaacuucagcuuuaauccaaacuaggacauuuaugucaggaaauaauauacagucuuuaacuaguaggauauaauguaauuuguuuuguuacauuuauuauuuccucauaagauuauaaucuuggugacacacuauuuuaauaaucacuuuuuauccucaguggaaugccaagcccaauagguaguugcuuaauaaguugucuguugaauagauuaaugaaugaagaagaaaguuuggaaacuauugcuguuacacuuggcugugcuucaguagacauccuaacauauguuggauggcaagcaaucuccacauacauauauaggcugaaaaauagaauuaaacagaguuauccugaaauuuuauuuuuuccccuagauuuggaggauuuuauuuuuguuggguuuuaaucagaguauuuugaaauauuuugagccuuuauuugcauuuaaaauacaaaauugccaaauucaaguaauagauuaaugauuuuuuaaaaaaaauaauugaaauugccaggcacgguggcucuugccuguaaucccaguacuuugggaggcugaggugggaggauagcuugaggccaggaguucaaaaccagccuaggcaauauagugagaccuugucucuauaaaaaauaaaauuagccaggcaggguagcacaugccugaaguccuagcuauucggaaggcugaaaaaaaaaaaaaaaaaaccccacaacaaacugaaguuagcaaggcauugaacacuuuauaugaauccucugucuuacuauaacaauccggugaacuuaagguuguuacuauuuccauuuuuauacaugaagaggaaguagagaaguuaaguaacuuucccaagguuaagaccuaaugagugacaagagcuucuugaguuggguacagguaugcauguuucuagacuggagugguuuuuuauuuguuguuauuuuuuguuguuguaguuuuuguuuguuuguuuugagacaggcucuuguucaguugcccaggguggauggaaugcaguggcaugaucauggcucacugcagccuccaccucccagguucaaguaaucuucccaaguguauuuuuuguuugcuuuuaauuuuuagagcauuuuuagguuuacaacaaaauugagcagaaagcacagaauucccauauacccccugcucucauacaugcauaacauccccuacugucagcaucccacaccagagggguacauuuguuacaaucagugaaccuacguugauacaucauuauuugaaguccauagcuuacauuaggguucacucuugguauuguacauucaacugcuuugacaaauguguaaugacgugugucuaccauuauaguaccauagagaauacuugcacugcccuaaaaauccucugugcuccaccuguucaucccacccuccuuccuaaucccuggcaacuacugaucuugcuacuuccuccauaguuuugccuuuucuggaauaucauacaguugaaaucauauauauguagucuuuucagauuggguuuuuucacuuuguaauauguacuuaaguuucuccaugucuucaugguuugauauuucuucuuaccacugaauaauauuaauugucuggauguaccacaguuguuuauccauucacuuaaugaagaacaucuugguugcuuccaaguuucagcaauuagaaauaaaguugcuguaaacaucuauauuuagguuuucauguggacauuaguuuucagcucauuugaguaaauaccaagaagcaugauuguuggaguauacuaguuacuauucuaaguguuucauauguauuaucucauuuaaaccucuuuaaaccucugugaguaccaaggaaguagguacucauauuucuacuuuacauauaugaggaagcugaggcaaaaaagagauuaauuugcccaguacuauacaacuguuaagugguagagcuaaaaugcaaauguaaauaaucugacuccaaaggcuguacuuuuuuguacuagaauauacuaccucuuuacuauaccauaaccucuuuuuuucuugucagucuuacagaacaggauauauuauuuguuaacuuagguaucuuguggccuggcaccuauaacuuuuaagcuaucuuaaaguagauuguucuuaacagauaaauuggugauuguucaauguauuuucuucaaauccuauaagaagagaaaaaucugucaugaugggaauuacauuuauuuuuuagguuggugaaugucauuguuggcuccauguuuagauuucuguauaauuuaaauuuacauuggcauaaauguaauuuuuuuauuaucaguuuggauuuagguggcgaguagaaaaagaaguaauuucaggaaaagguaauucuuuaaaauuuuuacuuuuuaauaggauaaacuuauuuuguuaaguuacugaauuggagucauuaagaucauuccuaacauauacaagaaauuauuagcuacaaaaguaaaauuagagaagguguauucaugauacauuauuagcaaaggucugaauauaaugcuuuaaugauuauuaccuuuauacuuuugccuuuagaacauucaguugaauguucugcauauuucuaaguauguagaaaauauuuuacaaauuaaagauuucauagcaagacaacuuucaacaaaaaagaaagguuuauuuuuuuccuuucuuuauuaauuuuuggaauaaugaauugguguuacuguuuuucagccaaauccacauuucaaaaguagaaguuaaauaucacuuuaaucccaauagaauuuuggggcaggcuaguacucauuuuuggaagucccuuauauugagcccaaauacuuagucuaauagcaaaagaccagacauuugguaggcaaucaguaaaugcuuuuucuaugcauuauuguaaaucuauucauuaaauuuuuccuggaaauuguguaucuccauacugucucuugcuauaaaauuagcuccuuacugaguaauugcauuuuaaguguuaaaguacugaaaacuauauaguagcacuaaggaaauaauuuuaaacuuacuuuaaaaaaccuuuuaaauggaaagauuacauuuuuaaaugauuaaauauuuaugcuaucguggcucauauauaucuuccauaaguuggcuauguuaggugugaaauugcauaugccauaaaacaacauuaaggaaaaagaauaaauuuaaagcuauuuuaacuuuucuuaggguuauauuuuaguuuauguuuuuaucuaaaauaaugagaaauccugaaaugucuaucacaauuuuaagauguacuuuuauugaaugagauuuucaggugaguuuauaaugcuaccuuuuaaaaaaauugauggguagucucuaaauucauauaacugaauaaaagacuaguuaggaaagggaaagaaagcugcuaaugugauuuaugugauuucuuuuauaaaguuauaauuuuguugcuguuuuaacaacaaagccuuaccuacuaaacauauagauuuaauaaaauauucauuuggaaugaguuuaaaaggcugauuuagaaauaagucuuuuuaggauauaauuuucuaaauucauuuugauaauuucuuaauuuuuaugaaaaagauuugcugguuacagauuugcuucuguuagugcaaauuauugugauauaaauuaauaagaguuugaucuugucuuuuugccaaaguaaauuacuguugaguuguuucucuuuuuuucucucagguuaucaguuagucuuuuuuuggagguuuuaauauauuguggacaugguaaugugugugauguuaauaauagugucaaguuauucuaaaauuuagaguaucagguuugacugcguauuguacuucaccucaaagugcuagaauuuuuaaauguguuuucaaggccaucuaugcuaguauuuaaaauaaaugucauuaugcuaauacuuaaaacuauuaacuauuauuaccauuaaauauugaaagguuucacccagcuauaaguguguguacuuuggaaagugcguuuuuuuuugggggggguauuugugaguauguuguuuuuuuuguuuuuguuuuuuuauuuguuuuuccuuaaaccaacuuucugagaaauauguccauucuuuaauacugucuuuccaaaguguaagauucccuaauagggagucgcuaaaaugucuaucuaaauacagucuaucaagcaagaauucugugacugauuuuuuuugguaacaguacuuugauuugauacuuguauacaaguugguugaacauauuacucuggucaguuuuuaaaggcugacuaugguuaauuugcauauuuuagaaguacauuuuagggguaauacuagaucauauagauaaauauuaucaccaacuaccauagcuaauauuccuuuccuuucugcaggucaauuuuucuguggaaauaaauauugugauaaaaaagaaggcuuaaagaguugggaaguuaauuuugguuauauugagcauggugagaagagaaaugcacuuguuaaauuaaguaaguugauuuuaggggguauaugauugauucuuccaaguuugucuuuaauuuaaaaauauauagacuuuaaaauucaaaugcaauuuuuaacauaucuuucuggaagugcucuuuuuucuuggagcuucccaaagucucaaagaacuuuucagccucaguuuuuuacauuuuuagcauuacagugguguuucaguaaaaagaauucuaaugucaaauguaaacugguaauuuguagaguggggcuccguccccauuaacuugagaaugccaccacauuacauagcuaagaggcacaguaucagaaaaggcaguguaaucucacauuagcugauuacucagugauaucguuguagcacagauaauaaacaaauucacucuguuucacaguauuaauaaagaaaaacuuuaggaaggcauaauuguucuugaccucagucuuaaaaccauagggaauaaauacuccagaauacagcaguuucccuuaggaugcauguuuuagagucugucauucuuuuauuuauuuuuuaaguuagucuucaugugucagcuguuccucuagccuucucuggguccuaaguaaaugugccuucagaguuuucugcucauaccuaauaaaagucaagaauguccccacaugcuacguaugcaugucaauacagacugauuucugaguuccuucuggaagugcucaagaggaaaagucagccagugugaacugagauuaaggcaaaaaaaaaaaaaaaaagagaccacaauuauggaacuauuugaaaagcuccuuugcauuugaaaguucuuagagcacuucagaggaaaugacuauacucacauuauuauuagauaucuuugaugugagacacauguuaaugugccuguggaacacaguuuguuuuuggaacaaauugacaacacauuuuucuaaaauaguguuauuuucaauuccucaagcuaauauuuuuauuauauguauguguguauauauuugcauuuuugaggugaugaaggucagauuguuuucuuuggauuguuuguuuacccucuuauaguaauggaauauaaagaaagugcgaauuuaugauauuaaaaguagauuagcagugugguuauucaaaaucagccauucaguggugucuuuucuuuuuaggguuaugccaagaauguuccauuaaauuaaauuuccaucacagguaaugucuuuuaaaaugccauucuuaauguuuaguaauccaggauauagucauuuaccugcacuaaguaucuaaauguagacuuaggugguugaugguugaauugguugaucauguagaaaauguggcauugucguauggcuacauaaacgagggguuuagaaguccgcuaugcccuauucuugccaagcaguuuuaaauguaaaggccuaugugaggugguagauggauguuagaauuuuuaguuuggagccaauguucugacacuuuaauauuagaaauuauguuguaaagcagacuucauaaagcaguucuugugucucauuuagacaguguuuuagcuggaguuugccauucuuacaaaggauuagacaccucuauacucauuuuaaauguuaaaaucaagaacaggcgcgguggcucaugccuguaauccuagcacuuggggaggccaguuuggguggaucacuugaggucagaaguucgagaccagccuggccaacaugguaaaacccugucucuacugaaaauacagaaauuaacugggcgugguggcaggugccuguaaucccagcuacuggggaggcugaggcaggagaauugcuugaaccugggaggcagagguugcagugagccaagauugagccacugcauuccagccuagcaacagagcaaaacucugucucaaaaaaaaaaaaaguuaaaaucaggcuuuuauugaaugagcuuuaauguaucugccacauugaaugugugggaauaccaguguccugcaguuaugggguuugaaaucagaccucaguuuuuaaucucagcuucuccgcuuacuaggcuucuucuugggcaaacugcuuaaccucuguaaggcuuaauuuuaucaccuguaaaaaugaggcuacucaggcuauuguggggaauaaaugaaagugcauguaaagugcuugccacaguaccuggcauuaaagauguucacacugauucuucgcaacuugccuuugugauggucagguuuuaugcgcuggauaacaguuaaaaguucagcuuuugcaacuuuauaaaauguauacauaagcauauuaauuuuaaaauagcuuucuuuuuuuuaaucacauggguugucaaaaaauaacagcuuuguuauaaaugugccuauauaguauuuuagcuguuaaaaauaaauguuaaauaauauuuuuaauucuuaaaauuagcaggauuauuuuuauuauuuucauuauucuuuauuuuuuugagacaaggucucacucuguugccuaggcugaagcacaguggugugaucauggcucauugcagccucagccuccugggcucaagugauccucacaccucagccuccagaauagcugagacuacaggaguacaucaccaaaccuggauaauuuuuuuuuaaaguuuuuguagagaugguguuucccuauguugcccaggcuggucucaaacuccuggacucaagcaguccuccugccucagccgcccaaggugcugggaugauaggcauaagccuccacacuuggccagaacuuuuuuggauuacuggaauagccuaaaccuuuauuuccccuucccaucagugauacugaaagaaagcagggauuuguuuugaccuugacuuuugagcuucauuucaaaauggaaaugauucuuacaaaauaugcaaaagugguuaaugcauuaaauacuauuauagcauuuaguagauguacuuuaacuuggaaaaucuacugaacaaguuuuuugaaaguaaucuuuuccuuugucucuauucuccuugccagucccaauuucagcauuaucacuuuuucccauuuaguauuucuuuucuuaaccuauuaaaauuaauuaauuguuugccaaccuuguaaaccugcucuagaagagauaaagcugcaacaauaagaguauaaauuauaaguggccugauguugauauaugaauuaacaauaagcccuuuccauuuucauuccauuaugcuucuacuauauuccuuuauucuuaagaguagaaauuucuauuuacugguggcuuagagcuguucagcaguuucuucuucuuuguguuuuuuuaacauguagguggauauggauuaugugaagggaaaugaggcuuuuuuuuguaauuuaguuuuaaauggcuaagugauagaauauagaaagaaagaaacaaauacaauuauaauuuguauuuacuauggucguauacagaacuuauagaaaguaauuauuugugucaguguuaagacuucauuaucuuauagaaugauuuuaauuaauauacaagcauaaaauauuuacagucucacuuaacguuccuuauuauauaaaucacauuuaaaaaauaaguauuuuaacugauuuugguuuuuuguucauaugaugguuauuuuugaaaaggucaguuggaaaaguuaacuuuaauuuuauauuguuuaacacaaaggagaaaagaaaucaagucaaaaaaaagaaaagauaaaaccaaaaaagacugugaagagucaucacauaaaaaauccagauuaucuucugcagaagaggccuccaagaaaaaagauaaagguaaaaggaaauuaagauaaggcaucuacucacauuugugagcaugaaauauaaucugccauauuucauucaucuaauuggugaaugcauugagaauuucauuuuaugguaguugagaggaaacuggcugagaauuuagauaugaacuuaaagugacuuacaggaguuuuaagaacuccucuaaauuaauuaaggguuaauuuuaguucauuuuuggcagauaguauaauauugccaacaguuuucuaauuccuggcuuugucaccuacagacuuguuacuuugcaucagucacugaacugcuuuauuuuucuuauguguauaggggugaggugcauaccuggccuucauacuggucaagcuuauuguggaaacucaaauaagaaugugaaagggacuuugaucagugccuuuaaacagucuauaaucuauaaaucaauauaaaauuguaacacugauuuuauuuauaauggccugugugacuuuuuuuacuaguuuaugaguuucuagaaaugagaaagauugucauauaucuguguucucagagccuagcauggugcugugcaccuauacuuagaacugccugcuuuuucuuuagcaguccuuaagcucgcuaagacucaauuucuucauguguaaaauggucuugauuccuuuuagaauuguucagaaguugaaacgagauaauucauuaagcaguuugcauaguacuuggcacauauuagcuauuaugaagguuacuucuaguugcuuuuuuuagcccauaauaaaguagagucaaucggcuguaauuuauagugaaucagacuaaucuagauagguaauugaauuagauucaagccaauguuaauauaauauuuggacaggagagggcucucuugcuccagcuaugaagaucauuagcuauguugcaugcuuagaagcauuuacuucuucuugcacaugguaauauauucauuauguagcagaguuuaaaucugugugcccuugugauacugucuacucccauagcuucaaguauauggugucaccaaccuuuagacuucguaaaauugauagauggugagaggaagauauuguuauuuuauugcuuauugagagauggcauuuguagcagaaugccuuuuuugucucuaucuuaauuauuuuccacucuaagguaaauuuuaaccaauaaauguuaaaaauauguuuugaguuuuaaaaacuuauuuauccuuauaugcuaguaaaacauuuaauaugucacuuaagaaauuuguugcccucauuguauuauauguucauucuuaucacaacugugauaccauguuaaucacugcguauuccaaaugaaagaacuagucucuacuuuauaaaauguuacucaguacaaucaaaguagaucagguagaugaaugcucagguucagggcuaagguuggacccuucguauuaugcguacauaugcacaugaucuuccuuauagacauuuuucccuuaguguucugucaguagaugacaccuauguugaccuaaaaacuaauaucagaaaucuggggauuauccuugauacuuucuuuccccuuauuauuuauguuuaauuugucaccaaguccugugaauuuuacccccagaguauauauuucucaaguucucuccacccuacuacaaaccacuauauuuucucuuauaggcuacuguuauauucuccuuacggguuccgccucugucuugccaucccaccuucccuccucuuaauccauucuccauaaaucagugauuuccuguuguuuuuaggcugauaagcaaaauccuggacaaagcuaaaagguucucugugauccagaacuuguguacuauacaaggcuuguuucuuaccacucuguaccucacguucacacuccccccauguagccuuucaguuucuggaaaaugucaagccucuuucaauuuuagggguuacauggaugcugugucuucucuuccuaaaacucucaguucuaucccagcucauccuucaggucuaagcucuuaaaugucauuuccaaggauccuuuccugauuucaucccccaccuugaaucuaaauuaggacucucauuuguaaugcugucauggcuccugacacuuuccauuauuacacauaugacgauguaaaagccaaagaggcagagauucugccugcuuuguucauugcuauauccccagcaccccacuagcucauguucagcauaaauaauaaucaguaaaggacuuugaagauucuucagggauagaagaccaaagcaagguggaauugagacaucucuuucuuauguauucucuauuuagaaugccuuugaaagcaaagucucuagaaauauagcuuuuuuacccccaacuucuaugguauauaacagaaaauaacaaaauuuuagcaaacuuuuaggaaaaccauguggaacucuuuaauaucuuaucugggaucaucuagaauuagcuuuaucauugauuugauucuuucuugccagaccaccuuaauuuggaccagacuugaagaguaauuaauaaacgcuuaacaucucagcugcguuuggacuguugacaacuuccuuuaauuuuauuucuaucuuucuggccucucuuuagcuaaugcuuuuuuuuuuuuguaagacagggucuuguucugucacccaggccccaggcuggagugcuggaauacaguggcaugaucuuggcucacugcagcaggcuuaaccucggaggcccaugugauccuccuuucucagccucccagguaacugggacuacaggccugcacuaccauacucagcuaauuuuguuguuguuguuguugcagagacagggucuugcuguuucccagacuggucucaaacuccuggccucaagcaauucucucaccuuggccccccaaagugcugggauuaccagcaugagucaucacacccgaccuccuuagcugcuuuuaacugaaguuccuucucagucuuacauuuagcuguuagaguuccucggggcucuuaccuagauuucucuaguuucucucuguacucccaguguaaucccaucaacucucauagcuuuagguuaccgucuuagaaaauguuaaauaaguaauagauggaugaacuagauagcugaaugaauggauagagagaaaaaauaagaaagaucaguagcugacuuuaaggaccagucugcuuuggcagguaugaggagaacaagauauuuagguagacugucuuggcaaaauguucagaaucuuaucugucucaccaucaccccuuucccaaaagcuacgucauccuucagguuucugcuuagcucaauuccuuggaaaggcccuuccugacacccuucuccucacuucuccaaauaagauuauguuccucuuacauauuccaauaauaccugucacuucuccuuuagaaauacauaguauccuuggaauaaauuguuuauuuucuguaagggaagggacugugugacauguuuacuucguuaucucuaauuccuaauagugcuugcucccauaggaggcauucaauaaguguaggugagugaaucagugaauucaaccacauuuucugaaaguugaaaggaacuucagagaucaguccuggaaucaugacugaaaggauauucuuuaauuuugcuuuucaaaguaaaguccucugggcagcauuuaggaacuuguuagcaacucacaaucucagacccuuccagaucuacuaacaaguucccagggcgaaucauaugcacuaaaguuugagagaggcacuguuguauauuaugugauuguucugcauugguucaacauuuccagggaaaaggaacccacuacuaucaaaaauaaagcuuuacauuuucagguaguuguauuugcuagcacguuucucuuaacauucagccaaaaucuacagcuuccucccuuugguucuaauuauguucuugggccuccaaauuaagccuaacgucuuuuuuaccuauggaccuuuggauauugggaagcagguaucauguuccucauuagaggaugacaggaaagaauacauuuccuguuuccuuacccuguaguucuuauacucuucaucuggucuaaaggggccaaaaacuuuggguuacgaggccuccuauccaggaacauuggaggaauuguuacuguccaucugucaccugcccuuuuuuacuuuaucauccuucagaaauauuuucccugaggucuuauugcaggaagcucuguaucguggugauuuuuuuuuuaaauuacacugaccgaucuucagugccuuucucucucucuuucucucacuggaugaccauuguagagcugagaauuuuuguuuuaugacauaauuguguuguguucuuaucaguuucugagaacuaauacuuaccugcauauaugacuuuagaaaagauacuguaaaaagcaaguauuuauuuguaaacugcuuucaaauguugaacaucucuauagauaauaaauuauugcuuauauugcagcuaauuaucugugagguuuucuuuuuagcaauaugagauuuuuuuugcagguauucauuauuuuuuguuuugugcuggcuauuacagaccauaugagcacauaagauaugaucucugccuaaaagaacguaacauuuuaaugagggagauaagacuaaggaacaugaaagauuagaaaacagugaagugcuuaucuguaagacuauaagcaaacuagaauauugcuaagaauucugguuauagcuacaaugauugcacuauuacaagaugauaguuaauaaaucaaugauguuuccuuuucaggacauucaucuucaaagaaaucugaagauucucuacuuaguaaguaacaaguguuuauuuaauaaaaauaugcauuugagguauuugcaauuuagauuucccaugaaucguaucuugcugugaugugaauuauuuuuuguuuuuguuaauuauuuuuguacaugagaaaaacuguagaaaaaaggccaaaaguguauaggauuuauuccccaauuaagggcauuaagaaguuucuuauuuuaaguauagagagcauuaaaaauuuuuccaguaaauacaauggauauaucuuucaauuucauguuauaaaaugugaaggaagaaagauaaagggaugagguugaaauggauuuaaauuaggccuaugguuuucacuaguuuggaucaaaacagauuggauuucguugaguauuugcugcaaauuuuauuauuuuuucccugcaauauuccaaaaaguauucacaaugacuuauaaaaacauacacaauaaguuuuuuuaagguuaaaaaagucagaauaauggaaaaauaagguagaauagcaauguaaaacuacaggugaaauuuauacacacaaauguauuccaaaaaguccugcauaauugcagagauagaucacagauuugucaguguucuuccuaacaaccaaaccuaagagugaaaccagcaauagaaagauuaauuguacccauaagauaauaaugagaacuccuggaguguucagcuuuuugcuggcaguuuugagagaagagucuucuauggguuuauaaaaggguacauccauuugugucauaacaaacaguagcuuugaaucuaaacaguaauauaauguugaauuuuuuaaagacuuguaguaggcucaaggccuaauaauaagguguaguucaauagcauaucuaauucauuuuauacucucuggacuuaucucauagaaauuuagaaacuugagauuucuaggcuuacuuaguuauuuuauuuuauuuuuuuggagauggagucaugcucuuucacccagguuggagugcaguggcgcgaucucagcugacugcagccccugcuucccagguucaagugauucuccugccucagccucccaagucgccgggacugcagacacccaucacuaugcccagcuaauuuuuguguauuuaguagagaugggguuucaccauguuggccaggcuggucuugaacuccugaccuugugaucugccugccucggccucccaaagugcugggauuacaggcgugagccaccacgccuggucacuugguuauuuauaaaccuaagaauuaagaaaaaauuuuuuaugacuuuaaaauaauauuuauuguggcaaacucagggaaaaaaguuugaugauuauucuaaauuucaaaacucaaauauaaacauuauuugcauuuaguauaauucuuaacaagaaauuuuaaauauucaaugaucagaaauuuugcacugagaaaaauagaaauguuaagauauuuguuguuuaaaaauuuagcagagagggagauguugauggagguauuccucucuuaggaauauaguauauuccuuauaauuauuuugcuuguacgaacuuuguuuucaacauauuugaagugucuuaaagcacugacucuuucucuccacguaaauucuaauuuaucaggagguccuuuccuaaauuagguaaaauguagugacaguuucgaaaauacauucaaguauaagaccaguggaccaauguuaucucaggaugaaaucauagauacauacuucaacaaagguguacacaggcuaaagugggagaguguauuuuaguuuucauccauuuccaacagugagaggugugaaugcuuaugcaauauagaaaaaauuccccuuuuucaguucuaauuuuuuauccuuaaaaagucuuuuggggcaaauucuugaaucacugauuuauauuauucuuuuauuucuucugccugccuucuccuucccacugucuuucacccccugcccuuugaauccuucccugcuuccuagaaauagcccuuaaugcucuuuuaccucuccucagcuaagucaaauuuuuacuaguagaagcagggugaauacugugaagacuauauccaaucugagaaaccccuagcuaauuugaucuugaaaaaacaaacuauccacuucaagcugaccugcuguuuggcagccgguacgcuauuuaccauagcaagcaugaaacauauacauuguuaugguaugccaaccccagauauccucucagguggucagucaucuguauuacauggucuuggcaauuucagaccucacauuuugcucuuuauuuccauuuggacaauacucaguuaccuucuuaacccauuugacaccuggauuauuaaaaccaaauccauggagaaaaacucaauuucuguugggacaguaacaagugcuuuagauauguuaccucauuuaaucuuaauaaugugcauauaauauccucguuuuguagaugagaaaaaucaagaccuagagaaugucuuuaaaugaaugaagaaacucaauuuuuaaaaauauauauauuuaaaguauacaacuugaugauuugcugcccucuuaacaaauuucaaguauuguuaucuuuagucaccuugcacaugagaucgcccaagaaccaaagaauugaaguaaagugcccaaggucaaauaguuaauggcaaagcugggauuaaacauaaguuuauaauuccaaagucuaugcccuuuaccuguaucaucaaucaauaacuguucaucagugaaaucaacuguaugucuauucuuuauaccucaguuuuggcauaugcauuguacagauccacauuaaaugauuugaucuauguuucacuucugucuauaaaauggguauaaagagaccuacuucguuggauuauuaucagaaucaaaugagaaaacauacauguaaaguaugugccugacgcaaaguaaguccuugauaaccuguagcuaucauuguuaucagagaaaagaaaaauacagacauauaaauccuguguuuguucucuagaauugaugaaaucaaaaguuaagucuauaaaaaucugaccuguccauuuguuaccaugauuauuggagacauuugccauuucuucaguggugcaaguuauuaguuaccauauaauauccacaaaaaccaagaugauagaccuacuuucauuauucaaaacauguaggaaaaauuguauauaauuuuaggcaccacacucuaaagggaacauugaaaacuugaagcaggucaagaagaaaaaaacugagguauggagaaaacuugaaauuauauuguaggaagaauguuggaggaacugcagauguuuaccugggagaagagugaaaggaugggagggaagaggugaggaaguagacauggaaauuacuguauggauauuugcaaggcugcuacuauguaggagacuuauuuuuuaugacucuggguuggcagaacugcccaaaaacagauuuuugccuuaauuuaaggaaaaacuugucccuuagaacugucugacaaaaggaauggagaaaugggcugccucuggaguagcgaguguuccagcauggacuggauuggcacuuauuggagguguugcagugaaaguucauucauuggauaaguguuggauuaaaugaccuccagguuccccuuucaacucagaaagucagugacuuaaauucugaucccuacuuaccaauaaucacugaauagauuugacagugaugcauucuuuuguguugccuguucuuccaauuguuauuuccuuaguaacacuccucccgccccuggcagguuguaacaguuaugauagcaaugauuuguagugacugccaacccucagggaaccaggauacuauagauucauaggguuauaagggaccuuaaaggucauuuaguccagucuuguagacuugauucucuagggauaucuggccacuuuuuuaguggguauuuuuuaagacaguuaguuuauaauguuacucuaaacugacuugauuuuuuaguaaaauugacugguaucagaaaacugguguaagaaagcuggcaugugggaaguacucuuggaagggaacaagauaacagcuguccacuucuaaaggccuuguagguuucguucucuggcaucauuaacauuagcagaguaauacaauaguaauaaccuugcuaggccuaauuaauuuuucucugcuuucuuuaucucauauuaaugaguuuucauaaaaauaagagaagauuuuaauucuuuuuuucccucacauuaucaauuugggacacuggccauuccagugauggcugucauugagucaggaaucuuguuuucaagauuaaaauuuuaucauuuguauguagaucauuagaauacaaaaugcccucccccacuuuugccauuuuugcuagaauuggugucagaauagauucaguuaggagcaaaguucagacacacauguugauucagggaucagaguccaacagguaaaaggcuagaacuaccguaacaaaucaaugcuguuuuauuuuuauguuguguuuaacuaaaggacauucuguauugacaggccacauuugugccauuucuuuuuuagacuaauaaucauuauuggagaggaguugucugcuaauguaacuacuuugugaguuauaguguuauugucugauaauuuugcaguauuuuuaaauuuuuaguugacuaauacaggugauuuauuugaaacauaucuauuuugucaucuuuaauaaaaugucuuuauuguuuuuacugauuuugaagguaauucaugcucauuguuuaaaauacaaacaauuugaaaauguuuaaaauagaaaguaaaaguauuccaggcccacagguaauauaaucaguuaaauuugguuggcuuuugcaaacuuacaauacguacauaaaauuacauguauguauauaaugugcauauguuuuuaacauaucuauuauacuaugcauacuuuuuguaacuuuuuaaaaauuugauauagaauggacauuuuucuauugcaguacauacagauaugcuaauguuuuuaaacagcuguauaguauuuauuuaaccaguccuuaaucccuaauugguggggaauuagguuuuuuguuguuguuguuacacagugugcaucuuuguacauauguaucagaggugcuuauuuauguauguaaguaaucaaauuccuaaaagcagcauugcuggucaaaggguaugcguuuuaaacugaucuauauugccagauuuuucuccagaaaaagguuuacagaauuuucacucccagcaaugugugagaaugccaguuucuucccugaaacaggcuucuucucauuauguaaucagcauugguuuuuuaaaaugucugacaauuuuuuuuaaaauaauuuaacuagcuggucuuacauacuagcucaguucuuaagguacuaauccuaauguaaacauguucucuacaaauguaaaucuuaacuugcgugucuucuguguaaccaagaaaaagaagaaacuagaucagagacaacuauauugcaagagauaauugacuuacaagaguuaauauuggaauugcuacuuuaacucaguguaacuuagagaaguuucgaugagacuuaaaauccuuggccuuuuugcugagauucuuugguaacccuuggcuuauuuauauauguuuuaaaagaauuuauuguaccugugagagugaauuaaauuucuagagagucauaaaaguugaagcugaguuaaauaaaaaguuaauuguauuggcgaauaauucaaaaugugcuuuaaguauaauagguuuuuaaaaaucaucuuuuuuaaaugaacaggaaacucugaugaggaagaaagugcuucagaaucugaacuuuggaaggguccacuaccagagacagaugaaaaaucacaguaagugcugauauuaauagagaauauguaccuuuucaaucaguuuaggaagcuauaaccacagcuuuauuaauggaaaaauacaacaucauggugaucuauuuaaugccaaggacugccuagccugguaagauuagagcuuauucccagccauugucauaagcagccaacacauccagcuuccuccugguaaauaaaucuuucaucaguucacuuuaacagaugaaccucugguccuugcuuggauuucuucagagauggcuguuuccuaagcuuccagagaagccuauuccaucauacugugauuaucauaaaccuaugcaagggaaucccuugcaugggaaguacacuucuauacugcuaucccacuggucuuuuaaaaaguaaaauaauaauauuuacuguuacaaauacauaauauauuuacuaugcucaguguaguaaaaaaacuacagccuaaggagauuuacccaauuccccuuaguuauuccccaauauaacuuaggcuuacauuuuuccuuaaaaauaguuucuuuuuuauucacuucuugagcagacuauaauuuaaaaugagaaugaacagagaaguuauaaaguaagcccacaaaguaaagagaagcaaugacauuucacaaguauuucaaagcaaaauuuuagguaauacauuuagggagaggugccaccauaugaaauauuuuuauuuuaaucaaucuggguauaguuaugauuauucuagaaacuaagaauuauuugauggcugaaucauggcaauauauugauauauagcagaaucagccaauauguugacuuaaaguauuuuauuuuuauuaaucucauauaauguaucauguaguaauuuuuuuacucuauugaucuuaaguaugcuuuuuuuuuuaaauagggaagaagaauuugaugaguauuuucaggauuuguuucuaugagacgagagagagaagccuccgcuccuuaaugugaaacuucaugaaguuuuaaacuucaugcaauuugaaauuccauauaaguuuuuaucugcaaguuacagcuugugugguuugucuuuggaaauaaaaauccagguucucucagaaugucagaggcuuuggaaguucauuaguucaauuaaagacuuuccuguccuuuaaauaucuuuucaauugcuuaucuacaauucuguuuuauuuguagcuccuagaggauagagcuggacagauuccauuguuccuacauuuuguagguuuuuuuucacugccuucauuauguaucuucucuugccuucauuauuuuauuuuauuauuucuucuuuuucucuuuuuuagagccaccaauacuggauuuguuuguuuuucauuuuuuucuuuuguggaaacggaguccuccuguguugcccaggcugguauucaaacuccuggccuuaugcauuccucccacccuggccucccagagugcugggauuacaggugugagccaccaugcucugccaauuauuuuaaauuacuaggauuaaaguauauuauguaugucuuuaacuucuuucuuucccauugauaaacuggcacccuucuuuuaaguaccugcucucccauuaccaccuauuuccagcugcuuuuugagguuuuuugcuugccugucucuugcuuccuucuuaaccucuaccacuuaagagaguuuguuauaaucaaauuugacuuccuagccuguggauaauuuacuauuaaguaaauuauuaccacagggagccagugaggucccaguagucuaaaacaguucauguguucacaaaaauugccuccccggcagagauuaugcaguaagauaauuuaacugaauaauacuaugugcauguaucuugccucagauauacucaugcaaauaugaauauaccucugauaugguuuggcucuguguccccacccaaaucucaucuugaauguguacucccauaauucccacauuuuauaggagggauccagugagagauaauuugaaucaagggggcgguuucccccauauuguucuugugguagugaauaagucucacaagaucugaugguuuuaucaggggcuucugcuuuugcauccuucucauuuucuuuugcugcugccauguaagaagugccuuuugccucccaccaugauucugaggcuuucccagccauguggaacuguaaguccaauuaaaccucuuuuucuuccccagucucugguaugucuuuaucagcagugugaaaauggacuaauagaacuucuaugcagaaauauaaaauguaacuucuuaacauaagguccuagucgcaagggucuauggaggugcuucaggagauccaagccuuuuuagaaucugugcaaacuucuguguauguuuuuuggaggaaaaguccauaaauuucaaauuuucaaaaaucagauuuucaaaaggauuuauugauuucugaaaacuagcaaagaucugcuuuuauaaagagcaaauagauggauagauauaggagaagaugcuugacuugaugaauaagagaaaggacauauagaaaaugaacugaacauaagcaaguauuuuauugaagauauacuauuuuaaauaacauuuaaacacggaaugauuggcaauaaacugcaaaaugaguaauuugguaucauuuuaaaaugguuauuaucagagauuuuccuuuuauuaaacaguuauucauuaauuccacaaauauuuaucaggcuucuauuauaugugaggcacugagcugggcauggcuguaaaggaaccaucuaggaaguaauuaugcaaucauuucugaaccuguuucagaaaaguaaaucaguguuggguuuaucaguguuuaacauuguuugauaguccccucacuucuugaauaaauuguuuuuuuucaccucacuacuuguaguguguaaaaaugaaucuguauuuccggugaaaaaguguuugaaauguccagccgcaagacugauauuaguaguagaauauaugcaguuaaacauucuuaugguaaaaauauguccauuguuuagugguugucagaaaguaaaauuccugcaaaauuaaaauuaggaauuuaacuaggaagaauaucuaaagacccuuuaaaaauagaucaguguauuugguauuucaaguagauuuaugacaucaggcucauuuauaaauuuauauaaaaucacaauacuuaauccaugcauacacagugacagauaaugggaguuauguuuuuaaggagucuugaaaaggccucuaauaugaugaguuuaaaaaguaauucuccuacacaccuaucucaaacuuugcuauagugcggucagugguggucagcagaccacuggucuggggguguugaaguuaggccuucuuauacuugcucuuaugcagaguucauguauuuggcagaccuucagugguggacaucucuacccucaauacaauuucuggugacuaaggaggggaaguuguuugagcugacugauguuuuggg

SEQ ID NO: 18821 - RNA, 14033 nt, Homo sapiens
caaagucccucaauguuccucaauaagaaugcaugcauaucacacacugugacuccugucaucuucuauguuggagcacaccaaugcugcugggguggucagcucacuucacugccgucuucuaccuguaacuucuuggugggccccacugccucaccuggguuucuguuccaccuguucuucuagagguccacagacauccucagcucucacagagaaagaugugaugggguguaagcauuuuccaccuauccugaucagugauuacagcuccuauacaauaauguaccgcuucuacaacucauaccagcuuagcagaauggaguggccaaaaucccagaugcaggcucccaggucagacuugcuagccguauguucauggacaaguugcuaauuucauuaguaaaauagagguauucagaguaaccaccuccugggguacuugugaggcuuauacaguauuuaaucugcaaacccacucuaugacgaucauuauucacauuuugcagaugaguuugauuagcuugucccagguccuagagcuagaggaggccauauugggaugcaaaucaaggucucccugacucuuaaacacaugcuguuaccacuaugcccacugccccagagagagaacuauuguggacaccaacaggauugaccuacaagcaaaaaaaaacagaaaacaugugucaugauucauuuauucuuuagacccuuauagaaguuacuuuugccucuuucaagucaaauuuuuugcaugcuggcuuuuagaaauaagcuccacugguuuguaaauuauuuagggguaaggacaauuuuuugcucauuuuaauuuucuuuguaucaucuaccauagugcuuugcacauaguaaguguucaauaaacauuuucagugaaaagcucuaccaaaagcucuaugauaauggagacacaucaaauuucugaguggcguaucugucuaucuggcaguuuacagaguucugaauuuuuaauauauauuuugucuuuaggcacuuuguagcauggugccacugauggauaugauccaaaugaaucuuucuuugcuucuuaacugguuguauagcugugggaaaguuacuuugcuauucuaagacucugcuuucucaucuguaaaacaauacuauuaucauaggauuagaguacggauaaagcccuuaggauagaggcugacucauaguaagugcucaguaaaugucaccuaucgcuaugauuaaauuaaaauguuaaagaauauguccuauauuaaagaaauuuuauuuuagaauuguuaaauauguguguauagacagggccaagagaaugaaguaugaacaauuauccugagaucuggcauuauuaagaggaccgauuucugggauacagauuugcugggaauuacuguuaaaagcuccagcuagggaggaugcucccucuggggcaucucugaguaguacugaccacagauguggauuccucucuggggauaaaaauuucaaagggcauaggcuuucugaaagugcuagugucaagcuucuugccuuuuuacuccccauggcuuaauucagucaguucccauccuucaguuuugugaaccaggucuuagguagaucugcaguguguguguuuaauaaggauuuacucaggaaauaaauugugucucuuucaccuucaagccuacccagguuaccaguggggagcuggcagacugucaaauccuauucuuuugggguaauccauggccagaagcuuuuguggaacucacuacaggggauguggcugcuugucagagaugcaaacaggagcacugaagcuucugggcuuaagugaguugauuuucaccaaguuuuuggacccucuucaaaaaguaggacuauucuaggagcuuaggggagggauggauggaagaaucacagauuucuaagacacaguccugacccucagagauguguaaccuggugggacagauggauauauugacagcuaaccauaaugcaaggucaagugaaacaugagccuugcucaugguacaaagcaaggggccaagaaacccagaggaaggagaaaucacaccuaacuaguugguugagaaggacuaagauuucaaaagcuagaaaagcagggaaagggcauucugggugguuggagccacugaagcacggaagcaugucagugcuuagaugaauagagauuggcaaauuguguggguaacuggagugugggcaagguagaggaugcaggagugggcgaaaaaacaggccagaucuugaacuccaccuucaggacuuucuagggccauuuuaggucuucuugaaauguguugucccuggaggcccugaugcuguugauagaaaucauauuaaaaugccuuauaucccacauuaugauugauauguaaugauaagagccgaguugagugaguugagcuguaguuguuucaguuacauauagaugugguccugggaccaaugccaguccagggagaguuuggaaucaguuugggauaaguacagaacuugagacauuaccacaucaaccaagugugugaucguuuuucuaguaauuccuuuuuaauuuccaaaaagauugguucacaauauauugguccaaaauacacuggaaauuauaaaauuuugaugguucaaaaauuuucauacauuggaauuuuuacauaaaaguuuagaagcauuaaucugauugaaauaauaguacauuuugaagacauuugacauugaaaaugaacuugaagauagagcaauagaaauuauacagucugaacuguggaaagaaaaaggauggaaauaccuaguacuuaccaucauaucuacauuacaguaaauuaugccuaaaccuucugaauuaguuggagauaauuuugugacaaguacagaaauccauucaaacuaaccugaaacaaaacaaaaugugugugugcauggguuguuguuagaagguuauagaagucccuuguauuagucugcuuuuauacugcuaauaaagacauaccugagacuggguaauuuauaaagaaacagagauuuaauggacucacaguuucacauggcuggggaggccucacaauuauggcguuagagcaaggggcaucuuauauggcaucaggcaagagagagcuugugcaggggaacuguccuuuauaaaaaccaucagaucucgugagguuuauucacuaucaggagaaacagcaugggaaagacccucccccaugauucaauuaccucccacguggucccucccacaacacgugggaauugugggaguuacaauucaagaugagauuuggguggggacacagccaaaccauaucaucccuugaggaauucaagggcagggagcugaauccaaugcuaaccagcauggaggcuguauacauauaaagaccugguccccuugaucuaacuugagacaacugagaagggacaucccagcucaguugucucaaguuagagcagcuaccagguugccugaggcuuuuauuggaauuuugucacaguucagugccucccuccacccaauccuauuuccauuuucuccuucccaggugaugaccucaagaggacuccugaauuaaugucuguacaguaacuucucagagucugguuaccagguaacucaacgaggaacacuguaccuccccaucuuccucucacuaucccucccuccucacuuccucuuccuuuuugcucucccuuguucccucuuuuccucccucuuuuucucacccuuuuucucucuucuuuccucucucuauucucucuccugcucucccucaaacugcguaguuucucaccucugcuccuuucugagcucucaugucauucucuucucauuuucugaccaguuuccucagcucuuccggcacauggaccaugauggcugcccccagauggugccuucagcuccccagucaccaucacugugguauaugcuguugguaucucaccccgaugccuuuacugggcugauguccucaucuugcagcugcugugggugucaguuaauaacagcucauauguguacccuucucuggaggacuauccuuuaccaacuggaagcuucucuccuggagaugcccaaaagguuuugccccacaugccuuagccaaugacugucagaugggugggggcaugcaaaaguccauccuccuugccucaaggcaggacacacucugugguacaauucacacucuggacagcccccuaggaucaggugcaggcugccuuuuccugucuuugcauagcaucuuccccuguuccauguugcuccucucacucccuucagguguagccucggagcacucccucaaucaaucccucugccucuaaggagccugauuuaggcucaucuccuuacagauccugugccuguggcaaauuggcucagccuuugcuguccuaauuccaaauauccaggagacagaacucucuuaaaguucuuucucuuugaacucccauucaaagaccagugcucccuacgugcagcuuggcucaggcugagcucagcccagcaucuaggacaaacaccuggaguucauuucaggugaacacugggaacacauuacaggugcaaccuucuguggcugcagaggagacagaguuaaauagaauagggcagaugaaggguacauggagaggggacaacucucagaaaaggcuagucaguuccugcaaaggugaacccuacccguguccuccuccucagucuuucuugaauuaauuuucuuggucuucucuuuaccccucaucaaucuucccaucuacaugccaaguucuaaucagauagugaauguuugaaaaguggcaccacaugauggagaaaggacuaggcugagugucaggauggaagaugguccuaauucagcuagcucgcuucacauacaccucugggucuccagcuuuaagguaaauuagagucaauuugcuagcuucaacagucagugcuuuucugaaaacaagaagggcuggcugggugcuuuggcucaugccuguaaucccaacucuuugggaggcuaagguaggagaauuucuugaggccaggaguugagauuuaccugggcaacauagcaagacccugucucuacaaaaauuuaaaaaauuaguugacuguggugguacaugccugcaaucucaguuaugcaggacgaccacuuagcccaggaguuuaaggcuguagugagcuaugauugcaccacgacauuacagccugggcaacacagcaggacccuaaaauuaaaaaauaaaaacaaauagagcagaaucugggucuuuuaaucucugcauuccugaauucagcacaaugccuggcagaaaaaacauugauaacguauuuuuuaaaaggagcuauucucagccgggugcgguggcuuaugccuguaaucccagcacuuuggggggccaaggcagcggaucaccugaggucgggaguucaagaccagccucaucaacauggcaaaccccaucucuaguaaaaauacaaaaaaaaaaaaaaaaaaaaaaaaaagccagguaugguggcaggugccuguaaucccagcuacuugggaggcugaggcaggagaauugcuugaaccugggaggcggagguugcagugaguccagauggcgccacuucgcucuagccugggugacugagcaagacuccaucucaaaauuaaaaaaggaaaaaaggaguuauucucuaaaaaaugaaaugauggagaguuacauuaagauaauaagguagagcaugaucccaaaguaugcacuauucugaguguagggugccuguuggcaauaacuaucacuugguaagggcucaguugugccaguuccauguuaaguauucuacugcuguuguguaacaaaucacccaaaaacuuagccauuuaaaacaauuuaagccauuuuauuaugcucauagaguccgugggucaggccuuuggacaggacacaguggggauggcuugucucugcucugcaaugucuggggccucugcugggaagaucugaagucugguagugacuugugagcuggggcugggaucacccagaggcaucuucacucacagaaccgguggcugaggauggccuugucugggucuguugaccaaagcaccuaugugugguuucuccaugggggcugggcuucaucacagaacaguggccucaggcuaguaggacuuuugaaggugucugcucacagcuccaaaaucaagugucccaguuuacaagauaggagagaaacuucaucauuuuuaugaccuagccucagaaaucaacuauauuauucccaccacauucuuacaagcaagucauaaacuaauucacguuuaagaguaggugaacuagguacugccucuugaugggaugggggagaggcugucacagagcacaugcgauggcagauauuguugugguuauauuugggaaauaaaaucugccuugcauguacugucucaauccuuccauuaucuuuggaaguagguauuauugucccucuuuacagggaaagaaacugaggcucagaggggcuaagcaacuggccuauggacaaggcuaguacauggcagaguuggaguucacccuagucuguacagagcagguguucuccaguagcauaugaugcugcuuacaggaaaagggaacugaaaaaaauaagacauucaaaggccaguucgggagugagguauucuucucucccauaauccugaugucagaguuaauaucuuccccauaugggaaucugguuccugugcauaacuccccagggaguugcuucccagaaacuauguaaguauguguguaccuuugaugccucaagucuuccagauaugcacugugugccagcagcugcugucugcccuccccgaccacacuuauauggcaaaauaguccagcaaacaaugagcaggagcaagcucugacccccuccgugaaggcagcacacagaaccaguucgugccaggaauaucuucucugccgugaucccccuuuaaaauuacaucuucccuuuaagugcaaacaagaaccuagacuuccagaaagucaucuugauacucccaggauacuuauaaucuggaaucuuuagaagguacuuggcacucacugcuugcucuguaggauuuuuguguucuaacaccccaguuagucuucuaaggccucagagggcaagguucaugcccuauucugccucagucccccaccccugcuauacaauaccccauucuuaguagguaggcaauaauuaggucaaaaggccucagaaaguuuauuauauuauaacaggaggacacgugcuucuuuaaaagcauuuuuugagagccuacucuaucaccggcauugugcuaaugacccaugugaucuagaagcagaaauuuagaaaaucaaauaugagccuuuugggcauucugcagcagguaaauaacaaaucaaaauugguaucuagaagugaagcauccuuggucagauuaagaggccuucaugacagguacauuugaggcaagcacuguaagguuacaaucucuaucagcugucagauguuuagaaagacccuaaauaggguauugagauccuaauucuugauuuuacuuucuccuagaaauugucugagugaugauuuuagcugggcuuaucagucaggaaaggaugggucuugcuguccuuaauuucaaaucagucuucuuguaguaggcaaauuucucuaccuuucuuuuaauuugucaccauuucaccucaaauuaucccuaaaggccaugaccuuuggaaauaccuuugaauguucaaaaucagcugauccagccacagauaaaccuggucauaaucaauggguaaucaauaucauauuacccauaauuuuaucuucacucauucuucacaucguaaauccuugauccaaauacaauacuauuauauaaaacuauuucuucaacauaccaacaacaagaaugaaacagcuccuguaaauaauuaccucugggauaugaaagaaaauguaaacauuuuauuuggcaguuguuucuguacacaugaauaaauaaauggaaaaguacauauuaauauuucuuuuuggaguaacagauaccauuaaacgcuuauuuacacaucuucacugcaaagaacaguuacacaauuaaauuuugucuuauaaaagguaacuucccacaucacuggacuggacaguuaaggauggagauacugguagugcuugguucuagcagucucaauguuugaaaggcauucauuugcaagugugauaagaagagucaucaugcauugaguucauccgggucauguacuguagaaaauuucugauggcagccacagaauuuggugucucaugcgcuuaagucaacuaugacauguuuguaaaucuguguauuucccuuaaaacuggaagcaaaaagaaaauuacgcuuauuaauggacacaugugugaaugaucuuggugccugaacauuuaauuccugaaauuucacaaauuuggcuuucucugcaucccaguuauacacuugaguaaaggaguaaucacuuccaagaauugcauauugguaauuauuuauuugaagaggcuggaacaccauggauccucgcgauggcauccucugaauauccuggaacgaggagccuccccauuucaugacuuuggaaucaccaaugaaucuugucaagcaaauguacacguccccuuucacugagaagugcuucacugcguacacauccuccauguuaggaaugucaguuugguuagugaauaauuguguugcuuuguuccacugauaaauuacaggacgcugggaacuacuagacagaauuaaaugaggcguucugagugucugagguguucugacuauuucuagauauuccacaucagugucccuguaccacgcguguaaggauugaugggaguagaauccguuuccguuccauuuguaaaugguaguaaaaccagcuuuugaacugucagcaacaacaaaguaccaguuguuuucaaucuugaauguuucaaugucauuggguuuucggauuuugagaauuucaauauccuggauuuuuaugaauuuauuugcaaaacugucucgcuuauagaugugagagccaccaaacagcugggccacaauaacauagagcugaguuucaaugacuauaggcuugcauacuacaguggaugugccugggaaaagacaaaggagagauuaguuguguggccauccucuuuuggagcauguaaacaugcgggcuggggccauacaacuuccacccaaaucagccugaaacaagagaucuccuugguugauuaggcaaggcuggucuccaaagcccaauggcagcaguguccuaaaguuccgugccuuugugccucguggggccuuguugccaacaauugaguuguuaaugucauaucuagccugcgcuagacguucaggacacacagcuauggcccgaguguucuccucuuacuucuugcagaaagaaagcauuaguuucccugacacaaaugaguuaaucauaauucuaaugaaaacuacuguuuacugagcaucuauuaugugcuuucucaauuuaccucauuaauuuucccaacaaucuuaagagauaaauauuauccuuuuuccacaugaguaaacugaagcucagagaggcuguucugguagcagaaggcagaguuggggauucaaagccaggccuaccagcaucucuaugcuuuuaacccaagcuggggacaaguuagcuauuccaggacuucaaauuugguuuaucuaagaucuuagauaaccaaaggcuagcguuguggucuggguagcccauggcucuacuguaauuguuuugcucuaagucugaacugcuuccugcucuagaauaauuugccuuuccccugcaaagaaaggagaugccacuugucacuuuucuggagcuuuaggucacugguggcaggagugaagagaaggaaaaggaaucuuuaaaaaaaucgaaagaagggugcagccaugggcacugcuccugaaaguuauuuuggaaaaucacagaaaaugaugugggaucugucaguggccuagcuugguauccuuuggggaagaguuugacauuuaucaguagauucugaucuugcaggaguuuggcucuagaaaauccagagacagcugaacaaaucugggcuuuaggccucuucugacuacagcgcuagugcggggcagaaaguucuacauuaauucuuucuacuaauuggcuucauccauaggcaaaauaguuuuauuucugacucuuuucagggcuaaacugauuguaugaucuuaagaaaaucauuuaacuucucugaggcucaguuuucuuuucuguacaaugagacuuuagacuagauuaaggauggccaccagauuccaacacauguaccaauacugauuggcucauugcgugugauugucuggggaacuguguugagaaggauucuguggccgugucugcacucuacaugaaagauucccaugauagauuaguggugccugucuagagugaaggaagggauaaugacugaguauggggcauauauuugucaucugcuaugguuggaauguuucugucccuccaaaauuuauguuguagcuuaauccccaguguaauaguauuaagaaguggggugucuaggaggugauuagaucaugaggacuccacacucaugaauggaauuugugcccuugcaaaagggcuugagcgagucuguuagaucuuuuuuugcccuucugccauguuaggacacagagaaggcaccgucuuugaagcagagagugagcccucaccagacccuaaaucuccuggugccuugaucauggaguucccagccuccagaacuaugagaaauaaauuucuguucuuauaaauuacgcagucaagguauuuuuuguuacagcagcaggaagggacuaagacaucauccuagacaagaugagcucugagaugcccucagaaaguuugcagauguaugauuuauuucucuuguaagugcucaucuaaagagucauucaaagaaauugaugaaccauacacaaguaagaaaagccugguuucgaccgcacaaaacccugcuauaguccacuggaaaacuuaugggggccuaaggaagcaugaccuucuuccuucagagaggaggauucuaaaagaaaggaggauuccaaaagggucucaguuuggaagggaucccuuuauuuaagcaaccccagccucaagcaagccccagaccugucuugguccuuugagcaaugagggugauggcuaccagcaaaaucuaucaugacccuccaugccuugucuaaaggguuaccuuuuauggggaggugugagugcucuugagagcagauuuaaagguauuagaagcuaaaacugauauuaaaaauuguagagggagcccuauguucuaacuuaugacuuauaauuuuaaaaauuauuaaaaugggaaagaaacuuaagagaucagcuaaguaagcccaggcaaggugguuuacucuuguaaucccagaacuuugggaggccaaggcggguggaucacuugaggccaggaauucgaaaccagccugaccaacuuggugaaaccccaucucuacuaaaaauacaaaaaauuauuagggcgugguggcacaugccuguagucccagcuacuugggaggcugaaggacaagaaucgcuugaacccaggaggcugagguugcauugaccccagaucacgccacugcacuccagccuggguaacagagcaagacuccaucucaaaaaaaaaaaaaaaaaaagagagauccagauaaguaaaaguuuucauagaaagaauuagauuccggccgggugcgguggcucacgcuuguaauggcagcacuuugagaggccaaggugggcggaucaugaggucaggaguucaauaccagcuuugccaauauggugaaacccugucuguacuaaaaauacaaaaauuagcuggacaugguggcacgcaccuguagucccagcugcuugggaggcugaggcagaagaauugcuugaacccgggaguuggagguugcagugagcugagauugugccacugcacuccagccugggugacagagcgagacucugucucaaaaaaaaaaaaaaaaagaaaaaaaaagaaaaaagaaaagaaaagaaagaauuaaauuccauggccaaauuaagggugaaaaauauuggaaaaauuuccucacugcaggacuucucagauccacagaugucuguauuaugaaccuacaagaccaagauaugguucaugaauuuauuggaccacaaaauccuuuucauuacaaggcauacauuaacauuuuguagaagacacguuuguguaacaaauuugagacuuauugaucuaaaauaaccuucuuauuuuauaguuaagaaaaagggguugaggggugucagugaguaugagcagcuugcccaaauagacuguggcagaaccuggacuagaacucaugauucaccauccaauacuuuuauuugaagaaaaauaaucaaauauuuacuguuuauguauuauacuagacccuaugcuaaguuucuugaauauguguucacaugaucuuauuaacaaccuugugaguuaaguauuaauauuauucccguuuuacaaguggggaaauuauggcuuagagaacaaucccaggucacuuaacaaaugguagaguuggaauucaaaugcuaaagcauuccccuauaccacucaucuuuccuuguugcccuuggcugaagcaguuuaaauuaccacucaaaauaucauuaggcuuuucauaccuguaauguugucauaauuccggaaggucuuuuccacauggucccauucaaggaaaaugcauuuuccaguaaaaggcugagcgaugacuacauacucaucauucaaauaagaaaaagugucuauggacaaugauugauaaggcaggucuugagacuuugcaaauucugcaaaaauaggaaauaauaaguaacugugagcuaauaccucuuuccuuggcuagaucuuaaauauucacaagaaauacauuuauuucagagaauaguaaaauggccauuuuacuuuuaaacacaugaagcauugucaaugguucauaauuuuuuuaaaauuaaguugcucagcuaguuuuuaagauauaaaaaauaucaguuccugcacaugaaaaaaaaagguagcccuuauuuuaauuuuuugagguggaaugaugaugaguacauuaccuguaaugaugcaaucaaaauccuucgaggagagacuauugauuuugcgcuucuuguauucuggggggccuucgcaguagaugucuucaacaguugcauugguguggccaagccauuccacuagccauuucaguuuacagucacaauuaaaugaauuaccccucaggucccugaaagacaaacuucagcugcuuuugcuguacaagggcccuacccacgcaggaaagaguucuacaucaacaauuaacaugugcagaaugaccuuacccggcguugcauccugcccuauaaccugccuggaaccugacugaccacucauucacuuugggcucagagaguuagcaccaugcacacuugaagacuacccagucaauggaaccucaucacuuacucccucuugaauuccaaagcggcuuagucuagggcugugcugucaauagaaacaguauaugaaccguaauuguaauuuaaaauuuucuauagccacauuaaaaaaguaaaaagaagcagguauaauucauuuuaauaauauguuuuauuuaacccaauacauacaaaagauuaucauuuugacacaucaucaauauaaacauuauugagauauuuuacauuccuuuuuuauacuaagucuuugaaguccaguguguauuuuauaccuacaauauaucucaauucagaugcuaaauuuuaccagaaauaggugaucuauauuuagaugucauaaaauucauaauugaaaaaaauagguguauauacccaaauuauuccaagcguacuuaacauuuuccaauaauugagcugagaaucagcuuuua

SEQ ID NO: 18822 - RNA, 8593 nt, Homo sapiens
ccugggcaaggagagcuaguuagaaauguggccuuccucuuacagccgcucuccucugggaagucccguugcccugcccuacuucaucgcuacuacagguguuuguauggcugggguccugaaagaagcuggggcggcgugggaccuucuaagaggugacuaaagaagaaagcccuaccugugacaccuugaaucaguuccuuuaaucagcaggagacagcaaccaaagaacugcuuuagaacauacuuauccugcucaauauuaugaacuuaaaaauaagguggagaaaauuaugucuaacaugcgcaaagcaaagucagcccauuauccugucuguaaguaaacuuugugucuuaccuggcauuuaaacaaucuaaguuuuuugaaagaacuguguuaggacaagccgagagaaguaaaagauuugccucaucacaaauaguaauuucuacuaagaggcuugaaaggggaagaauggaucuaugaauuaaagccaguucuucuuucuaggccucaguuuccucaccucuaaggugcagcaguuuaucggaaugaucucuaagaggucuuccagcauacccuggcaugacucuaggccccuccucugccauaccucaaaguucauggaaauggggggucgagcccauuucuucuugucguugguaggcagaagcucaaucucugcgcugaucugcgauuccuucaugccugccaugcgcuugauccugggaacacagggacaaugggcagcccauuggggcuuggaggaguuucaagggcaguugcccauuucaagcaaggagagagcccaggagcuugcaggaggugccagaacaaggagaaguggucaggacccugcuaaccacuugcuauggaaacuugggucuacuucuuuagaacaacaggaugcaguuucugccuagacacuuggacaugcuaucguuugcuuugucugcuucacagauacauuacaaaggcaauguauucccuuuguaauguauacauuacaaagggaaaugccaaagcaucuuaaaaaauaagcacgugcaugaacccaaaugcaggcguguacauacucacauggagguauaaagacugacaguacaagcagaggcuccuagaaaagcaaacaggcacacuccccugccccucauucagaaggaucaaagcugaaaacaagaggguauacugggaucuugagcccugcuguggccuaaugaaggaaagacucacuuccacacgauggcauucucgcuggccuuguacuuggccuuccccuucaugcagaucaccugcaccccgcuuguguucagugggguugggauccucaccuagaagugacacaccugucagggagcucugucaagcugugacaucagcuaccuuuauuccuagggacaaguucuuccuccuccuugagcccccuguccucaccucgaucuucugagccagcagugaggguuuaaaguuggacuugaugaccaccuugaccuccaguuuggugcgucccacuucucgcacuagcgggaucacccggaagggaaggaugauguccuugguugugcgauaccuuaagggaugggaagcaagguuaccaaagagcugacccacuuccucuccccagucugccagcagcacuagcugccuccucacaccccaauggcaccucauaagcucaaacucuccaucuggcgggauaaagcugaugcugcguucagagucaaacuugcugagucgcacacacugguggaaggugcagucaucaauggcaauugauugcuucccgcugcaagcaggggcagaagaggucucauugguacaggagaaugacagcugucaugcugggagaccacuccaccccaggcuggcaccagagacuaugaaaagcugcuagaaugcagcuuugugacucggaggucugccccagagcuugggaugagagggaagccuugcaagcucaucucuuggggcuccuucugcuagggaccuggguguuucaggcacacugggcagaggcugucaguauguacagaaaaggccuugguccuagggaccaaacaaaggggcuugcucucugaggacgauccccucaucucucguagcacuaaugucaagagcgaacagccaggcuuaccgucaggaacagaguuugcaauuacagugggaaugaaauccagaagaaacuugugguucacuagaccccacugagcccuccaagggacacccucucccaccagcucuccugccucaggcaccucuugcuuguuucaucagcugugccuuugcccugcuuuucaauaacaaucuugucauucaucccaaacuugcauucaggcaugccacucagguagcucuucaucaccacccggcccgacacaugggcacucagcaccugcccuggugauggaacagauaaauggggagcagcggagucaggcaggcaggcccaggauccugcccugggcccccuccaacuuugucgugagagggaccucaccuuguggggacaugagcagguucacacucuccagcacauccaggaagagcucauuccgacgauacuugauacccucucgccgccagccaaucugcccaguuaccuggcuggugaucugugacugcucuucuuuugucuacaugagggcagaaacaaacagcaauggccucacuccucugucccuuuaaucauccugucucuauccccacuccacccucauuccccaucccuucuaguccccaccuguaauccauuuuccccuauaagccccaaagggcagggccuggagaaacaaagcaaagcugcaaggguggaagcugagggaagagcuuaccugaugcuggaggccgcagggccaacgaggugcccacaugaagcagcaagggaggcagaaaaggaggagaaagcuaugaggcuuggauccuagaggagagggcccaagcucgcuccuccugaggaauaccaggccucaagaccaggccuccucccccaccccucagugcaaaaggaaacugcuugagcuguauuccugguaauagagaugcugaauuggcugcuccugcagugggaggaccacacagagcaaaaucggccugcaaucauggcaggaggcucaggccagcacuuccugucaugggagggcucaugagucagcucagacaaggcucaggggccagcugagaugaagggagauuggacuccacccugacuauagucugcacaauucaaguaccugacucuugaugcccugcugcgugaugaagguuuucagcgcgccugucucggaauucuguggguagccaaagucuagaaucucugcaaaaagaagggaaccaucagccccuggacagagcuucuucauuccagccccuacuugggccuacacaucugaccggcacagcucccaaagcccaugugggaucauccgcaagaaagucuucuagcuuuguagcauuuauucugugauuugugcuuuacaggaaaacaauucaaauguuugauuuuuuucaaauagagaaaucaaggccaggugcaguggcucaugccuguaaucccaacacuucgggaggccaaggugggagaaucacuugagcccaggaguucaagaccagccugggcaacauagcgagacccagcucuacaaaaaguaguaaaaaugagccaagcaugguggcaugugccuauggucccagcuacucaggaggcuaaggcuggaggauugcuugagccuaggaggucgaggcuucaguaagcugcaauugcaccacugcacucagcauaggugacaagagcaagacccugucucaaaaaaaaaaaaaaaagaaaagaaaucaauagaagagucacauggccaguggguggcaagucaagaagcuuugagcuguuuucuccagaaaauagacauugggaagguggaaguauucaccuucucuuagaucacacucuacagaggaacagagauaacagugcaccccaagaggcuuguaauaucucacucucccccaggcucugaagcagcugcugagauggaaaacuggguggacaguuagugaacuaagguccaagccacaaaggaaagaggaugaauacaggagguucagccaccaaaccugagucagguuccuagccccuuggaagaucaccugcuggccuauuucuguguucuacuucagaccagccuucaggucuggaugugaacuggccuucugaggggcauagagauccuagcccaagagaccaaauacucaggaaagaaaguucagaguguaccagagccucggaccuacacccaccuucaggccaggcccagccugguuuuuucccacccuacgcccgcugccgugccagcccgccagccucaccauccagcagcucauauaugagcacaaaauuguucuugauguuuuccucgcugaucuugccaaaguaggcagccaucacgucacacaucuuauagaggaauucgaagaccauggcagcguugacauucugcuuggugacugcugccagccaaauguuggaccgcuuaacguggaagaagcuggugcgagcaauguuggugacggggcugcgcaccugcugccgggcauggauaacauugacccgaaaggcauccacugcguuccuccugagggaaaagagugcauagggccugcucagcacccaggugaaccuuaccccauaaggaucaaccacagcugcuaacagccccacccuccuuucugcagaagucugacacacacacuccaaagaaagccaaugccuaaaccacuggagugguucccuucuuaugacucccuguggaggcaugggaagagugccugagcugggcuagugucuaaaggccacaagaaauagggaagucaacuauuaaggcugauguaaccuuaauaaagugagguucaucagguuuagagacagauauuccuuacucccagggcuggcccuaauuucccagcuuuaucuagcuucccuguaagcucccagguccaggacagaaagagacacugcuucuucaguccucccgcuagugaucccaccaguggggagggccgacuccuccagauguuagacaaagccagcauggcuucagaagucacaaaggagggagaaguaccaaggggccauggaauugugcuacccauucuugcccaggauccaacuccagagcaaguugagggaaugaaaaaggaugcaggaaaacgaugggggcaggcccccacccaccuguaccugggcagcagcuugagaggccgcuuaccuauugcuacggcagccaaugagaugggaugagagaaaugacgccagcaagaagaggagagugauagcaacgagagagaggguuagacacacaacacaccgggagggcggcacacaccgugaggcagaagcagacaagacaggcaaggcggcgugugaccuggccuuggcuugcccaguccauccaaggcaggagggggucuggggugggggguguagccagccagguucagacaggccaggccuugccacagcugcagcucuagcucaugccacaccaccagccaauggacaaacgcccgcaagggccaagccagcccaucagccagggagccaaaugaagagcacugccacaggcccauucugugacuuuaucucaagcucucugaggaagaaaaacaggcagcaggaaccagaggagccuacucuuuagcgccucggaggcuaggauaggucccuucagucgcaaagaacaagggcgugcaagggggcgcagaaugagaaggcaggcuguggcucugugugaaggcccaggauauggagcugcucugggucuacugagaggguagcauggcuucccugcccucccacagugacccagagagugccucacgcuuccagccacuccccagggaaugggccagaggaacugaagacagcugagucagcagccugacgacuccugagaaagggagcaggagaggauugggcagccuggaggggcuuucaacagaauccagugaaggcguuugauaugggaagggcuucugagagcaaggcuuagauggauuagugccuccagcguggccacuaaccccacccacuggagacauuucuccuccuccuccucaaagaaggaauucaccagccugggcaaaggcacuguaacuagagaaacaggaugcaggaagggaaggaguuccuaaagcugugggaccaugccauuccacaggucccaccuaggggcuggcaggcuggcugccgggccaauaccaccagaccuaaugggagccaggcuacacuagcugagcuuccagggugcagccaggggucaggguggcccaagucaagccaauggugggaaaagaccuaauccuguaugcuggggcuggggggcuggagugguggggcacagcuggcuccgccaggggacucacccgaugucaucucgguagacucgggagaugagcaccucccccuugugauuauagaugaauaagccuccaaucauggcggcagaucagucuccgcggcccaucgcucugagaacagaccuaggacaggcgggggcaggguaaaagaagaccucagaaucgcugccaacauccccuguggagcugugcaggucacuggagcuucuuuccugacucaacccuuuaguaagugacccugcagcccucccagacaugccccuccccucagccaggcuccaguuccuguuuauuccacacuagaugggagaaagaaacagagagagauuaggcccaggauucuaaggccauuuugacccucccuuuccuggggcugagcaucaguaacccccgcccccucuccccagcacugagcucaggaaugauccuuuucggcccccuccugugcagacucucgggcucccgccagugacucacuaaggcuugccugccugccugcggcugcaggaauggcgguaggcauuacuccaguugguucaggccuggggcccccaggcauaaccuuuagagcauccagucucuugggcuccacuacccuucagagaaggucgcagggccugaacuuccggcacucuaauucacagaauucaaacauuccaggaaaggguauaaggagaagagaagggagcccuuaggcccuaauguggacccgggaguguggcuuaaccucuuccaggcaguggaauaagcaggcaaagggcacaggaggaagguccuagggcuggcagacuacacuuccaucacccaagcugcuuauuacaguuauuucugauuaccaccccccuuucaaaaagcucuggaaugcaauaaaaauaaggacugggggguggggguggcgcaggcucauaaaauuaagaaauccuuccaucugaaaucgugauuccaggcccaugaaguaacucauuucuggccugggugccuauaagcaagaagcagggaugucaggaugccugaauuauccaaauuauuugggucaaauuaauuuagacuguuugagaaaaggcauuaauuugguuuuagauuuccuggauuagcccugguauuaauuucacagggaguacuuuagaggacuuuucuaaacuggaaaauaaagccuuuuccuguggcugucaaggucuuccagaggggugagcggucucucaaggugguggacucaucccaucccucagucccaaacaggcugggagaggagaugcaaaauggagguagagccuggggcaaagcaccaaguccacagguaucgagugguagguagcgaagggcacccgagaaccagaggggggccuugggcaagaauggaacauuuaguuaaggggaaagaccuucagugaaagccaggcagcguccucaggugagcccacagcagcaaacugggcugguggagugaacguaaagguaaggguuuccaguauggaaaaggucaaggcuuuaagaaggaaaaaccggccgggggaacugacaguggugaauaagggaaagcuggggagacagagccugcuugggguucaggugcagaguaaugagagggugguaggcuuuucgccuuggggaggacauugugggaaaagauggugccaugggggugcgggggcugucacaggucuaaggaagaagagccgcggggugccacugaacuaagaggagggggugccgcauggcgugagaccugucacggugcaaggcggcggcacaaaggggugucacuguccuacgagacggggaaauuguccuugcgcggagggguaggggguuggcacgauccuagggagggggcgcugcgcagcguuccugcucugggaggauuccaagcgguaucccucucaugggaggcgccaggcgggucagguggagggcaccgcuccccgccagcccugcaaucgcgccccgggcgcccccgccccaccgucagcuagcucccggguccgaaggcugaagccacucccgggugugggcagcuuuccgccagcucagugcagggcaggacaaagcugcgcggcgaggcagacgacccgcagcguccuccuccacgccauaaggccagauccccggcucaccugguguccucggcccccugcucugccggcccggccacucuccggaucccaagauguccgcccgcccccu

SEQ ID NO: 18823 - RNA, 33168 nt, Homo sapiens
uggaguucaguaugucuucuagaacuacuggcggcagcuucuuucguugacgugggcuacaaugguugcuaaaaccugcgugccagaagccagagguggggaggcgccauuugcuaaaccggaacugguuaaaaucucaggguggagaccauucccagucagcaagggcuugggaagugcauacaguuccugcuccuggugucuacucugaagagcacagaguagacguuugucugccauuucaccggcaguaagaucagcagcugcuggugagcaaagagguaguagugggucacuggacuggugggcgccggggccgcgcgcuagauggagaggucagcggcgaacccagcuccauggccuagucucgucagaccgagcgcggacccugccggccuccguucucuuccgcuugucucagguaaagcgcagaucccuccgccgcagcgugcgcucccgguagcgcugcgaucagcuuuucggcaauacccggauggaaguguaauggccgccaucagggacucgcaggcaauggguacuacgacagguauuccccgucagcgggacugcccagaccuuuuaggaugucagaacuucuagagggccacccagcaggcaaacggcgaguuuguggaccgucagggucccccaaacagguccagggauccgccucuugugagaggaagcgcgaguuaaauagucccggccauucagcgcuuccgcuuaacuugccgcaaaguuuuucuggagaagucgggguuuuuuugccgagcgcuuuugccgacugcuagagcuuacccuuacuuucuuaaccugggguuguuuuacuuccgggcuuuuugaacucuacacucuccuacauucuaggagcugggugggaguaggagacggugugccuccgcgcuccccgcggggcagccgaaccccggaggaaggggcggaucgggcgcgguguuuggggcgaagcugggcgcgcggcgcucgaagcacucacucggcggguuucgugguugguggagacagcaagggcgccccgcagaccgcaccccucgagcuauagguucgcaggcccgacucgacggcgucccuauugcuggcccagcguauggucauugggggccauuucuugcagagaugcccugcucccugacgcgcucgcucuucuccagaguuggccaaaggugcucuuccccgcagacccuaaccacacccaguggcaguuggauuucuuuguaacuggcuuucucacauguaggguucauuuugacucuauucguuacaugguguccucuuugucaaguagacagucucuuccuagguggcugugguaauugaaaaguacauagagcgaaauguauauaaggaaaaauguuuuaacucuuaaguggaccgaucaaacagauguagcuuuaaaguucagaauacaacaguuaagacucaguuuucuuuuuagguuuaaauuugagagcaaguaguguaugugagcuguuuuagugcaaacauuguugaguauguugucaaacgucuaaaaaacccuagaaaaauaaaauaagucaauguucaaggaauucauaagaauguuggaauuuguacaguugucgcagugauaaaacaugaagacaccaaacugucaggauaggaauucuauuaacuugaaagugugcauguuagaucuaguuacugguaauuguugaauugcuuuuucugcagcaaggggucugauuugaguguacucuaagguugauauccucagguuuaauuuaaaacauuuaaauugauucagugaaauuuccuaacauuuuuugaguuuaacugcaaauuuauagaaaugcauucacuaucuuucagcaaaauugucuuuucugaaauuuauaaagagacauugcguucuguuaacacuuugaggguguugggauuuccuggggaagguaagcauaguaaacgauguugauuuuugccauagaaacuguaaauuagaucaucccuagauacagaaaauugccaacaaaaggggagaauaaaauguagguauguuacacaaccaaauguuuccuguuuguugcgugaaaauaaguauaauuaccaaauaaaacguuuuauaucugguuuuauggaaggacaaaagacaguaaccacaaugaacacccacugugugcauugauaauguaugaacuuuuaaaugcuucaauuuuuugccauggucacacuucggauucuguucuagucucucugguaauaguaugcuguaaucccagaaguuucuauauuuugaaauauuacagagggacuauacuuuagccuagaucuauaauuugacuucaggauaugcuuuaaaugcccuuuaaguguauuuuuguuguuuacuuuucuguuuauaguuguuuagaauuguucucauugaggcauugugacauugcauacuuuagagcacuuaauacuacuuuuuuuuuuuuucuuuaaaugauaggagacuugaaucuugcccacauuccuucagguaugcuacugaagguuuuguggcaaagugcuauuagcagaacaaaaagguuuuaacaccgucuugaaauuuuuauuuauuaucuggucccagguguguaggcugugaguauuucaguucuauaugggguauuggcuucucauggugagcaguuuucauggcauauuagauaccagaaaugaguauuaaggguuaguauuguggugguaggauaacugaauuggaaccggauccagauauuauuucuaguuuugugacuuugggcaaggcucauuuucuuuuucuuguaauaaaugaagauacugaguuagauugauucuaagcuuuagguugugacuuuugcaaauuugugacauguuaucacuggucaucaaugauguaugcuuaaguguauagaaguuuuuucuuaguuuuuuuuuuuuuuuuuuacauuucuuuauacaccuaaguugaaugugaaguguaauugaacaguuuuugucgucaaaaguuuuaaaaucuuggucuucauuuccagauaucaucucuucuuuugaucacuguuccugauugugacauugugcaaguguuaaauugugugccuuuuguuccugaagaaagagguaugguaaagauugaaauacuggaguauauagucuauuaaguaguaaguugguauguuuuaauauuggacuaaauaaaguaaaauauagguuaaguaucccaaauccaaaaauccagaaugcaaaauuuuuugagugcugacaugauggucaaaggaaaugcucuuuggaacauuuuggauuuugaauuuuuggauuugagaugcucaacugguauaaugcaaauacucuaaaauccuaaaaaagaaaaagaaaaaaagaaugaaacccuucuguucccaagcauuucaaauaagagacacucaaccuguaguuuuacauauacaugaguuuucauaaguuauauaaguuauaguuuuauuuuauuuuuuggcuaaaauaaaauacuuaaacaugaguuuucauuuuaaucuaagcaaaaaaaguaauuuuugguuucauaguuuauuacuuaacauuuuauuagaaauccaaauauaacuuuaacuaucauccuucugaauagaaaaguggcauuaaagucuucuggguaaugaacaguggagauaaaggugguagauagauguuucaaagcuauaugaauggccagaagauugugguuuuggucuaguaagugcaaagcaauguaccuaaagaaaaauuaucugauauguguuuauauuaugacuaauagcaucuucauuaugaaucaggaaagggacuugggaaucacuauaguguuaugauugguuucuugaagacagucaugugaaugucuggguguagacaaaaaaggaggaaaaauaugccaacaaaucuaugguauuauaaggaaagcuuuggaaauguaguggaaaauauuguacccauguaaaaaaacauguuuuuucuacccucaaaacacagaugucuccuacucuuuguguuggauagguccugggaucuuugaaaugcuaagauucuuggauaccacaguaucauaaaauuccucuaaaugcaguaaguauacacauaaguaugaccguaaauuaggaauaagauuauuuauguaacugcugaaauagcugacauagacuauaccaccuuacaguauugcuuuaauuaucauaauaaccguguucuucccugaacuucaccagcaaauggauuucuguucagggccauuuuuuuacaaaggcaugaauuuuuauuuugucagaaaauaauguacauugaguagagagcaguagagcugaguugagguaccacguuaucguuuaugucauuaaguaacuuuuuccuauauaauauuuguuugacuuccuaccacgagauucacauggguacuguguuauuccugaagagauaaaguaauucugaaugcuaagaauuuuccuaaagguugagcaucccaaaucuaaaagccugaaaucuaaaauacuccaaaaucugaaacuuuuugagugcugacaugaagcucaaaggcaaucaucacuggaacauuuuggauuuuggauauucagccaguaaguaaugcaaauauuccaaaauccacaaaaaucugaaaucugaaacacuucugguuccaagcuuuuuuguuuuguuuuguuuuguuuuuuugagacggagucucacucugccacccaggcuggagugcaguggcgcgaucucggcucacuacaaccucugccucccaggugcaagcaauucuucugccucagccucccgaguagcugggacuauaggcgcaugccaccauggcuggcuaauuuuuuuuuuauuuuuaguggagacgaggcuucgccauguuggccaggcuggucuagaacuccugaccuugagugaucugucugcuuuggccucccaaagugcugggauuacaggggugagccacugcucccggccuacuuccaagcauuuugguuaaggaauauucaguuuguacuauuugacccagacuacucagaaaaaguaauguaaugaagaaugaaagcuguaguuguagugaaguaaauaggagacugcugugugaugacugaccaaaacgauuuguauuaauuuaucuugaaaacuugugagcaaagucugacuaaaaauuuaaaguugugacugguauggcugcaugaaacaagugucagaauauuagaaugaagguacaugaugugaaguuucagaaaauuaagugggcuucacauaggucucauuucaugaggaaagucagauaauuucaaaauguaguaagcuuaucgucaauuccugauuaauauugguuuguugaagguuguggcugguaaaagacaugucauauauuguuuuugucaacucaguaucucuucauuagagaaccaccccuccccuauucugagugguuggugggcuguccgucagucuuacugucuuauaaccugagcuuggucaucccuauugcaacagugauugcuguuacucaugcagagccagucagaauccuuuuuuugaaauuuaugguugaaugcuaggacaaagauacuaccuuuucucugaaauuguuaaucugggaaggugcugguggcauucuuuaccacguguaugaaaagcgcaucuguguagugggagaaagugaagccauaaggagaugggagauggauggugguagugccaguuucaaucucagggaacaugguaagugguaccuacuuuucuuuugauuuugugaacuauccugguguccuucucaguccuugugccaaaauuuuuuguguaaauugguuugaauuggauugcagcagaaaguguucugaugaauauauggcccuuaugaauuuaaggucuaaaguuucagauugaucauucacauccuucuguaguuccccacuuuccuauaccuuauaaagaguucccuuuauuuauucaucauuugugcaugcauucaaucuacuuucacucaaccuacaaacauuuuuuugaguguccacuauguacaaguaugugcaacugccuggauaggcaagauuauauguacuagacugaguggaugguggauauauagcauauuuuuauuuauuucuggugcacagauuaauaagcguguguugagaauaaugacuguggugcuuggcaucuaaguaauaauguaagaacaagaagaauuccuugucuuggaagugcuucuaguuaggaauucauauuaauauacagcaaacacaacagaaaaaacagauaaaugaaugcacaguuguauuuuaagugaauuuugaugggaaggaagugagcagguuggcccauuuaggaagauuuccugaagaauauacaacuuuaaauguauuucugcuuaugaauguggcuuugauaggcacagagaauaacugaaaaaaggauggaguuaaaaaugauuauaggcugauccagguuggaguggagauugguuucacuguaacaguauguguucuuuggaaaugagguaguggaaaauaaggugacuguuuuagguaaaucuauguaugaggcauuuggaaagccaagcagaaauuuuggcccuuucuacuaagauggagauuucuuugaaaaaauguguauauuucuuuucauauaauuucauuuuuguaugcuaaaaugugaauuaaaugugaugaaauacuguaaaauuacucauuuuggcaaaaaccuuuguuuuauucaucugucuugaagauuuuuuaaaaauagcaauuaacuuggaaugccgauuuauaaauauguauauauaaccuuucucaaaaagggaaagguaagaagaaauguuauauauauuuauuuauuucuucuuaccuuucccuuuuugagagaucucuuaguaauagucaaagccauacccuauuccuuagugagaaagccaguuugaaacgaauguagcaauagauguaaaaacauuuaaaggcguuuuaauguggcuuuuuaaugagcuggcuuaugccuguagucccagcacauugagcagcugagcugggaggaucgcuugagcccaggaguucaagacuagccagggcaacauagugagaccccaucucuauuuaaaaaaaaauguuuuuaaagauaaggaacagacuuaaagugaugauugauugcucauagaacguucauuuugggcuccagaacuaggaaugauguagaauuuauuguugugucauugucucauuaaaugcuguaguuuccuauguccuugccuaccuucuuuccucagagccucgcaucugacccucagagaguagcaguuggauuauuccauuauaccaagguuggcaagcuuuugcuguaaauggccagauaguaaauauuuuaggcuuugugggccauaugguuucuggugcaacuauuguaacacaaaagaagccauaggcaauauguaaaugagugaguguggcuguauuccagugaaacuuaauuuacaaaaacaggcagcaggccagauuuggccugcaggccgucauuucauuccacaaacucucucagucacaucugcgcaccugcuagcaucuuuauuuauccuccccucuaguuacuauagauggaucauguuugcuccuuucuaaguucaccucuucagcucguucacuagauuccguccguucuaaccugaaggacuucacugcugcauuucuuuccuauccuuuaucaucaauuuuuuuauuuuuacuagaucauuuuaauaagcgugcagucauacuguaauuccucccaccuuuaaaaaacaaaaaauaaauugaaacaaaacaaaacaacuccuuuaucuuaaaacuccuugaaagaguugucugcacugcaucacuacuuccucucuucccauuuugccuuacauccaagcuugucagccuuucuccucuaaaacuccacugaaacuguucuaauccaugguaccagugaucuucacauuaagucuaguuagucaucuucuuacuugacagaguuguucaaucccuuauccaguaaacauuuucuucauuuugcuuugaggauaccacauucuugauuuaccuuaacucuuauuggucauuucuuuucugucucacuugcugguucuuuuuaaucucuuucuguuggauguguuauagaaucuugaggcucaggccuuggacugcucuuuuuguuuauucccccuggugauuucauccugcuccaaguacuugaaaguacauauguacauauacacacaccgauaacuccccaaauuucaucauccaccuagcccucuguauucuauauccagccacacaguccacauuuccucuuggaugucaaauagacaucucagauauuacaugccuaaaauggaacuuuugauaaacuuuccuauuacuuuaacaaucuuuuauaucucggugaauagcaacucaguucuuuccaaugcugucagaacuucuagaguuauccuugacaugucucuuucuuucagagaaagcauaucaggauaucuuguaggugcuagcuucaaaauauauucaaucugaccaugccucauugucucagccaaaccaccaucaacucuuacuuggauaauuguacuguguagucuuugucuuuacucuuaaucccuccugaauacucuguucuuagcauagcagcccaagugauagaaguaauucgacucaugguaauucucugcccacaaugcuccaguagcuuccucucugauucagaauaaaaccaaagccuuuacaguuucuaucagggccuguuucuguccccuuguuacuucucugaccucaucuucuagcuuucccucuaaugcuuucuguuguggucauacugauuuucuugcuguuccccaaauguguuaggcacauugcacacucagggucaugucacuaacuuuuguuuucuuggauuguuggcuuccucagcucuuuaagauacugacuccaauaagaccuuuucaagucgagggcucccugacuuaauauguaaaauuacaacacucugauucugccuuucugucuuugcuuuauuuuucucuguagcaauuguugccuuugaauauacuuuauaauuuacuuacuuuguuuauuaccuaaauaaucaguaaaauguuaccuccgugaggggagggauuuuugucuguuugguuuacugccauauucccaaugcuuagaacguagauguggugcuagcuacaagucuggcagcaucccacaugcuggugauguaguaaaggacauuacagauguaguucucacccuuacgcaacuuauauuccggugguagagacagauagaaaauaaaugggcaaauaaauaaaauauugccagagauauuaaguguuacaaaaaaagaaauagaaaaggauaaaguggcgaauuuuuuuuuuuuuuuuuuuuuugaggaagggaugguuuauagggaagggcccuucugaggugguggcauuugagcugagaccuaaaagaugagaaggauguagccuuuugaagaauggaagaaagcacauuucaaguagggaacagcaggugcaaaggccugagauaggauggauaggaagaauauuugaggagcugagaaucuguggcagcuuguuggaguauauguacaauggggagaguggugugagaugaaguugaagaaaaagacccaagaccagauaccgcuguuucuugcaggccuuuguaaagagauuaaauuuuauuuuaagugccuuguugcuauaggcugaauguuuaugucccccuuccccauacucaaauugauacauugaaaccuauucuccagugugauggcauuuggaaguggggccuuuuuaagaggugauuaggucauaagggcagaguccuuaugaauggaauuaguacccuuauaaaagagaccccagagggcucuauuuugucaugugaggacacagugagaagauggccaccugugaaccaggaaguaggcccuccccagacaccaaaucgccagugccuugaucuuagacuuccuaggcuucagaauugugagaaauaagucuaugguacucuguuacagcagccagaacagaguaggacacuugggaaaccaccaaggagcuuuaagcaggggagcuuugugauauguuuuauuuuaagaagaacauuugcuccuguguggaggauggacucagaggagggugguggacaagguggaagcauggaugccaguuaggaggauguuuucauucauguuagaaaugaugguggccuggacuaagaugaugacaguggauaggaagagaggaagggaaauacaagaucuguugguuuuguuuuuguuuuuauuuuuucgagacggaguuuugcuuuuguugcccaggcuggagugcaauggugugaucucggcugacugcaaccuccaccucccggguucaagugauucuccugccucagccuccugaguagccgggauuacaggcaugcaccaccauaucuggcuaauuuuguguuuuuaguaguggcgggguuucucuauguuggucaggcuggucucaaacucccgaccucaggugauccaccugccucagccucgcagagugcuaggauuacaggugugagccaccucgcccggcccaagaucugguuuugagauggaauugaccaggcuugcuuauggauuaauguggggaguaagggauggaggaaucaaggaugagucuugauuucuggguuguggaacuguaugaauuuuagugccauauaguaagauggggacauccagggaguguaacuucuaaucauggaggcaggugcuguguagaccuagagaaaaauuaaaccauuuauauuauuuucugaagcugaguaagaauggaucacaugauaacauguucucccagcaaauagcaguacaucuuuugauuuucuucccuccccucauguauuccaaaucaaaaucugccuauucuaaaucacugucgcagcaaaaugacaaacagaaaaagaaaagagcaaaagaugaaaauaauuccuuuucuauacugaauucaauggcucuuaugucacuuuggacaaauuaguucagauuuuucucccaauuccuaccuauuaaaaaggugauuucugccagggugugguggcuuaugucuguagucucagcacuuugggaggcugagguaggcaaauugcuugagaccaggaggucaagaccaaccugggcaacauggugaaaccccaucucuuaaaaaaaaaaaaagaauuggaaaaauuagcugggcaugguggugcauaccuauagucccagcuacuugggaaauugaggugggagaaucaauugagcccagaagggcgaggcuguaaugagccguaauugugccauugcagcacuucagccugggagacagaguaagacccugucucaaaaaaaaagaugggggguugugggagugauuucugacucuguguuuuaaaccaaguuccaaauuauugcagcaaaaaaguuuacaugcucuuugaaguuugcuagaaagugauuuaaucuaaaaucauagucauauauuugauuugaaaaugagagaaugaauagcuuaaaaauauauggguuaggcacuuguguacccagccuucugguuuuugugagggaaaaaugagaaauaguaaguaaaacuugcauuuaggaagcuuauaaauuaucuggggagguaaaaaauaaugaaauuauguaauaguauaaagcaauuuguaauaaauggugagcacuggcuauucuuuaaguggauacucagagaaaggagagauuuaguguguauuguaaaagguuacaugucccuauaagaagcagaauuugaaaggaaguuugaauaguguugaauuuagauagaaggaaggagaugccaugccuggugaccgaaaacuauaugaacagaacaaagguaaauaaagguguauguguggguaagcaucuuuuauauugggcacagugagaagucauaguuucagggaguaauaaagaauaagguuuaccugaaccaagaacugcuucuguauuuuaauuuuuaauuuuaaacuccuuuauaauuguauaccaauaucaauugcauaccagaaugguaugugacucacagauacacuagaauuuugaacauuucuagaucuguauuuaauuacuuuugcauauuuaauuacuuuugcauauuuaacccuacauuucuuuuuuucuucuucauuuuuuuuuuuuuuuuugagacagggucuagcucuguuggucuggagugcaguggugcuuggcuugcugcaaccucugccacccagguuuaagggauccucccaccucagccuccugagugccugagaauacaggcacaugccaccacacuugccuaauuuuuaaaauacuuuuguagagaugaggucucacuauauuacucaggcuggucuugaacuccuggacucaagcaguucuccugccucugccucccaaagugcugggauuauaggccugagccaccaugcccagccuacauuucuuuuucuaugcuuaaguuguucauuagaccacagugauuuggaaggagcuggcuuugguuacauauguaaacuguauacaaccauuucuugcacucuuaaaaugugauaggcuuuagucucucagguaaacuuuuugaaaacuuaaaacagcugcaaaaaaaaguaagcccaaaauguuuguuucaagucaugaauagauaauaguuauuuugagggcacuaaaauagauucugcuuugaaaguaauauucuuaggguguguguguguguguguguguguguguguguguguguguguguguguguuucuagauuccuuuuagcagaaccuuauauuuuucaguaagcuuuuacuguuacaugcugcuuugguuugaucaccacucauauauucauucauaugacuguuuugccuguaucugcagaagaaggauugaaugacuuaaggaaugcaguaguuuuuuaugugaugagacaacuuagagagcuacaugcugagucaugaauauagcuaagcuaaaacuagaguuuuuaguuuuuuuuugguguuuaagcaacuugaauauaguuaaguagcagauagauucuuccuuuuuagacucuguagaaugccuuugacuuuuaauuauuuuagaaagcaaauauaacugucuaggaauguugccuuuugaugaacucuucaaaucuuccuuaucuuuggcauuuuacuuugggaauuaucuuuuaaaaaucuuuccggacccaaugugugauuucuuuuuuuuuuuuuuuauugcgacagagucucgcugugucgcccaagcugaaguacaguggcgugaucccggcucacugccaaccucugccacccggguucaagugauucucaugucucagccuccugaguagcugggauuacaggcacccgcaaccaugcccggcuaacuuuuuguauuuuuaguacagaugggguuucgccauguuggccaggcuguucuugaacuccuaaccucaggugauccgcccgcuuuggccucgcaaaguguugggauuacaagcaugagccaccgcucccagccgugauuucugaccuauguauguuaacauuaccaguuccuuggcuccucacuuuuuauuuggauugucacucuaguugcuuaauuuccucauuucuauuuuuacucuuucuccaguuuaucuugcugucuaguacccuucuaauauuucuaauguacugcuuuuauaacuuuuuucuguucuuaaauuaacaauugcuucuguuuaccuuucauuuccaguucagaucuguccucuauagucuguucucacuuaaccuccccaucaugcauucucuuuuucaucuagacccugugguaccuuaggagaaaaauacuuuucuuccauuguuucuuuauucuguucuugugguuuagauugccuuugcuucuuucuuacauguuuuaaguccugcuacucuuuaaaggguccucacaaaaccuaccuuucugugaaguaaacacagucaucguugauuugucaacuuucuguaguauguaagaagccuuugauuacaagcaguagaaaccaaugugagcuagcuuauguugaaaggggggauuauuuuaaggauacaggauuuccuggaauucaagaguaggaauauauaggcagaccucauaaaggcuugugguggugacauugcccucuugguuucagucaggguucuuaggagagcugaugauuuuucuccuauugauuugguuuucugguuuguuuuuugcuauaccaugcugucauuucuuuuaaaaaaauuaaacuauugucaguaguuuggaggauauccuucugcagaucugugcuuauacgcacauaugcuuauaagaucuuuccucuuagcaugaaaacaaggaucauuucuccuaauuuaaaaauguauucugugccucagucugcagcuuccuuuguuguuguuuuuuuagacaggucucgcugugucaccuaggcuggagugcaguagcaugaucacggcucacugcagccuugaccucccaagcucaagcaaugcuuccaucucagccucccgaguagcugggacuacaggugcaugccaccaugcucagcuaauuuuuguauuuuuuguagaaaugggguuucgccauguuuucuaggcuggucuugaacuccucagcucaagccauccacccaccuuggcuucccaaagugcuaggauuauaggcaugagucaccaugcccagccuacaacuuccuuuuuaaaaauuaaaaaaaaaauugcuuggaauaaauacuguuccaagucaauucaguacacauacuucuuucuguauaauuucauguggauguuccguaauuuuauaauuuuccuauucugggcauuuaagugauacugauauauccauauuuauauguuaugcuuuuuugguugagggggaggauauucuuaaaagugagguuuuugugaguaaacaaaauugaguauuuucaaggaaaauauaaauuaccaaagugacucaagcaguagaaaaucuaaagagcccagaaaucauagaagaacuugcaaagguuguaaggucuaaaaaucugaaguguuacuagguccauaugguguucuuggugcagucuguauaauuuuaaggaaagaacaaaaauuaaacuguugucaguaguuugguuagugaacuauuucagagcagaugaaauagugguaaguacuccaauccauuuuacaaauccucuguaauaccacuaccaaaacuguuacagauagcaaaaaaaaaaaauucuaaauaacacuuugucagaugaaauucagcacuuuauuaaagaauaauaugcugcauauugcaaaaauuguucaacauuauaguugcuauucauuucuuuguauagcauauagaaauaaauauauaggcaaaauuagguugguguuacaauuuuuaguauuucuuuuaacaguaucaagaucaggaaacauauuaguugaauaccauuuguuuucguauaaaauacauguauguuuuguuguuguuguuguuguuguuaagauggagucucgcucugucgcccaggcuggagugcaguggcguaaucucagcuuacugcaaccuccaccuccuggguucaagcgauuuuccugccucagccucccgaguagcugggauuacagacaugcgcuaccacacccggcugauuuuuguauuuuuaguagagaugggguuucaccauguuggucaggcuggucuugaacuccugaccucaggugauccucccaccuuggccucccaaaguguugggauuaaaggcgugagccaccgcuccuggucgcaucuuuuuauuuauguaacaacacugcauacauaacugcuauucugguuguauuaauucccauuacuuuuuagguagccucauuccucacaaauuaauuguuaaauaaaccgacuaaaaacacuucucuuauagcaugaauuuauauagcaugaaugaaauucaguaacauaauucaucauucucuugaguguuuaccauuaacuuugacgcuuguguuaaaguguucucugcagugguaugacuggguacguguguguugauauggagaacacagaauugaaugauaccuguauuguuuugaucucuucuucaccuuuagugucaacauugaucuguuuuauacuggcagcaaguauauuauuuugaguuuaagaaaaacucaguugguuuaccacagaaaucacuugcuuuguuugagaauuugcaucaugccacuuuuucauaaaguuucauaaaauugcagucuagagacaaaaagauugcuguucucacaaaguccaaauguaagguguuugcuugugcuaucauaagguaguaugccaguguggaggccauggugaucuaagacagcauuuuaugaaacacugaccuaagaguaaccagugaucacuaggaacauuuuuguauguguauucuucuugacuuuuaacuuuugacgcauuuguuuauccauuuucuauccaucuaucaguauuugaacaaauuaaacucuauaugucuacuguuuauuuuuuuuucacuuaagguauguuagauaucauuguguuaauaaaugugaguuuacaguauugguuuuuaaauugcauaauauucccuuacaauacuguaauugauuuaaucaucauuuauugguggacacuuauuuuuaauuuugugauuuuauaaacgauggcacaaauaauauuucugauuauuagcuuuaggaugcauuucuagaagugaaucagaaguuguaugccuuuucuccagacucuuuauguauguauugcaaacuguucuuuauaaaggucaugccagcuuuuaucuccaucauuaguauauuacugugccuuuuuuuccucacugaccaacacuagguauuagaaauauguaacaucuuuugcaaucugauuagcagaaguuuucuuguuuuuauuuguuuugaauucuagugaaguugggcauguuuucacuuauauuccucugugacuuucuucuuugggucuuuugccuaguuuguaacuuguuuuuauuuuuauuaugaaauguguuuauggacaaaaugcacacuauguaugugguuuaaagauaaaacaaauaucugcauaccaacuauuuaagaaacagaagcuccuuuccucuacccucauuguguucucucuggucauauccuccucucugcuccuaacaaauaugaaacuaccauucugacuuuugguauuuuggugacuauaaacaccaaauuguuuaguuuugaaaauuugguagcaagccuaaaucuggcuauacagugaaaagguaacagugccacuaguagaugaaggcucccaggagaaguuaagguaacagcauaccuggaucauagucugguuuuagcuucucuggaguuuaucagagccacuuuuggggaagucuagguaaaucaugagugaauccuagcaaccuuagggcccacuguaagcagagaaucuggcaggcucagaguauagaccagauaguggaugucugagagaggcuacucuguaauuuugguuucuaagcucaccaugcaguugaucuggauauaaagguauggagggaaaagcaggaacaucaugaguuuaugucaauacaagccaaauacagaugagaaucugggccaggcuuaccuggggauucuguccaaugguugaaaagacgguacagugucagugacguuuuuggugauggaaguccucagugugucuuuugaugucaaagaugucuugucuuuggacugacaggagcaugugaucugugguccaacuguuuguuauccugguauuucccuuuacugucaucuuggggauauuauuuacuucucucuccuccauuugaucucccaaugcauauuaugucaugucuuucucucucucuguuuauucuuucauuuugcuggaguauaucuuauaguaacaacuuggggaaggaugucuggcagguaaauuuugagauuuugcaugucuucauuuuacccuuauaccuagacccuuggcaaaauguagaauucucgguugaaagcuuuaugccagaauucgaagguauugccccuuugucuuuguccaucuguuacuguugcugagaaaucuaaagucauuugauuucuaauccuuuguuuucugaccuuuuuuguuucuauuuagaaacuggauuuugucucuacuguuaggaaucuuugcaaugauaugccugcguaccuuacacugagcacuugguggacauuaucauccuggaaacugauuuccuacagcucaguacuuuaaaaaguuauuuuauugaugauuuccuuccccuuuguacucucuuccugcccuccuguuagucaaauguuagaccuccuagauugcucuucuuucuuaccuuguuucuccuauuuuucaucucuguguuuuguuuuuuucugagagguuauuucaccuuuaccuuauagcccuucuguugccccuuuuugguuauguuuucuuauuucuuagaguucuuuuuguucuuuugauguucccuuuuuguggcauccuguucuuauuucuuauaucccuagaaaucaaugaguuuuaaauguuuugucuuggccgggcgcgguggcucacgccuguaaucccagcacuuugggaggccgagguggguggaucaccugagguugggaguucgauaaccagccugaccaacacggagaaaccaugucucuacuaaaaauacaaaauuagccuggugugguggcacaugccuauaaucccagcuacuagggaggcugaggcaggagaaucgcuugaaccugggagguggagguuguggugagcugagaucgugccauugcacuccagccugggcaacaagaguggaacucugucucaaaaaaaaaaauguuuugucuuaguacauagucucaguuucuaacaaauuacuuuuuuugauuuaauuggucuggaucuugaacuaauauuagaggguuuucucagacuguccaguaauccucuggccugucugcuugugucucagaagcucauggaaagccccugucugaacccacagaagggcuuguaacacaagguuuugacucccacuguggggagcucuuugggcugggccaggcaccagaaucuggcccagugcuucuccaacuagugaagcuccagaauuuuuuuugagacggagucucgcccugucgcccaggcuggagugcaguggcauggucucggcucacugcaagcucugccucccagguucacaccauucuccugccucagccucccgaguagcugggacuacaggcgcccaccaccacacccggcuaauuuuuuguauuuuuaguaaagacgggguuucaccauguuagccaggauggucuugaucuccugaccuggugaucugcccgccucggccucccagagugcugggauuacaggcgugagccaccgugccuggccugauuuuuuuuuucuuuuaccucaaucuguuacagcugauaauuuuaaagcauaauaaaaauaaauugccagaauaaugaaauuuuaaaaaugaagacauacaaaacauaaguacauguuuuuauuauuagauucaacagauaagucuaacucugaaaaguuuauaaauguuuauuuucgguuuugguacuuaccuugucauggacuggugauagauggcuuaugggccaucagcagaccauaguuuaaggagcauugcugucgccuaggagccaacuuagaagcagaaaaaaaggggauaugaggugaggguuugugucucauguauauggucguuuaauccucuugguuuuggcauagugccuacucucuccccugugccuggucuccccuaaaacaaagauucguuuuacccacuguagagaguaagccucuagacuucuguaguggggaaacaacaguaaccaauagcaugauagaguggggaagagaaucuuagcauccaacuauaagucaaccaacuuucuccaaauuucuuucuguuuuagcuucccccuuccuccuuccucccacaagcuggcaguucuuaggccucguaaagauucagaauguaaaauguguuaguuccuagcuuucccagcugucugcaaggucauuuaucuguuuuucaguauccaaaauuuuguugcuauugcucccucuucuguuuuccauugugaauucugcuguaagggauucuaaauauuugaugucacagguguucuuuuucuccauccagucuuuucugcuuuuuuaacuauauuaauaacaauguuuauauucaauguauauauuuuccucaaagaguacauauguaguauauuuucugaaucuuugcauaucuaaaauugugcuuuucccucacauaugggagcuuuucuggaugugaaauuaaucuuggguuaccucagaacucuauauaaauguuacuccauugucuucucguguuuagaguugugaauaaaaugucugauuaauauuggugucugggccgggcgugguggcucacggcuguaaucugagcacuuugggaggcugagacgggcagaucacgaggucaggagaucgagaccauccuggcuaacacagugaaaccccgucucuacuaaaaauacaaaaaaaaaaaaaaaauuaaccaggcgugguggugggcuccuguagucccagcuauucgggaggcugaggcaggagaauggugugaaccugggaggcggagcuugcagugagcugagauugcaccacugcacuccagccugggugacagagugagacuccauuucggaaaaaaaaaaaaaaaaauugaugucugauuaaaggugguguucugaugaaaaaucccuuuuuuuagguaacuauuacccaccuuuuuggauagcauuucauuuuuaucuuuuaagcuagaaauuuuuacaagaauaaguuguagauacugagcuucuaaucuugccugguauuuggagagcguuugauuuuaaaaauucagaucuuuuuggaaaaaaaaaaaacuuagguacaauuuuuucucauuuucaaaaucauuauuccucccgcaucuacuuuguucucucuuuuaugacagucaguaugcucuuuuuuucaauaugcuagaucuuacugagguugcuaguuauuacuugauuuuuuuuuaaguuuucuuuuuuuuuuuauugcagcaacuuucuuucuuuccuuuuuuuuuuuuuuuuuuuuggagacagagucucacucugucacucagccuggagugcaguggcgugaucucggcucacugcagucuccaccuccacaucccagguucaaacaauucuugagccucagccuccugaagagcugggauugcaggcacccaccaccaugccugacuaauuuuuguauuuuuaguagagacgggguuucaccauguuggucaggcuggucucaaacuccugaccucaggugauccgccccccucggccucccaaagugcugggauuacaggugugagccagcacucccagccuuacugcaguaacuuucauuauggucacugcuggaugggagaacaggggagagguuucucugaggguucagauuauuuucucuuuuuagagcugcugcauccagugauguuucugccuacuuaucuuuuuuguuggcauuguugggugggaugaauuccuaaagaauacaccaagauuuucucaguguuuuuguuaggagaaggggaaguugagaguuaaccucauuuauuuuucuuacaguguagagauaauucaguuauguagcgaaaggacagggcucuuaaacagaggaagauagccauggguguaggaagauucgucuuuguucagaaauaauguccucuuugcaucucuccuaacaguuggugcuagcaauccccuacucugucuggccucuggaucuagcuugaaguucuggauucauuuccuucuuccuuguaccucagccugagccuucugucacccaaagggcuccagcugguuuuucacucaggccucacuuuaucuuccaagguauguuuaggggaaguuguaggcagaauuaugucucucacuuccuuacuugggcauaaugggcagauccucauuaaauauugauuggaugaauguuccuagugaacucccuuuuuaaaaaugguguuuggcagugggucggcauuuguuuuuacuccccucucaccagacuguuugcugucagacaccuugccauauguauauggaauguuuuucuaguuccuagccauuuuguaggaguuuuuaaauuauauuuuuugguuguuucaaugggcaguuaggagaaggaggaagucagauguuuucaguugccauguucauauaggaaacuacagauuauuuuaauacuuuuacaaaauuguauuauuucaagacuuauugagauguuggucaagucuuaugcuguaauaauacauauauagaaggcaguaguuuaaauagcacauuuaaaaccaguaaucugggcuggacguuguggcacacaccuauaaucucaacacuuugggaggccaaggcgaguggaucgcuugagcucagaaguucaacaccagccugggcgacauggcaaaaccucaucuaugcagaaaaauacaaaaauuagcggacugugaugguguauaccuguagucccuguuacuugggaggcugacgugggaggauuacuugagcccaggagguugaggcugcagugagcugagaucacgccacugcacuccagccugggcgacagcgagacccugucucaaaauaaauaaguaaaaccagcaaucuuuguugguggguagagauuggacuguaguaaaaagagcauuagcucauagguuggaggauuacaauuguaauaaaauuuuucuuuuuuuauguugagacguucacaacaugccaacauuuuuuguccauacguggcaaccuuaguauaaauugcugucagauaucauguuuguguauuagucaagaguucuccagagaugcagaaccagaaagauacauacacagucauaccuuguuuaacgaugggaauacguucugagaaaugagucaugagguuauuuugucauugugugaacaucagaguguacuuacacaaaccuagaugguaaaccuguuacacacuuugacuauaugguauagccuguugcuucuaggcuaccuguauagcguauuacuguacugaauaguguaugcaaauguaacacagugaugaguauuuguguaucuaaauguagaaaagaugcagcaaaauuacaguauuaaaaucucaugggaccacauuuguuuauuagguucauuguuggccaaaacauaauuaugcagcaugugacuauauauagauugauugauagauacauaaauacaugagaggggauuuauuaggggaauugacugaugugauuaugggggcugagaaauccuguaagagguugucugcaaacuagagacccugggaugcugguaguaugauucaguccaaguccaaacgccucagaaccagagaacccaaugguccaauucucagucugagguuaaaggccuggcuaaagcagggcugcugggcuaaguccuggaguccuaaggcuagagagccuggaguucugaugcccaagggcaggaggaagagaguauccuugcuccaagagagaggcaggggaaauccuuuucucuccuuuuuuguucugucaaggccccuggccgguuggauggugcccacccacacugaggcaaaucugccccacucagucuacugacucacauccuggucucuggaaacacccucacagacaaacccagaaguaauguuuuacugguuuucuagguauuccuuaauccagucaaguugauaccuaaaauuaaccaucacagauugcuuccccaugcaacaaguugaacauaauugaagacauaguagacucucuagagaaacuuaaaauuugagggcaaauaacaaaccccaaacuaccuaaaauacaaacuccucuaaugucauauuguauaugccauacauuaaauacaaaaaagauugacauucagcuuuauuuaaguuaccaagcuuaaguaagggcuaaguggauuucuuaauaagauggucucuuuuauccuuacuguuaugccauuuuuuugacuuacaaaaauguucccaaugaagcuuuugaaccccuuguauuugaaguugaaacuagugaaaacacaugaaaacucgaguagcacagaagaggugucaaaugugaaauaggacauaagcaguggaaauacugaguuuccaucuccuaggcaccuaaaaucuucugauacccacaaacagaaaaaguauguauuacauuuuaauaauccuauucucaaggucuaagugaggcauuauuagagaaggaaaagcugucuguuauguuuucacaaccauuuugacuccugagucacauauuagaguaucuuacgagauuagacaguuugauuuccuaccucuucauauauuccauuuccccacucuugcccuagucccugaaggagaacugaacacaugauuuaguaauacuauuuucuuuuuaaucaacucauauaauucuuucuacacccagccugggcaacauggcgaaaccucaucucuacaaaaaauacagaacauuaguuggguaugguggcgcaugccuguagucccugcugcucucaggaggcugaggugggaggaucaccugagccuggggaggucaagccugcagugagccgugauggugccacugcacugcagccugagcgacagagugagacccugucaucaaucuuuucuuucuuucucuuucucuguuucuuucuuccuuucuuccuuuccuuccuucuuucguuucuuucuccucccucccucccuccuucuuuucuuuuuuuuccuuccuuccugccuucuuuucuuuuuuuucuuuucuuuucucuuaacaaagcagugaguuaaaaccugacuguuggauuguagagccuucaauuagugucuaguucauucuccuagaaagacaagugcucugcuuggcuagucauucugaaaucaucuguaagccccaucuuaguuuaagaauagccaucagauaauucuucucagccuuuucuccugguuuccugacaguuccaguuacuuuuucagcuuuucuucuuuuagggcccuaaaaacccuucaugaggccuucaucuuguguuaccuuuucuuuguaauacuaaaguuuuaugacaaacaucccauucuggauucacauuuuacuguauuagucauggcauguaaaacaauucaauaauugguacccuucugauuaauuuauuauagaucucuuaauauguaauucaacuuuuaaugauucccucaguaaaggauuucuaaaacaguaaaguuuguagguauuuagauuaauugaaguuuaaagcugagaccuuuggauagacauuauggaugaggagcuuaaugugauuuauacuauguuuuguuuagcuuaucugauuuugucuauucauacauauauauauauauaaagcacaaaauuaaaaacauguaauuuuucuaauaauacaguuugauauauuaaugacugaaccuucaguauucagauuccugucucaacaauauauuguuaugucccauacgugguaaucacauagaguaauagugguagcugugauuuauauggcacuuuaaaggauauuuuuacauauauuuucucauuuuaucuucacaacaaccuugugaaagacauaggggaaguacuaauuuuuccccccauuuuacagaugaaggaacugagacacagagguugagacuugucuaaaguaacaugaccaguaagugcuugaauuaaugcagguagguagugauggguauguucuaaucugccaagggcuuuuccuugcugucaucuggcuugaguucugaggauauaaauucauauagccaaaaugguagggaaccagaaagguaaugaguagauggacuuuaggacuacacuagggaaauggugcugcuguucuuuuuaauuucuuccuuuuuguucuuuuuguuugguuucuaacuuguuaguaaugauaagcagauaccgucuuugguuguuuccguuagaugaaugaagcuuuuguuuuaauuguagauuaucccugaggaacuaaggaaauagaaaaucuggagagaagucuguugggauucucacagggaauagcuauuagaucaacuaagcaaaugaaaaaguuaauaguauauggauaaaccacauguguguaauuggaacuucuuaggauucuaagauuuuuaaaaucuuguuuaaaaacuguauuaucaccuuaauauaaaaaucuuagcgcuugagcguacuuacccaacugugguuuucuuuagaugaggaaacugagguccagagaaguugaaguuuucccaaggucacacagcagagcuggaacuagagcuugcauuuccugacuuccagauuaguguuauuuuuacuucaaacuauuacuucuugguaagcuguucuuaaaauacuuaaaaagucuuuuguauauuuaauuuauguuuuugauuaacauuccuacuuugugccaaaaugaacuuacagauacgaauuuacuauuauuuuugugaugagaauuucaauucuuuguuuaauuuuaggugaguuauugugggaaaaauccuguauauugaagaugucucuacacaguaucguuuccuguuuaaauuacagauaacuucaagaguuuucagaaaaaaagaaauugggacuuuuuugguuaaaucaugccaucugaacagaaacaguuauuuugugaugaaaaacaaacuacuuuaaaaaaagauuaugaugugaaaaaugagauaguugauaggucggcaccuaaaccaaaaauuucaggaaguauucauuaugcacuaaaaaaugugaaaauugauuugccaaaaauaaauauuccaaaugaaguccuauugaaacaugaaguugacaaauacagaaaauuauuucagaguaaacagcagacugcaagaaaaucuaucaguauaaagacuguaagcuguguagaggaguguacauugcuucauaagucugagagagcugaagaagaggguguaaaaaugucugcaaaaauacucaauuucagcuguuuaaaaugccgagacaacacucgauauagcccaaaugauuugcagaaacacuuucaaauguggcaccauggcgaauuaccuucauauccuugugaaaugugcaacuuuucagcaaaugacuuucagguauuuaaacaacacagacgaacccauagaagcacuuuaguaaaaugugacauuuguaacaaugagaguguauauacuuuacugaacuugacaaagcauuucacauccacacauuguguuaaugguaauuuucaaugugaaaaguguaaguucuccacccaggauguuggcacauuuguucagcacauucauagacauaaugaaauucauuauaagugugguaaaugucaucauguauguuuuaccaaaggagagcuucagaagcaccuucauauucauucugguacuuuucccuucacuugucaauauuguagcuauggugccaccaggagagaacaccuuguaagacauguuauaacuuugcacaaagaacauuuauaugcaaaagaaaaacuggaaaaagacaaauaugaaaaaagaauggcaaagacuucugcaggacuuaagcuaauacugaaaagauauaaaauaggugcaucaaggaagacguucuggaaacguaagaaaauuaacaguggaagugacagaaguauagaaaagaacacucaagugcuuaagaaaaugaacaaaacacagacuaaaucugaagaccagagccauguuguucaagagcauuuaagugaagaaaaggaugaaagacuacacugugagaauaaugauaaagccccugaaucagagucagagaagccaacuccucuguccacugggcaagguaauagagcugaagagggaccaaacgcuaguucagguuucaugaagacugcuguacuaggaccuacacugaaaaauguaaugaugaaaaauaauaaacuagcaguuuccccuaacuauaaugcuacguuuaugggcuucaagaugauggauggaaaacagcauauuguauuaaaauuggugccuaucaaacaaaauguauguucaccaggcucacagucaggugcugcaaaggacgguacugcuaauuugcagccccagacuuuggacacuaauggauuuuuaacaggaguaacaacugaguuaaaugacacaguuuauaugaaagcagcuacuccauuuucauguucaucuucuauacuuucagggaaagcaaguucagaaaaagaaaugacuuugauaucucaaaggaauaauaugcuucaaacaauggauuaugagaaaaguguaucuucuuugucagcaacaucagaauugguuacagcaucagugaauuugaccacaaaauuugaaacaagagauaauguugacuucuggggaaaucaucucacucagagucaccccgagguauuagguaccaccauuaaaaguccagauaaagucaacuguguugccaaaccaaaugcauacaacaguggagauaugcauaauuauugcauuaauuauggcaacugugaguuaccuguugaauccuccaaccaaggaucauuaccuuuucauaauuacucaaaagugaauaauucuaauaaacgucguagguuuucaggaacagcaguguaugaaaacccucaaagagaaucuucauccagcaaaacaguuguccaacaaccaauuagugaaucauuuuuaucacuagugaggcaggagagcucaaaaccagauagccuauuagcaucuauuagccuuuuaaaugauaaagauggaacuuuaaaagcaaaaucugaaauugaagaacaguauguuuuagaaaaaggacaaaacauugauggacaaaaccuguacaguaaugaaaaucaaaauuuagagugugcgacugaaaaaucuaaaugggaagacuuuucuaaugucgauucaccuaugaugccuagaaucacaucuguuuucucucuccagagccaacaggcaucagaauuucugccaccugaaguaaaccaauugcuucaggauguauugaaaauaaaaccugauguaaaacaagacucuaguaacacuccaaauaaaggcuugccacuucauugugaccagucauuucaaaaacacgagagagaaggcaaaauuguugaaucuucgaaagauuucaaagugcaaggcaucuucccaguuccaccuggcaguguggguauuaaugugccuacaaaugauuugaauuugaaauuuggaaaagaaaaacaagugucaucaauaccacaagaugugagagauucagagaagaugccuagaauuucagguuuuggcacauuacuuaagacucagucagaugcgauaauaacacagcagcuuguaaaagacaaacuacgagccaccacacaaaauuuagguucuuuuuauaugcagaguccacuuuuaaauucagaacaaaaaaaaacuauaauuguucagacuucaaaaggauucuuaauaccauugaacauuacuaacaagccugggcuaccaguuauuccuggaaaugcacuuccauugguuaauucacaagguaucccugcuucucuuuuuguaaacaagaaaccugggaugguuuuaacacuuaauaaugggaaacuugaagguguuuccgcugucaaaaccgagggugccccagcucguggaacugugacuaaggagccuugcaaaacaccuauuuugaagguagaaccaaacaauaauugucuuacaccuggacuuuguuccagcauuggcaguuguuugagcaugaaaaguagcucagaaaauacuuugccauuaaaaggcccuuacauuuugaaaccaacgaguucugugaaagcuguucuuauuccuaacaugcuaucugagcaacagagcacuaaguugaauaucuccgauucaguaaaacagcagaaugagauuuuuccaaaaccaccucuuuauaccuucuugccugauggcaaacaagcuguuuuuuuaaagugugugaugccaaauaaaacugagcugcuuaagcccaaauuaguccaaaauaguacuuaucaaaauauacagccaaagaaaccugaaggaacaccacaaagaauauugcugaaaauuuuuaacccuguuuuaaaugugacugcugcuaauaaucugucaguaagcaacucugcauccucauugcaaaaagacaacguaccaucuaaucagauuauaggaggagagcagaaagagccagaaucuagagaugccuuacccuucuuacuagaugacuuaaugccagcaaaugaaauugugauaacuucuacugcaacaugcccagaaucuucugaggaaccaauaugugucagugacuguucagaguccaggguauuaagguguaaaacaaauuguagaauugagaggaacuucaauagaaaaaagacuuccaaaaaaauuuuuucaaaaacaaaaacucauggaaguaaagacucugaaacugccuuuguaucuagaaacagaaacuguaaacgaaaguguagggauaguuaccaagaaccuccaagaagaaaagcaacauugcauagaaaguguaaagaaaaggcaaaaccugaagauguccgugaaacauuuggauuuagcagaccuaggcuuucaaaagauuccaucagaacuuugcggcuuuucccuuuuaguucuaaacagcuugugaaaugucuaggagaaaccaaccaguuguaguuuugaaucauccugacgcagaugcaccagaaguaguaaguguaaugaaaacuauugcuaaauuuaauggacauguacuuaagguuucauugucaaaaagaacuauaaaugcuuuacugaaaccaguuuguuauaacccuccuaaaacaacuuaugaugauuuuuccaagaggcacaaaacauuuaaaccuguuaguucugugaaagaaagauuugugcuaaaauuaacacucaaaaagacaagcaaaaacaauuaccagauugugaagacuaccucugaaaauauuuugaaggcuaaauuuaacuguugguuuugugguagaguauuugacaaucaggauacuugggcuggucaugggcagagacauuuaauggaagcuacucgggauuggaacauguuagaauaguuuaccauaauuaccaaggaaaagaaaaguaaaauuaccuuagaagaaaacaacggguucaguuaccauaaugcagacauuuucuacuucaguauaguaccugaaaucgaacauuuuaaaaguugauuguauuucuguggaagaguaaaaguuguauguaugauauuugaaaaugcuaucccugcacucaaaaguuuugaaagaaacuaaucacagcacagaaguaccuugauuuaauuuuuuaaacguguucucgggaaguuagggcuaaagaaaauuuugauaaaacaauuuucccacuuuaguucuuuagugacucuuaguagaggguaauggcugacacccccauucccucucuucuuccaccagccuuaugcaucuaaguguagcuccucuggagauggagagcucuuucaucguagaacugaaggaguuucucacauuugugaagauacuuugagagaaccuggguaaagaagucacucuauaucugcuaaauauaguuauuuugaaggauauuaggcuccuugaaaguacauuuaacucacuacaguuacaccucauacaaugcuugaagaguuuuuggcaaguaaauuuuuuuuccaguugaacucugucacuuguuagagauugggaacacucucccaaggugauuuucuuuuucuaagugacugugucaaauguugcaguagaugggcagcuucaagagaagaauuuaaacucuuugucucauugaaaguuugguuaaagaacuugaacauauuucuaaauuugauuauauucucugaugaucccuuugcacagaacuaugcuuaucucauguuuguccuccauaaacaaauggccauuuuuuucuucuugguucccaucccuuuaaaaagaguggaacauaggagcacuuccaagggaguggcuuuucuugaaaauuaaaauuguuuaccaaaacaguauuuugaagcaagaucauauuuuugucuguauucacuuuauuauuugaacauguccaaauuaggacaaagcauuucuguuagcugcuucucagugugacugacaacccaaaacauauauacagauuguuggcauuugcaaaaggaagcaucaauaguggacccagaggcagugcauaaaaccuuaggauagauuccuaagggacaugcccaacagaguuuuaaaauggauguuuucaugaugacaacagaaucauagauuuagauuuuucaccuuguaaguuuggaucaaauuuugcugguucuuuggauaauggaguucuuguguuaacaaauuacgugcuauaugauuuuuuguuacauuguuacaaguguuaaugacauuuucauuaauggaugaaaacuucagggcuucuuuucuguauauaacaaauuaagucuguacauauuuuuguaccuuuuauguaaauuuugcacagaaauuuuuggcauaaguuuauuuucuuucaguuuaguucagugcaugcacuaauaaaacugguuguuuaauuuaaaaggaauauauaagacuuuacccauguuauuuucuugguuuuuauuucagauguagauuuuguuuuugagguaaauucguucuucagggauugaacacuauuguuagcaagugccuaaaaaagaugugaaacaguuuacauaugucaacuguaacaguaggucccaaaugggcccauuccccuaauaguuuuauuuuuaaagaaagccauacauagaaugcuucaagcuaucuugcuaugcacauuauacuuguacuguuuugugcaguuugucuacuuucuuagugaaguauuuuuuguauaaaauguuacaauuguguuucuuaaauugagccuaagaauggaguuaauuggaaauauacaguauauauuaauaauguacaugguguuuaaagaaugguaagcauuguuaauuucuguaaugaacauuuucaauuaaauuuaucuuguuuguguuuacacaau

SEQ ID NO: 18824 - RNA, 892 nt, Homo sapiens
uugucauuaaucuuuucaucaucuucuuauucuucuuagcacaguuggggcauaacauauuaucuucugugccuggggaugggaaaaugcaggcagguaacaagaagagagaaaucauccuccugugagugguaggcacucaagccugaccugcaugaaacugcaggcguacucaacccuuugugucugccgagagaagucugccauggaccacacaccaccugacaccagcggcuugcaucaaaaaggccucaagagaaacaggaauggaacuugaauucacagccucaggcucaacagcucuugcagcaauucuugcccuugaugccaacauggcucccugcgcugaaguuaucacuucgacuguauucgucucuucugcucucucauucaucucauaaguuuucugaagccuugcucucuuggucacugccuuguguuuccuugaacaccgcuguaaucuggucucuugugacauuucaggcauaucuugcuguuguucaggguaagcaggccuauggacccucagauaaacuucgauuuucuugccauuaguacucaaacugaguuguuggcaccagucccgcaaagugucccaacacaccuuauuaaugggaggcaaaauggucggcaagggaagagcugguauuuugcaucuagcuuuuuguggagcuguaaauuguuaauuuguuugaaguagaugaccuugauuguauuucauagguuucuccaguuugacaucagaaguugaagaaacacuugguucuguuuguuccauauuugggucaucuuuaacuggcagcaaugucaaaaucacacuuuccucaucagcuacuucccccucaaagaaauucuucuugcugcuauccaaauuugagucugacauuuucag

SEQ ID NO: 18825 - RNA, 897 nt, Homo sapiens
uggcgucuucauuugacaauacucuuaagccaaugaaauccugugggacguuugcgaauuuuauaaagaucaauguuuuaagauuggcggggugggcugggaguggugggggggaaggugccuuccuacccuugcauuugcaucucaagccacccguacccgaggcccacccaguccaucuguucauugguagauacaccauuccgccauuccgccaguggcuggugcagagaaccaggaccaccaccuuugaaaagaccuaaaucaauacuccaaugggauccugaugucaaguauuuaacgacuuugcuuuaccuacuacaguaauuaaaauuaagucuucaaacuuaaauuuaaauuucuaaaagcaggaaugcacuguccuuaaucuuaaacaccaaaggugggagaaagaggccagaauccuaggguacuaggccuacugguauagggcgaucucuucugcuuuuuucuuuccaccccauuucuuuucccuuucuccuuucguuucccaucuucucucuucucguucucuucgaaguaacagugacaaaauuaaggugauucaauuauuccaagaggcuugcucauauaaaauauuucucuucaagcccuuuccugaaaucccaaauuaaagcauuuccaauagucucugcuuuaaguauuccuaguuaagucuacuuuuggaaauauuaaauauucucacuuuggcacaauauuccaaaauuccuugagaaguucgccuacgaucagucuugcuaguagaaaccuuuuuuuuuuuuuauuuaaaacgcucgauuuccacuuuuuacuagguuucccaauguuggcgaugucucccaaugacuuaauaacguguauccacuucaccuuugaaaaucuuagaggucagugcau

SEQ ID NO: 18826 - RNA, 5504 nt, Homo sapiens
uggaauauuucaaaagauauauauuuuaccuuauuauagguuuuguaaaguuaguuuguaauauucaggugcacuuuuaauguuaaauuuuguguucagaguuccauuauaccauguauuucucggagguggcucaucacacggcugguggcagucuuggugccgcagugauuccuuaauauuugauuucucucuugauuugccacuauucuguauuggcacuuucaguguagauauucuaguuuggggauguccucacaauguguaauagagauuggucuauuagcaugcuuaauuucugcuaaucagaguuuugcauggcccaaacaacaguugaccauuuuuaugguaugggaaaguguaguucacaacugucuuugucacgaaagccguuuuuccucacauuuuccaguaggcagauaacauuacuuaaauuauuaauauauaacacucuuggaacuauugauaggaaauaauguauuuaaaauaauuuuuugcauuuucagagaccuugauguuauaggguagauaagcuauggcacuauaaaaucaaaaacacuaauucuguggaaggauaucuaguugguauuuuuaucuuuagcuuucucauuucugagacagcauagucauccagcuugaugguaauguaguauauuacuuuguucagugggcuuauaagugacucugaauuauguuugugaugagcuauacacuuuuuuucuguuccccaaauaccaugaaggacaaggucacucuuucaggaaaaauaauuuauauuuguguauaauacuuuuuaauauuaaguuuguuguucugaaguuuagauguugcuugauaaaccuuugcugcagcagaucaugaauaugaguaaggcuuugugugauaauagggguccuuaugugaaguuaauuacuguucaguucuggugagcaagcucaacaagugugaaguguguauuagcuuuauuugguacacuuuuacuuuacaauaucgaagugcuuuuagaacucugguuaucuuauauaaaccauuaccucaaccaauuggcauuucuuuuccccaacauuuaccuuagcuauaauaugagcuaugugggaucagaugguaaaacuauaaaaggcacaaugagaaguuuaguucccaaguuuuggagagaacucuaaauuagacuaaaaacaacuaccuguuaacaccaauaucauaacuaccuucugucguuaggcaguacauagcaaccuuugagcugcuagugagcuaucuguucucccccuacccccaaguaagcacacagugccaggccugguucuaagccuuugugauucucuuacaucucauugacccauaauagugaagcauggauucauuuauuuucauaagacaaauugagucagcucgaugucagaaguugaaaauauuuugaguaguuuaacaguuauaugagagauuggcaucauuuucuuuaacagcuuuuaucuuuguagauuuccuuuugagacauguauuuuugcuuuuauaauccuuucauuaaaugccagagguuguuuucauauuaaucacucuuuucuguauauucagguugcugucauuggugauagaauauggcaauagacagaauugugcuccacuuuauguuuuuuaggagauauugaaaguuauagguuaaauuuuggccuucuugaagauaucaaagauuguuuuccuuguuaccuuuaauuagaauuuggucuucauuaaugcuuuggucaggcuagcauuacuaaaaacuugauggcuucagcagaacagcccguuuaggagacuauuaagcuaucuagggauuuuuuuucaaauuaauugcuuucaaaaucugaaaaggaaaaaaguauaauugugguacaaagaagacagaucuccaggcucuuucuucucaguuuauuuugguuuaauucuguacuggagacuugaauaggauuugugaacauggugauggaaagaaaaauagaggacauuauuuguguacccucauuccugaauaaucuugcagucaccuuuuaaagaagcagacauuagcccuguaacacaacacuguagcuauaaacucuaaguguuaggaaggagauugggguggggaggguggaguaggauggaaaaagcauguagacuucugagaagaggcuaaaaauucugcccuauaauacuaaaaaugagucacaagauaauguggugaaguuaggccaucuugauuugauagaaaaaucuuuuacauuguuuaaaaaugagaaucgaggcuaauuaauguugauuugacaauagaacaugagcuaauucugcaaccguuugggggguaauuuuaugguuuccaguucauuuagagcuguaucaagaaaagcuaaaaagcaagcacuuuuaguuaaucauagauuuauuggauauagcaaauauuauuauaauauuuaaucucuauuauuugaauguggaaaugaacucuuuuaccccaucuugaacugucauugaacaugcucaagaugaucaacacuggaaaugacccuacacacauaccaaaaaaaucuaaagcaguaagacauauuugaagauccauaccucuuaaacuuuuuagauuugucuugggaaagaauuuaugaaccuguaaccaguauuagugcagucuuggguuccuuguucugcauaauugcacccuuucucagguauguccugacaacauaaauuuuaaaauaaucucauuagagauuagauucucaguggauaguguguaaggggacuaggggugggggguuggggguaguuggacacaggacacugacacaguagagcagggauuuuuaacagucaauagccaaauagaauuucaaucuagaauauuuuuacccccucagaaugagugaaacaacuucuauuauuugguguacccggugcuacacuccuaaaagucuuuuuuuuuuuucauccaggugacguuuuuuauuuuuccugcuuggugguggaagguuauauaguaaacuucacugucauuaagaaagcgcuuguccaaaauguuuaaaguacuagaaaagggauaauucagcacuuuuucuguuacaacacuaaagucuuaauuuaucuucagagucuuagguacuguaaguuuuuggaugauuauuuaaaaauauaaaacauacuacauaauauggggucagaucacauuuauauaaauaauucuuauuuuaaaaaagacaauaacauuuuguaccuuucuagcaauuccaagugauugccucauuuucucuuguuaagcauuucaagcuuaagaauuuggaauuugagagaaggugagggggaaaauucccuaaaauaaaaauuuguuucaaaccauuuuagaaaaauaaaucacuaggaaaauagguagggauucucucccccuuuaagucuucagggaaugagcaguauuuagaaucuuuggcugaaauucaagccuuuuuacuuuguaaauuuuuaauauuaauucacugacaugcuuuuuacaccagaggacugaaaauggaucuuaauguuuuuaaguuguggaaggguauauuucuaaaaugaggggggaugauuaacuagguuaguauuaccagcauuaguaaguuuaaggaauuuuaguauguaauagcaaaguguuugauuaaaagucuaauccuauauuacuagucaaaauuaguuacauucugaucuaggaaagauaauagucauuggauauugauaugcugugcugucagaaaaccagacuaagauagaaaccuuuaucugacucccacauguugcuuguugugaugggauguauacuuuacagcagcuuauugcugcuuugaaaaaaaauguauaaacuauacauuuggaguguuugcauauaauucuuuauaaccuccacuuaaagcugucagacauugguauuuuaucaguccacauuguugaauaaaacuaauguucuuaggaauccagcuuguacacacuguuuaaaaacccucagggacaguuuacacacucuucucacucaauucagguacuuugaugcuauucuuaaaccuaacagugacuuguauuuuucuguuuugcuuuuauuucaacgugcugguagcacaucugaugaaugucaacuuaaaaaacucaguucagguauccagguauaacucagccaaacagauuuuaaagcugcauauaacucuccagcacauggugccucacacucuuauaguggcauucuauauauucaguuauuacuacugagcagauaauauggggguuccuguuaacaguguauuuuuuaaaaaaagcgcauaaauguauagccagcacacuacacacacacacacaaacaugcacaguuaaacuauauauuuuuaaaugccacuaauagccagcacaacuaaaacaaaagacauuccuaacugcucuguaagcuguuaacagaugcaguuccuucuugauguggcucuugcuucuucacgauaacuacuacuaaauucaagcacugguccuugggugucugaccucuacauucuaguuuaugcaaugucuuuagagaauuuugugcacuggccacugugauggaaccauugggccaggagugcuuugaguuuaucaguagugauucugccaaaguugguguuguaacaugaguauguaaaaugucaaaaaaauuagcagaggucuaggucugcauaucagcagacaguuuuguccguguauuuuguagccuugaaguucucagugacaaguuuuuucugaugcgaaguucuaauuccaguguuuuaguccuuugcaucuuuaauguuaagacuugccucuuuaaaauugcuuuuguuuucugcaguacuaucugugguuaacaaaauagauuauuucucugcuuuaauauuugauaucuuacaucuaaaauaaauucucuccacauauaaaacccauagccuuuggagauauggaaaaugguaucuuucagauuucuagaaguucaagugucauacaacaaaacaggaacccccuuuacucuuauggaccucauuucaauauacuguuuacaguuugauggaauuguauaauuuaauauuucucuuguacuguaguuuauauuuauuuacagauuuuuuuguacugugugauuugaacuuuuuguuccuugcuaugaucaauguuuauguaguagagcacuuaugaucacaaauuaaguuuuuugguuugauugcacuacauuaaauuuuuuaaugcaguucugauuuuugacuggacuaaaacugugucuuaauguaugugaugaguacuuaaaauuuuaauccaugugguccccccccuuuuuuuuuuuuuugcauuguaugucaaaagcgcuuguucuuucgugcauguguaagauuuaaugguuccauuguauuauuugaccaugacauuuuggagaaacauucccagcuguaauguuguguaugguaguucucacuggaugcuagaguuuucaaaaccacuauucuucuaauaaauuuuguugugaaaaacuguuu

SEQ ID NO: 18827 - RNA, 11466 nt, Homo sapiens
cuuaaaggagaagaagugaguaaacuaggggacacaauuucagauuauugucuggcaaaaaauauaacuuguuaugccuugaagagggggugaggaagcauuuuuguuuuauuuaaagagucaagccauaguaauuuacaacccuugacuauagucagcucucuaaagcuugcuuuccccuucuguuuuccugggacucccuguuucugcuauuaagauuagcuccuauccaaacaucauucucuguggcuauugaucuuuuuucagucaagaagaauguauuuuggucaucagugauauugccuuugcucaucaagcaguuauugguaguuagagaguaaauaccuaaauucaucacuccuaaauucuagacucucagacuugucacuucaccuccaugccaaaucucuucuccacuugaucuuuaacucuaagauaacauaagcauugcccacccaccaguauuaaccacaggaaugcuuuccaucagaaauuaaauguuguguuauugacuugguaggcaaguuaagcugugucuaaccuaugauguagauaaauauugaguaaaucauuaaagaugggguuaugaaacaacaaucauucuuaaacuguagcuuuuaaaggguuuaugaauauuaucuuauccuuuuaccacacccuuaacaauugggcauggaacugaagauaggaagacaguggucaaggucaugcacaccguuucucaccaaggagauaaacugaaaacuaauuuaaguauuggaaauccaguuuuuucuuuuccuuuaugagaagugggaguacuuccucccauuaaccaaucccuaggaucuuacugugcuuuaguggugguuuucagguauuucugauuaacgaauaauucacuugacuauuacagaguccucuugaugagcagaagcagcaugaacuagcaugagcucaagucauuucaacaucuguuaugaauuacuguucuuauaaagaccuuauuuagucagaugugaaggacaucguaugauacagacuauaaucugcaccgaacuaaaacagugcuuccuggaccuuaggccaaguugaggaaaugguuugcagaacagaaaauugccucucucugguuucccuacuagcugcccaacaauauucuaaguuaaugcaagugcuauauuuaggguuuguuacaaaucuaaggucucggaaaaauugaauaacuagaagcaaaaguaaagacaagcuguuuaaaacaggaaaaacuggcuaacaccuauuuuuuaacauaaaaaaauaguaauagaauuaaauaucaggaaguugagauucauuuuuaaaauauucaaaugauaaagugaaauucaucuaaauuuaggugcuauuggccgggugcuguggcucacaccuguaaucccagcacuuugggaagccgaggcugguggaucaccugaggucaggcgcuuaagaccagccuggccaacaggguguaaaaccccaucgcuaguaaaaauacaaaaauuagcugggugugguggcacaugccuguaaucccagguacuuggggggcugaggcccaagaauugcuugaacccgggagguggcgguugccgugagccaagauugugucacugcacuccagccugggcgacagagggagacucuaucucaaaauaaaauaauaaaauaaauacuuaugugcuauuaagaaaaauuccagaaaaaaaaguaggaagcuggauaacuuugaggcacagccaaaacugauuuuauugcuauauuguaaaguuagcuguuauaacagggccuuuuaaugacaccuggacaaagguuaguauucaugugaaggccucucagaucgaagggaagcuguuggugggcucaucaugccuaugugucuaguugccuaccagacaucucagguucagaaucauguaaauaucuuaauauguauaguacagagcucuucagaaacauacacagccuaacaaccaccagccacuaucuuuguuaccuuuauuccuaucucaguaaauggugcugcccaggaagaaaacucaggaagcauccuagaugucccuuuucccucuccucuuuuuugcuaagagaaaacaggaaaacaugaaacauggucccugcacucaaguagcuuacaucugcuugggaagcuaagacaaaaacaaggcaaagucaauacaagauaaaaauuauaggauaaauauacaagacucuggccaggagugguggcccacaccuguaaucccagcacuuugggaggcugaggcagguggaucaccugaggucaggaguucgagaccagccugaccaacauggcaaaacccugucucuacuaaaaauacaaaagcuagccggacgugguggugggcgccuguaaucccagcuacuugggaggcugagccaggaggguugcuugaacccgggagguggagguugcagugagccaagaucacgccauugcacuccagccuaggcaacaacagcgaaacacacaagaccccguguaauugaguuuuaccaagcacaguggcuuaggauuuucaggaaagaaugcaaucaaaccaggugggguaguuuugagcuggccagugacaggcugacaagaauacccugguaccugcucuuacacguugucccugauccuuuuuaugaggaaaacauacaaaugaucuuuuuuguugaugccauuuucucuggagguugccauuugcaguucuguggaaagaaacguuuauuuucuuuucauucuccugagcuuccacaaacuacugcucuaagugucccuuaagguugguguagccugugucagucucucugaugcuacuguuuuuuaguauccacaugcuguauuacauuguuccagguuagaguucaguggauccugaacauguuucuuuagcaugccuuagugguggcauggaagacaccaccgccucuugccaugagguugugaaauacauuccuaccuaccuguggcugucuaauggggacuagcuugagccauauggccaugguuguugcuucagggcuggcugcauggcccuuuggaagaccuuacauuaguuaaggguaaugaagauauuggggugcuauuaaguuauugaaacaugggacagcagcagauuagagucucacaaucaugaaggaaguuagauaauaccugugaacuaaauuauuacucauuuauucugugugagcaucacuuuagaggaaagugcuucuucagcuuucuucauagcacucugucuucuuacugcaugcauaccuugaugucauucaaccccaggcaucucauuaauuccaagcacuaaagcuugcuuccagaacccagcuauaggcaugaagcgguaccuagaaaauuuuugcgaagaguuagguaaugauugugcuucuugaauuaggaagaaccguuuaucucuucaguuuuucuacaauuagaugccauaauauuucuucacccucuucacugaccuuugucauccuuuuuuguguauugccaaaacgcacuuggaguauguucuuugaugcauugaaaaggcacccacuuauuuauagucaccuaccuuggaaacaucaggaacauaucaggaacuaaggaauaaaggcuuuugagcaacagaaguugugguuagaaaauucauguacuuaccccuaaaacuauuccucaagcuuucauucagagccuauuuauuuuuacuuaaaguaccauuuuggcacuugggauauggcuucucagcuagugaguaaaauucucuacuaaagguagaaguaggacugcuaagaucagccacuguuuggaagccaguaagaaagaagauuuaauacaauacaggccaccacuguaguuuuuaggaagucagacuuaguuaauugaguugccccucaaacuauuaaucuaauucagucuaguauaauaaaaauaauagccagacuucaguaauaguccauaugguaaugaucccaaguaucaggaagaauaaauuauguuccaagauaauauaauuuuuuaagacuuccaucaaaaaaaauuugaaucuuuaaauauuugcuuuaaaauguuugguacuugaagguuaaacuuuauccagaaaauguaccccuuuuagguuauaagaaagcauuaaugcauguucuugaucuccaaguuuguuuguuuguuuguuuguuuuuugauguggggucucacucugucacccaggcuguaguacaguggcaugaucauagcucccugcagccucgacccccuuggcucaagcgauccuccuaccuuaagucucccagguagcugggacugcaggcucauguuagcaagcacagcuagcccagugauuuuuuacugaagcacuuuuaauuugauucacugacaguagugguagcugauauuuguauaaacuuuguagguuuuuccuuggagaauuuccaagugguagauggggcagguacucuacuaagacccaaagugguuaaauguuuuggacaaggucacauaacuaguaagcagcaggacuacuuacugauucuccaucuccacucucguacuguagccuguaacacauauugugcuguugcuuucaucugguagacauagugacaaaguucuuccuaaaggggucugggguccuucagcaggggccuccuccugccuguuccaugagcagaaaagucugcagcugcaugaggauucuguugagcuccuuuguacaucucauugagucggaaaguuggaaauguccuaacaaucacucauccaagggugucacugaugucuugccuguuccaaaggaagaagauaauauuugccauucuugcaaagcaggaggagcuuauuccauaugcugccuuuuuaaaacuuuuacuaaguccacuuuacagauagaaaaguacucaauagguuuuuucuagcugcuuucgucuuuucuuuccuuugguacauuuuguccccaucgccaguauguacuucagaguucaccguacuuguguaccuuuuguaauacuucuauaauaauauuuuuuccuagaguauucacaauucagguaucauuggaaaguaugagguaggcauuuucuaugacauuucuagucuuucaaauccauggucuaauauaggcccuuucagaaacccauggcacuaccgacuaaaacugcuuucuugcuaguugugaaaacaaaaacacaguguaaccuuuucucugguaaagcaguuuagguuaagcaacagauuugacuaauuucuugguuuuguauuuagacauguucagcaaccuuuucacuacuugaucuuaaaaaucucccuaagcccugaacagaaacugaaauugucugagcaccugcccuuuugugcuuugugcuuuauguuuuauguauguuaucuaauaucucacaacaauccuuugagauacugacauucagucccaacuuacagaugaggaaaccaagguucagagagaugacguaacuugccuaagauccuguagauaguaaaugucagagccaaagguggaaucucggaucuccauauuccacagccuaugcucuuuuccacugugaccccacugcucagaagccaguggagggugggaagguaggaggugauguggguugucuagggucagccuuccuguaaaagugccucaugacugagacagaaaaaucaaagacugaagaaaagaauuagccagaagauauuaucaaacaucuguucacacauuuaaagcugccucugugugcugcuguauuucauggcaagucacauaauagucuccugaggaauuauaauccauacagagagagagggaguuuaaaaaauuauauaaaacuccaggaaauuggagcacaccgacugcauggguucaguacaacccagacauccagaagcacaaagcagcuagugaaaggccuggcugucuaagcagguauugccuguggcaugucuugagucuagcaucacccuuucacacaguccccacugucugcgcuaagcucuaaggauuuguccugggugacuuacuuaaaugguggaaagggguuuuuaacauagaaugauuucuugugguugauuguaaaagguguauugaagaucucggagaauguagcaagugggccuugaauaaagauacaauacuacuaccuugcagugacaggccuguacaguuuaguguggcuucauagcuaucuccucacuuaagagacugcgaauugggacuugcuugucaucucaccauuuaaaguaggugaaguuauugauuucuauuccuuuauacucccaggaaaggguagcaggauuccugcauuagcaugaccaauuggucaugcugagaaacuaucuuaaaacuguuaaguucucagccgagugcggcggcucacgccuguaauccuagcacuuugggagguugaggcaggcgaauugccugagcucaggaguucgagaccagccugggcaacauggugaaaccccgucucuacuaaaauacaaaaaauuagccaggcguggcggcgugcgccuguaguuccagcuacuugggaggcugagguaggagaauugcuugaacccaggaggcagagguugcagugagccaagcucgcaccacugcauuccagccugggcgacagagcaagacugucuccauuaaaaaacaaaacaaaacaaaaaaaaaaaacuguaaguucuguuaaguacuucuaaacccaagauuuguacuguagugcaccucaauucuugucaguguuguggacuuauaaacccacgauuauuuaacaggaauacccagaccuaaaauaaaguauauguugaccaaccagaguuaauaguguggucaaaauuuuagcuuuuuugaaaaaaauguauuugcaguauuucuucucuuuaagauaaaaaugauuuuugaaugauuacuuuuaacguaugaagaauaucgucacuaaaauuugaggcuauaacaggcugaccuuauaauuagguaaauaauucacauuuauugaaucaaaaguauaugagcagacuuagaagcaguuuucgccaaaguacccacccucuuuauaauacagauagccaggcaagguggcuuacaccuguaaucccagcacuuugggaggcugaggcaggaggaucucuuuaggccaggaguucgagaucagccuggccaacauagcgagacccuguaucuacaaaaaauaaauaaauaauaaaaugaauaacguugggugaauuuuauaauguaaaaaugguucuuugguaaaugacaauacuaauuccuucuuucucuuucucugucuagugagaacucaacagaggcaaaagcaguagauucuaacaaucagucgaaguccccacuggagaaauuuauggucaaacuguguacucaucaucaaaagcaauucauucguguucugaacgaccuguacacugaaucucaaccaggcacugaggaccugcagccuucugauucgggagcaauggauguauccacuugcaaugcuggcugugcccagcucagcaccaaacauaaggaaaaagaugcucugugucucgauaugaagucuucugcuucuguagauuuguucguagacucgucagacucucacagcccucuacacuugacggaacagaccccgaagaagccuccuccugagauaaacccuguagauggaagagagaaugccuugacuguuguccagaaagauuccucugaacuuccaaccacuaaaucgaauucuauuaauagcaguucaguggauaguuucacuccgggauaccucacugcaucuaauuguuccucagugaacuuccaccacaucccuaaaaucuuggaggggcagaccacuggacaagagcaagacacaaaugugaacauaugugaggaugguaaagaccauaugcagaguucagcuuuaguagaaagucuaauuacaguaaaaauggcagcugagaauagugaggaaggcaauaccuguauuauuccucaaagaaauuuguucaaagcuuuaucagaagaggcuuggaacucaggguuuauggggaacucaucuagaacugcugacaaagagaauacuuuacaguguccaaaaacaccuuugcgccaggauuuagaggcaaaugaacaagaugcaaggccaaagcaagagaaccaucuucacucucugggaagaaauaagguggguuaccauuuacaucccagugauaagggccaguuugaucauuccaaagaugguugguuaggccccggcccuaugccagcuguacacaaagcggcaaauggacacucaagaaccaagaugauaucaaccuccaucaagacagcucggaaaaguaaaagggcaucagggcugaggauaaaugauuaugauaaccagugugauguuguuuauaucagucaaccaauaacagaaugccacuuugagaaucaaaaaucaauauuaucuucucggaaaacagccagaaagaguacucgaggauacuuuuucaauggugacuguugugagcugccaacuguucguacacuggccagaaauuuacacucccaggaaaaagcaagcugcucagcauuggcaucagaggcaguuuucacuccuaagcagacccuuacaauuccagccccuagacauacaguagaugugcagcuucccagagaagacaacccugaagaaccuagcaaggaaaucaccucucacgaggaaggagguggagacguuucaccucgaaaagaaccucaagagccugagguuugccccacaaagauuaagccgaaccugagcagcuccccuaggucagaggaaacgacagccuccagccugguguggccucucccugcucaccuuccugaagaggaccugccagaagguggcuccacagucucagcucccacagcaagugggaugucuucuccugaacacaaccaaccaccaguugcacuguuggauacggaggagaugaguguaccccaggacugucaccuccuucccuccacugaaagcuuuuccgggggagucagugaagaugucauuucuaggccucauucuccuccugaaauagucaguagagaagaaaguccucagugcucagaaaaucagaguuccccaaugggcuuggagccccccaugagucugggaaaggcugaggacaaccaaagcaucagugcugagguugagucuggagacacccaggagcuaaaugucgacccacucuugaaggaaagcagcacuuuuacugaugaaaaccccagugaaacugaggaaagugaggcagcaggugguauaggaaaauuagagggagaggacggugauguaaaaugccugucagaaaaagacacguaugauacaagcauugacucacucgaagagaauuuggacaagaagaaaaaagguaaaaaauucccugaggccucugauaggugccuaagaagucaacuuucggauucuuccucugcugacagaugccuaagaaaucagaguucagauucuuccucagcuugucuugaaaucaaaguuccuaaaaauccuagugcaaaacguucaaaaaaagaagggcacccuggugggacaacaccuaagggccuucuaccugacaguuuccacacggaaacucuggaggacacagaaaagccaagugucaaugaacgccccucugagaaagaugcugagcaggagggcgaaggcggggggaucaucaccaggcagacuuugaaaaacaugcuggacaaagaagucaaggaguuacgaggagagauuuuccccagcagggaccccauaaccacagcuggacagccacugccuggagagagauuggaaaucuauguucagucuaaaauggaugagaagaaugcucauauccccucagaaaguauugcuuguaagagggacccagaacaggcaaaagaagagccagggcauauucccacacagcauguggaggaggcugugaaugagguagacaacgaaaacacccagcagaaagaugaugagagugaugccccaugcagcucucuuggguugucgaguaguggaaguggugaugcugcuagggcaccaaaaucggugccaaggccuaaaagauugaccucuucaaccuacaaccuaagacacgcucauucucugggcuccuuggaugcuucaaaagugacuucagaaaaggaagcugcacaaguaaaccccauaaugccaaaggaaaauggagcuucagagaguggagacccccuagaugaggacgauguugacaccgugguagaugaacagccaaaguuuauggaauggugugcugaggaggagaaccaagagcucaucgccaacuucaaugcccaguacaugaaaguucagaagggcuggauccaguuggagaaagaaggacagccaacaccaagagcaaggaacaaaucagauaaacugaaagagauuuggaaaagcaagaaaaggucacggaaauguaggaguucauuggagagucagaaguguucuccuguucagaugcucuuuaugacaaacuuuaaauuaucuaauguuuguaaaugguucuuagagacaacugaaacccggucucuagucauugugaagaagcucaauacucgccuuccaggagacguucccccugucaagcauccucuucagaaauacgcuccuuccagccuauaucccaguucacuacaggcugagcgcuugaaaaagcacuugaagaaauuuccuggagcuaccccugcuaagaauaauuggaaaaugcagaagcucugggccaaauuucgagagaauccugaucaaguggagccagaagauggcagugaugucagccccggcccuaauucugaagacagcauagaggaagucaaggaagauagaaacagucauccuccagcaaaccugcccacuccagccaguacccggauucuuagaaaauauuccaauauucgaggaaagcucagagcccagcaacguuuaaucaagaaugagaaaauggaaugcccagaugcucuggcuguggaaaguaagccaagucguaagagcguaugcaucaacccucugaugucccccaagcuugcccugcaaguggaugcagauggguuuccuguuaagcccaagaguacugaaggaaugaagggaaggaaggggaagcaggugucugaaaucuugccuaaagcagaaguucagaguaaacgcaagagaacagaaggcagcagcccuccagauaguaagaacaaggggccuacggugaaagccagcaaagaaaagcaugcugauggagccaccaaaaccccugcugccaagaggccagcugcaagggacagaagcagccaaccccccaaaaagacgucuuugaaagagaauaaagugaagaucccuaaaaaguccgcugggaagagcugcccucccuccaggaaagaaaaagagaauacaaacaaaaggccuucccagucuauugccucggaaacacugacgaaaccugcaaaacagaagggggccggugaauccucuucaaggccucag

SEQ ID NO: 18828 - RNA, 2264 nt, Homo sapiens
guuuacaaaucaacccgagccggcaggauuccggcuccagcggcugcaggcgcguggcucgagugccuggcgggcuccggcuuccgcguccgccccugcuccggcuucgcccgcagcuccgcgcccgcgggcaaccaagcccccagcgaagcccgcacagcuccgggugccaggacggggggccaugccgugccggagggaggaggaagaggaagccggcgaggaggcggagggggaggaagaggaggacgacagcuuccuccugcugcagcagucggugacgcugggcagcucgggcgagguggaccggcugguggcccagaucggcgagacgcugcagcuggacgcggcgcaggacagcccggccucgccgugcgcgcccccgggggugccgcugcgggccccggggccccuggcugcggcggugccggcggacaaggcccggcccccggcggugccgcugcugcugccgcccgcuucggcugagacggugggcccggcgcccucuggggcccugcgcugcgcccuaggggaccgcggccgcgugcgcggacgcgcugcgcccuacugcguggcggaggucgccgcaggccccagcgcgcugccggggccgugccggcgaggauggcucagggacgcggucaccucccgccgcuugcagcagcgccgauggacccaagccggggcacgcgccggcgacgacgacccgcaucggcuccuccagcagcucgugcucucgggaaaccucaucaaggaagccgugcggagacuccaacgagccgucgccgcgguugcagccacgggccccgcaagcgccccugggcccgggggaggccgcagcggaccugaccgcauugcccugcagcccucaggcuccuugcucugacgcaggccuccuggaggaggaaguggaggccgcugcguagacccaacagcguccaguuccuacuaacucugagcugaagccgacgucgccagccugggagcgaccacuuuggcugcggggaggcgcguggggagagaucucaaccagagaaguuaccagccgcggcgaggccgucggagaaaacuuaagcguggagaaauguaugcgccagggugcuuccguggggcaugagaauuucccgggccauccaagcccaaggaccugggauaaacugggagaacuauggcagcuacuugcaucgacuuguaccucacuuagcccuugggggcgucgugagcuuggauuguuuaaggagggcucagggguaggaaucgcgauggcuuuauaacaauacuugaaaacuaacgacacgcauacauuuucuuauuuucugguggaggagcuuaguaaguggugcuacaauugcugugcaaagaaauuccagaggggagaagaauguaaaaguuuggugguggguggcuuggcauugccccuuuuucccaccgauucgguggcuggugaaggugggagaugugaacuccaauuaagggacuggagagaggugaagaauuuugcaggugggagauuuggauuugaauguggacuuguaaaugacuugaccuugccaucuguguucaaggucacgguuugcugugggguuccugggagagcuuacucaccccggagucuuuucuuucucuugcuccaagaagagcccuguuggugcuuuaccaccgcuuggagucucccgaggacacaaacaggcagagagggacguguagggagaguucuuuccuguuuucugugcuuuccuuuuuacaggacucccggaaggccacucauggccaugccaggagcuuucucagaaacagucauaaacgaucucuugagucucuuucuuguccucccagcugagcuuucuuauuccacccuuucuggugucuauaggaaugcaugagagacccuggacguuuuucugcucucuucuggcccuccauggagucaugggccucggccucggcggcuccucacccucacaauuuauuuccuccucccgugccagcccuucuuuugugucugaaaccgguuuuaaaaugugacucucccagagaagaagccgcuggcuguaugaaacuugacggcgcuuuuguaaggugccacccccaaacuuuaagguagcuaaaccaauuuuuaaaagauucaauggcuuguucauccuccagauguagcuauugauguacacuucgcaacggagugucugaaauuguggugguccugauuuauaggauuucauaauuaaaaugucugcugaauaaauuuggcuuuuguuuuggagcac

SEQ ID NO: 18829 - RNA, 22886 nt, Homo sapiens
agguauaggcaguucuggugauuucuuuauucuuuauaaacaccuuuuucuacaguacaauucagagaauaaauagaggcacacggcuauaacuuccaccacaaucugcuguugaagagacauucaaugugaggcuagggagcuagaggugggggacguauuuggguaccaggguaacgggaggccuacguaauaaacugcagagaucccaucaguaaggucugauugcggccugacggucaaggcucaugauagaagagcuacagugagccaaaugcuccuuuaguuccccacaguccuagaguagguccaauucuaccaaaaccccagggguucgggugagucugauuuauugguccacugggaagaaacugugucagcccaagccauccguaugaauucaguucacuccaugguagugccugaaguggccuaaauauucuacccuuuucccuggaguuagucacaaauacaaguaauaagauuacuguuuacaugaguuuuuuucuugauugucccaaaaagggauccuguuccccaucuaaggaaggagagaggcacacauggggauuaucugcucuaaguugaugaaagaagacagccugucuucuaaagggaggaggaaauagcacucuuaccgaauccuucacggggacauaggcaggaaugaauaccagucugaucagaccaaguggaagccugcagccaugauuccaaccagcaugaggaguaacauauggaaaagcucugccagccaggcacaguggcucacaccugcaauccuagcacuuuggcaggcccaggcaggaggaucacuugagcccaggauuuugagaugagccugagccacauagcaagacccuggcucaauuuuuuauaauaauaaaauuaaaggcugagcgugguggcucacgccuguaaucccagcacuuugggagaccaaggcggguggaucacgaggucaggaguuugagaccagccuggccaauauggugaaaccccgucucuacuaaaaaaaaauacaaaaauuagcugggugugguggcgcgcuccuguagucccagcuacucaggaagcugaggcaggggaauugcuugaaccugggaggcagaaguugcagugagcugagaucaugccacugcacucuagccugggcgagaguaaaacuccaucucaaaaauaaaaaauaaaauaauaauaauaauaauaaaaaaauuaaaaaagaaaagcucuggccuugacuuucacagggcugcuguacugagccaccccuaucuuuucccuauuucuccagaguggcacagagcacuggcccuaagcuggggcuaggaucaccuguccccaaagcagcagaacgaagguucuguaucacuuggcagaaaaugaagcagaagggucacagcaggcuacacuggguaaccugaggucuuaggaacagaguaucaaccagugagaagagguggcuccucuguccuccagcacauaaggguuagggaaagacagaaccaccaaugacugcugcagggucugcuggccagcauccucagcacuuuucugugguccaguucuggaauggcaggugacagggcacauacaaggccucugcuccacugucauugucaacucaucucagcucugauucauuuguucaccucgaaucaacaacaggggcacuggcuuuacccaauacuuaucagcuggugcccacugcgcugucaggcagugagauuucuggcugacuuggaggcgcucugggcccgcugaacaauggcagaacacuucucacgucgcagcagcuuguuguucucaaagagaccuucauugcgggggauuccaugagaaccaucagggaaagucagcaggccuuugaggagggcagagaaaauaugggagugacaauggcauuaaugucucaaagaugagacauaucuuuggccuugauauguccaggccaaagaagagaaaaacucccagcucuacucaggaguacucuauugaugaguucaauggauaggugucagggacggccacuauggauugcuggacacccgcaggauuaaaacuaaacagguauauuuccacccauauuaugcccaccuaagucagccauccugcugggcugcaacuuaccaaaaccaucuacucugccauuuuuaaauucccccucaaaggucauguugucauaucgaaugaagacuccgacgccauuaaacuugcccugggcaaacucccccucauaccugcagaaacaccaagaaguuagccuucaguggaaaguuagcuguccagaugaacggagucgagcagcugcugaucucuguuauuuaaugaugcuaaggagcaagccgauucuaccagucacauagcuccaccuaccccaccuauucccaaggagcagagaguauauaugacaugaagcccugaucucaaggaaagaagauaggaugugaaugggagugggguggaaagucacucacuugguugacauuucaaauuuuagguccacuuaaaaaauagcuaauaaaagaacuacuuauuacucaucuguguucugcagggagugagacaaggucaggauugaccagauauuuaccagagucccauuuuucugucagacccucccuuauuuaaggcuaagaaaggaaugaccucauacccaccuugaaccaucugagaaggucaauaccccaaagccauuaaagagcccauucucaaaaugacccagguaggugccaccaucugcaaacaucaguugaccaaaaccaugccugcggccugaacaaagagaaggauaggugucagguuggaaggaggcagcuucagggucccuucuuacucuuguagcaucccuuaccugccaucacccuacccacaaagaaaacaagagaagcagugacauuagcagggcagaggauuauuagccagagucaggcacugggaaaaccuggcuccuggggccuucccaucuuaucacuacagauuaaagcaggucuacccaaguaugaauaagagagcacuuaaaaauaacaacagcugaccaggcgcgguagcuuacaccuguaaucccagcauuuugggaggcugaggguggaucacgaggucaagagaucgagaccagccuggccaacauggugaaaccccaucucuacuaaaaauacaaaaauuagcuggguguaguggcgccugccuguggucccagcuacucgggaggcugaggcaggagaaucacuugaacccgggaggcagagguuucagugagcugagaucgcgccacugcacuccagccugucgacagagugagacuccgucucaaaaaacaaacaaacaaacaaaaaaacaacuggcugggcgcagugacucacgccuguaaucccagcacuuugggaggccgaggaggcgggcagaucaccugaggucaagaguucaagaucagccuggcuaacauggugaaaccccguuucuacuaaaacuacaaaaaauuagccgggcauggugguggcgcgcuccuguaacccagcuacucaggaggcugaggcaggagaaucgcuugaaccugggagguggagguugcagugggccgagaucaugccauugcacuccagcucgggcaacaagagcaaaacuccaucucaaaauaaauaaauaaauaaauaaauaacaauugcuaacauguguauuuauagugccuuuacuaugugccagccucucuucuuuuuuuuuuuuuuuuuuuuuuuugagacagagucucacucugucgcccaggcuggagcacaguggugcgaucuuggcucacuguaaccuccgccuccugguuuuaaaugauucuccucccucagccuccccaguagcugggauuacaaaguguugggauuacaggcaugagccacugugccugcccuaaauucuugagccuugagagaaauuguacaggugugaugugaccuuggcuccuccaaucccaggcauuucuuccuggcuuucaaauaccugguguccccuuuaaugcggacuguuagaggagagacuuccugaggcucugcugggugggcuguauccaccacaagaacucccuugaauucuguuugaaaggcaugauuacuccugcaacaucuugcucuguuuucuggucaguucagagaguaagcacagcccuguuguuauaaugaagcugaaaccagugcugcuaaucaggcuguuagauuugcccaguagcuuuaaggugcuaaauggauacugguuguuuuuuuuuuuuuuuuuccucagagaggcaauguaguuagauuuugaggacaccgagucaggcugccugcuguguuugccuucuuguucuaccacuuagaguucugugaucuugaguaaguuacuuagcuucuccuugccucaauuuccccaucuguuaaaugggaauaauaauaguaugugccuaccucauaagguugucaugaggauuaaauaagaugauaaauacaaaaugcuuagaagagaggcuggcaugggccgggcaugguggcugaugccuguaaucccagcacuuggggaggccgaggugggcagaucaccugaggucaggaguucgagaccagccuggccaacauggugaaaccccgucucuacuaaaaauacaaaaauuagccagaugugguggcaggcgccuguaaucccagcuacuugggaggcugaggcacgagaaucgcuugaacccagggggcagagguugcagugagcugagauugcaccacugcacuccagccuaggcaacauagugagcgagaccucaucucaaaaaacaaaacaaaacaaaacaaaaacagaagcaaaaaaaagaaagauauaacucauuccuggagguugaauuaacaauagcauuuucaaauuccuuuauuuaauccuaaaauggaauaaaggaauggcaggcacuauauggaauuaaauccuggaguugaaaaugaagauccauaaaguuggcuauauauccugauguauuuguccuccagcaaaugaaguguucaucauggauacuccccagggguccuucucacccuccuuccacucgccacgauauuccuccccacuggaguaggugaaggaaccuuuugucagggucauggugacagauuacaggauaaaaggaugaaacuguaggaaauaagcaaaggagaaccagugucauggaauggcgggaggaaaggacugcaaggcaauuuuauagauacauucuaaaggccaccagccugguaaguguacacugccuuaggugcauuuaaccaaaauaccccuaucuccaaccaccaccagcaccaucaucuccaccucugcccaagugcucuuauccuccugcuuaucuuaaaaguuuucagccaguuccuauuuucuaugaccugggauggaaaucuacaaauauuaaucuacaaauauuuauuugauaccuacuaugugcucagucgauguauaaaauacaguaucuucccuugacgaguuuauaaucuaguuaauaagacuaacaauuuaaacacugaauuaugccagagauaaugugauuaagugccaacuuggauggcagagauuaacaaagacaugagauggccagaauuuaaaacaagcagacaagcaguggagaaggcaaagagcaauuccagaaucagaaaacauagggaacaggccaggggcaguggcucacgccuguaaucccaacacuuugggaggccgaggugggugggaugaccugaggucaguuguuugagaccagccuggccaacauggugagaccccgucucuacuaaaaauacaaaaauuagcugggcgugguggcaggagccuguaauccuagcuacuugggaggcugaggcgggagaaucacuuaaacccgggaggcggagguuguagugagcugagaucacaccacuguuacuccagccugggugacggagcaagacucugucucaaaaaaaaaaaaaaaaaaagaaaaaaaaaagaaaauauggggaaccaacacucaaagggcaaggaacacucuaagggcaaugugaacacgagauguuccauggcaaaauaagaagccuggucucauuacaguugaggguuuauuuggggaguauuaggaaauaagccuguguagguacauguagccacaaucuuaaauuugaagagaggccuggugcagugacucacaccuguaaucccagcacuuugggaggccgaggugggaggaucacuugagcccaggaguucaagaccagccugggcaacauagcaagaccucaugucaaaaauguaaaauuaaaaaacaaaaaauaggccgggcgugguagcucaugccuguaaucccagaacuuugugaggccgaggugggcggaucacgaggucaggaguucgagaccagcuuggccaacaugguaaaaccccaucucuacuaaaaauacaaaaauuagccgggugugguggcgggcaccuguaaucccagcuacucaggaggcugaggcaggagaauugcuugaacccaggaggcagagguugcagugagcugagaucacaccacugcacuccagccugggugacagagcaagacucugucucgagaaauaaauaaauaaauaaauaaauaaauaaaucugaaaagaaucucauggauuuagcccaaccucucauuuuauaggagaaauagaagcccagagagguaauaaaguuuguugacagccuccccugacuaugcuaguccuuuuuuccuguacagcacagccucugcuuuuagcucaggcuaacuuaaagagaccuuugaaagcugggcauaagaguuuacagcauaugagggaggaaaagaggcgaccucugcggguuugugaaccaggauguaauaugaaggcaguguguaaggaaaaugaaugugguagcacgaagugggaugaauuggagcagcaaguccauagucagaaaagcuugcaaggaagggaaauaugauaaugaagcaaauuguaaaaaugggcagaguuauucucccuccguucaugacccuacaaugugacaaggcagauccucccauuaagaggcagaguuggccgggugcgguggcucacgccuguaaucccagcacucugggaggcggaguggguggaucaccugaaccagaauggccagcauggagaaauccugucucuacuaaagauacaaaacauuagcagggcgugguggcgggugccuguaaucccagcuacucgggagacugaugcagaagaacugcuugaacucgggaggcagagguugcaguaagccaagaucgcaccacugcauuccagccugggcgacagagugaggcucugucuaaaaaaaaaaagaggcagaguuuauuuauuccuccaccugcuggaccuggguuggcugugugacuuguucuagauaauggaauguucgcaaaggugaucuagcagaggucugcaaagcaccugugcacugggcuugcccucuugcuacacuuggaccuguucugcccccauguaaaugaguccaaucuagucuacuggauggugagacccugucccagcuggccacagaugaacaaauugcucaggcaagacuagaagaacugcccuucugagcccggccccaaacuagcgaccacagacucacaggauaaauaaaugguuauuguuucaagccacuguguuuucuggugguguguuauuacccagaaaaagcuaacugauacguucaggcaugagucugggagaucacaguauaaugggagcagaaggaacaacuggggggauacaucauaggaaaacaaucaguaacauuuggggacuggcuagauauggcuucacauuaguggugaaaggauguauugaaggauauucuauaagaagggaacugcacgguggcucaaaccuacaaucccagcacuuugggaggcugaggcuugcggaccacuugagcucaggaguuugagaccagccugggcaauauggugaaaccccaucuguaccaaaauuacaaaaaauccaaaaauuagccgggugugguggugcguuccuguagucccagcuacuugggaggcugagguggaaggaucgcuugaacccaggaggcagaagugcagugagccaagaucacgccacgacacuccagccugggcgacagagggagacccugucucaaaaaaaaaaaaaaaaacggaagaagaagaagagggaauuaagauaccccccaaaaucauuaaauauaaacagaggcaaauaguacgucauuugauagacuaaaaaauacaagcccuauuucuuuuuuaauucccuaggucucuucauucaucccuucaucuuucauuuauuuauuuauuuauuuauuuauuuauuuauuuauuuuuuagagacagggucuugcucugucacccaggcuagagcacgguggcacgaucauagcucacuguaaccucaaacuccuggauucaaggcaucccgucaccucagucuccugaguagcugggacuacaggcgcacacuaccacaucuagcuaccuccucaucuuuuccagaucuaagcaauacaauguuuucuccaguaauuuugacaaugcagauuccuaggcccaaacucagacuuacugaaucagauucuguagucagagccugggaaccugcaguuuuaauaagcacaucauuagauccuuacuucaaagcuuguggccuacugcuacaauaaauggaaauacugugugugaaaaguucucugaacuauaaaucacuauugaaaaguccucuaucaaccaagcaugguggcucaugccuguaauuccagcacuuugggaggcugagcagggacaauugcuugagcccaggagucugaggcugcaguaagucaugacagugccacuacagccugggugacagagcgagacccugucccccuccaaaaaaaaaguccccucugauuaauaaguaaccuagagucugacccucaggcaucugacugaguuccaacaggacaaggacacauucuccucagaguacuggggccagaccugguggagaaacaggaaagaauucuuuuuucuuuuagagacagggucucauuauguuacccaggcuggacuugaacuccuagguucaagagauccuccaauccccucuuagacuucugaguagcuggaacuacaggugcaugccacugcucccagcucaaaacaagacgggauucuuuuuuuuuuuuuuucuuuuuuugagacagagucucacucuguugcccaggcuggagugcaguggcaugaucucggcugacugcaagcucugccucccggguucaugccauucuccugccucagccucccgaguagcugggacuacaggugcccaccacgacgccccacuaacuuuuuguauuuuuuaguagagauggaguuucaccguguuagccaggauggucucaaucuccugaccucgugauccgcccgccuuggccucccaaagugcugggauuacaggcaugagccaccgugccuggccgcaagaugggauucuuaaaucucgggggccuggcgccaacagcuagcuuccuuuuccuucaagucccagggaagccaaaaccucauccagucaagauggaguuccaaagaguggguuccauaguuucauagcacaaaaggggucugguauauuuuaugcaaaagugaugcuuuaaauguucaacuaaaacaacccauauguuaaauuugcuuucuccacauugucaugguggacagugcuagauuauuuauauuucaauucagguggcacaacccucucuaauaaucaauugcacuaaccccagagaagcugucugaaauaccuuuauaacagaagcuaacauuuacugaccucuuacuguguuccaucaguguuguuuauuuguuuuguuuuaagagauggggucucacucaguuacccagccuggaaugcaguagugugauugugauuagagcucacugcagucucaaacuucugggcuaaagugauccucccgcuucauccucuccaguagcugggacuagaggugugugccaacacacccagcuacuuuucaaauuuuuuguugagauggguaucgcuauggugccuagacuggucccgaacuccuggccucaagugauucuuccucaucagcuucccaaguagcugggauuacuggugugagcaucaguguuuuuuguuuuguuuuguuuuugagacggaguuucacuguuauucuuccccaggcuggagugcaauggcgcgaucuuugcucacuccaaccuccgccucagccucccaaguagcugggauuacaggcaugcgccaccacgccuggcuaauuuuguauuuucaguagagaugggguuucaccauguuggucaggugaccucaggugauccugaccucaggugauccaccugccgcggccucccaaagugcuaagaauacaggcgugagucaccgcacacggcaugagcaucaguguuuuuaaaauauauuaucuaauuucaucucacaacaacuuuuugggguggguauuauuauuauuuccacuuuagggaugaggaaacuaaggugcagagaggauaaguaaauuaacuaaggucauacauguggaaacuaacacgugaaaguuagaaucagagcucugacagcuggccuugcuggcacaaguucuuacaguaacuugcuaacuuauaccauacuauccuaucuggccucccaggauaauauggugguguuguagacucugagcacaggaggacuugaguucaaauaugaguucacuguauaauuaugggcaagguauuuaaguaucucuaaaucucagucuccucaucuguaaaguggagauaagauauguauuucacauaguuggcagguggauuaaauuaaauaucugagagucagugggugacagaaaagaaaaauaaaagaaagaaaaugacacacacguaaguaccuagaacacugcuagggccuguccacuaaauguuaguuucuuuccucuuucaaaguuuuacacuuaaacucacacauauacuuacuguaaugaaaacuucucuaggucuuuccucaguaaaaacugcuaccaauguaauucaaacaacacuuugaaaaagaaaaucucagcaauuuugacuaaagagcugaauacuaaguagaggaaaaacaaacuauaguugccacccauccacucuuuaucaacauccuacaggauauuuuuauuuuggccucaugucauaacgauuuuuuguuuuuuaaggagacagugugucgcucuguugcccaugcuggugugcaaucgcuugaucauaacucacugcaacccugaacuugugggcucaagcaacccuucugccccagccucccaaguagcuaggacuauaggcacacaccaccaugcccaacuaacuuuuuuguagagaccgugucccacuauguugcccaggcuaaucucaaacuccuagccucaagcaaucucuggccuuggccuccgaaagugcuaggauuauaagcaugagccaccacacccagccucaugccuuuuuuuuuuuuuuuuuuaaagagaacaagcgggcugggcacaguggcucacgccuguaaucccagcacuuugggaggcuaagauggaucaccugaggucaggaguucgagaccagccuggccaacauggugaagcccugucuuuacuaaaaacacaaaaauuagccaggcgugguggcacaugccuguagucccagcuacuugagaggcugagacaggagaaucacuugaaucugggagguggagguugcagugagccaagaucaugccacuggucuccagccugggugacagagcgagacucugacucaaaaauaauaauaauaauaaucauaaucauaaucauaaucauaaucauaaucauaauauguucugaugcuuguucucucucuuuuuuuuuuuuucuugaaacggagucuugcucuguggcccagacuggagugcaguggugcaaugucggcucacugcaaccuccaccucccgaguucaaguaauucuccugccucagccucucgaauagcugggauuucaggugaccgucaccauggcuggcuaauuuuuguauuuuuaguagagacagggcuucaccauguuggucaggcuggucucgaacuccugaccucaggugagccacccaucucagccuuccaaagugcugggauuacaggcaugagccacugugcccagauuuuuuuuuuuuuuuuuuuuuagacagaguuucauuccuguggcccaggcuggagugcaauggugcagucucagcucacuguaaccucugccucccagguucaagcgauucucuugccccagccucccaaguagcugggauuacaggccccugccaccacgcccagcuaauuuuguauuuucaguagagacaggguuuuaccauguuggccaggcuggucuugaacuccugaccucaggugauccucccgccuuggccucccaaagugcugggauuacaggcaugagucacugugcccggccugauuuuuguuuguuuguuuguuuaauggagacuggugcuggugacuuugcugaguagcuucagcagagggaccugaacaccuuuuuuuuuuuguuuuuuguuuuuugagacacucucacucugucacccagguggaagugcaguggcucgaucucagcucacugcaaccuucgucuccuggguucaagcaauucucgugcuucagccuccugaguagcuggcauuacaggugugugccaccacgccuagcuacuuuuuguauuuuuagcagagacaggguuucaccauguuggccaggcuggucuugaacuccuggccucaugugaucugcccaccucggccucccaaagugcuagauuacaggcgugagcuaccgcgcccagccagaacauaaugauuuuugauacagacaccaaaagcccagaaauggucuaaugugaaaacagcuaggccugaccagagcaggguucaaugacaucuucuacgcccuggcucugucccagccaugaggacagacgaguuauaagaaucccugugcucucacccaaauaagagaaaagauucauuucucgccuaaaugaagggcaaccuuguggagacucuucuagagauauuugggggccacucccauaggacuuucucccuucuucaguuaucagucaagcauuccauuuccaguaucucucacacagaagauauccgaggcaaggaccauuaucuucuuguaguaaacucccuccaaaccucugggagcuauuuucugagacgugaugcugguacuugccaugucaucucuguccuaucaaugucccacaaggucagcauccaauuucaggcucacaagccucuuaucaccagcccagcaucagagugugcugggguagaggccaacaugacuccauugcaaauauaacauuaaugagagcaugagaaguaguuuuccaucagaauagcagaagaaaacgcuuuccaguacagacgggcauuuugaucaggcaauccucagcucuucccagaacuaaguuacagcacuaaaagucagcuuaugguugaaguuucauuccuucaaaacacaucaguuagaaucugaagggcuguaucuuccacuaaaucuuauaauuaaacaaccauuccaaaaccuaaacacaaaaucacuauuuauacaaaaagauuauaagagcauuuccuuuagaugucuggcagcaguuaaccaacuuguuuucacucaaaauuuggaaggaguuauugcagugggauuugaggagucauauugacuacacagggacucagggaaaguacugccuuguauuuauuuacuuuuucucaaggcuacgugaaacuuccaaagaguggcauucuaccuuguuccagaaggaacaguauaagauugcugaaagaagggaacauuucuccaguuugaggguuauuuacggacaaaguacuaguuuucaagugguacaccuaaccacuuuuuuucuuucuuuuuuuuuuuuugagacacagucucacugugucacacaggcugaagucuaauggcaugaucuuggcucacugcaaccuccgccucccaggcucaagagauucucgugccucagccuccugaguagcugggauuacaggcgugccagcacggccagcuaauuuucauauuuuuaguagagaugggguuucacuauguuggccaggcuggucucaaacuucuggccucaugugaucugccugccuuggacucccaaagugcugggauuauaggcaugagccaccacgcccagccccuaaccacuuuuuuaguaugcuguuagcucuuggggauuauacccuaaauauuuuaaggaagccaaugaaacugaaaagguuaccuucuuauuaccaaauguggcggacuguauuuccaagauguuugcaacaguaucuucugucuuacauguuugucuacaauuugaucuggccauugauccauuaaaaggugaaaucuaccuccccucccuugaaucugaguaggcuugugacugcuuggaccaaaagaacacaaugaaaaugauggugugggccgggcgugguggcucaugccuguaauccuagcauuuugggaggccgaggcggacggaucaccugaggucggaaguucaagaccagccugaccaacauggagaaaccccaucucuacuaaaaauacaaaauuagcugggugugguggcccaugccuguaaucccagcuacuugggaggcugaggcaggagaauugcuuaacccaggaggcggagguugaagugagccaagaucgcgccauugcacuccagccugggcaacaagagugaaacucugucucaaaagaaaauggugguguguucugagguuagaucauaaaaggugaugcaacuuccaucuugucacugauacacucacacuuggagacccgagccaccacauaaaaagccugacuacacagaggcuaacacugaaagccaagccacacagaaaagccauauauugguguuccaguuggcugcccuuaccuuugaaucauccuaucccacguaccaggcaucagugaaggagccuucagaugauuccagcccucagccauugagccugcauuccaucccauaucagggagcagagagaggccuccccauggugccagguccaaauucccucacccacagaauccaugagcaucauauggguguuuuuuuuuuguuuguuuguuuuguuuuuugagacagagucucgcuuugucacgcuggguggaguacaguggugugaucucggcucacugcaagcuccgccucccggguucaagcaauucuccugccuuagcuuccugaguagcugggacuacaggugcucgccaccacgcccagcuaauuuuuuuuuuuuuuuuuuugagacggagucuugcugucucccaggcuggaguucaguggcacgaucucagcuuacugcaagcucugccucccagguucucgccauucuccugccucagccuccccaguagcugggacuacaggcgcccgccaccaugcccagcuaauuuuuuuuuguauuuuuaguggagacgggguuucaccauguuagccaggauggucucgaucuccugaccuugugauccgccugccucagccucccgaagugcugggauuacaggcaugagccacugugcccggccccggcuaauuuuuuguauuuuuaguagagaugagguuucacuguguuagccaggauggucuugaucuccugaucucaugauccgcccuccucaaccucccaaagugcugggauuacaggcaugagccaccgcgccuggccacaguauggguguuuuaagcugcuaaauucugggguacuuuguuauacagcaauaauaacuggaauaccauguuucaaccuaacccucccaccauccucucccauugguuuucaacaguacauacuacaaacuuccauuccauuuugacuuaggcacauauagcaaauucccuucagcaaaugcuugccaaaaugauguccauugccaagaccacagucagaagugcuaaugaaagggaauguguguagaauccaugagucucaggccaugguugaauacauuuggcuagaaacugucacaugugcccaaauaguugauauugucacuauuugggacagugucuggauuuuaugacuuuuauaauuaaccaugcuaaugaauagcuuuacagcuacugaccuaaaaaggaauuucaccaguaaccauggucauugagacaaaccuaguuuaacaaaguauagucagugccgaugaagacugaaagcccaauacuuuuuuuuuuuugaggcagucuggcucugucauccaagcuggagugcaguggcgucaucucagccacugcaaccucugccuccugggcccaagccauccucccaccuuagccuccugaguagcugggacuacaggagcaugccacgacacccagcuaauuuuugcauuuuuugguagagacaggguuuuaccacguugcccaugcuggucuugaacuccugggaucaagugaucugccugcuucagccuuccaaagugcuaggauuacaggugggagccaccaugucuggcccaauacuuuaauaagggaugcaaaucaguauuucuaucaguuauccaaaucauauuuuuaaagagaauauauggcucaggaguuuaggcuacagauacacccauggaauccagucacaaaccaagaugauucacacuucuaaacagacacucacccuuucugcacuccugauagauggguugcaaaggaucaguccaaacauuuacauaaaagaaaauuacuauucugucccuguaaaccaacacacuauuagucugcacuauauaccauauuccugguaucuucauuuucuuuugucccagacauuucuuuuuaauuauuauuauuuucuuauuuccaaacagaacucugaggcaauaacgagaauuuuuguuuccguucuuuuuaucguuuucuaauuuuaagaaaucaacguauuaaacaacauuuuuguauucacaguaaacuguguccaauuuaagaggauuaaaaaaaaaaaaacugacauaaagaggaaaaagggccaggcaugauggcucacuccuguaaucccagcacguugggaggcugaagcaagaggaucgcuugagcccaggaguucaauaccaagcugggaaacguagugagaccucaucucuacaaaacaauacaaaaauuugcugggugugguggugcaugccuguagucccagcuacucaggaggcugagguaggaggauugcuugagcccacaauuugaggcugccggggugagcagugacugcaccacaccuguacuccagccugggcaacagagccagaccuugucucaaaaaaaagaaaagaaaagcaaaacaaaacaaaagguuggggcggugggggagauccaguuagagaauacuggguggaggcagccacccuaacuacccacauguccccccagaaccacccuucccaggguacaauagucuugucaaauuauuucaguaauaaagaaagcaguucauaagcuuuuagaauccuaaagagaagaaaaugaaggcuuugaugaacaaagauuagccuuguuaggaaccuagaacaaaaagucaaauaauacuccccuuuuuuuuuuuuuuuuuuuuuuuugagacggagucuugcucugucccccaugcuggagugcaguggcaggaucuuggcucacugcaaccgccgccucccagguucaagcaauucuccugccucagccuccuggguaguugggauuacaggcacgugccaccaugcuuggcuaauuuuuguauuuuuaguagagacgagguuucaccaucuuggccaagcuaguuuugaacuccugacuucgugauccacccgccucggccucccaaaguguugggauuacaggcgugagccaccgcgcccggccuaaauauuuuuuuuuaaguguuuuaaaaggagcucgaaauaacuguuuuucauuauaagucuaaccuccucuuuccucaugugaaaaguaaagaaauguaucguugcuauaugaaggguucguuuagggaagacugugggaugguuagauugaagaaagugggaagaaaauacuggcgccaaaaagauuuuuuuuuuuuuuuauuuaaaggcgaugaugaccugggggugauugggacuagggaguaauacugccagaauacuauccuauuucacgggaaagggaaugccagggcuggacuccgauauagcaguuauuccugcugguaccuaagcaguucagagaugcuagaaugcagggauaccacccaucaacuaaaugaagcaucccauuccccaggcuuccauaugugggaguucucuccaccagugagauaaaggcgggcucagggaaaacaaagcccuagaccacaacaaggcaacaccuucucgcaccccauuuucaccuuccaggcgcguuccuuccugcuauccgggcccgcucucccgcccggcagggucuaacgcucacacaggucugccaauuccccugaugcaacccuccacccucugcucgcuaaccccaguccagucagcucucccgggccucgacccccgcgguggagacuaaaggguucagguuugggucccccacaggcaaccgcccucaggucagcguauccgagguggagccgcgcccccgagccgggucaucucgugcuccguuccucagugcccaccugaccgaucacacucuuucccggcccccucccuccugcgccuccagccaaccuggggccggccuuucgggaugaccgucacgccuggacgcaggguuccagcgccucggacuuuuccucugaugggcucccggcugccaccuugcucuccgccaccuccaccagcgauugccccacuugacgccgccauccugggcgaccgcacuggguacaauucccgcugcccauuggcuguuaccuaggcaaccgggagcaacgccacuccgcauuggcccagcccggcuccacgccaucuuugugcggggccgaguguuugcgaacccgggcugacuaugugaaagagggguggucccaccucugcaacgcagauaaagacagaggauccagaucuggccuacccagaggccgucuaguugaaauggcaaccccaaagaaaaccaaaccugcgcccgaagcaacagugaccaucaacgcgagcggcucugaucuugcuccaguccccacugcugucaagggccccgccgcggaguuuaaggcagauccuaaauccagcuucagagaggcagcuuuguaaauuguaacgcgcuaggcaggauagccuccaauaacucugugcuagacauugugauaucaagacacuuuugcauucauuauaggaauuugugcuguccuugucauuaucuagauccuuuuuguuuaaaauauaguaccuggccaggcgcaguggcucacaucuguaaucccagcacuucgggaggccgcggcuugagcucaggagugcgggaggcuugagcccaagaguucuagaucagccugggcaacgcagggagacuccguaucuacagaagaaaaaaauuacccagccuaguggugggugccuguagucacagcuacucaggaggcugaggugggaggaucccuugagcccaggagguugaggcugcaauaagccaugauucugccacuguaccccagccugggcgaccuagcaagacccugucucaaauaaauaaauugcaaaccaaaaaguaucugagacaggucucaaucaauuuaggaguuuauuuugccaauguuaaggacaugcccgugacacagccuuagaagguccuaagaauguguguccaaaauagucgggacaccacuugauuuuauacauuuuagggagacguaagacaucaaucaauacauguaaaauauacauuggcuuggucccgaaaguggggguggggguggcaaguuccaggauguagguggauucaaagauguccugauugacaauugguugaaagaguuuaaagaccuggaacccacagaagggaaugucuggguuaaguuaaggaauuguuacuaagauaugcacgcacacacacacacacacacacacacacacacacacaaggaauuguggaaaucaagguuuuuauuaugcagagaaggcuacagguagcaggcuccagagagcauagauuguaaauguuucuuuauuuuuuuuuuuguuuugagacagggucucccucugucacccagucuggagugcaguagcuggaucacggcuuacugcagccuugaccucccaggcucaaguuauccucccaccucagccuccuaaguagcugagacuacugguucauuccacuaugccuggcuuauuuuuguauuuuuuguagagaugguguuuugucauguugcccaggcugguauugaacuccugggcucaagugauccucccaucucugccucccaaagugcuaggauuacacgugugagccaccaaggcuggccaguguuuauuaucagauuuagaaagguaucagacucuuaguuaguucuccccuggaucaggaaaaagaccuggaaagggaaggggauuuucuacagaauguagauuuucaccauaaaagacaccuuugccugcuaucaugacagauggggccugcuaucugucaauguugguaucauugcuacaaagagucugcugugucaaccuuaagaucucugcuuuaauguuaaaugcugguccugaauuccaaaagcaggagaaaauaaugaggcaugucugacucccacuucucaucauggccucaaauaguuuuucagguuaauuuaggaaugcccuuggcccagaagaggaggccauucauuugauuggggggcuuauaauuuuauuucugguucacuagauaaauaaauaaauaaauaaaauauagugccaagauuggagcaaaucuucccaaauaccacucacaucaaucuguguauccauauguuuauuucuuaaacaaugugaguacagcaugaugcuagguucugucaggcuugaaaagccaugauuguuacucuuauggccuuuauaauuagcugaguguggugacaagugccuguggugccagcacucgggagguuaaggcaagagaacugcuugagccugguuaacagagacccugucucaaaacauaaauaaauaaauaaauaaauaaauaaauaaauaaauaaauaaauaaaauguaguuucuuggccaggggaaugacacacuacaagcaguauuuuaugaaaauuaaucugacagugacacucagagaugaccagugagagauuggaagcaaaguaacaaacucagaaguuauuguaauaaugcaacuaacacauccuggaaguuucauguagcaucaguggagaugaaagaaaggggguaaauaugagacauauuucauagggauauuuaauaagaaucaacauaguguuaagagcauggaaacagucugccuggauuuggauccggcucugccauuuaccagcugaaugaccaugggcacauuaccuuuaccucccugggucuggguuuccaacaucacaggauacuauaaagcugguuccaugaguuaauccauguaaugcauuuaaaacaaugucuaggccgggugugguggcucaugccuguaaucccagcacuuugggaggccgaggugggcggaucaugaggucaacagaucgagaccauccuggccaacauggugaaaccccgucucuacugaaaaauacaaaaauuagccggaugugguggcccgcgccuguagucccagcuacucaggaggcugaggcaggagaaucgcuugaacccgggaggcggagguugcggugagcugagauugcacaacugcacuccagccugagugacagagccggcuaauuuuuguauuuuuaguagagacaggguuucaccaucuugaccaggcuggucucgaacuccugaccucgugauccacccgcuucggccucccaaagugcugggauuacaggcgugagccacugugccuggccaaaaaauuuuuuuagauaaaauaaaagacucugagggguuucuguggagaaaaaacucagaauuccagggagaacucuaaaucugggaccuuuccuuuaccauaauuugaagcuuaugggcuaaaugagaugaaugauaccaaaagauuaucuauguggcuacagacccugggccacaagagccaggcaucaguugauuauugaggucuagauaggaaaaggaagugcauguauuauaacugaaaggggcaauuuaaccuucuguacgacuuuuguuuagaaugguuugucuggccaaaaauguuuaagacauucccauacauauaauuaaacaauagugcuuucaauuugguauuucuaguuagcaguggcaauaauuugauucaagaaagaaugauuaugaaauauuggugacuaugugacuggccaugauucgugaaagcccauaccucuagucugcuggugacuuuaagcauaaaaacaaaaacaacaucaacaguaacaucagcagugauuuuuuuucaaaaagcuaccauauguugagugcucuuuauguacaaaacacuaugcuaagugcuuuauuuuuauuuuuccuauuagagagucaugcuucauaugcuaagugcuuuacauaacauuauauugauucuugauucaguaaucauggggaugauuauucccauuuuauagauuaaggaacugaggcuuagagagguuauauaacuugucuaaaacaacugaucaucauggagacuggauucaaacucaaaugucucugauuuccaagcccaugcuuccaaccauuacauuuuacacu

SEQ ID NO: 18830 - RNA, 40973 nt, Homo sapiens
ucuuccucacauaauugugcacuguggcuacucuggggcagagggagacgcuccaccauacggugacucaaggacccaggcuccuuccaccccguggcucggccaucugcucugcacugagcucgcaggugagggaggagaggcaggagaagguuuccugcuuccugcauaccuucaucuagaaguaacagucagcgcucccacucaccuccuugggaguaacaggaccugaccuauaagcagaggaugcugggaaauguagucccuagccaggcagcugcugcguagcaacaacucuauaucaugguagggggcacaggacuuuuugguggacaguuaaucgucgcuuucaagggaggcacaagguuuuauugcugaaguuuucauugccuugcucugugaacucuuuuagugccaguguuugaugaaugguuguuuucauggcugccaagagcuguugaguaagaauguaacugcagacagucauuuccuugcuguguuuguccaacaaccacugucucacagcuggaaaacucauuacucaugaguacuucuuucccagguacaagaacauaaagauguauuuauugaacacuuuuuagggcaaugacacugaacuguuaauccaaaaauauacacuggucaaacgauaagcuuaaauacuagagaaaauccaaauauuaaggagacuuuaaagauacauaccagucaaauauuucuuucauuugucuauucauuuuuucuuucuuuuuuuguuuuguugcaucuauucauuuuaaaaauggaaaccuaauucauauaccauaauauuucacauaauaugacauaaaaauucccaguuuuauuuuuauuuauuuauuuagagacagagucuugcucuguuguccaggcuggagugcaguggugcgauuucagcucacugcaaccuccgccucucggguucaauagauucuccugccucagccucccgaguagcugggauuacaggcacccaccaccaugccaggcuaauuuuuguauuuuucauagagauggaguuucaucauguuggccaggccguucuugaacuccugaccucaggugauccaccugccucagcuuuccaaagugcugggauuacaggcgugagccauugcaccuggccaaaaauuccuaguuuuaaaguguacaauucagugguuuucaguauauucagaagguuguauaaccaucaccaccaucuaauucgaggacauuuccaucaccccaaagagaaacccuguaccuguuagcagucacucccaguuccucccuccuuccagucucuggcaaccacuaauuuacucugucucuauagauuugcauauucuggcugggugcgguggcucgugccuuaaucccagcacuuugggaggcugaggugggaagaucaccugaggucaggaguucaagaccagccuggccaacauggugaaaccccaucucuaguaaaaauacaaaaaaauuagccaggugugguggcgggcgccugguaaucuuagcuacucaggaggcugaggcaggagaaucacuugaacccaggaggcagagguugcaguaagccaagaucgugccacugcacuccagccugggugacagagagagacucugccucaaaaaaaaaaaaaaaaaaaaaaaaagauuuguuuauucuggacauuuuacauaaauggaauaguauguggcuuuuaugucugguuucuuucacuuagcacaauguuuucaagguucauucauguuguagcauguauuaauaacucauuucuuuuuuugucuuccaauaugaucucaagacucauuuuuuauggugaauaauauuccagugaacggauagaauauauuuuguuuauaucauucacuaauuuuuaauuuuuuuuuuuuuuuuuugagacagagucuugcucugucgcccaggcuggaaugcaguggcgcgaucucagcucacugcaagcuccgccucccggguucaugccauucuccuuccucagccacccgaguagcugggacuacaggcgcccaccacuaugcccagcuaauuuuuuguauuuuuaguagagacgggguuucacugcauuagccaggauggucucaauuuccugaccucgugauccacccaccucagccucccaaagugcugggauuacaggcgugagccaccgugcccggcuuuaauuuuuuuuuuuuuuuuugagacagaguuucccucugucaccuaggcuggagugcaauggcgcgaucucagcucacugcaaccuccgcuuuccaggcucaagcgauucucgugccuuagccuccugaguagcugagauuacaggcaagcgccaccaugccugguuaauuuuuguauuuuuaguagaaaugggguuucgccaugucagccaggcuggucuugaacuccuggccucaagugauccgcaggccuuugucucccagagugcugggauuagaggcgugagccacaccgcccagccucuuaaaauuuuuuuaauuguaguaacauacacauaacauaaaauugaccauuuucaaguguacaguucgaugguauuaaguccauucauguuguuaaacaacauggucuauacuggcuguugugcaaccaucaccaccauccaucuccauggcucuucucaucuugcaaaacuaccacccugaaccaugaaacaauaacuccccauuuccuccuccccacagccccuggcaaccaccauucuacuuucagucucugaauuugacuacgcuagguacuucauagaaguggaaucauacaguacuuaucuuuuugucacuagcuuauuucauuuagcauaauguauucaagggucauccaugcuguagcaugugucagaauguccuucauuuuuaaggcugaacaauguuccaucuucuguuuauaccgcauuuuguuuauccauucauccacugauggacaccuggguugcuuccaccuuuuggcuauugugaauaaucugcgaaugaacauggguguacaaauaucucuuugagaccuugcuuuaaauucuuuuggguauauacucagaaguggaauugcuggaucaaaugguaauucuauuuuuuaauuuuuaaggaacugccacaaugcuuucuauaccauuuuacauuuucauugacagugcacaaggguuccgauuucuccacauccccaacuucuauuuuuuuuuuaagacggagucucacucugucguccgggcuggagugcaguggcacugcaaccuucugccucccagguucaagcuuucuccugccucagccuccugaguagcugggauuacaggcaugcgccaccaugaccagcuaauuuuuguacuuuuaguagagacgagcuuucaccauguuggucaggcuggucucgaacuccugaccucaugauccacccgccucagccucccagagugcugggauuacaggcaugagccaccaugcccagcccccacuaacuucuuauuuuccauguuauuuauucauuuuuaaacaagcauucauugaguaccuacuaugccacagcucuauacuugguagaaacugaggcugccaaaauguuaaaucuguuucccugcucuuagaacuuaggaaacaauggagaaacagucauguucaagagauagagugaaaugcaaggugauaggugccuaauagagauggaaucaaugguagauuggauaaagaaaaugugguacaggccggaugcuguggcucacgcuuguaauccuaacacuuugggaggcccaggcagguggauagucugagcccaggcguucgagaccagccugagaaacauggugaaaucccggcucuacaaaaaaaauacaaguauuagcugggcuuguugacgcgugccuguaaucccagcuaccugggagacugaggugggaggauccccugagcccaaggaggugaaggcugcagugaaccaugauggugccacuguacuccagccugggugacagagugagacccugucucaaaaaaaaaaaaaaaaaaaagaagaagaagaagaagaagaaaauaugguacauauauaccaaggccguaaaaagaacgagaucauagccuuugcggcaacauggauggagcuggaggccauuauccuaagugagcuaacacaggagcagaaaaccaaacacugcauguucuuauagaugggagcuaaauacugaauacccacggacacaaagaagggaacagacaccagggagacaccagggccuacuggaggauggaaaguugaaggaggcuaaggauugaaaaacuaccuauaaauacacagauacuaugccuguuaacuggaugacaaaauaauauggacacugaauccccaugacauggaauuuaucuauggaaccaaccugcacauguaccccuaaaacaaaaauaaaaguuaaaaaaaaaaaagagagagagauggaggcugggcgugguggcucgcgccuguaaucucagcacuuugggaggcugagguggguggaucacccgaggucaggaguucgagaccagccuagccaacauggugaaaccccaucucuacuaaaaauacaaaaauagucgggcaugguggcgggcgccuguaaucccagcuaccugggaggcugaggcuggagaaucacuugaacccaggaggcagagguugcagugagucgagaucaugccacugcucuccagccugggcgacagaguuauacuccauuucaacaacaacaacaacaaaaagaaaaaaaaaagaaaaaaagaaaacggcgugugauuucugaggaugcaucagaagagacuuuuggcuuccuuccuggcucccugguggaucucuuguucuggguuaaggcauccgccaugucaggaggacacucaagaagcguucaggagagccccgagggaggaccuggcaccuucugccaucuugucacuauuggagagugccagcaucaccuugucagcugugugaggaagccacccugggagccgauccuccagccccacuaagccuucagaugauugcagccuugaccaacaugugacugcaaccuuaugaaagcgccugagccaaaaccaucaccaagcugcucuugauuuucugacuaaaaacacccagaacccaaaaaacugugagauaauacaugcuuauuguuguuuuaaguaauuaaguuuugaaauacuucauuacacagcaagagauaacuaaugcagcuagaagcaugaaaauaucuggcauaguguggaaauggcgagaaaugcauugaggcuggcacgagagguuaaagccagaaacuuggaguugaaagagaugcuucugaaaugccauguuucuccauaagagugggcaagggagccaucugguggaggaggcaugcuuagacauucccuucucucuucccugauuucuccagccuguucuccucagcauuuccaccuaguauuucuccaagggccacagugagguuuaugagucaaguaugugggccauaaacacacuugcuuauugaagcaaauacuaaccucugcaaaaugucaagguaagauauuaucuucagugauuauuuaauuuucucccuuagucucuucuaccugucugcuaccaaggggaaaacaucagcagcaccaggaguugaggcagaaugcugcaggagggaaagaaggaacuagaacuugauuauggaaaaaucagaauuagacucgagagagcacagucaagcugguccgucucuuaauuauaaggggaggccuuuauucaucgcuacaggccacgacuauugucccuuucugguuuuuaaagccuucuuguauccuccaauguucccuccagauaaugucuagaaauucuugaauaauaucucucaauucuauagcugcuggaagagaaaacaaauacuauuacucuccacugucagacugaggccaaggaggaggaauugcaaagaaacuaaaauuuaccuuuggaguaaauuaccagugugagaauuucaggcacuuaggauauauauauuauuauuauuuuuucgagacagagucuugcucugucgcccaggcuggagugcaguggcacgaucuccgcucacugcaacccccgccuccuggguucaagcaauucuucugucucagccuccuaaguagcuggaauuacaggcacgcgccaccacacccggcuaauuuuuauauuuauuuauuuauuuauuuugagacggagucuagcucugucgcccaggcuggagugcaguggcaugaucucggcucacugcaaucuccgccuccuggguucacaccauucuccuguuucagccuccccacuagcugggacuacagacgcccaccaccaugcccggcuaauuuuuuuguauuuuuaguagagcccagguuucaccguguuagccagaauggucucgaucucuugaccuuaugaucugcccaccuuggccucccaaagugcugggauuacaggcgugagccaccgcgcccggccugauuuuuauauuuuuaguagagacgggguuucaccuuguuggccaggcuggucucaaacucuugaccucaggugaucugcccgccucagccucucaaagugcugggauuacacgugugagccacugugccugaccgguacuuagguuauuaaagaaaaaaauuuauuuuucuuaagaaggguggggacuccuuagcuuaaauacuacauuguugaacacaaaacuuuccccauccucucacuuagauuaagucugccucuucucucugcuccuacgguuacaguagaauccccugcuuuauaucauggcucagucaagucagcgucuucuguugaacuaagaguucauagaggguagaauuucuguccaguucauucuugcugguuucacagucauuguuuuaagaaaugauucaugaccagccugggcaacauagcaacaccucauucuacaaaaaaaaaaaaaaaaaaaaaauuggccaggcacgguagcucacaccuguaaucccagcacuuugggaggcugaggcaggcagaucacgagcucaagagaucgagaccauccuggccaacauggugaaaccccgucucuacuaaaaauacaaaaauuagcugggcgugguggugugcaccuguagucccagcuacucgggaggcugaggcaggagaaucgcuugaauccgggaggcggagcuugcagugagccaagaucgugccacugcacuccagccugaugacagagugagacuccguuucaaaaaaaaauaaaaauaaaaauuaaguagcuagguguuaguggugugcaccuguagucccagcuccucuggaggcugaggcaggaggauuguuugagcccaggaauuagagugagcuaugauugcaccauugcacugcagccugggcagcagcagaagacccuaucucaaaaauaaaauaaaauuacauuaaaaaaggaaagaaagauaagaaaaagaaaaaagaaaugggcauuguucuggggcuuuuguugaaagagaugugaauucugugcuccaagaggaaacugacacgcaugcgcucauucaaggaacauuuguugguaccuccuuugugcuagaugcuggacacagaaauuauaggcaguucccucaggacucucacugucuagagagaggaggaggcaccaagugcugggguggggcaggcccacggagccaagucagaagggcacguaauccagacaguggcugcugauggggaaggugucagagaagucuuucuucaggggugagaucugagcugaauuuuggaggaagaauaagagcuggccaacuaaagaauauggggcgcaguggcucacgucuguaaucccagcgcuuugggaggucgaggcagguggaucaccugagguaaggaguuugagaccagucuagccaacauggugaaaccccaucucuacuaaauacaaaaaauuagccaggcaugguggugcaugccuguaauuccagcuacuuaggaggcugaggcggaagaaucgcuugaaccugggaggcaaaaguugcagugagccaagauuucuccauugcacuccagccugcgcaacaagagcaaaacucuaucucaaaaaaaaaaaaaaaaaaaaggugagaguagucuguagaaagguacaguaaugggagaaggugugacauauccgagaacugccagaguugaauacaccaggcuuugguuuuauccuggaggucacagggggccacugaaacuauccaccaagagaguggucugagaaagguacagagggguggacagggugggggaugggaguggguggggaguggcgauggccuauccuggaauucagaccugaggccagguuaggaaacgaagaagaggggccuucagaggcuaucugcaugacagacccaggagcuuucggggaaaagacccauccuaagggaggagaggcagaguccagcagaugggccuggaccaccacaaagcucaguccauuucucuaagggguggugaguggauuucuguauauggcuuagugauaugugugggaauuggaucuuucuacauuuuggccuuucguggauucuugucugauuuuugggcuaggggugguggugguagggcuuugaguaaaaauaaaaaucacaaugauugcuaacgauuuuugaacacuuauaacaugucaggaauuuacauacuuuagcucauuuaauucucaucacagccccacacugaggguaccacuaugguuauccccauuuuacagcuggaaaaaccaaccaagcaauucaucugaggagaagcccuccuaccuuacuuauguugggacuggcgcaugccggguaauugacaaagucaacuaaagcagggagcuuugagaaaaauaccuacacaggguaagcauuuacuuuugggacaaucgucaauuuauacauaguuauaagaacuaacacagggugaucccacagacuaccccccaaugguaacaucuugcaacccuucuuaacagaaugccuacuaugugccagguacugcuuuaggugcuggagacauagacacgggaaacgaaacauuagcugacagaagccacaagagugaaugagauccucacggagugccuugagucagaagaaagaaggguagcaaaaggagccccagcauuugagggguaggaagaaaagcccuaaggagaccuugaaggucggaaagagaggagaggguggugucauggaagcuaagguggacaauggugccaaaaaggaaagagauuccagugcuucugaggucaucugcaaggaggacugggaaguguccauuggauuuagcagccaggaugucacaggugagcaggcagguagcccagaaauauggaggggagcaggaccacagugcagugaggagugaauugggcgaggaagcagcgguagagagcacuucacagugagucuuccaacucauguaggaaagaggggguaaaguuaggcuaaaggagaaauuuuccaugaauuuugucucuagaaugaugauuaagaguuagcgagagucaagauuucaggccuguuagagcaaagcccuaaggaaauaagaguuggacccuggagcacagcuaaguccuggcuggagggaugggccugucuuucugaaaggagauaauggaggaagagaugcaguuaaagcucuguggcuacuugaagagggaagugauuacuuccagcuggggcacucaaggaagggauacagacauuugagugccaggggcauuugaggguaacaguggagggguucaguuggccaaaguuaaaggcagcugaaagauggcaggagacaagaccaggaaaugcagaccaagguggguggugguaugguuggggcguuggggucagaugacacauaagcuucaaauuccagcucccauuugcuucuuagcugugacucuaaagaaguuccuuaacacgucugagauuccccaucuguaaaauggcgacaacccuaauagggucguuggaggagaacuagauaaugucuaaaaagagcucaguccgguucagugcuuggcuccucuguaccugagcgcuaagucacuaauauaaagccaucggaugugugcuuuaagggaaauuaacugggccacacggugugaagugaacugagcugggagaggccugcacaggaccuuguacacacuagcuacuccggaaacaacugcaugcucugcugggcaucucauacaggauacggugucuuuccggggcucacacacaguccccaguucaguuccaaaguuggaaggaaagaggaugaagacguaaauucuucauuuaagccucucgccaacuguucccugcggcaaggcagggcaacgagcugcagggucgccaagcacgugcuuccaaggguccucaaggcuuugugaacggcggccggccaaggacagaauuaacuccagccuggagcgcgcgggaaagacgcgcaggcgcacugcuggcaagggugcuugccugugcuggggugggcggagcuaaacccggagcgggaugacgucaugaggacgcagccgcagagcgauucgcgucccggaagcggcgguggcggccgcggcguaggcggaggagauuuucggaccugcgacuuccgaacaacccuggcaggaggagcggcguucagccgggggaggccugaagaaacgcuccggggcccaguggcucuaccccugcuccugcccgacccugccgccucccucacggagccagcggccggguaggugaggugccguccccccgcgucccagugucuccgcaggcuguguguaguugggugcuugggcgcagcgggggccgccacaugcuggccccacgaccucgggcauggccuucccuguccagccucacgggcuccaucaggccccccuggcugcagagguguuggccaaggccagugcgggcgucgauauaccucgccccuuccugggcucauaccuggcgccgcucugugcccuuucgccuuggcucggccugcggggauuucggggucccguuggccccuuugucccauccccucacccucccaucaggucgcggcugauugccugggacugguuuauguugcucuucgccgagguuccgcccccucguuugcugcuuagaguucaggauaggacuuugaacugggaaagaccguaaaggcuccucgguuuccucaucagaaagggcagacgggaauggggcguucugaugccgacugcccuggggcagagauggcccaggaaguuguugggaaccgaagggagugggaagaguuagaggaucgggcgagaguccuggagcacgguauuucauucacucauucagcaggcauuuguuaagcacccacuguguacagaagcagucgugaauggaggccaguuaagagcagggaguuuuacuuugacguggucagugcucugcacuugaucuuagccacaaggccaagaagcgaugugaugugauaagugcucuguuagggugaguacgugauccuuugggagcaucggagagggucucccaguccagaguuggggguguuggcagagacuucccagaguaagggagugauguuuaagcugauaccugaaggaugaguaggaauuaaccagguaaagagugggagaaaaauguuccaggacaucauuucauuucagcccaugggcugccucgcugcagcgaucauuuaugcuugguuuuuaugauuuuuaguuuugauggaucuuuggggaaaagagcauuggauggagaguacaaagaacaggauuuuaggucugaauaguucacuuucccuugcucacagguuuacuguuggcaccaccugaaucuguagguagaauuguguugaggacuagacgugcaaugcaaauguugggaauuauuaugguuacaggaugcagacaucagaacgugaggggagugggccggagcugagccccagcgugaugcccgaggcuccccuggagucuccaccuuuuccuaccaaguccccagcguuugaccuuuucaacuugguucucuccuacaagaggcuggagaucuaccuggaacccuugaaggaugcaggugaugguguucgauacuugcucagguacagacuuuguggaguugcucuggucugcucugccuucugccguccugcucuguaguaacuaacacugaccauuuaggcaguggcugggcuguccuuucugcccuagugaggagcaguucugggaggucuguucggccucuggguuuaucuaggccuacccugugucucaggcccagcccaggagaggcagauacugggaaugauccugccuuucagcaagguucuucuuugugacugaauaagcuccuuccucuggacugcuggacaaccuugaacaucacgccuucuacagcuuagagcaggcuuaauuuuuuccuuugcccccaauauuagcauaauuaauauuaaaaaauuaggguauaauuuugaacaaaaauuaaagaaauacaaaaaccugugaauaagcagauaccauuuucacuacuuuuuuuuuuuuugagacagaaucuugcuguauuguccaggcuggaaugcagucgugugaacauggcucacuguagccucagccucuucagcucaagcgauccuccuaccucagccaccaugccuggcuaauuaaaaaaaaaaaaaaauuguagagaggcucucacuguguugcccaggcuggucuugaacuguugggcucaagugauccuccugccucagccucccaaagugcugggauuacaggugugagccacugugcccagcccauuuuuacuaauuuauugagauuauggaucuuaacuuuuucccuccuauccugcuuugauuuucauucucuauaauuuucauuuuuucuuuugacucauuuuauuauguuaaaauuauuuuaaauuacuuauauggcauucuacucccuaaauaugucaguuuuuaucucuaaauaaggacauuucuuucaagaucaaaguaacaccauaccuaacaaaauuaauaacuccuugauaucauccuauacucaguucauauuccauuuccucaguuguaccaucucuuuuggcuaaaucacauuucaguccaggagugugcauuguuuguacuuauuaugucuuuuaagucuuuuuucagucuaagacaaucucucucgugacauugauuugcugaagagacugagccugaacugacuuuccuggagaauuuacuaccgagauuugucugguuucuuccuuguggugcagacuagaaguuagauuuaaagguuggauuugauugaaguuagaaaaguguuuuuuuuuuuuuuugcaaagguaaauguugugccccugguguugcauugcaucaggagucacacaaaaaccugauuguccuaaagagcagagguuuuuaacuuggagccuaugggugaguuuuagggaucagugaauccccugaaacugcauguaaaauuaugugucugcacauguguguauuucuagggaaaagcuucugguuuucaucagauucucauaaagacccucaguccucugaaauacaugagagagacugguaggaagcagggugaguggaguuacguuaaccucugaggaugccauugaguauuuauccaugccucagucuggaaauaguggauguuuuguuacuaguucucuggcaaaggcccuacauuuuucuuguucaccuaauuuaugucuguauccguagaggugagcuagucaguguuccagagcuguguucucuacuguaagaucacugugcucuucccacaagggguagggagacaguaugaggagaggcuguuuucuccuuuuauaaucucagcaugaugugaaguuuggucuucuuuaggagagaggcugugcccccggcacauucuuuguauguguguguugcucuuuguggcaaaguacgaaaguuaaguguauccuguccugcccgucuccuuuuccucuacuaguccguagugcgucuuagcacacuaauguguuaggguuuuuccauuuuauggaauuaaaaauuggaggaugugguaggauugguuaaagcaggaugcaggaggagcauuggacuuaaaagcccccaggagccugcaguuucugugcugcugggagagggagcacugguccaugaaaguggcugucacguuaguuugugcuuuugauuguucuuuucuuaguaaagaggauuugacuuugaagagggaccuaaucuugggcucuggcuauuaggucugaagccuagagcugcaguaaauuguuaacagacucucuccugggaucagcuacucuacugcuugggucuccugggaccaaagugucaguaaagacauuuuauagaagggaagaggcuuuaaaaugaaagugacuugaguggugguguuuuuauuuccaaaaugggauuggcuuuuauuucgcuuuuacccugguagcugccacuagagguucugaggcguaauuagggugguacagguggaguguguugaauuucaggagaaagacacagaugucauuucauucccuuacucauaaauuucauuaaaaaguaaaagccccuuuacacuguugguggcaguguacauuaguucaaccauuguggaagacaauguggcgauuccucaaggaucuggaagcagaaauaccauuuuacccagcaaucccauuacuggguauauauccaaaagauuauaaaucauucugcuguaaagacacaugcacauguauguuuguugcagcacuauucacaauagcaaagacuuggaaccaaccuaaauguccaucaaugauagacuggauaaagaaaacguggcacauauacaccauggaauacuaugugcagccaugaaaaaggauaaguucauguccuuugcagggacauggaugaagcuggaaaccaucauucucggcaaacuaacacaggaacagaaaaccaaacaccacauguucucacucauaagugggaguugaacagugagaacacauggacacagggaggggaacaucacacaccauggccuauugaggggugggggcuagaggaagaauagcauuaggagaaauaccugagguagaugauggguugaugggugcagcaaaccaccauggcacguguauaccuacguaacaaaccugcacguucugcacauguaucccagaacuuuaaguauaauaauaaaaaaaaguaaaagcccugcaugaauuaguuaaccucauucaguaacucugaaauacuccagagcacaagaaaauauauuuagccccagcacgguagcuuacgccuuuaaucccagcacuuugggaggccagggugggcagaucaccugaggucaggaguuugagaccagccuggccaacauagugaaacaccccaucccuacugaaaacacaaaaacuggccaggugugguggcgugccccuguaaucccagcugcuagggaggcugagacagaaucgcuugaacccaggaggcggggguuguagugaaccaagauugugccacugcacucuagucugggcaacagagcgagacucugucucaaaagaaaaaaaaaaaaaaaaagaaaauacauucaaugcuugccagcaauuuaccuguuuauuuuucugauguuugucucucuccuaguggcucaccuauauauugacacugccuuuagaauuugggugucguggcuucauuguugcaucugugcuccucuuucccuacuaaauguccuuuaucagggacggagccagcagcauuugcuuguucucagcaaucugagucucuggucuuccuuguucccuguuugggggcuucugcauugccauuuggugguggugguggugguggcagugauguaucuguguuugcuucugucuguuccagcucacuuaaggugugauugcuaagugaaugcugcacccuacuuucaucuugauuuuuaauauauuaaaauaaaaucuuuacuauuguuucucuuuuugaauuaauagguauucaaaauaaacucucagauaaacucucaaauuuucaaaaacauggacauaagaagauaaaggcacaaauggggccaaagaaguccacaauuuguuuuuucuugauuucuguauuaguugaaucuugugcaaugauuauauauucuuaugaaauuauaaaaaaagaauagaggaaaauauuaagaacauuugucagugucaccucuuaaggagaauacaaccuuacaaaacacagguuaaaugguauuaacuggguuucuuaacugauauuuuauaaauucuucuuccuuuugggagaaagcacuacagaccuaccaguuuccucaccccaggugcuaaugugugacaucuuaccgccucuccuggucaccaguccaagugagaggcccccuuuucguuucuccuugaccuucuguguuccaggccuccucuucugguuugaugucccgucugugcugccuggucuccccuccccagcuggaggagugacucucuguagugaucaggacucucuguauuguagguggcagaugccuuuguguuccuugcugaccugccugggccucaacgucuuguuccucacuuugaaugaggguaagaacugccuucaggggccagugguuuuugugaacgaaugugggggaagaacaccuggaugcagccccacccuaugugugggagcugcucuuguugcccuggaguuaguguuccucugugucugcuuggagucagaaacagccuccagagggacgauccaggcugagcugccugcugugaccuugggcagauuauugaacuucccuguuaaggccuaauuuuccuuaccucuagagggaggauaaaaaugacgcuuuccuccuagaguauuugugaggaaugcggcagucuaggcauaauacuuagcacagugccuggcguggaagaggcagccagugcauuguagcugcucucaguauuaucguuguuuccuucuugacuuccugcugaggaugcauugaccuuuuuccauuuugguuuuuaagcugauucaagggucaucuggggacauggcaugaguaaagguacugggaugaggagcugauaagggauuuuugccauaucuguugcuuuucucugguucagcuagugagccuaacgggagcugcugggcagucaccagcagugaggaguggcaugaagccuuugagauagaaguguggacacaugggugucuguuggggucauggguaaugucuucuaugaaccucuuacuacagugcauaccgugacccuacccuauccgugguuggcgcuggcagauggccacauaaaaagccaaaccccucagggugagaauaaagagucugggacagaauguuuggaggagcugggccauuauucauguuuuuguucuuuuacuuaccuuguauuucucaggugucuucuuuguuuccucuggagauagggauugaguagguugaaaauaaauccaguucauauaagaucucauuuucuguuucuuaguuggacucaucuuuaccuguucaaaacuuccuaggauguuugauuuuucuauauaugcucccaaaguaagucaguuccuaugacagauguuuaguaagcauuuauuaugggcccgcugcucuguuagcuuguuguuggggugccauguuacauggaagaaguucuuucuuugaauuuuaucucggcuucgccauuucucaaggcacaaucgucugcaguguccuaaaagcugaacgaaaggcuucuagcuuccuuaguggcccagagguccgagugucaggcaucaggagcuccuggcagucacacuccagcgugagccuccucugugcuagcagcaucuuaaaacguauuaaaagugaggauggggccacagcagugaccaaagggacaaagucccagcccucaagagcuuacuucauuagaggagacaacagacaugccugcaaugugucauguggugauaaggucuaugaggaaugaagcuggguuaagggggcuggagaguaggggugagacacugugucguacagagcuaucagggaaggccugacuggcagagcccuggaggaggugaggaacaagcagugggcgucugggugggccgacuccuggucuuugcuuaccuguguuaccugcaguguuuuugauucugcaggugcaugguacucaguaggugcccugaugauuucagugcccgcccugcugggcuaccuucaggagguuugccgggcacggcugccugauuccgagcugaugcggaggaaguaucauagcgugaggcaggaggaccugcagagaggucgccugucucgucccgaggccguggcugaggugaagagcuugugaguauggaagagaggccagggaggugggggaacaguaacagcagccaugacacuaagugcuagcuuugugugcucgacaucauauuaggcaaaccacagcuguuacuucauuuaaccuuuuuaacaguuccgggagguaguuaauauuaacaucuuccauuuauggguaaagaaaaaggcugacuuacuuagcuagaaaguggccaagcugggaugagaaucucgaucuagcuguuuguuuucacagcuucuguucuuucuuucuuuuuuuuuuugagacagaguuucgcucucguuguccaggcuggagugcagugacgcaaucucggcucacugcaaccuccgccuuccauugguuucaagcgauucuccugccucagccucccaaguagcugggacuacaggcacacaccaccacgcccagcuaauuuuuuguauuuuuaguagagaccggguuucaccauguuugucacgauggucucgaucucuugaccuugugauccgcccgccucggccucccaaaaugcuggaauuacaggcgugagccaccacgccuggcccuguucuuucugcuggagagacaguuuagggucuugacuaagcaugugcauguauaagccacugccuggguucaaaucccagcucuuccauuuacuugcuguguaacauugggcaaguugcuuagccucugugugucucaaguuucucaucuguuaaauggaaugauaacagggcuuacucagaaggugguugugaagauugaacaggugucuuguacuggggaaguguugaguagauauuaguuaucaucacuacacuguggagaaacuucguaaacaugacagagcugguacuucugaggaagcauuuuaagacuugaaaaauauucaucuaacaacuucaguagcaguggacguuuacaccucccuucccuggaguggggucucugcauucucuugaaauagaauaggggcaagaaaaguuauaaacaaacagauggcugggccucaccccagaaauuccgagucaguuaucuggaguggggccuggauauguaguuuuuuuaaaaaagacuuucuuacuuugaaauaguuuuauauauauauacacauauauauauauauauauauauauuuuuuuuuuuuuuugagacagagucuuguuauguaacccaggcugaaaugcaguggcgugaucucggcucacugcaaccucugccuccuguguucaggcgauucucgugccucagccuccagaguagcugggauuacaggcaugugccaccauguccagcuaauuuuuguauuuuuaguagagaugagguuucaucauguuggccaggcuggucucgaacuucagccucaggugaucugccugccuuggccucccaaagugcugggauugcaggcaugagccaccgcacccagccugaaauaguuuuaaacuuaaagaaguacaggaauaauaccaagaaugccuuuuacccagauagaacaauuauuaacauuuugccauguuggcuucgucuaucucucuacauauacauauucuuuucuuuuuccuaaaccauuugaaaguaaguugcaaacgugacuuaauacuucagcguguauuuccuaagaacaaggacauucucuuaaauauccacagagcuguaaucaaaauuaggaaacuuaacguugauaacuaauguauaauucguaaucggauuuuaccaguuguauuaauaaaguucuuuuucuucuuuuauuaauuuuuuuccuuuuuucuuuuuuuuuuuuuacuuuuugagacggaguuuugcucugucauccaggcuggaaugcaguggcaugaucauggcucacugcagccucaaccuccuggacucaagugauccuucugccucagccuccugaguagcugggaccacaggcacaugcaccauacccugcuaauuaaaacaauuuuuuuguagagauagggucucauugucuugcccaggcuggccuugaauuccugggcucuagcaauccuccugcuucagccucccaaagugcugggacuacaggugugagccaguguggguguccuaauaaaguucuuuguaucaguuucccugaucugggauccaauucaggauuauacaucauguuuaauuuuuuuaugucucuuuagucuucuuuaaucuggagcaguuccucaguccuuguuucuugugaccuugacauuuuugaauaguacaagcuuauuauuuuguagaaucucccuaauuuuuggauuguuugguuccuugugaucagauuuagagugugacaagugaugugucauguucaguacauccguaucaggaggcaccugaugucaggaaauacugacuuugaucacuugguuaaggcauccauacuguaaauuaucauuuuacucuucauuaguaguaauuugaggggagauacuuugagacuauguaaauaucuuguuccucaucaaacauuuauccacugcuuuaaaaauccauugaugggucuugccuuaaucaguuuauuacuaugaugguugcaaagaugaucuucuaauuauucuaucgacauuuuuuuagcuggcuuucuacuauaaggaagcucuuucuuacuauuaucaguaugaacucauagauuuauauuuuauuugaugaguuagaaucuauuacuaucauuauuuauuuugaucucaaauuguccuagauuuggccaguaggagcucuuuugaguuggcucuuguuugcauuggucccugucauuuuugaaugcuuccuuuaugguacaacaggauggucaaauucaucuuauacuucccugccccagcccuggaaucagcuuaucuccauguuuccugguuucccuucagaaacccagaucuggguucagauugugcucauggcuucugugguucauccauguuuaaaaaaacaacaaccagaacuccccaagugagucuguuucacaucccagguagagaauaucaugccauuuauucugacagcugcuguguacccgugagguggguccucugauccucauuuuauagauaaagaagccacagcccuggagaauuucaguagccugccugacaucaacaguuagaagaccaaagcaggaacauuuauacuguuuccaccucagcaagaggcuccaaaaaggggacugaaauguagcugggguggcuuagccaggccuguuucucccaugcucucucgacuccucucucuuuaagcacauggugaguguguuuaaagagauugaccaucccuagccaacuguaccugcaaggccccaggcuccacuucccagggcuucuguccugcccacucaccaaagccccugugucuguagcuugauccagcuggaggccuuccugagccgccugugcugcacaugugaagccgccuaccgcgugcugcacugggagaaccccgucguguccucacagugagugaccccuccucucccgccaccacccuauaggaauuugcagcuugagcccgagcaaagccagcugccuugagaggaccucugccccucuuaccucaggggaagagcucgccuccugggcucuuguguguauaucugcacauaugcuugcgggcucuaauguacugcuuuuguuuagaugcuugcuuuuaugugugguaaaaauaauaauagaaaaauaacucaccauauaauccaccaugcagccgaaucucuuguuuguuuugccugcuagaauuugucacaugcaucuacuuuacggauguauaguuucauaguguauguucaauuuuucuuuuguuuuccacuuaucauuauauuaaagaugauuuucuuuguugcuauauagcuuuuggaauuauuuauaauaccagauuaauauagauggcaaauauaauuugugaaaccauucuguuacagauuuagucaauuucccuuuucauuacuaaccccaugguaaacauuuuuauggauuuagcuuuaauguuuuagaaaauuuuucuuggaguaaauucaaggaugaaacuaccauaucaaacagaauggguguuuuugaggcucuuuaauaugaauaauagugauaacuaauguuuguuguguucaccuggugccaggcacugcucaacacucccucuguauuaucucacucuuauaguaacucuauuagguaggcgcuacuucaguccccaucuuacacgggaagggagcugugcccagagaaccaagagacuucucagaaugagaaguggcagagcuggauucaaaucccagucugucuuacucuagacuucagagucuagaccuuaaggagugaugaugguugaaccaguuuaugugccaccagcugacaccacuuuggccucaccagcaucagguguuugcaccggugacuugggauaguucucagucuucaucgccauuuuccgcugguuugaugagcggcucuugucaguuuauuaaugugcccagagcugugucucaccuggacccugcugugggugugcuccaaacccgucuccuucugcuguuacgaauuucugaucuugugguucuucccugucauccagguucuauggggcucuucugggcacagucugcaugcuguauuugcugccacucugcuggguucucacccuuuuaaacagcacgcucuuucuggggaauguggaguucuuccgagguaagcccugaagggccugaaagauggggcccaagcuggcucugagggcuaggcuaggcuccccaguucuucugucucuacagcuaaucaucaguuugcugugcuuccacaagugcaacaccacacugggguccucucucaugggcucugcaucucugagauguuagaugaagcuggaaucucaccaggggaggcugcuaccauugggcucccaucucccuucgcucccuucccaaggcagaugaaucacugcuuauaugauaugauggcuucuggaagaugagggaaggauguuuuucccaaagcugccacccauccccuggggugcagccaccuggaguugcuaccacaucucugugugaucccagaauaccccucuguugucuggcuucuaaagcgcugaggcagucuggagaggcacugagucgcagaggcccgagucuguacauauguuugggugauugcuguauuuguuuuccucccugugguagaguuauuuauuacagaagccaugauuuauugagcauuuacuacauuuaaucucuguagcugucuggggcagguggugguaucuaaguuuuguuuaagaggcuuaaguuaggugacucgcucagaguuaggagggugacucuuuccuguagugaagggaagagaggccagccagcugcagaaguggguaccccuaaagugccacucacggugucucauuuuugccuccuaccuuguucuccauucccuggguaguugugucugaguacagggcaucucugcagcagaggaugaacccaaagcaggaagagcaugccuuugagaguccuccaccaccagauguuggggggaaggauggucugauggacagcacgccugcccucacacccacggagguaagugccacugucagggcagagccugcuguggccgcuugugggccccccuguuaucagcuuguuuuuggcuccugggcuggccucuguuguaguuccugcuauuucccaggccuuaacuccccugaaguguucaauaauaauaauuguaauaaaaacagcuacuccaugcuucacugagugcuuacccugugucagaugcugcuccaagugcuuuauagauagauauucacaucauggagugcagguucuuucuuuccuuuucuuuuuuuuuuuuccuuuuuuuuugagauaaggccucccucugucacccaggcuagagggcaguggggcaaucacagcucacuacaaccuccaucuccugggcucaggcaguccucccaccucagccucuuggguagcugggacugcaggcaggugccaccacgcccagcuaauuuuuuuguauuuuuaguaaagaugagguuuugccauguugcccaggcuggucucaaacuccugggcucaagugaugugccugccucggccucccaaagugcugggauuacaggcgugagccacugcaccaggcugguuauuucugagaaagagaucauucucauuuguggaagagaaggcugaggcacagaguggcugguaaguggcagggcugggucuaagaccccagcccugugguucuagagcucgugccuucaaccacugugcgauguggccacuguagggccagcugugcucguguuuccaucucccccgcccugccaggcuagagguugcuccuuccugugaguuccuucuuucuugccauugugccauuucgugguguuuuggguagccuggaugcuggcuuggggaggugguccucugccuuagggagcagcgcugccauccuucuccuucugucauagagucucucuucccaggaccucacaccgggcagcguggaggaggcugaggaggcugagccagaugaagaguuuaaagaugcgauugagguggguggcccuuccccagcauccucuacucagcaggccagaaauugggugguccuggagcuguuuuuuguuuuuguuuuuuaauguccaagugagaagcuaaaacuugcugugagcuagaacucacugguugaaagagugccacugaaccccuccccacuccuguuucugguugagccagcuguccugggugcccagggcaagaguggcucuggaagucuccggguaaugcccugcuaggggagcuggacgauuucuggccuuugcuggagaccgugggcuuggugccuuugauauaggaaaggcagcuuuugaggaggcuacugcccugggucuccgcucuucugcagagugaguuccguaagaugucccuuugcggggcugggaggggagguuggagaaaguaguugcauggccaagugcuaggucagaggaaguuaaacagcuuucuugauuuuaggaugguaauucaaauugguaguuugcagaaguguuuuauuuggcaugcaaaguuucaaaauaauuuuuugagccaauguuuaaauauggagagauuuuuauuagaacugcagguuuccaguuucucugguaguccugagucugcagcaguagguguagcuaaggagcugcuguccccuuuacgcaggucacaugcuguggcuacaggugguccucaacacccccugcuguauuuugucacugaggucaagugggaguugccauuugucacauuugcguuuuuguuuuucuuagaguaggauaucauuucucuuuauuuauuucucuuuguaaagugggaaauugagauauaagaaaaacaccucguggauuuccaccaggccugugauuuaccccaacucaccucaaucauacaucagcccaggccaugcaggcauuugacuuucugauggcuaaaagauugcuccaaaacuuugauauaugauuguagaccgugaaucuugguggagggaauauguagagcagggguuuucaagcauuuuuguucaugacccauaguaaggaacacauuuugcaucuugacccaggucacacuuaggucuauaaaauauguaaaacuuaagugaaacaaaaguuuccggaaaauacguuguaagggauauuuucuuuccuuuucuguucuauucaaauaaagaccuacuaaauuauuuucacccaguuugagaaacuguaguaccuagcuuucuccaaggcuguuugaugcugggauccucuuguggggggcgucugucaaugucaccauuugggaagugcgcagagcucagagcagcgcuuccaugcuuccuucugcuugggggccccuccagguagcuucuuucuucuugcuaucuuuuucuuucuguuuucucuccucuuccccgcaccuugggaggcaggagacccacuugguggugcugguaaguggaagccuuggugggugggcaggggcugggcuggggaggguggcugaaccggcugcugccacaccucgugggggcugccgcgcaggaugccucugcacacggguccugcagccuugcaagaggugggcaggacuggaaggagcuguucccacaggaggaugaugagggcgccccgugcccagcagaggaugagcuggcccugcaggacaacggguuccugagcaagaaugaggugcugcgcagcaaggugucucggcucacggagcggcuccgcaagcgcuaccccaccaacaacuucggugcggccaggggacagggcugggcuggugggggaguggggguggacuucugggacucuaguggggaacacccagccacaggggcagagucucagaacuguggguacugacuugugacaagagcagggagugaagguguguccgcgggaccccggggagcuagcagaugcccggcaggacugcugagggaguggguguggguuccuucuugucccuccauccugauuggacauucaguugugggaagacaaggaacucaguuugggaaaugccaucccaggacuguagagaaccauaauccugacagaacuucagaaggcaguguagcaugauggugaggaacagaguagagucucacugccugcugcaaaucccagcucagccagguguccuugagcaaauuauuucacaccccgugccucaguuuccccuucuguaaaagggggaucaucauucuuaccucauaggguuguuacaggucucaugucaaaugagacaguaguacuuacgaagggcuagcacagugcugguugguucauaguaaguagugggugcgguuaaugugggaggcccugacccacgcuguggguuccuaggauccugucuuggucuuucuuauccagcuggaagcaaguugaagcaaacauuguuucucuggacgugauagagcccugaguucaccucuccccagccaguccuuauuuuacugagggucgggggagagcggucaaggaaggcagcuuuggagaaggguggacuugacagcacagcuuagagaccuggcucagaucagcagcgcugagagcugagccacauacaauuaugguggaaaccuagaguagcuagguugaccugggagcugcugugcuccugaggaagggcccuccugccugcugucagaugggagcaggguaagggggcaguacuguguguucugguguugagugaguucuagggucugugcccuggaagaagacaauggaguuuaucuugaggaauuugacucagggcccccaggguccugccuuccuaccccugcagcagccagggcaguuguuuucucaggauuagauguccuggacaggcucuuucuuucugcugugugaaugucccccaguuauucaagaucccuuuuuuuuuuuuuuuuugagacaaggucucacugugucucccaggcuggagugcaguggcaugaucacagcucacugcauccucgacuuccugggcucaagugauccucacagcucagccucccgaguagcugggacuacaggcauguagcaccaugccuggcuaauuuuugaauuuuuuuuguagagacagggucuuacuuuguuccucaggcuggucuugaacucuuggguuuaagugauucuuguaccuuggucuuccaaaguguuaggauuacaagugugagccaccacgcccggccccuuuguuuuauuuaugcugccugcugacuucugcagggcauucuguauguucagugaucuguuuacccuccauacuugcacaugugugaucucauuucauccuuaccguaggugugacaggagcaggcaguucuuaaggguucagagcagccagauuccagcagugcccgguaacacuacacacaagaaguauuacucugguccagcaaauaauuugucuauuucuacaacuucuaaguaaagguacuuagcuguucccauuuuacagaugaauaaccugagguaaaaagagugcuuugcccagagacuuuggccuggaaaugguggagcugugacucaaauucagguugucugauucggcucuugucuucuuucuaccucuucauccucccucucuguuuucccuuugcccuugcgugugaagucccuuguuuuaugccugucccgcuuuuguauuugauuuuugguuuggauaaucucuaccagcaugggcagaggccuuuucagccucccucaaggauggcaagggcagaaagugcuucuuuuccuaaacuccucuuaguuccucauccuucaagaccacuugcuacuuucccuuuucugagauguucccaagcucuuugccaugagggcagguguagcagcucugcuccugcggccucugcuccugaaccuggguccugagagcagggcgaggggagcugcuuugggggcuuucuccauuucagcgacuauaacgaaauacacuaagcuggggggcuuuuaaauaauggaaaucucucaucacaguucuggaggcuggaaguccaagaucagggugucagcaggaucagguucuggugagguccauuuccgucgucauagacagcaccuucucacuguguccucaugagaaggugggaggggcacggcaguucucuggggccucuuuuauaagggcacuaaucccauucacgagggcuccacccucaugacccggucaccucccaggggcccugcuuuggguguuaggauuccacaugugaauguuaggggacuguggugggggcuauucuauuuaccccugccaguggaugagggggugcauggggagaaugagggcagacugcaaaggagcuucucuguggccuccguaugggagaggucuugguggggagggccccccuuuguccuggaggcuccaugacuguugcccuggcaggccccacugggccuuagugccccugcugucauggccucgguggcaucgucacguggugagugaggaugggugaguccaggcuguugcugagaaggggcagaaagaguugguagguguuggaagggaacgucaccuggcugagcugcucucagcucccagagcccucccuggcuccggucugugaguggguucacagcugucuccccagcccacuuggcugcccuggggugcuuggcccugacauuccauucaguuuagaggagaccuugggcucaggucagugucagucuuugaguagcuccuuuugccugucccauuccccuugugucccuugcuaaggagaggcuggggcaggcugccuuccccaaauucuugguguagggacagaaucuuggagcagccaguuuccugguuuggcaccagcaguaggcuuguucuucucuuucccuggcugacugacagggugggcauuuaccugaagcaccuuggccucagauuuccccuggcucuagcagaggucuuccuuucccugaaccuagggagucuccuuuagcaagaacuucaggugauuuuggcuggacagaggaagggaccacauguagccgucaauaaagcuuuggggccuuucugugaaagugaggccuggugcucuguacuugcccagacaggugguccggcugggucauagcaggccuaugggccccacaucccagaaaccucauucucugucucuccucuccccuuacacccccuuguugucuucuagccauuuucuaagcugccguugccccuccacuguugccgggcacuuggccaucuuggcaucucuggugguuuaggcaggaccucucccugcucugcguccccccaugccacucacugcccaccacaauugagcauucuacccuucgugucuuuacaguugagcauucuacccuucaugucuucuuggaaugugccuggcucugaguuucucuccugcagucuucaggggacagaaagcaggaguuuagguuuuuaggaguuucugucuuuagccuguggguggaguauuuguaaggcauugcuccggaaagggucauguuaggcaggugucauuuggggaugccuguggucaggucccugccagcuuagcuggcuuucuuggaguggauucugcugggugcucuuugauuucuguugaaccuguagguagggccacucagcucuggaaggguucagggacugguagcuauguauggcuggagacaucaguccucaggggcuaucagucuucuuaguuugaguccuucuuucugucucugaaucuggccuugcucccuggcucacuguguccagccaaggaggcugggcugguguccugagugucccauuuagaagcgccaggagcaggugagcgugagaguccugggaugggcggggguugagcugcugccucuguuucucagggaacugcacgggcugcucggccaccuucucagugcugaagaagagggugagugucugugagggugcauuuguuggggacaguguccuugggacugucggguggggaggaguugaggggagucauugagaaagucuggcucgggucacauugggccuggcaguggcuuucuggagugagugugcccuccccugcgccugugccaccuuuuaccagccuccccaggggguauuccauuugcucucuuuccugcuccacuugggcaccccccaggcccaguuuccuugggugggaucagcugguggaaaggagggaggugcugagaacuccagguaccugagggugagggacacaucugaccuuggcucuugucugcagcggagcugcaguaauuguggaaacagcuucugcucucgaugcugcuccuucaaggugcccaaguccuccaugggggccacaggugaguggugcagguggugggagggcuugguugguaucccgcccaggggaugucacgcuguggcacagaggcaagggugucagaggucaagggaacuugggauuguagucaggccuacgggaacguuuccuccauccccuuuagcaaaauccugaaacauuugguacaugccgaagaauagauaugauguaccugugaauugugaaggguaauaacaagaugaauaccuguggcugcuucacuaaaguugaaaaacaagagcccuggcaacacccccgcagcucccagcacugcuccugccuuccuggagucaaucaccagccgcaauuuuaaucuuuuucuuauuuccuuggcacuuugaacaaaacuaaaaauuccuuuuuuuccuuuuauaaaauauaaaauauuuccuauacauauuguaaauaaaaaacacagauaagcaaaaggaaaaaaaauuccugauuucuuccugagagaacaaucgggcauggacccugcugcucauuagcuugcauguagaauaaaagcacaugcauauuccugaaaaauguggucacauuucauguaccguuuuguaguauaauguuaaaccaaguuuuuuuuuuuuuuuuuuugagacggaguuucacucuuguugcccaggcuggagugcagugguacggccuuggcucaccacaaccucugccuccuggguucaagcaauucuccugccucagccucccgaguagcugggauuacaggcaugcgccaccacacccggcuaauuuuguauuuuaguagagacgggguuucuccauguuggucaggcugguuuugaacuccugaccucaggugaucugcccgccucggccucccaaagugcugggauuacaggcgugagccaccgcccccagcccaaguucuuuuuucuuccgaugcaaguaacauaugcuuacuaacuagaaaauuuggaaauuauuauacagaggacgaaggaagagaaaaauaacccuguaauuuuaccacccagagguaaccacuguuaaaacauuuugggaaauuucacugugauauuuuacuuauucuguuuuuuugagacagagucucgcucugucgcccagccuggagugcaguggcgccaucucggcucacugcaaccuccgccucuuggguucaaacaauucuugugcuucagccuccugaguagcugggauuacaggcgugcaucaccaugccuggcuaauuuuuguauuuaauauuuuauuuaaaaauuuuugaagguguucuguuggugccacaauaaugucuaauucauagcacaggaguggccugcuguuggcaucaucacccccaggauccccaguucccauggaaagaagaaucucugcgggcaggcuagcaagcugggcagggagggugugggcuggguggggggucuguguggggcauuugggagggugcuucuaguaguuggggccaugaaccaaagggcgcaaggaaaugucucaccaaguucuuccuccuuuucagccccugaagcccagagggagacuguguuugugugugccucguguaaccagaccuugagcaagugagaagagaggccaggguccaaccaggcacccguccuugggaccagcaguagaccccccacucuccccaccccuggcccacuguggugugugcugggcaaauguggccugaaugcuagguaggcuuccccuuccuuccucacucucuccagcuggauucuggagcuguucuccauccaugagaguggcuggcaauggcugcucucaaucccuugagggagaagagccccuggagggccuggcauguuuguccugcucugccugggacugagcgaguggacuuagggcugggcaggcaguagccaccagagggcagcagcgaacuaggccaggccugacuggggucugaagaucagggucaguguggcugugccugggaauuccagaccugagguugggaaaagagguuuuucuccugcaggguacugggccaggcccucagccucagagagccugcagaagggcuugggagugccacaccccaucucugcugauugaaugucccuccaggcaccaggaucucaucauuuccccaucagaggguguggccaggccuaacaagaccaugggugcuucuagaaacaggguugaaguucccagauucccugagaggagaauguguauaggaggguuuggcugaguccuucagcguuaaguggaggaaagcuuggggaagccccaauagcuggacagaccucggccuccccucgaagacaccucaauucacagacucucagcccacacaaugccccaguguccccagcuccgcuggagcagcugcagggcacuuggaucacaacuucugcacccucuguccagagucuagggcaguccuccacuggcccagcacuccaguuuccuuucccugccucuuguccaauggagugggaggccaggugaguggagcagagguccugaagcccuugaccccugggggccuggguaguguaggaucucgcugggcuggguccuggauuccagggcuauucccuggaggacagucucaguuaugggauaaggcccccugggggucuccauuucuuuccaacaguuucauguucacuacuggacucuuacgggcucaguaucucucccuuagccaugagcuggcucaggcaucccuucccuucccuggagcugcccugccuuucucaaguauuuauuuauuuauugcaugguuccugggaacauguggcacaaguaaugggaugaggaggaauugggggugggggucuucuaccuaggacucuucccuggagucaugggcugccugggacccaggacccaugagggggcugagagguuucuacacucgaggagcagggguccagagaggcaggcuggggaggcaagggacccauccuaggcccgcuuucuugccgagccaagcagcuuagcuggggcugugcagccaggggcuuacccaggccaguggaggugccacagcccuggggagccagacaggcuuugguaucguaucgccucuguguccuuuuaagagaggagaguucaguaccccgugcuuucuuuacacuggagaggaacuaaaaggaucucugugucuauggagaauugucaauaaaaaggccucaagcuucuuguuuuugucaugucuuuguguuggcauuuucccugaggcuggaagaccagaucucucuggcacugcuggaguuuugcaggccugggcaauuccugcaggaccaggcugaggggcgggccuuuggggcaccaugguggcaggggcgugggggcugcagccuggucuggguaugagcugggggccaagaggaggaaagcugugccuugcacgcaggagaggcucagcaaaugcuugucggauugacuugaggcccagucuugugacccaauugugagggcccagcacuggggguugggguugggacuagaacuugguaaaccccaaacaaugcaggcuuuacaacggaaagauuuuaacuaaucccucugagaaagccagaaagggucagccuucagggaggcugagagcagcaggaaagaggauuggacaugagaugggaagugcaagccaugcccugagcuggggcaggugggugguggguggcugggugcugggcacuggugagggcuuugcgugcaguaucucauuuauugcucacagcaacucugagguaggcacuguuccccugaaguaggagcagagucccugcagcaguagaggguggugccuggcgccugcuguggcccaccuccaugcuuggaccccuuuaccaucuguuggagcggugcuggggcccauuggcauagggaugcugcccccaggcucacugugcuuuccuccucuggaaagugcaccugauggugaugcauagcuugugcgggugcugugagagaaaugagagagucgacgggaggcauggggcccggugccuggcaugcuggacacgcuggcuccugucauccuggccaccuucagaggacaaacagcucuguccuggguggcuuagaacagugauuuauuuuuuuuaaaccagaguguaauuuuagaugauucuucagagaagaguaucagagaggcacaaguguaguuuggaaaagcagucaaugcauuuuauuuuuggaaaaugaaaaugccaaauguuggugaaaucucaaccauaacagcaguaacuugaagucugugccugcaggcauggauuacagagaugggagaagcaugaguuuccauccuuggguaacagccuccgagaaggggaugcuagagggccuuguccccuugaggugccccugagaguaggcaggggacauaacuuuaaauugcagguaccgcugggaagcgaagucacggagggauugugcuucacaacuggcugcguccacagcauggagaggaccugcacguggguggccuacaagacaaacuguccauguuugaaaaaaaaaccaauuuguucucaggccccugaggaggggauggggaaccagacugcugcagcccucgugccugcuggggcaggucuggggcuccagcucccacagccuggcgugggcugagggcucugccaauccuuuuugugguugguuguguugagcagccucccgugagccauggccgaccuugagcuggcagugguuucugggaucuucaggauuuucagcccucggggcugaagccauaugaaguucugucuucauccccuugucucccuggaaccuuugaggcacccccuaagagaggcccuggcccagcaucugucuuacagcugguggcccucaggauaacaccuacauugauggagcaccugugccaggcaccaugcugagugcaucaucucaucgagaccucaugacaaucuccaaaaguagguucuguuguuaacucuguuuaacugacgaguaaaaggagguguggggagguuagggaaccugcccaaggucacauagcuaguaagucguggagccgggaugugaauuaugccacaugagcuugcaggggccucauaagagaaccuuuggaggaacagagcaauccugggugccacccucccccucuuucugccuggcccccacuggcuccaggagcuagccacugagcuaacaagaaggccuacccacuaagcauggccucucuccucuccucccucccacccccagcccuagcgaaaugggcucagccacaagaacagaggcagccuuguggccggagcucccccagcucccagcaaccccaccuccggccuggucggguauguuucaacaccccagagcagcacauuccauucucuggcacagcugggggcuggggauuccggauuccccuggcugccuguguucuucacagccccagcagagccugcugucugggcugggacauggggucccagccacacacauuccagcagcaaccacccccccauguuacauuuccccaggagugaacuucagccaggauuacaggcgacuaaacaguugugggaugugagcuuccuuuguggagaccuaaggcuggaugcuggcagggcugagaggggagaagggguugggggugggcugucuuugggaauuaggagaaaagccacuggcuccucugccucugucaggacccuuggagugggauuggaacagggcucccagaaaucuuccugugaggcaggcuggcagaagcauggcugccugcaccccugagccuuggcuuugccccuaccgauaguaguauagugguuaagagcaugaagucaaauucuagcacugccaugugcaagcugugugaccuccaacaaguuccuuaaccucuuugagccucagccaccaucacugaaaugccacuaccucaaauggcuguugggaggcuuaaauuagaaugcaaaagcugggugaggcacaguggcucaugccuguaaucccagcacuuugggaggacaaggagggaggauugcuuguguccaggaguuugagagcagccugggcaacauaaugagacuucaacucuaagaaaaauaagagauuagccgggcauaguggcaugcuccuguggucccagcuacuugggaggcugaggcagugggauugcuugagccuggcagguugagacugcagugagccacgauuguaauacuguguuuagcccaggcaaaaaaaaaaaaaaaaagaaaaaaaaaaaagaaaaaagagaaaagaucauaugcaaaaguuuugaguagugccugccacccaucauggccuugauauuuauugauauuggcuugauacuggcuuacaccaccaccuguauuucugaagcaaaaccccaaauguagguucuagcucucuucugaaaguagcguucuggcuuuuagauaagauacucuugucuuuucccugccuuccugccgauauuguuucuuaguugauuaaucaaucaauuaggaauuuuacugagcaccuauuauggacaggcacugcuaggucauggcuuuugguuaauaaaaauagucauuaccauuuaauggacaucuacaugcugugcguuguacuuuucaugcauuuucccacuuaacccucagcaacccugugaaauagacauuuuuacuccauuuuacagcugggcacuauucccgaugucacgcagucacuaagucacaggauuagaagccaggacuggacuguaucugccucuucucaccccaacacggaguguucagcugccuccuccccugucuguccuguucuuuauuagaacucugauuuuguccccagcugaaaaagcuugacuuccuuugcugucuugcaccuagggguggccaugugacuuaguuuuggccagugagcuagaaguggaaaucuacuaggugggauugcuggggaaauuucuguuuuccugaucaaaggggccagaggcagcugacaagcugugcuccucgcccuuccccgccuugcugucuggaaugugguggagaaguuggaaggaggcauugucuauaaccacgagagcaaacgucaccccauggcagagcaggaaggcaguuggacauagaccucccaccuguccaccuccaccccucuuguguggagaagcugggguuucgguuccugggguuucuguuaugugugguugggggccgcaucguucacugcacccaggugcucuuggggcagcacagcugcugggucuccagccagcgggagggagucuugugugacugaagggaaugaaggguggggcucaagccuggaaggaccucccuggucuuugggaagauucuucuuggucccagaaaagagauucuuggcgagucugacagcagauguugggggacagcagauguuucaagcugggcccugaccccuuguggggguagaggagugccuuccugggcuucacgggaugggcuaagggaguccuccccucgcccugcugccccacagcugccagcaucuggcagaagucaguguaguacuucagccagggcagacccaguccugugugugccauggaaaaucaucccugguccugguugaccacagaaguguccguaaacauuuggucaggguaggaggcugggagacaaggcgcagauucagggagccaggugcacugggcaggguuugggcgcggaugggugagggaggagcaaggcggccugugcagcuguugaccugcggcgaggccaccugccugcccggggugauuuaugggcgcgcugucggaccaccugcuagccagaccucaggcgaaugugcgcucauggcccacagaagaacucagccccuggccccucuggagucauuucccugaggugacguucaccucugggagcggaagccaaggcuuuccucaguuccagagaaugaggcuccuuugucuuggaggaacaccaggccuugacuggacagcaucccagcuuuacccccaccgguggggagagccccucagggggugccccuagcccccugcucuagguacaucuggcaucugcugacagacccccccagggagcuccuuccuggcacugcccuguccauagucugcccauuagaguggggguggcuucucgccucccaagcugucuccccucccuguccaucuaccucaaggcagcagcccccaucugcucugagcccacuggggcacccccucagccccuugcccucucccugucucaguugucaccuuaucuagauaguaguucucaauccuggcuacacaucaccccagggagcaucuaaaaacaccaacuccugaacacccuauagagauucugauuuaauugcauuagaguagggugcaggauucuauaaaagcucccuagaugauucuaauguuuauguguucaaaugcagauucagauacagcaggucugcauuucuuuguuguuguuguugaguuagggucucacuguguugcccaggcuggucuugaacuccugggcuuaagggauccucccgcuucagccucccaagcugcuggaauuaugggcaugagcgaccgcacccccggccagaugcugucuuucuaaccagcucccaggugaugcucaugcugcuggaccagggacagguaaggagcagugcccgcggugugugaaagccgaaggggaggagugacacgucuucggccucaggcuuuucacgauaguucccuguggccccaccuucuuggacuccucugaucaggcccugaccuccucggggagcugcugcaggaccaugggagucuucugacugugggagaagcugggaacuuggcaccuccauuccuccucagggacaaaagaacggccaucuccaucccucacuuagcggucagaaugacagggugacccuugcuauguacuacaaaaacacaggccuugcuuuucuuaggcauuccaaggaggucuauguggccaggccauggguuaagauaagggcuucuuuuugaagcuccauucuaaaccucccucuccccccaccucuugggaaccagcugacaaagaaaccaccugguccaaaccaguuauuguuuucuuugauuuaauuaaaaaguuaaaaaaauuagaaaacccaacccugcauguauugguugucuaguaccuauggccucacagcaguagcaauaacuuauugggauaaaagggagaagcagaggcugaggaaugaaucccgggaaucgagccgcgggcggaccagaagggggucuaugccgaggcugggcugggcuugcucuccagucuggggggagcucugggccuuggggcagggaaaugggcaagcuggggaaggcaggggguguggcuggaggcacugagacccuaacuccuuuccuaaggggggcuaggaugacgcguacaggggcgguggggagaacuuucccaaauagcuuagccuaauauugagacuucccucuucaaggugaggccccaccaccgacagaggggagcuggagcugacaccaccuucuacucugaaaccuccgccucagggugcccugagccccuccaccuuucccuuacccucuccuccccugccuacuuucugagacccugaggucuucacccagaugaagaagcccugcuccugagagaggaagcccaacaucccagggaccccaggaccccugggucaaaaaggacagccugggcuccgugcccaucccuuaggccuugugccaguaacaacauucgugaaaacacccuccaguagggccgggucagccuggaaguuggggcggggccagagggcaagcaaggcacagcuggcagggcaaggaggagugcccuucaguggggcucugccgccccguagaagaaaggguaguagagg

SEQ ID NO: 18831 - RNA, 11541 nt, Homo sapiens
uuuugguggacaguuaaucgucgcuuucaagggaggcacaagguuuuauugcugaaguuuucauugccuugcucugugaacucuuuuagugccaguguuugaugaaugguuguuuucauggcugccaagagcuguugaguaagaauguaacugcagacagucauuuccuugcuguguuuguccaacaaccacugucucacagcuggaaaacucauuacucaugaguacuucuuucccagguacaagaacauaaagauguauuuauugaacacuuuuuagggcaaugacacugaacuguuaauccaaaaauauacacuggucaaacgauaagcuuaaauacuagagaaaauccaaauauuaaggagacuuuaaagauacauaccagucaaauauuucuuucauuugucuauucauuuuuucuuucuuuuuuuguuuuguugcaucuauucauuuuaaaaauggaaaccuaauucauauaccauaauauuucacauaauaugacauaaaaauucccaguuuuauuuuuauuuauuuauuuagagacagagucuugcucuguuguccaggcuggagugcaguggugcgauuucagcucacugcaaccuccgccucucggguucaauagauucuccugccucagccucccgaguagcugggauuacaggcacccaccaccaugccaggcuaauuuuuguauuuuucauagagauggaguuucaucauguuggccaggccguucuugaacuccugaccucaggugauccaccugccucagcuuuccaaagugcugggauuacaggcgugagccauugcaccuggccaaaaauuccuaguuuuaaaguguacaauucagugguuuucaguauauucagaagguuguauaaccaucaccaccaucuaauucgaggacauuuccaucaccccaaagagaaacccuguaccuguuagcagucacucccaguuccucccuccuuccagucucuggcaaccacuaauuuacucugucucuauagauuugcauauucuggcugggugcgguggcucgugccuuaaucccagcacuuugggaggcugaggugggaagaucaccugaggucaggaguucaagaccagccuggccaacauggugaaaccccaucucuaguaaaaauacaaaaaaauuagccaggugugguggcgggcgccugguaaucuuagcuacucaggaggcugaggcaggagaaucacuugaacccaggaggcagagguugcaguaagccaagaucgugccacugcacuccagccugggugacagagagagacucugccucaaaaaaaaaaaaaaaaaaaaaaaaagauuuguuuauucuggacauuuuacauaaauggaauaguauguggcuuuuaugucugguuucuuucacuuagcacaauguuuucaagguucauucauguuguagcauguauuaauaacucauuucuuuuuuugucuuccaauaugaucucaagacucauuuuuuauggugaauaauauuccagugaacggauagaauauauuuuguuuauaucauucacuaauuuuuaauuuuuuuuuuuuuuuuuugagacagagucuugcucugucgcccaggcuggaaugcaguggcgcgaucucagcucacugcaagcuccgccucccggguucaugccauucuccuuccucagccacccgaguagcugggacuacaggcgcccaccacuaugcccagcuaauuuuuuguauuuuuaguagagacgggguuucacugcauuagccaggauggucucaauuuccugaccucgugauccacccaccucagccucccaaagugcugggauuacaggcgugagccaccgugcccggcuuuaauuuuuuuuuuuuuuuuugagacagaguuucccucugucaccuaggcuggagugcaauggcgcgaucucagcucacugcaaccuccgcuuuccaggcucaagcgauucucgugccuuagccuccugaguagcugagauuacaggcaagcgccaccaugccugguuaauuuuuguauuuuuaguagaaaugggguuucgccaugucagccaggcuggucuugaacuccuggccucaagugauccgcaggccuuugucucccagagugcugggauuagaggcgugagccacaccgcccagccucuuaaaauuuuuuuaauuguaguaacauacacauaacauaaaauugaccauuuucaaguguacaguucgaugguauuaaguccauucauguuguuaaacaacauggucuauacuggcuguugugcaaccaucaccaccauccaucuccauggcucuucucaucuugcaaaacuaccacccugaaccaugaaacaauaacuccccauuuccuccuccccacagccccuggcaaccaccauucuacuuucagucucugaauuugacuacgcuagguacuucauagaaguggaaucauacaguacuuaucuuuuugucacuagcuuauuucauuuagcauaauguauucaagggucauccaugcuguagcaugugucagaauguccuucauuuuuaaggcugaacaauguuccaucuucuguuuauaccgcauuuuguuuauccauucauccacugauggacaccuggguugcuuccaccuuuuggcuauugugaauaaucugcgaaugaacauggguguacaaauaucucuuugagaccuugcuuuaaauucuuuuggguauauacucagaaguggaauugcuggaucaaaugguaauucuauuuuuuaauuuuuaaggaacugccacaaugcuuucuauaccauuuuacauuuucauugacagugcacaaggguuccgauuucuccacauccccaacuucuauuuuuuuuuuaagacggagucucacucugucguccgggcuggagugcaguggcacugcaaccuucugccucccagguucaagcuuucuccugccucagccuccugaguagcugggauuacaggcaugcgccaccaugaccagcuaauuuuuguacuuuuaguagagacgagcuuucaccauguuggucaggcuggucucgaacuccugaccucaugauccacccgccucagccucccagagugcugggauuacaggcaugagccaccaugcccagcccccacuaacuucuuauuuuccauguuauuuauucauuuuuaaacaagcauucauugaguaccuacuaugccacagcucuauacuugguagaaacugaggcugccaaaauguuaaaucuguuucccugcucuuagaacuuaggaaacaauggagaaacagucauguucaagagauagagugaaaugcaaggugauaggugccuaauagagauggaaucaaugguagauuggauaaagaaaaugugguacaggccggaugcuguggcucacgcuuguaauccuaacacuuugggaggcccaggcagguggauagucugagcccaggcguucgagaccagccugagaaacauggugaaaucccggcucuacaaaaaaaauacaaguauuagcugggcuuguugacgcgugccuguaaucccagcuaccugggagacugaggugggaggauccccugagcccaaggaggugaaggcugcagugaaccaugauggugccacuguacuccagccugggugacagagugagacccugucucaaaaaaaaaaaaaaaaaaaagaagaagaagaagaagaagaaaauaugguacauauauaccaaggccguaaaaagaacgagaucauagccuuugcggcaacauggauggagcuggaggccauuauccuaagugagcuaacacaggagcagaaaaccaaacacugcauguucuuauagaugggagcuaaauacugaauacccacggacacaaagaagggaacagacaccagggagacaccagggccuacuggaggauggaaaguugaaggaggcuaaggauugaaaaacuaccuauaaauacacagauacuaugccuguuaacuggaugacaaaauaauauggacacugaauccccaugacauggaauuuaucuauggaaccaaccugcacauguaccccuaaaacaaaaauaaaaguuaaaaaaaaaaaagagagagagauggaggcugggcgugguggcucgcgccuguaaucucagcacuuugggaggcugagguggguggaucacccgaggucaggaguucgagaccagccuagccaacauggugaaaccccaucucuacuaaaaauacaaaaauagucgggcaugguggcgggcgccuguaaucccagcuaccugggaggcugaggcuggagaaucacuugaacccaggaggcagagguugcagugagucgagaucaugccacugcucuccagccugggcgacagaguuauacuccauuucaacaacaacaacaacaaaaagaaaaaaaaaagaaaaaaagaaaacggcgugugauuucugaggaugcaucagaagagacuuuuggcuuccuuccuggcucccugguggaucucuuguucuggguuaaggcauccgccaugucaggaggacacucaagaagcguucaggagagccccgagggaggaccuggcaccuucugccaucuugucacuauuggagagugccagcaucaccuugucagcugugugaggaagccacccugggagccgauccuccagccccacuaagccuucagaugauugcagccuugaccaacaugugacugcaaccuuaugaaagcgccugagccaaaaccaucaccaagcugcucuugauuuucugacuaaaaacacccagaacccaaaaaacugugagauaauacaugcuuauuguuguuuuaaguaauuaaguuuugaaauacuucauuacacagcaagagauaacuaaugcagcuagaagcaugaaaauaucuggcauaguguggaaauggcgagaaaugcauugaggcuggcacgagagguuaaagccagaaacuuggaguugaaagagaugcuucugaaaugccauguuucuccauaagagugggcaagggagccaucugguggaggaggcaugcuuagacauucccuucucucuucccugauuucuccagccuguucuccucagcauuuccaccuaguauuucuccaagggccacagugagguuuaugagucaaguaugugggccauaaacacacuugcuuauugaagcaaauacuaaccucugcaaaaugucaagguaagauauuaucuucagugauuauuuaauuuucucccuuagucucuucuaccugucugcuaccaaggggaaaacaucagcagcaccaggaguugaggcagaaugcugcaggagggaaagaaggaacuagaacuugauuauggaaaaaucagaauuagacucgagagagcacagucaagcugguccgucucuuaauuauaaggggaggccuuuauucaucgcuacaggccacgacuauugucccuuucugguuuuuaaagccuucuuguauccuccaauguucccuccagauaaugucuagaaauucuugaauaauaucucucaauucuauagcugcuggaagagaaaacaaauacuauuacucuccacugucagacugaggccaaggaggaggaauugcaaagaaacuaaaauuuaccuuuggaguaaauuaccagugugagaauuucaggcacuuaggauauauauauuauuauuauuuuuucgagacagagucuugcucugucgcccaggcuggagugcaguggcacgaucuccgcucacugcaacccccgccuccuggguucaagcaauucuucugucucagccuccuaaguagcuggaauuacaggcacgcgccaccacacccggcuaauuuuuauauuuauuuauuuauuuauuuugagacggagucuagcucugucgcccaggcuggagugcaguggcaugaucucggcucacugcaaucuccgccuccuggguucacaccauucuccuguuucagccuccccacuagcugggacuacagacgcccaccaccaugcccggcuaauuuuuuuguauuuuuaguagagcccagguuucaccguguuagccagaauggucucgaucucuugaccuuaugaucugcccaccuuggccucccaaagugcugggauuacaggcgugagccaccgcgcccggccugauuuuuauauuuuuaguagagacgggguuucaccuuguuggccaggcuggucucaaacucuugaccucaggugaucugcccgccucagccucucaaagugcugggauuacacgugugagccacugugccugaccgguacuuagguuauuaaagaaaaaaauuuauuuuucuuaagaaggguggggacuccuuagcuuaaauacuacauuguugaacacaaaacuuuccccauccucucacuuagauuaagucugccucuucucucugcuccuacgguuacaguagaauccccugcuuuauaucauggcucagucaagucagcgucuucuguugaacuaagaguucauagaggguagaauuucuguccaguucauucuugcugguuucacagucauuguuuuaagaaaugauucaugaccagccugggcaacauagcaacaccucauucuacaaaaaaaaaaaaaaaaaaaaaauuggccaggcacgguagcucacaccuguaaucccagcacuuugggaggcugaggcaggcagaucacgagcucaagagaucgagaccauccuggccaacauggugaaaccccgucucuacuaaaaauacaaaaauuagcugggcgugguggugugcaccuguagucccagcuacucgggaggcugaggcaggagaaucgcuugaauccgggaggcggagcuugcagugagccaagaucgugccacugcacuccagccugaugacagagugagacuccguuucaaaaaaaaauaaaaauaaaaauuaaguagcuagguguuaguggugugcaccuguagucccagcuccucuggaggcugaggcaggaggauuguuugagcccaggaauuagagugagcuaugauugcaccauugcacugcagccugggcagcagcagaagacccuaucucaaaaauaaaauaaaauuacauuaaaaaaggaaagaaagauaagaaaaagaaaaaagaaaugggcauuguucuggggcuuuuguugaaagagaugugaauucugugcuccaagaggaaacugacacgcaugcgcucauucaaggaacauuuguugguaccuccuuugugcuagaugcuggacacagaaauuauaggcaguucccucaggacucucacugucuagagagaggaggaggcaccaagugcugggguggggcaggcccacggagccaagucagaagggcacguaauccagacaguggcugcugauggggaaggugucagagaagucuuucuucaggggugagaucugagcugaauuuuggaggaagaauaagagcuggccaacuaaagaauauggggcgcaguggcucacgucuguaaucccagcgcuuugggaggucgaggcagguggaucaccugagguaaggaguuugagaccagucuagccaacauggugaaaccccaucucuacuaaauacaaaaaauuagccaggcaugguggugcaugccuguaauuccagcuacuuaggaggcugaggcggaagaaucgcuugaaccugggaggcaaaaguugcagugagccaagauuucuccauugcacuccagccugcgcaacaagagcaaaacucuaucucaaaaaaaaaaaaaaaaaaaaggugagaguagucuguagaaagguacaguaaugggagaaggugugacauauccgagaacugccagaguugaauacaccaggcuuugguuuuauccuggaggucacagggggccacugaaacuauccaccaagagaguggucugagaaagguacagagggguggacagggugggggaugggaguggguggggaguggcgauggccuauccuggaauucagaccugaggccagguuaggaaacgaagaagaggggccuucagaggcuaucugcaugacagacccaggagcuuucggggaaaagacccauccuaagggaggagaggcagaguccagcagaugggccuggaccaccacaaagcucaguccauuucucuaagggguggugaguggauuucuguauauggcuuagugauaugugugggaauuggaucuuucuacauuuuggccuuucguggauucuugucugauuuuugggcuaggggugguggugguagggcuuugaguaaaaauaaaaaucacaaugauugcuaacgauuuuugaacacuuauaacaugucaggaauuuacauacuuuagcucauuuaauucucaucacagccccacacugaggguaccacuaugguuauccccauuuuacagcuggaaaaaccaaccaagcaauucaucugaggagaagcccuccuaccuuacuuauguugggacuggcgcaugccggguaauugacaaagucaacuaaagcagggagcuuugagaaaaauaccuacacaggguaagcauuuacuuuugggacaaucgucaauuuauacauaguuauaagaacuaacacagggugaucccacagacuaccccccaaugguaacaucuugcaacccuucuuaacagaaugccuacuaugugccagguacugcuuuaggugcuggagacauagacacgggaaacgaaacauuagcugacagaagccacaagagugaaugagauccucacggagugccuugagucagaagaaagaaggguagcaaaaggagccccagcauuugagggguaggaagaaaagcccuaaggagaccuugaaggucggaaagagaggagaggguggugucauggaagcuaagguggacaauggugccaaaaaggaaagagauuccagugcuucugaggucaucugcaaggaggacugggaaguguccauuggauuuagcagccaggaugucacaggugagcaggcagguagcccagaaauauggaggggagcaggaccacagugcagugaggagugaauugggcgaggaagcagcgguagagagcacuucacagugagucuuccaacucauguaggaaagaggggguaaaguuaggcuaaaggagaaauuuuccaugaauuuugucucuagaaugaugauuaagaguuagcgagagucaagauuucaggccuguuagagcaaagcccuaaggaaauaagaguuggacccuggagcacagcuaaguccuggcuggagggaugggccugucuuucugaaaggagauaauggaggaagagaugcaguuaaagcucuguggcuacuugaagagggaagugauuacuuccagcuggggcacucaaggaagggauacagacauuugagugccaggggcauuugaggguaacaguggagggguucaguuggccaaaguuaaaggcagcugaaagauggcaggagacaagaccaggaaaugcagaccaagguggguggugguaugguuggggcguuggggucagaugacacauaagcuucaaauuccagcucccauuugcuucuuagcugugacucuaaagaaguuccuuaacacgucugagauuccccaucuguaaaauggcgacaacccuaauagggucguuggaggagaacuagauaaugucuaaaaagagcucaguccgguucagugcuuggcuccucuguaccugagcgcuaagucacuaauauaaagccaucggaugugugcuuuaagggaaauuaacugggccacacggugugaagugaacugagcugggagaggccugcacaggaccuuguacacacuagcuacuccggaaacaacugcaugcucugcugggcaucucauacaggauacggugucuuuccggggcucacacacaguccccaguucaguuccaaaguuggaaggaaagaggaugaagacguaaauucuucauuuaagccucucgccaacuguucccugcggcaaggcagggcaacgagcugcagggucgccaagcacgugcuuccaaggguccucaaggcuuugugaacggcggccggccaaggacagaauuaacuccagccuggagcgcgcgggaaagacgcgcaggcgcacugcuggcaagggugcuugccugugcuggggugggcggagcuaaacccggagcgggaugacgucaugaggacgcagccgcagagcgauucgcgucccggaagcggcgguggcggccgcggcguaggcggaggagauuuucggaccugcgacuuccgaacaacccuggcaggaggagcggcguucagccgggggaggccugaagaaacgcuccggggcccaguggcucuaccccugcuccugcccgacccugccgccucccucacggagccagcggccggguaggugaggugccguccccccgcgucccagugucuccgcaggcuguguguaguugggugcuugggcgcagcgggggccgccacaugcuggccccacgaccucgggcauggccuucccuguccagccucacgggcuccaucaggccccccuggcugcagagguguuggccaaggccagugcgggcgucgauauaccucgccccuuccugggcucauaccuggcgccgcucugugcccuuucgccuuggcucggccugcggggauuucggggucccguuggccccuuugucccauccccucacccucccaucaggucgcggcugauugccugggacugguuuauguugcucuucgccgagguuccgcccccucguuugcugcuuagaguucaggauaggacuuugaacugggaaagaccguaaaggcuccucgguuuccucaucagaaagggcagacgggaauggggcguucugaugccgacugcccuggggcagagauggcccaggaaguuguugggaaccgaagggagugggaagaguuagaggaucgggcgagaguccuggagcacgguauuucauucacucauucagcaggcauuuguuaagcacccacuguguacagaagcagucgugaauggaggccaguuaagagcagggaguuuuacuuugacguggucagugcucugcacuugaucuuagccacaaggccaagaagcgaugugaugugauaagugcucuguuagggugaguacgugauccuuugggagcaucggagagggucucccaguccagaguuggggguguuggcagagacuucccagaguaagggagugauguuuaagcugauaccugaaggaugaguaggaauuaaccagguaaagagugggagaaaaauguuccaggacaucauuucauuucagcccaugggcugccucgcugcagcgaucauuuaugcuugguuuuuaugauuuuuaguuuugauggaucuuuggggaaaagagcauuggauggagaguacaaagaacaggauuuuaggucugaauaguucacuuucccuugcucacagguuuacuguuggcaccaccugaaucuguagguagaauuguguugaggacuagacgugcaau

SEQ ID NO: 18832 - RNA, 15542 nt, Homo sapiens
ugggcuaccuucaggagguuugccgggcacggcugccugauuccgagcugaugcggaggaaguaucauagcgugaggcaggaggaccugcagagaggucgccugucucgucccgaggccguggcugaggugaagagcuugugaguauggaagagaggccagggaggugggggaacaguaacagcagccaugacacuaagugcuagcuuugugugcucgacaucauauuaggcaaaccacagcuguuacuucauuuaaccuuuuuaacaguuccgggagguaguuaauauuaacaucuuccauuuauggguaaagaaaaaggcugacuuacuuagcuagaaaguggccaagcugggaugagaaucucgaucuagcuguuuguuuucacagcuucuguucuuucuuucuuuuuuuuuuugagacagaguuucgcucucguuguccaggcuggagugcagugacgcaaucucggcucacugcaaccuccgccuuccauugguuucaagcgauucuccugccucagccucccaaguagcugggacuacaggcacacaccaccacgcccagcuaauuuuuuguauuuuuaguagagaccggguuucaccauguuugucacgauggucucgaucucuugaccuugugauccgcccgccucggccucccaaaaugcuggaauuacaggcgugagccaccacgccuggcccuguucuuucugcuggagagacaguuuagggucuugacuaagcaugugcauguauaagccacugccuggguucaaaucccagcucuuccauuuacuugcuguguaacauugggcaaguugcuuagccucugugugucucaaguuucucaucuguuaaauggaaugauaacagggcuuacucagaaggugguugugaagauugaacaggugucuuguacuggggaaguguugaguagauauuaguuaucaucacuacacuguggagaaacuucguaaacaugacagagcugguacuucugaggaagcauuuuaagacuugaaaaauauucaucuaacaacuucaguagcaguggacguuuacaccucccuucccuggaguggggucucugcauucucuugaaauagaauaggggcaagaaaaguuauaaacaaacagauggcugggccucaccccagaaauuccgagucaguuaucuggaguggggccuggauauguaguuuuuuuaaaaaagacuuucuuacuuugaaauaguuuuauauauauauacacauauauauauauauauauauauauuuuuuuuuuuuuuugagacagagucuuguuauguaacccaggcugaaaugcaguggcgugaucucggcucacugcaaccucugccuccuguguucaggcgauucucgugccucagccuccagaguagcugggauuacaggcaugugccaccauguccagcuaauuuuuguauuuuuaguagagaugagguuucaucauguuggccaggcuggucucgaacuucagccucaggugaucugccugccuuggccucccaaagugcugggauugcaggcaugagccaccgcacccagccugaaauaguuuuaaacuuaaagaaguacaggaauaauaccaagaaugccuuuuacccagauagaacaauuauuaacauuuugccauguuggcuucgucuaucucucuacauauacauauucuuuucuuuuuccuaaaccauuugaaaguaaguugcaaacgugacuuaauacuucagcguguauuuccuaagaacaaggacauucucuuaaauauccacagagcuguaaucaaaauuaggaaacuuaacguugauaacuaauguauaauucguaaucggauuuuaccaguuguauuaauaaaguucuuuuucuucuuuuauuaauuuuuuuccuuuuuucuuuuuuuuuuuuuacuuuuugagacggaguuuugcucugucauccaggcuggaaugcaguggcaugaucauggcucacugcagccucaaccuccuggacucaagugauccuucugccucagccuccugaguagcugggaccacaggcacaugcaccauacccugcuaauuaaaacaauuuuuuuguagagauagggucucauugucuugcccaggcuggccuugaauuccugggcucuagcaauccuccugcuucagccucccaaagugcugggacuacaggugugagccaguguggguguccuaauaaaguucuuuguaucaguuucccugaucugggauccaauucaggauuauacaucauguuuaauuuuuuuaugucucuuuagucuucuuuaaucuggagcaguuccucaguccuuguuucuugugaccuugacauuuuugaauaguacaagcuuauuauuuuguagaaucucccuaauuuuuggauuguuugguuccuugugaucagauuuagagugugacaagugaugugucauguucaguacauccguaucaggaggcaccugaugucaggaaauacugacuuugaucacuugguuaaggcauccauacuguaaauuaucauuuuacucuucauuaguaguaauuugaggggagauacuuugagacuauguaaauaucuuguuccucaucaaacauuuauccacugcuuuaaaaauccauugaugggucuugccuuaaucaguuuauuacuaugaugguugcaaagaugaucuucuaauuauucuaucgacauuuuuuuagcuggcuuucuacuauaaggaagcucuuucuuacuauuaucaguaugaacucauagauuuauauuuuauuugaugaguuagaaucuauuacuaucauuauuuauuuugaucucaaauuguccuagauuuggccaguaggagcucuuuugaguuggcucuuguuugcauuggucccugucauuuuugaaugcuuccuuuaugguacaacaggauggucaaauucaucuuauacuucccugccccagcccuggaaucagcuuaucuccauguuuccugguuucccuucagaaacccagaucuggguucagauugugcucauggcuucugugguucauccauguuuaaaaaaacaacaaccagaacuccccaagugagucuguuucacaucccagguagagaauaucaugccauuuauucugacagcugcuguguacccgugagguggguccucugauccucauuuuauagauaaagaagccacagcccuggagaauuucaguagccugccugacaucaacaguuagaagaccaaagcaggaacauuuauacuguuuccaccucagcaagaggcuccaaaaaggggacugaaauguagcugggguggcuuagccaggccuguuucucccaugcucucucgacuccucucucuuuaagcacauggugaguguguuuaaagagauugaccaucccuagccaacuguaccugcaaggccccaggcuccacuucccagggcuucuguccugcccacucaccaaagccccugugucuguagcuugauccagcuggaggccuuccugagccgccugugcugcacaugugaagccgccuaccgcgugcugcacugggagaaccccgucguguccucacagugagugaccccuccucucccgccaccacccuauaggaauuugcagcuugagcccgagcaaagccagcugccuugagaggaccucugccccucuuaccucaggggaagagcucgccuccugggcucuuguguguauaucugcacauaugcuugcgggcucuaauguacugcuuuuguuuagaugcuugcuuuuaugugugguaaaaauaauaauagaaaaauaacucaccauauaauccaccaugcagccgaaucucuuguuuguuuugccugcuagaauuugucacaugcaucuacuuuacggauguauaguuucauaguguauguucaauuuuucuuuuguuuuccacuuaucauuauauuaaagaugauuuucuuuguugcuauauagcuuuuggaauuauuuauaauaccagauuaauauagauggcaaauauaauuugugaaaccauucuguuacagauuuagucaauuucccuuuucauuacuaaccccaugguaaacauuuuuauggauuuagcuuuaauguuuuagaaaauuuuucuuggaguaaauucaaggaugaaacuaccauaucaaacagaauggguguuuuugaggcucuuuaauaugaauaauagugauaacuaauguuuguuguguucaccuggugccaggcacugcucaacacucccucuguauuaucucacucuuauaguaacucuauuagguaggcgcuacuucaguccccaucuuacacgggaagggagcugugcccagagaaccaagagacuucucagaaugagaaguggcagagcuggauucaaaucccagucugucuuacucuagacuucagagucuagaccuuaaggagugaugaugguugaaccaguuuaugugccaccagcugacaccacuuuggccucaccagcaucagguguuugcaccggugacuugggauaguucucagucuucaucgccauuuuccgcugguuugaugagcggcucuugucaguuuauuaaugugcccagagcugugucucaccuggacccugcugugggugugcuccaaacccgucuccuucugcuguuacgaauuucugaucuugugguucuucccugucauccagguucuauggggcucuucugggcacagucugcaugcuguauuugcugccacucugcuggguucucacccuuuuaaacagcacgcucuuucuggggaauguggaguucuuccgagguaagcccugaagggccugaaagauggggcccaagcuggcucugagggcuaggcuaggcuccccaguucuucugucucuacagcuaaucaucaguuugcugugcuuccacaagugcaacaccacacugggguccucucucaugggcucugcaucucugagauguuagaugaagcuggaaucucaccaggggaggcugcuaccauugggcucccaucucccuucgcucccuucccaaggcagaugaaucacugcuuauaugauaugauggcuucuggaagaugagggaaggauguuuuucccaaagcugccacccauccccuggggugcagccaccuggaguugcuaccacaucucugugugaucccagaauaccccucuguugucuggcuucuaaagcgcugaggcagucuggagaggcacugagucgcagaggcccgagucuguacauauguuugggugauugcuguauuuguuuuccucccugugguagaguuauuuauuacagaagccaugauuuauugagcauuuacuacauuuaaucucuguagcugucuggggcagguggugguaucuaaguuuuguuuaagaggcuuaaguuaggugacucgcucagaguuaggagggugacucuuuccuguagugaagggaagagaggccagccagcugcagaaguggguaccccuaaagugccacucacggugucucauuuuugccuccuaccuuguucuccauucccuggguaguugugucugaguacagggcaucucugcagcagaggaugaacccaaagcaggaagagcaugccuuugagaguccuccaccaccagauguuggggggaaggauggucugauggacagcacgccugcccucacacccacggagguaagugccacugucagggcagagccugcuguggccgcuugugggccccccuguuaucagcuuguuuuuggcuccugggcuggccucuguuguaguuccugcuauuucccaggccuuaacuccccugaaguguucaauaauaauaauuguaauaaaaacagcuacuccaugcuucacugagugcuuacccugugucagaugcugcuccaagugcuuuauagauagauauucacaucauggagugcagguucuuucuuuccuuuucuuuuuuuuuuuuccuuuuuuuuugagauaaggccucccucugucacccaggcuagagggcaguggggcaaucacagcucacuacaaccuccaucuccugggcucaggcaguccucccaccucagccucuuggguagcugggacugcaggcaggugccaccacgcccagcuaauuuuuuuguauuuuuaguaaagaugagguuuugccauguugcccaggcuggucucaaacuccugggcucaagugaugugccugccucggccucccaaagugcugggauuacaggcgugagccacugcaccaggcugguuauuucugagaaagagaucauucucauuuguggaagagaaggcugaggcacagaguggcugguaaguggcagggcugggucuaagaccccagcccugugguucuagagcucgugccuucaaccacugugcgauguggccacuguagggccagcugugcucguguuuccaucucccccgcccugccaggcuagagguugcuccuuccugugaguuccuucuuucuugccauugugccauuucgugguguuuuggguagccuggaugcuggcuuggggaggugguccucugccuuagggagcagcgcugccauccuucuccuucugucauagagucucucuucccaggaccucacaccgggcagcguggaggaggcugaggaggcugagccagaugaagaguuuaaagaugcgauugagguggguggcccuuccccagcauccucuacucagcaggccagaaauugggugguccuggagcuguuuuuuguuuuuguuuuuuaauguccaagugagaagcuaaaacuugcugugagcuagaacucacugguugaaagagugccacugaaccccuccccacuccuguuucugguugagccagcuguccugggugcccagggcaagaguggcucuggaagucuccggguaaugcccugcuaggggagcuggacgauuucuggccuuugcuggagaccgugggcuuggugccuuugauauaggaaaggcagcuuuugaggaggcuacugcccugggucuccgcucuucugcagagugaguuccguaagaugucccuuugcggggcugggaggggagguuggagaaaguaguugcauggccaagugcuaggucagaggaaguuaaacagcuuucuugauuuuaggaugguaauucaaauugguaguuugcagaaguguuuuauuuggcaugcaaaguuucaaaauaauuuuuugagccaauguuuaaauauggagagauuuuuauuagaacugcagguuuccaguuucucugguaguccugagucugcagcaguagguguagcuaaggagcugcuguccccuuuacgcaggucacaugcuguggcuacaggugguccucaacacccccugcuguauuuugucacugaggucaagugggaguugccauuugucacauuugcguuuuuguuuuucuuagaguaggauaucauuucucuuuauuuauuucucuuuguaaagugggaaauugagauauaagaaaaacaccucguggauuuccaccaggccugugauuuaccccaacucaccucaaucauacaucagcccaggccaugcaggcauuugacuuucugauggcuaaaagauugcuccaaaacuuugauauaugauuguagaccgugaaucuugguggagggaauauguagagcagggguuuucaagcauuuuuguucaugacccauaguaaggaacacauuuugcaucuugacccaggucacacuuaggucuauaaaauauguaaaacuuaagugaaacaaaaguuuccggaaaauacguuguaagggauauuuucuuuccuuuucuguucuauucaaauaaagaccuacuaaauuauuuucacccaguuugagaaacuguaguaccuagcuuucuccaaggcuguuugaugcugggauccucuuguggggggcgucugucaaugucaccauuugggaagugcgcagagcucagagcagcgcuuccaugcuuccuucugcuugggggccccuccagguagcuucuuucuucuugcuaucuuuuucuuucuguuuucucuccucuuccccgcaccuugggaggcaggagacccacuugguggugcugguaaguggaagccuuggugggugggcaggggcugggcuggggaggguggcugaaccggcugcugccacaccucgugggggcugccgcgcaggaugccucugcacacggguccugcagccuugcaagaggugggcaggacuggaaggagcuguucccacaggaggaugaugagggcgccccgugcccagcagaggaugagcuggcccugcaggacaacggguuccugagcaagaaugaggugcugcgcagcaaggugucucggcucacggagcggcuccgcaagcgcuaccccaccaacaacuucggugcggccaggggacagggcugggcuggugggggaguggggguggacuucugggacucuaguggggaacacccagccacaggggcagagucucagaacuguggguacugacuugugacaagagcagggagugaagguguguccgcgggaccccggggagcuagcagaugcccggcaggacugcugagggaguggguguggguuccuucuugucccuccauccugauuggacauucaguugugggaagacaaggaacucaguuugggaaaugccaucccaggacuguagagaaccauaauccugacagaacuucagaaggcaguguagcaugauggugaggaacagaguagagucucacugccugcugcaaaucccagcucagccagguguccuugagcaaauuauuucacaccccgugccucaguuuccccuucuguaaaagggggaucaucauucuuaccucauaggguuguuacaggucucaugucaaaugagacaguaguacuuacgaagggcuagcacagugcugguugguucauaguaaguagugggugcgguuaaugugggaggcccugacccacgcuguggguuccuaggauccugucuuggucuuucuuauccagcuggaagcaaguugaagcaaacauuguuucucuggacgugauagagcccugaguucaccucuccccagccaguccuuauuuuacugagggucgggggagagcggucaaggaaggcagcuuuggagaaggguggacuugacagcacagcuuagagaccuggcucagaucagcagcgcugagagcugagccacauacaauuaugguggaaaccuagaguagcuagguugaccugggagcugcugugcuccugaggaagggcccuccugccugcugucagaugggagcaggguaagggggcaguacuguguguucugguguugagugaguucuagggucugugcccuggaagaagacaauggaguuuaucuugaggaauuugacucagggcccccaggguccugccuuccuaccccugcagcagccagggcaguuguuuucucaggauuagauguccuggacaggcucuuucuuucugcugugugaaugucccccaguuauucaagaucccuuuuuuuuuuuuuuuuugagacaaggucucacugugucucccaggcuggagugcaguggcaugaucacagcucacugcauccucgacuuccugggcucaagugauccucacagcucagccucccgaguagcugggacuacaggcauguagcaccaugccuggcuaauuuuugaauuuuuuuuguagagacagggucuuacuuuguuccucaggcuggucuugaacucuuggguuuaagugauucuuguaccuuggucuuccaaaguguuaggauuacaagugugagccaccacgcccggccccuuuguuuuauuuaugcugccugcugacuucugcagggcauucuguauguucagugaucuguuuacccuccauacuugcacaugugugaucucauuucauccuuaccguaggugugacaggagcaggcaguucuuaaggguucagagcagccagauuccagcagugcccgguaacacuacacacaagaaguauuacucugguccagcaaauaauuugucuauuucuacaacuucuaaguaaagguacuuagcuguucccauuuuacagaugaauaaccugagguaaaaagagugcuuugcccagagacuuuggccuggaaaugguggagcugugacucaaauucagguugucugauucggcucuugucuucuuucuaccucuucauccucccucucuguuuucccuuugcccuugcgugugaagucccuuguuuuaugccugucccgcuuuuguauuugauuuuugguuuggauaaucucuaccagcaugggcagaggccuuuucagccucccucaaggauggcaagggcagaaagugcuucuuuuccuaaacuccucuuaguuccucauccuucaagaccacuugcuacuuucccuuuucugagauguucccaagcucuuugccaugagggcagguguagcagcucugcuccugcggccucugcuccugaaccuggguccugagagcagggcgaggggagcugcuuugggggcuuucuccauuucagcgacuauaacgaaauacacuaagcuggggggcuuuuaaauaauggaaaucucucaucacaguucuggaggcuggaaguccaagaucagggugucagcaggaucagguucuggugagguccauuuccgucgucauagacagcaccuucucacuguguccucaugagaaggugggaggggcacggcaguucucuggggccucuuuuauaagggcacuaaucccauucacgagggcuccacccucaugacccggucaccucccaggggcccugcuuuggguguuaggauuccacaugugaauguuaggggacuguggugggggcuauucuauuuaccccugccaguggaugagggggugcauggggagaaugagggcagacugcaaaggagcuucucuguggccuccguaugggagaggucuugguggggagggccccccuuuguccuggaggcuccaugacuguugcccuggcaggccccacugggccuuagugccccugcugucauggccucgguggcaucgucacguggugagugaggaugggugaguccaggcuguugcugagaaggggcagaaagaguugguagguguuggaagggaacgucaccuggcugagcugcucucagcucccagagcccucccuggcuccggucugugaguggguucacagcugucuccccagcccacuuggcugcccuggggugcuuggcccugacauuccauucaguuuagaggagaccuugggcucaggucagugucagucuuugaguagcuccuuuugccugucccauuccccuugugucccuugcuaaggagaggcuggggcaggcugccuuccccaaauucuugguguagggacagaaucuuggagcagccaguuuccugguuuggcaccagcaguaggcuuguucuucucuuucccuggcugacugacagggugggcauuuaccugaagcaccuuggccucagauuuccccuggcucuagcagaggucuuccuuucccugaaccuagggagucuccuuuagcaagaacuucaggugauuuuggcuggacagaggaagggaccacauguagccgucaauaaagcuuuggggccuuucugugaaagugaggccuggugcucuguacuugcccagacaggugguccggcugggucauagcaggccuaugggccccacaucccagaaaccucauucucugucucuccucuccccuuacacccccuuguugucuucuagccauuuucuaagcugccguugccccuccacuguugccgggcacuuggccaucuuggcaucucuggugguuuaggcaggaccucucccugcucugcguccccccaugccacucacugcccaccacaauugagcauucuacccuucgugucuuuacaguugagcauucuacccuucaugucuucuuggaaugugccuggcucugaguuucucuccugcagucuucaggggacagaaagcaggaguuuagguuuuuaggaguuucugucuuuagccuguggguggaguauuuguaaggcauugcuccggaaagggucauguuaggcaggugucauuuggggaugccuguggucaggucccugccagcuuagcuggcuuucuuggaguggauucugcugggugcucuuugauuucuguugaaccuguagguagggccacucagcucuggaaggguucagggacugguagcuauguauggcuggagacaucaguccucaggggcuaucagucuucuuaguuugaguccuucuuucugucucugaaucuggccuugcucccuggcucacuguguccagccaaggaggcugggcugguguccugagugucccauuuagaagcgccaggagcaggugagcgugagaguccugggaugggcggggguugagcugcugccucuguuucucagggaacugcacgggcugcucggccaccuucucagugcugaagaagagggugagugucugugagggugcauuuguuggggacaguguccuugggacugucggguggggaggaguugaggggagucauugagaaagucuggcucgggucacauugggccuggcaguggcuuucuggagugagugugcccuccccugcgccugugccaccuuuuaccagccuccccaggggguauuccauuugcucucuuuccugcuccacuugggcaccccccaggcccaguuuccuugggugggaucagcugguggaaaggagggaggugcugagaacuccagguaccugagggugagggacacaucugaccuuggcucuugucugcagcggagcugcaguaauuguggaaacagcuucugcucucgaugcugcuccuucaaggugcccaaguccuccaugggggccacaggugaguggugcagguggugggagggcuugguugguaucccgcccaggggaugucacgcuguggcacagaggcaagggugucagaggucaagggaacuugggauuguagucaggccuacgggaacguuuccuccauccccuuuagcaaaauccugaaacauuugguacaugccgaagaauagauaugauguaccugugaauugugaaggguaauaacaagaugaauaccuguggcugcuucacuaaaguugaaaaacaagagcccuggcaacacccccgcagcucccagcacugcuccugccuuccuggagucaaucaccagccgcaauuuuaaucuuuuucuuauuuccuuggcacuuugaacaaaacuaaaaauuccuuuuuuuccuuuuauaaaauauaaaauauuuccuauacauauuguaaauaaaaaacacagauaagcaaaaggaaaaaaaauuccugauuucuuccugagagaacaaucgggcauggacccugcugcucauuagcuugcauguagaauaaaagcacaugcauauuccugaaaaauguggucacauuucauguaccguuuuguaguauaauguuaaaccaaguuuuuuuuuuuuuuuuuuugagacggaguuucacucuuguugcccaggcuggagugcagugguacggccuuggcucaccacaaccucugccuccuggguucaagcaauucuccugccucagccucccgaguagcugggauuacaggcaugcgccaccacacccggcuaauuuuguauuuuaguagagacgggguuucuccauguuggucaggcugguuuugaacuccugaccucaggugaucugcccgccucggccucccaaagugcugggauuacaggcgugagccaccgcccccagcccaaguucuuuuuucuuccgaugcaaguaacauaugcuuacuaacuagaaaauuuggaaauuauuauacagaggacgaaggaagagaaaaauaacccuguaauuuuaccacccagagguaaccacuguuaaaacauuuugggaaauuucacugugauauuuuacuuauucuguuuuuuugagacagagucucgcucugucgcccagccuggagugcaguggcgccaucucggcucacugcaaccuccgccucuuggguucaaacaauucuugugcuucagccuccugaguagcugggauuacaggcgugcaucaccaugccuggcuaauuuuuguauuuaauauuuuauuuaaaaauuuuugaagguguucuguuggugccacaauaaugucuaauucauagcacaggaguggccugcuguuggcaucaucacccccaggauccccaguucccauggaaagaagaaucucugcgggcaggcuagcaagcugggcagggagggugugggcuggguggggggucuguguggggcauuugggagggugcuucuaguaguuggggccaugaaccaaagggcgcaaggaaaugucucaccaaguucuuccuccuuuucagccccugaagcccagagggagacuguguuugugugugccucguguaaccagaccuugagcaagugagaagagaggccaggguccaaccaggcacccguccuugggaccagcaguagaccccccacucuccccaccccuggcccacuguggugugugcugggcaaauguggccugaaugcuagguaggcuuccccuuccuuccucacucucuccagcuggauucuggagcuguucuccauccaugagaguggcuggcaauggcugcucucaaucccuugagggagaagagccccuggagggccuggcauguuuguccugcucugccugggacugagcgaguggacuuagggcugggcaggcaguagccaccagagggcagcagcgaacuaggccaggccugacuggggucugaagaucagggucaguguggcugugccugggaauuccagaccugagguugggaaaagagguuuuucuccugcaggguacugggccaggcccucagccucagagagccugcagaagggcuugggagugccacaccccaucucugcugauugaaugucccuccaggcaccaggaucucaucauuuccccaucagaggguguggccaggccuaacaagaccaugggugcuucuagaaacaggguugaaguucccagauucccugagaggagaauguguauaggaggguuuggcugaguccuucagcguuaaguggaggaaagcuuggggaagccccaauagcuggacagaccucggccuccccucgaagacaccucaauucacagacucucagcccacacaaugccccaguguccccagcuccgcuggagcagcugcagggcacuuggaucacaacuucugcacccucuguccagagucuagggcaguccuccacuggcccagcacuccaguuuccuuucccugccucuuguccaauggagugggaggccaggugaguggagcagagguccugaagcccuugaccccugggggccuggguaguguaggaucucgcugggcuggguccuggauuccagggcuauucccuggaggacagucucaguuaugggauaaggc

SEQ ID NO: 18833 - RNA, 5693 nt, Homo sapiens
accaccugguccaaaccaguuauuguuuucuuugauuuaauuaaaaaguuaaaaaaauuagaaaacccaacccugcauguauugguugucuaguaccuauggccucacagcaguagcaauaacuuauugggauaaaagggagaagcagaggcugaggaaugaaucccgggaaucgagccgcgggcggaccagaagggggucuaugccgaggcugggcugggcuugcucuccagucuggggggagcucugggccuuggggcagggaaaugggcaagcuggggaaggcaggggguguggcuggaggcacugagacccuaacuccuuuccuaaggggggcuaggaugacgcguacaggggcgguggggagaacuuucccaaauagcuuagccuaauauugagacuucccucuucaaggugaggccccaccaccgacagaggggagcuggagcugacaccaccuucuacucugaaaccuccgccucagggugcccugagccccuccaccuuucccuuacccucuccuccccugccuacuuucugagacccugaggucuucacccagaugaagaagcccugcuccugagagaggaagcccaacaucccagggaccccaggaccccugggucaaaaaggacagccugggcuccgugcccaucccuuaggccuugugccaguaacaacauucgugaaaacacccuccaguagggccgggucagccuggaaguuggggcggggccagagggcaagcaaggcacagcuggcagggcaaggaggagugcccuucaguggggcucugccgccccguagaagaaaggguaguagagggagcagggguaggagaacaugaauuugacugcaaacuucaucuccuuauucuucuugucccagcgguagacggccaugagcagcagcuguccauccacuuugcggcccaugaccaggaagcugcccgccaggcuguccagcugugggcaggggcagcccgcgccauucuucaugugcagcaccagccgcuugguguccuugcgcuucagggggcccggcuugagcagcuucuucuuuuucugggcuccaaucagcuuccgguccccauucucuaucuugaucuccuugaugcgcauuuugaccacugugggaagaaaggacaggggcaaguugggaauggucagaucugugugggaugcuggugggcacagaguugguguguucuggaccuucgggcugggggagccugaugcccugcggggcuuggaaggguggagcucguagggcacauuuucauauuuaugaagcacuuaucaugcugcacucucaaggacagcaucacguuucauccucaagguacagaagaggggaauugagggguagagagcuugugaccugcgugaaucgagaguccaagcccuucugagacaccaaaggcaggguggagagcucuugauggagcagcauguggggcuccccagggaggggauaaggaguggaugggacuggggccgacugcuuggaaggggauccuugugauggagggaagcuggacuuccugaucucuggggaugauucccacugggauuucuggcugugugugaguguaugguauggaguauauaugggguguguauaugugugugcaugcacacacggugagugugguuggaacaguggugggcuggcaaauauuuaacagccggcucuguggacagggagcccugcuuugcauucauugacauccaugggguaaauacucccaccauaacugaccgcaugacuggguguggagcugggaauagauacacacaguucagcuguugcuggugugaacacaccacuguacaguaauguguaugugugugagagagagauuguacggugggugggaguguguuugugcuauguuuaggaguggggcaggggguguggcuggaggcacugagacccuaacuccuuuccuuuggggggcuaggaugaaggcagggucugugcccagagagccauggugcaggucacccuacaguggacguagagagccuaaggaguccugggccucagggugggguggggagucccucgggcuggucucucccuucuucaggcuucugggcccccaucucuguggggccagggagaagucagagaauaacugcccacucuuggcaggaaauugucauaaaaucuuguuccuucucuuuauguccccuucccccucucuuucucucucugacacacacauacaccccuugcaauagcaguauucucuuuccaaacaggcuaccaacauaaaagacuccucugaagaaaggacuucauuaucaucuccuuuuuucuuuuuuuauagacagggaggcuaagacacaaaacagggaacugacuuggcaaagaucacacacuggacugcguggcccaugugugagccagguccugaccggacuuggcuggauugucccagaaaaugggaaggcucugggaugaagcuguggggacaggugaccacagcuccgcuggcaggaggugugcugagucccagguggagguacccauggacaagggugcuccacuuccauccuagagccaucacuccccaccuggcuccauccaucucugggcuaagccugcacuauccacagagaugauccagucauggagggcccucugaaaaugacaccaagggagggcugugggagcccuggccggggugguuucugaggcccaaggcccauggccuuaggggacuugugaugguccugagaugaugcagaaagaggugcauuucucuugggaaaggguuuaugguuauaauuggcuucuaaacgggagccaugaugcaaaaacuguugggauucacugugauggaugugggcauguauguucccgugugcgucaagaaagaggggcugggggugaugucggggcaguggcagcgugggccccacacucaccaaagucacuggagcacaucugcuccaugaggccgucagcacugugcuccaucucacacugggcgcagaucuuggucacugaagagagaaaguggggugggguugggggacaguuggugaggggauuggaguuccaagagccacuuggggugcaggcuuccucacugaccagccacuuccccuugccaagccucuacuuccuuaucaggagaugggaugauggcaaucauaucacuaccugcucacagagugauugacaaucaccagacaggcugugcagugacaaaacugccaggugggcacagugacugccccaugacccuggcggcugcagccaugaugugcauugucuuuuaaauuuuaucuccucucauccucagccuaugaaauagggauucuuauuccuauuuuauuuuugagauguagucucgcucugucacccaggcuggagugcaguggcucucuaaucucagcuuacugcaaccucugccucccagguuuaagcgauucuucugucucagccucccgaguagcugagauuacaggcgugugccaccacgcucggcuaauuuuuguauuuucaguagagacgggguuucaccauguuggccaggcuggucuagaacuccugaccucaagugauucacccaccuuggccucccaaagugcugggauuacaagugugaaccacugcgcccagcccuuacuccuauuuuggagaaaagggaaccgaggcccagagcgguuacucaagucugacagcagacggggaggaagggggagagggcauggagccagccuggaagagcuauguggaccagcacagaaaaggggaggcugagaccagggagaaauuaggguucaggggacugaggggugggugggaggagggacuuaggaccucauagguuucaugagccugggauggcuuccuauuuuauggauggggaaacugaggcucagugaagucaagcaacuugccuaagggcuucucuucaggggcagagccuaaucugcucuuccuuccgcacugagccuuacccgaaugacucccagccaggggaacuggggaagaggguggagaucuuaggguuccagguacagaaaacggggacgcagaucauaguccagaacauucuuaguccccagucuuucuccacaucccuucccucaccucuccucucuucccaaggucccaacacggaguggggaugaugcuugcuuuggugccucgggauccaggugaaaggcauuguuuaacgaccccaggcauucuugggcugagaggggucauaaggcauuuaucaggacgucccaggauuggggggacggcauugggggauucucagcagcuugguuggauggguacugagaggggugccagggguuuccagggaacgagagccagagggaaggucuggagccgccgggaggcacuaugcugccacucccuggggaggugggaaggcgggaaggcugcgggggauaauuccggggacgcugggcugagcuaggacagcgugugugugugugugugggcggagggggggagcugcaccucuugggggguucgcagagcugugcuaggggagcugcagggccgucggagcgcgcggggacggcggcggcggcgcuaccuggaggcgcgguggcgggcaggugcccgaacugcacggcgaugcagaggucguuguccagggggaacuuguggcagugcagcaucucaggccaggggaagccguaggccuccaugagcggcgcgcagccggcgcgcacggccucgcacagcgagcggcacggguagaugggccggucgagacagacgggcgcaaagagcgagcacaggaagaccugcguauccgaguggcagcgcuuggccagcagcggcagccagcugcucgccugcugcuucacuucggccaggcucucgugcuccagcagguugggcagccgcaugcgcuuguagcccaccguguggcagagcggcaggucggcagggaugucaaggcacugcggcggcuuggaguaggagcggccgugcagcggcucggccugccagccauaguagucguacuccucgcagcgcgccggcgcccagugcagcgcccccagcagcagcgccagcgcggccguccgcacgcccccccccgccgccgccgcccgcauggcugcgcccucuccaggugcgcgccgcgcagccccccgacgcucggugcccggcggcccagguguuccggcgugcgcccccggcccugacucuacccagccgccgccgccgccgccgcggaggucgcccagguggguggcagccugcgcugcgggcgccccgacugauccuggcgccucccaccucggggcuccagcccgggccucgccgugcgccccagccaaucuccggccgccuggccccagcuccaaggcggggaggcagugggggcggcccucagccccucccgcacccugcccgagcgucccgcccagcgccaggucuugcgccccucucccggcucggcuccccugccgcagcccuggccucgcccagcguuucuccccagggcucccugccucccugggcauuuuccucgacccucgccuucuccauccuuccuccuuaucucucuccgccacagccucuccuguuccuuuucucacucacuucacuugcuuaucucucugccuuggcuuuucucccucugcucuguuuucucuuccccgacaccucgguuccucuucucccuggugggaggcucgugccac

SEQ ID NO: 18834 - RNA, 8630 nt, Homo sapiens
uacauaauuaauuuauaauaaaacacgcacgcaaugguuuaauuucuccaagugaaugaugugcuauccgccagauccugcuggaacgccuccccuaacugacugcuucuuggucuggaggugauggccagcugcccuagggagggauguuggcaugaggaaccugccaagucacauauucccccuggcuaccucuggaguauguaccacaggagaacagucuuucauugcaucuauuauuguucuagaucuggauacucaugagggucucacccaaacucugcauuguuugagagcuguuagguucuucauucgcccagucuuucucccagaguaugggaaaugccuuuguauuuauaccuuucccuccccaucucccucccuuccucccuccuuuccuuccuuccacaaauaugaaauaaaugaaggaaagaagugccuauuaugugaacuaccuuuggcuugcugcauaucagugaauaaaacagagauccuugcccaaguggagcuuacacucuagcagagggaggcacacaauaaauaauaaguguaaucauaaguaaauuauaccaaacaucacacaaugauagaugcuguagaaaaagaaaaagcagagcaggcuaagggcgaucagccaugauggagucagguugcaguuucaaugaggguggggagggcaagggaggggagggcagggcuuguggaaagccagcagccuaggcacugucaagcucuccaugaaugggagagaaaggcacucugggccuacccaggacuuuaauguuccgggauugcuuugguuacagguucuuucgguaacauuugucacuuuugguuucagauguccaggauguuaccguuccugcugcugcucugguuucugcccaucacugaggggucccagcgggcugaacccauguucacugcagucaccaacucaguucugccuccugacuaugacaguaaucccacccagcucaacuaugguguggcaguuacugauguggaccaugauggggacuuugagaucgucguggcgggguaagugccucccacccucagugugacagauauuaaucagauuuugcuguaauaaggcuguguaacaacuccaaaccccagugacuugcaacaacauacguucucacucauaggucugugguugucuguggcucagcugcagcuuggcugggcucagcugggguucuggggugcugugaccuugucuuuugcuacugcagugggucaggauggaaggaaguuuggaagaaggguguuugauccacaggcuuuucagggagaaaacuggaaugcucugcuuuaaggcacugucuucucuucauauuuaagccaacuugauuaugcagauauuacuucuuuaccaguggggcucuaggaucucuauacaggaagggcuuaagggugacaauuaugguagaaggguaugcucaaagcugccuuugcacagcacuuuacauaagacuaagaaaacauuaauuaaccguuucaaagaggggggaagauggaaauuaagaggguuagcuaaaccuccgcugagcaugccuuguugcccacggcuccuuucucuccugaaaaccaacauuggguugcaaaaaaagcauaagacuaggaauccaaauagccugaguucaugcccuaagguguaaacguuccaguuuuauguccuugagucucuuacucacugacauucagagauaucaucuguaaaaaggggaauaacuguaauggcuuguugucuugaagccuuccuaggcuauugugugugacagugcauuguaaauuucugccaaucaccauugauaauuauuaugcauugagggccgggugcaguggcucacgccuguaaucccagcacuuuaggaggccgagaugggugaaucacuugaggucaggaguucaagaccagccuggccaacauggugaaaccccgucucuacuaaaaauacaaaaauuagcugggcaugguggcgcgcgcauguaaucccagcuacucagguggcugaggcacaagaauugcuugaacccaggaggcggagguugcaguaagccgagacggcaccacugcacuccagccugggcgacagagcaagacuccaucuaaaaaaaaaaaaaaaaagauugugcauugagcacuaauaugugccagacacuaugcaucaucuuauuucacaucccucauuuuauuucauccccaacagcacuaugaaguaaauguauugucauccacauugagagaaaaggcagaugggguucagaggcaguaagcaacuugcucucugcuaaguaaauaguaaguagauaagucgggaucugaaccccaaggcuuccuaacucuacagcugccaaacuacacuguacaaaguuucguuaucacuucaaaaaucagucaaucaauaaaaacacuacaggggccugucgaccucauucugggaggccugagcuuuuuugguagcacuaaaguaacuggcggguaacauuauuugcagcaguugcauguaacaguagaaagcuuugaccuuggaauugaaagaccugguuuuaauucuaaccguagccaaccuaguaucuauaaacccuaugcaauuuacuuuacacagacccacuuuccucaucuaaguaaaaugggcauauugaaaucuacuggccugccucacgggguagucauggcgguuaguggugaugauguauagaaaagauuguuuguaaaguacaguuuuuauuuugucuauucauuucuucuacacugcaaagaguagaguugcucaauucuaggccuucuagauguagauuggugugcuauccagaagcauuuucugugaugauguaaauguucuguguuggugcuguccaguauggaauccaccagccacacguagcuacugaguaugugaaauggcuagugugaccaaggaacugaauuuuuaaauuuucuuuuauuuuaauuaaaaauagccacauuugaauuggacaguacaguucugggcuuuuagaaggaaaaaacuaaagagcugaauaugacagaaaaggagaaauggaaucauuguaaugacgcuuuuuaccuggggugaccugagcaggguugcaguuaaucagccuugccuguguccaguucugugacuguccaguugcucucugaaucagggagacacccuccucacuaaguccauacccaaacugacucccagagccaugugccacccugccagaaucucugguuaaaggacuuugaugcaucucugagauguucuguuuggaugguugcccugccuccuacuuggugacccuggccuccccugauagacccuggggacugacagaggacagagaauggcaaggcaaccguccuucucuccuccuccucgccccccaaguugcuacuauuaugcccuccuuucaucuuggaagaugguauacucucguauucccucagguuaauguggaaaaaaguaagaccugagauaugaacagaaagugucuucacccuauuuucuucuccuucugggaccuggacaucuggaaggagcuagccagauugcagagcauggaaagccuuucagagcauggaaagccucucccugucuccacugcaaagcugucucugauuucaguaccuugcacuccucccccagccccugccccuacaaugagcagccaacucugcuucucauggucuggcucucccucuuucugcccuggcuguugcaggagacccguugggugcccccccaccccaccccccacucuuuuguacucuuuucccaugguuccagauggaaggaaagaaagggugcgaagggccaagcacacccacuaaaggaggaugcaaagagccucuuacagcauacuucauuauuuuugcuaucguuuugccccuuuccacagcaucucucucaaaggcaugcugaaauaguaggcacagguugcauugcucuccucaagauucaucuuucagcugcgaagaacagaacuagcagagaaggucuuggccccagggcuggugcuggccugggucuguuugggaagaagcagagcuguuugguagcagaauuuucaguuucccuauccuuuccaggucaaagggaaugauaugugccaccaugggcccagucgcugaggucaguucccugagcccugugcguaaaugugggcucugugugcaggucuuuauccugccaguccuuugaugugcaggggauugcuccugcaccuccugagccuucagcuucuuucuuuccaagugcugggcauucauuucgucuuccucuucaaugaagucuuuuucucuuucucuuucaagaaaugugccuuuguguccucugugcuagugaagcuagaccaucauuugcacugacuacaagguuuagaagucucaaccuugucuagcuugcuguuuauguggguccuauaggacuuuggagucauccuccggaaacaagaacuagaccauccugggucuugaugugaaaucagccauuuagagagaccccuaucucuucuuccagggcaggguugagcaaagcagccucugucugagaaagcuuaggcugcuggauguuauucugaaagaugauauuuauugcucacccccagcaaagaauaagaguuacacagaagacaggauggcaaaauugggcagucucccagcuccaggucaggcuuucuuuguggcuguugugaagcauugcgaauucucagcgcaucagaaagacacauucuaauuugaguaccaaaauacauuccaaaggcaaauauaacuuuuuauuaucuucagcuuuggaugauuugucacugucuccuuuuuugggcuggauaaccaaaaguggacuauacagacauauuuaaaucaggaccuugggaggucauuugguccaccccuugccuuacaauaagaccacaccuauaguauucggaggcuccauuuacuuugagccauccaagcgaacguggcaauccuacuguaauccagcucgauaguuacuuaugucaagaaccgauuugacuaaucugaaucccacauauuagaguuuaauaagccauuucuuuuagguuuuguuuugcuauugccuuugaagauauaaaccagaugaucacugucuuuucaaacaaugaaagcuaggaucacugcccugccuuucauccuauguggacuuuuugacauuucugauuuugacucuuagauuucauccacccuaaaccuauauuuaauucugcuuuauuaucugucugauugucaacucacuguuuaagaaucauguagcaggaguugaaauuuugaaaaauugcauuugaaaucuucaucaggggcaccuaugguucaguucaugacagguccacccucuauuaccuuauagaccuuuccauuaccuguccccugaaggcauuuacuuuugccaccccugggagaacagccagcucuucaguuuauaaagcgcuccguacuugaacuugucuugaauguguugaccuuguaguaugucugacuggagcccuguugcuuugaguauuuacucuuugaauagguuuguuuuguguugcuuuuucgguguccucguucuggguauugacagcauugauuuugagcuuguugcgggucgguuuguguuguguuucagauucuugaguuaauugugauggaaggcgugugcaugucucugacucugggaggagcaggaaaugaccgcccuuuguucugcggggaugggggagggacugggccggcucagauccucugcacaucugggcgagugccuccgcauauggagggcuuaucuguuaaccagcaggugcaugauugcagucugcucccuguggggugaggggaagauuugaucaccucuggcaacuuccgugcacgcacagaccauuuaggaucuucaggacuguuuuuucaguaaauagaaagcccaguggcuucuccuuuucucaguggaacuaaacacccaaucuacagucucacagauucuggaaaggaauuccuguuggugucaaucuuguacaauuccuuuagagcagcuuugguuuccugggauauccccagaggucugagguaacaccccuaccaucucaguuuccaaaaggaguuugcucaaauggaaagacuguagugguuguaaaguuuaaaucaugauuuggauccauuuuucuacccaaagauuauucauuugauaaaaccguaacacauucuucacacuuggaaggguuucauuuaaagggaugcuauauacuguaaagcaguguuuuagguuuuucuuaauuuugcaacuaugucaguaaacuuuuuuaauuuacuaaaguuaauugaauuauuuaaaaggcaaauuguauucaauugccaaauuaaucaugaucauauaggagauaaauuugccauuauaaauaauaagaacaaugauuuuuuaaaagacacauuuauccaugauuuagccaaagcagcauuuaugcauuuuauuuuaaguauauauagauacauguaguauauagauauauauauaguauuuauagauagauaugguaaauaauagguagauguaguauguauauaaauauaauuagauacauauugaaauauauauauaugcacacauucacauaugcuuuuaacaaaauccgaauaaauauuuuugaacuuucagucuuaauuguugugguguguaacauuuuaauagauuugauaaucaguuuugauauuaucuuaaaauguuaaauuauuucauucuguuucuuuuuuuuuaacuuaaaauauauuuuacuuuuggccaggcaugguggcucacgccuguaaucccagcacuuugggaggccgaggcagguggaucaccugaggucaggaguucgagaccagccuggccaacaugauaaaaccccuucucuacuaaaaauacaaaaauuagccaggcgugguggcacgugccuauaaucccaucuacuugggagccugaggcaggagaaucgcuugaacucgggagggggagauugcagugagccgagaucaugccauugcaccucagccuggaugacaagagcaaagcuccaucucaaaaaaaaaaaaaaaaaaaaauauauauauauauauauauguauuacuuuacauuacacuuaagcacauuuuguugcaaaaaaaaaaaucacacaaccuaggucaagguaaaaauccauuuuuaccaacccacacuccuucaagaccaucccagccccuucccagaguaacaacuguuuccgguuugcuguuuaugcuuccagaaauuucuaugucauguauauggagaaagagugugugagagagacagagacauagggagaaagaguuuauguuauguacauuucuauuguguauauauauuauaaaauauauaauuucuggagaaaucacacugauacauauuguuccaaaacuugcuuuuuuucacugcauaauauguucaaacauauagauguagcuuuuuuuuuaaguugcuuaguauggauguacuguauucauuuugccauuccucaagugacguuuaagcuguuucuaaucugugaccauugcaaacuccaccacacugcauguacauccuuacacacauaugcaaauauuucuuuaggauggauaccaagaaauggaacugcagggucagggauauguucauuuuaaaucuuauuagauaucaccaaauugcuuccaaucuaaucuuuuuguauuuacucauagccuagaaauaaaagguuuuggauuauucagcucaacagcuauucaagcaccuacuguguguacagccauguaugcuccagggucugaacuuugucaauguagauuuaacaaucccaagaaggaaaagagggccucuucuacaucugcaaaggaagcugcugcuauuaaaacugaauugaggaacuucagcacuuucugauucaaacugcugaaagggccugcucuaaagccucuucugcaaaaauauauuucuuaaaugggucacccuuaacccugaaauuucauuguuguugguaucauggaagaaugguugcagugugccagcucuucagcugugguuuuggauggacugccccugauuuugaauacuaauaaauaccaauuaaauuaaauacuaauuaaaugcuaauacguauuaauuggaucaggggccagggcuuuuuuagcccauucuuaaaacuuuucuaaaaaagguuaccuagcagugccuggcagguuugccagagcugucccauugccgcauccguaccuccuucuccccaguccugggcagccaggagcaaugggcagaauuccacuuccacccccucaccccaaauuacauacucuccugaucaguucaaaggucugaggccccuauguaauuaccccagacagacaggcagacagacagacacacaugcacacauacacacagaacaagugugccaguuggugugguagacagaauaauggccuccccaaaaugccacauccuaauccccagaacccaccaauagguuaucuuaccuggcaaagugggcuuugcagaagugauuaaguuaaagaccuuggaauggggagaauauucuggauuaucugaguaggcccaauguaaucaaaaggucuuaaaagugggagaagaggaggcagaaggaga

SEQ ID NO: 18835 - RNA, 1139 nt, Homo sapiens
gagacguccgcgcgaauccgguccuggggaaagggcaguuccaacaaccuuucauccagaagccugcacagccaaugcgaaugcgccccgccaggacuucuuccccgaaaaucugccuuccagacucuuuucugaggcaggaaagcauuaggcgaacaggcagauuuuuuaaaaaaagaaagaaagcuggugggggaaagggggucugcgcagcugaaggaguucaaugaaagugggacaagcguugcggaaaacuccguugcacccuacauucggacgagcucauagacgcgcucugcugcacgaaagagcuuucgaagaggaagcugggccgcgcggagcuggcuguuccgcccucgcggcaaccgcaccaacaggaaccgaaacggccucggcaagggcagcuacagccucucaguccuccggcuaccuuuccuccacguggaaggagcgcuccacguggcgccucccgcuaccugccgcguccgcagacccgacccgggccagggggacaaccccaagagcugagaggcgggcgcaccucaagaagcaaaacucgaauuucgcaaggagugaaaaauacgaaggacgcacaacggaccuggccucggggcaaagugggacugagagcgcugagggcucuucgaggggaacccacagcugaggcuccaacuuguagggaauuuuuaaaaacucaacacuuggauucgacauugcagaggauuuauuucuuauuuuacacugcaacucugucccugaugggaagggaucgcaguugccuaacugccaaacugcaacaacccgggaagagugugagcccaauuagauuacaagcccuagagcaaaggggaucacaaaccuccggguuugcuaaucugcuggugcggaguucagaucuccgaagccucccuggaguauuucuaggacucuuaccgcuucccuuauaacgcugugaccccagcgaggauuuuuuuuuuccuuuaaagaaaagcuaaacugugcaguuaccgcaggagauuuaaggaggaggaacuggcggggggaggggggcauuccgucuauaaaaagcgccuuacaaaguccugaagucuggaaaugacagcggaggauauaaaauaaaaaauuuuaacuccgaucca

SEQ ID NO: 18836 - RNA, 10946 nt, Homo sapiens
uaguccacagggcgguugcgcugguagagguaguguuccggggccuucuuguucuucucaucaaacuucagcuccuggaucacguugggauguuucaggagccggagcaggaucuucuccgaaagguacagagacuuaaagggcuccacuucuagaggagagugagugggaagggaggaaucagcaucagcugugucccacccauuccagcaguggcagcugggaggagucagagugggcacaacugggaccccugugccuguaccugggcaucagguuggcagggcuucugcaguuccuccggaguggaggauccuaaucccaagugugcaucucagggccuuacccacguccucuggagaugugugucccugcacuggcaucucaggagaaacaggucuccauuuggaaaugucuguuucauuauuaauuuucuuugauuuuauuuaaaauuggacauggacaacuaagccacauaaacaacaaagacuuuaaugcuauaauugaaugaaaugcagauaauuuaaucuggcuuauuuguaugacauauaucugcugaaugaaaugaaaucccauguuacuaaagacaggcaauuauuuaaauaauaaguugucaauaaugugaggcaucauugcaucauauuuauauauuacagcuauugcuuauauuacauauguuaaacuuauauuacuuauauaacauaggcucugggaaguaguuaaaagaaaucuguacucagaacuagaaauucuaucuuaaagcagcuccaacuuaaaauuuucuacucuuuagcaccuaaaacagugcuagcacucauuacauacucaauaaauauauguuggauuaauuaaauauugaaguuagugauagauaugaucauucuaggucagcacauuaauuaggcauggauggucagaggguucaaagacaaacuuuaucuucuucacaagaaggaguuuaucuuuggauuuucucacuuuuuuuucuuucuaaagaucccaagauucacaauacacuucuguauuuuaaaaauucauagcucacaggcuucuguggcacugcucuagggcacugcaagucuaacagacagggagauggccucgggcuucagcgaggaagugaguagaagagggaaaagugcagcaaugguuucuuuagcucuuuucucugguagaagaguugaguuauacucauuucuuccucuaugagaucaggccuggggcucaauacgacaguagguggcauccauuacccugucuaaggcaaccuccuuccuagaacagugcuucucaguccugacagcacacuggaaucaggcuggaagguauuaacaacgauuggugccugggucccacccuagagauucuguuuuagcuucucuggaguggagacuuguccuaccuguggccaugaagcgguguguggcuagcagaagcuguggugagaucuucacccgcaucuccguguccgaaagcuuaaacaaggagaagucaugccgcuuccgcucccguugcgggacccucugcuuuuuccgauugucagcuguggggucacagaggacagauuacagcuaucucagaaucacguugaucuuuggagguuuucccagaaucacaggggacagauagaacauuucugcagugucaacuaugggugacaucacaauaucacccaggaaguagaaggauguuggugagggauagacaaugggagacugccaucauuucaguguuuuccacacuuaggggguguauaguagaaaaaggggaaagcaggcuugggguacccaagucugggguucuggggcugguuccccuacuuaccauguaaucucucuaagcauuagaguuuuuauuuuaaucuguacaaggaggcuaauaauauuuaauauagcucucauacucaucuugugcaauuaauuaugagacuccaacuggaaacuaccugugagaaugcuuuuacccaaagucauacacacacaagggaccugcauucuuaguaucaagaggguugcaggggcccagggaauuucugacucugucccccuccuuugcccugaacuggccucaccuagucuccugcugcuuaugugaaccaugcucugagugguaccugaagcaugccacacaaggaaggagggcggccaccaccucuuauuucacaauuucccugcuucaaccccagucccuccacugggagggaaucaggggaaauauagggaagaagagaggagaagaaauaagauuggaccuauaaucucuaaagguggguuuucuggaugggggccucaggcagggucugguaccucccaagagccuauguaucaggcauguaauuauugguugaaaacauuugcuuuuuccaauuuaauuuguucucauucuuuuuaaagcuugucuaaauauaucuacuucccccccggcccccgcuuuuuuuuuuguuuuuuuuuuuuugguagaggaaauguuuucuuugguucuuucucuuuugcuuucccugaguuuugaguaaaauuuugaaacugcuagcccaucuuaccugcacuaaggggaacagggagagggauuuggguuuucuccaaacuucgccuaaagagaaacagggcugugggggaacgucuggugcaagcugaguggaugcagugagaaugaaagggaaugaaccccuguggcaggaaaauaaggccccagaauccggcucccuggugugcccccucuccuuuuggggccugcuuuuggguuuccuucuagaagggucaaagugcccuccugccggugcagcucuuccauggcccgcucugacucugggccuucacagucaucuggccccugcuuugacacuccuuuugcucaagucacaaugggcagacccagacccagguguccagaucacguaagaggucagggucaugcaagaagaaagacaguaucccuggcuucugggccuuuucauagcucuuagggaaucaugccagcagcuauuuauagguagaaagacccuaaccugcuccuguagaaagaggaucacucagcaaaagaguagcaaaauacaggcuauuagcccagcucuuucgcucucacuagugagcaacuuucugauuuguaugauaaguuugccuaaauagccccccucucccccaucagauugccacuuaacauggcauuauuaggaaaucauuccucucaucgcccccuucuccuuagauuucaauaguguguguuggaagccuuaagguuguucaaacaagugcccugggaggagcuuacucauuuagacuauuaucaguaccuaacaccuuagugugaauggcuucacuaguuuaucugagacaccugggauuuuuuuuuuuuuuuuuuuuuuuuuuuuuuuuuugagacagucuugcccugucacccaggcucccaugcuggagugcuguggcacaaucuccacucacugcagccaggaccucccaggcucaagugauccucccaccuuggccucucaaguagcugggacuacaggcacacgucaccacgccuggcuaacuguuguauuuuuuguagagaugggguuucaccauguugcccaggcuacaccugagaauucuaaaucaagaguggcaggcagaggugggggagggagaggacauuuccgagcucguuccucaugugaggaagacacgccugguccgggcaagcacagcagugcccaggcucuuggagggaggugccaugacucucuugcuugucuuugccaaggccuggcccaccuuuuagaguugaucucuucuuugucuaaaaggaaggcacucuuucugcacugcucacugccuuaugguaucaaagcucuuucuaccaggagccaguuucugaaaggccgcaucucacaaacuaaggaccaaagucugaaacgaguuaucugcaaggaagaaaaggauggcuauuccaugagaugaaauucucaggaggaaacacuucccagccuagggacucccauggacuuagauaacauuccaauccuaaagacaaagcaugccuuuguaauguuugcaagcaaagcuuugauaagguucaguaacccaaaguacucacaucugcauagaaaagucuguauuguuccugagugagggaguuaggaggggcagcagaccagaaagaaggaagcagagacaagagcagggaugcugguggcagggagagaacagaaacccaggguggugggcugaaaggcagaagaggacagggaaguuuguaagaaggaguauucaguuuuuggcuuaggcugugaguaggcaaucucaugacagucuccacugcucacugcgauguucugaugugaguggaaccccuguuggggucugcaucuagguggaugaagcaaccaaacaagaacacaggggacagaaacaagggcagagaggccucugggcaccguccugggaacacuguguuuccuguagucccguuucuauccaaaggcugggaggucuccuuuucauagucuuggcucaguuccugaagguucccuccugauaaacacuuagcuagcauguucccagugacucagaagugauuccaacuaggguaucuugccacagcagcaccuggcauagguggcugacacacaucagggcacaggguuugcccugacacccuuucuauaaaucaaaugaggcuuuaccugagagucuuggaggaaaauaagaugacccuggagaacagccaaggccgugcacuuacuguagagaucaguuucauccaggaucuccgacuugauaaucuccucuaugauauccuccagcgugacaaugcccaucaccucauagaaaggguccccuucucccucauuauucacccgcuggacaauggccaggugagauuuuccuagagaacaaaugaaaucacaguuaaguaucggggacauuuucagagaucuuuuuuugugagaaaaaugauacaaaguugcugucugaccaaucucaggauugcacucaucccuggaccuccuuaaaauaugaaguuuuuaugcaagcgcuuauaaaugcaagggcuuauaaaugcaaaccuuauucuucuagauuuguguuucuauuuagggaaguuacugaauauauucaaaaccaguuaguuuuuuuucuuugaacuuuuacauauuagcaaguauauguuagcugauauaauauauacuaauugaaagagcaagaauuuagagucagaauuaugguaaaagucauucuccuccccuaagcccccuuccccacuaacuaucccaguuacuauuccuugacaaaucauuuaaucuccacugaauuaccaucucucaucuagaaucaggaaauaaugccaguguggugauuuuaaaacauggccuuugugguaugccucccacggagaggugugaucuacagccccuccccuugaaucugggggggcuugugacuacuucaaccaaaagagaaugggaaaugaauguucauuauaggacuucugaggccaggucauaaaggcauguagcuuuugcugcaagaacauuguaagaagucugacuacuacccugaggccaccauaguggagaggccacauguaggugcuuaggugccagucccagcugagcccacccuuccagguuucccaccaaagugccaggcaguuuggcagaagaaguggucuuggaaguggaucugccagucucagcugauccagccccuugucucacucacuccccagccuuucuuucuucccucccucccuccuuucuuucuuucuuuucuuuucuuucuuucuuucuuuucuuucuuucuuucuuucuuucuuucuuucuuucuuucuuucugucugucugucugucugucugucuuucuuucuuucuuucucucuuucucuuucucucucucucucucucucucucuuucuuucuuucugagauggagucucucucugucgccaggcuggagugcaauggugugaucucagcucacugcaaccuccgccuuccggguucaagugauucuccuaccucagccucccgaguagcugggaccacagaugagcaccaccacgcccagcuaauuuuuguauguuuaguagagaugggguuucaccauguuggccaagauggucucgaucucuugaccucaugguccaucugccucgaccucaugauccaccugccucggccucccaaagugcggggauuacaggcaugagccaccucgcccagccucuccccagccuuucaagcagcucccagcuguggccccagacacugugaagcagagauaagccauucccgcuguacuucuuuugaauuccugacucacagaaucugugagcauaauaaaauaguuguuguuuuauggcucuaaguuuugggguaguuuguuagcagcaaugguaguuugaacaaucaguaccuauaaggugacuguggagcucaaaugaccuagugaauaugugaaaagacuauaaacuacaaugugucacaggcagagauuucauagacuucauuuuuauugcgcgaugacugaauaauaauaguuuccauuuauucaggucuuacuaugugccagagaacucuaaauuuaucuauuuaauucucauaaaaaccacugagguaagugcuauucuccacauuuuacagauaacagaacugaggcacagauugguuaaguagcaugccugaaguuacacagccuguaagagcaaagcuggauugcaaaccagguaacuaaguucaguacuaaccugggacugaaguuuugucuaauaguccugcuucauauugguuuguuuucuucugcgguauagacacauuuccugguccuuuuucuaaaauaaaaaucugguugguucuuucccuuggcucagagacauuuaaggagaaaaucugggguacugauucagauguuauuauggaaaacaauaaaaagcaaguucaugcuuuauuaguacccuuuauaaacucuuuuuuuauuauacuuuaaguuuuaggguacaugugcacaacgugcagguuaguuacacauguauacaugugccauguugugugcugcauccaguaacucgucauuuaacauuagguauaucuccuaaugcuauccuuccccccuccccccaccccacaacaggccccagugugugauguuccccuuccuguguccguguguucucauuguucaauucccaccuaugagugagaacaugcaguguuuuacccuuuauaaacucuugcuuggccauugcuaaaaaauaucagucaagaggagucaucaguuagugggaggcauaauuaaccauuaaaauguaaaugaacuucuguaucaaauaucugaaaucauaagauagcuaccccuuggaguuuuuaaacugaaacgaaaucggaaagacggcauuuguaucacccaagaauggucucuaauuuuuuccccaccuucaaccuaaccuucagccuccuucuguacugaucugaucauguuacaacucuccucaaaaacacuauggcuaccuacugcuuacagaaucaaguccaggcucauuaguuugguguaauaucaucaagauuccacaauguggcucuucccugucuaacuguaugcccugcuacguccccuacucauucuauacuucaggcauaccagguuaccaccauuuccuugauuucucuuccccacugcugccaucuccccuacccccaacuuugagcucuagcccagguaccagcucuccaagaaagcucccccagaucuacccgacucugaaucugaaccaaccucucuauuacagcauuuaucacaaauugcuacuucuuguaacuagcaauguauguguccuacacuagacagcauuuccuccucagaucaugaacuacuuuaggacaaaggaucauauacuuaaauaaaguucccuccauauaucagacagccaaucagugccugaugaacugaagacugaauaaaaacucauaauuuauacaauaggugauauuaaaaccagauacuaaagaaagccuuuauuuuuugauaaaauauaacaguauguuuaaauuaaaauuuaaaccuugcaucagugguucuaaaauuauccuucuuggaaacaacuacauccuacccaguuuggccaaaguacuuuguagcuuaaauuagauuauauuaauuguuagaaugugcucaauuuaaaguuuuucguuucuaacacauuuuucuuaacuuauggcaccuauucucacuuuucugcuaauaugugcuagcagaugacaaaacaaauaacuaguguaacgaaaagccuuggaaaagugauuucuuaaaauugcuuccuauaauuggauauuuuuugguaaugugaacccuagaauacauauaauacagccauacucccuaccacuaacauaauuuauucauaugaugaaauuaaauuaacaguuuuugauauuuuacaaagaguacuauaauuuccacauuaaaaaaccaccauugcucuacacuuugaaaguucaguuugaggacacacuauguuaucaccaaggaauagagauuuuaagcccuaauuauauaauauuuaagauaauguaccuagguaagcuauuuagaaacauuuuauaauuuacucucagccucugagcuucccuccaaagccuguugagaucugcuacacacaaaugaaggaagccauuucuucuuaaguacagacugggaugggaauugucaaucacaauccuuauuccgaguugacacucacagagacaagaaaaccagcuguuuccaugucacacauaccacacacacucaugaaagguuggucuugaagagcccuaugccugcaccucccuuacucccuuccugggcccuagaggugcuggggguggcccuaugugaagccaaucuugagacaagcacaagucacucccuccugccacagcacuuuguacacaucucuguauuggcauuuauaauaacaauaauagcuguuauuauuauuauugaagcuaccuguugcuaugcacacucuaggggccaggcacagugucaggcauugcacacacauuauuugaccuugguuguuuucuauuuauaugugauccccacccccacccgugaggguaaucucccugagaggcaacagguaugcuacauccuauuuacuucuguuuccucagaaucuagaauagcaccuggcauaucaucaguaaggaaauacaaaucaaaaucuuacaacucuuaagaagacaacuccaaaagugggcaaaagauuugauuagauauuucuccaaggaagauaaauaauuggucaaugcacaugaaaagaugcuuaacauugagaagucaacaaauaguagcugguaacuggauauccacaugcaaaaaagugaaguuggaugccuaccucauacuauacauaaaagugaacuaaaaauggaucaagcaccuacauauaagaguaaaaacuauaaaacucuuagaaaaaaacauaggagaaaaccuuagagauugauuucuuaggacacccaaaacacaaucaaauuaaaaaaauagaucaaauggacuucaccaaaauuagaaacaucugugcaaaguacaccaccaagaaagguaaaagacaauucacagaaugggagaaaauauuugcaaaucauuagauaaaagacuuauauccagaauauauaaugaaauauuacaacacauaaaaaaccaacucaauuaaaaagugagcaaaagauuugaacagauauuucuccaaagaagauauacaauugguuaauaagcaaaugaaaagaugcuuaacauugucaucaugaaggaaauucaaaucaagaugcuaaugagauacuuuauacccacaagauggcaauaauaaaaaagacagauaauaacaaauguugguuaggaugcagaaaaaauugaaccucucagacauugcuggugggauugaaaaauagucuggugguuccucaaaauguuaaacacaaaauuaucaaaugacccgacaauucuacuuuuagagaaaugaaaacauauguccacacaaaaacuuguacauguuuccaaacaaaauguguuauaucaauacaauuggauauuaaccugccaucaaaaggaaugaagugcacccuacaacauggaugacccuugaaagcauuaugcuaagugagagaagccagacacaaaaggccauaugcuguaugauuccauuuauguaaaauuuccagaauagaccaaucuacaggggaagaaguagaucaugguugccagaagcuggggaaaggagaguguggggcauggcuaagugaguacagaguuucuuuuggggugaugaaguguucuggaauuagauuaguagggaugccugcacaacucugaauauacaaaaaugcauuaagugugcacuuuaaaaggaugaguuuuaugguacgugaauccuaucucaaugaagcuauuauuuuuuaaaaagaaagccaauugaaaaaaauaauaauccaugccugaaugagcaggaaguugguguggcugaaaguuacaaccugcaacacaaguugaguaaaaguagggacugcuucguaaagagaauggguugaaaugagaggaaugcugguuuggacuuggguaauaacuuccagcacacaugaucauuuugugcucuaggauguguggagaguaaaaacggucugccacaggugaggccacugggagacaagaaauaggggagaaggcaccguauuaugaguuuugugcaggcggaaauggugaacagggaugagggcuuuaucacaggcaggagagggaaaauaugagaacaaagagcuguuggccugguucacaucuuucagaaaccucaucaacucucagggaugacuugugaauauuuacaacuccuaaacuggguccaacuggggcagugggcgcucaaauaucccaagcauucccaucuuucucugggcaaaugcuuguaucuaacacacauuauuucuccuc

SEQ ID NO: 18837 - RNA, 3743 nt, Homo sapiens
uauuuggucuucgccaacauuguuuagguaaccuaggguuguuuuucucccagggaaugacguagggagugaccaugauauugcuggccaacgcugugaagaucauacuuuuaaaucaaauucugggaagguuaggcuauacaaugccccccucagcaguugcccucugccccugcuuuuggaagcacugaaaguucguugucauuugaccuucaguguugaacuuguaaugcuuaaaauguuauuagugaaacacugugggcaguuaccuuuaaaaccagaggcaauguuuuggaaaagaaauagauaacacaaaaaguugacggauguuauacaaaguucuuuggcuuguguuuauuacucugaaugaaaauucauuuuaagauuuauaguauuauccaguggagaggggcugugauauuguuuucuucugaaacaccaagagaauugacucuucuaccauuuguugaaggcuuaguaagugcaagaaaccuagggagacucacaggucccuagccaaaagaagcuacauggccaacaagcauauaaaauacucaacaucacuaaucacuagagaaacccaaaucaaaacuacaaugagauaucaucucacaccagucagaauggcuauuaauaaaagucaagaaauaacagaugcugguuucuggugagguuguggagaaaagggaaugcuuauacaaugcuggugggaauguaaauuaguucaguaaccgcggaaagcaguguggcgauuucucaaagaacuuaaaacagaauuaccauucgacccaacaaucccaguauugggucuauacccaaaagaauauaaaucauucuaccauaaagauauauguacauguauguucacugcagcacuauucacaaucguaaagacauggcaucaaccuaaaugcccaucaccaguagacugaagaaaauacgguacauauacaccauggacuacuaugcagccauaaaaaagaaagagaucauguccuuuguagcaacauggauggagcuggaggccuuuauccuaagugaacuaaugcggaagagaaaaccaaauacugcauguucugacuuguaagugggagcuaaacauugagaacacauggacacaaagaagagaacaacagacacugggaccuacuugaggcuagagggugggaggagggagaggaucagaaaaaauaccugucaaguacuaugcuuacuaucugggugacaaaauaauuuguacaacaaacccacaugacaagcaauuuaucuauaaaacaaaccugugcauguaucccgaaccuaaaauaaaaguaaaaaaaaaaaaaaaagcaguuuaccaucuaugaaggguguggcagauaugcaauguuaauaauagcugacauuuagagaguccuucuuacaugcaacuaaccacuucguaaauguauuaacucacaaacuccccacaccaacucugaggaaaauacuauuauuuccacagagcaggaacuuccacagagagguuaaaauaacuugacuaaaccugcccaaauucguaagcggcagccagaaucuaaaccuagauaguccggucccggagauagguuuuuaaccacaaaggcauuuucuaaaauugugaaaguacagaagcacaggaaagagacauuuuggccagauaaggguuaagggaaggcuucauggaugaaguggcauucgcucugggucuugaaggucagcagauggagagggcuccuggggaggaaggacucuaacggggaaggaacagccugacgaagaggaacuuuggguaccagccagcugacgacagcaagaucugguccggugcgcgcgggaggaagcugggaagggacgucgcgcccagaucccgagguccuugaggaccaggcccucucugcaaggaaucggggaggaaaaucucaaacuauuaauagaagagcggcaaaaaggaauucgugcgcaccccucucuguuggaaggaccuucccugccagagaccaaggcuggcaggacagguauacuucccucagggggaaacagccgacaaagguggucaaggucgcccgcgcaggcuccggagcugcacguccuggacgaacacucccgucccgagcacagacgcuggguauuuggcugccagcccgggcccgccaggccgggccuggcaccgccaacaccugcucggcgggaacaggaagaccuguguucgggaacucccuccggccaccuccccguauccuccuggcccucgaaggucgaaagguggccucucagggacacccgccgcucgcucggcuccuccccucagccgggagacccaaggaauaacagccucugcgauaggagcacgcucuaccaaucaaccguagucuucgcccacgccucagccggaggaaauugcauugguugcaucauucucggcagccgauaaauuguuuucuuggauuggcuaauagcguuccuucuccccugugccuucgucgucagaagcuggcgauugguuaaucgcguugccaagcuuuggacgcggcucgaccauuggaggccgcgggcccgcccccgccggcuaggugaaggugagugucuccuccagucgcaacggccagaccugaccugccagcuccgggcguggggugaaaucucuugauuccuagucucucgauauggcaccuccgucagucuuugccgagguuccgcaggcccagccuguccuggucuucaagcucacugccgacuucagggaggauccggacccccgcaaggucaaccugggagugggagguaaggauguagugcucuggagugugagcagcucggggaguggagcggacccaacccaggucguggagacugugggagaagccgaggcccaguguggcgcugccugaagagggcggcgccggagaggaggcuggauccacgaaggcuuccuaaaaccugcccauuuuacagaugcagguguggagucccuggaaaggggcgauguguccgaggccgcacaaaccagguguagcagccaagacacaaacucagucuuuccgauuccccauucugccuucuuuauacugcauccuccuaagaaaugaggcugccggagcuuguagagagagguagaaaaauaggaagccugauaggcuuaggguucugguugcuaggaaauggguaaaggagaacuuuuaacgcuagaaagcucuguucugagucgguaaauauuugagugaccaccgaguaucaaucagccaccuuauuaagcuuuguagggggagacugaggcuugauuuugcccuuaaggauuuaaaaaucugcugguguuacacaaugcuuugagacagguuaaugcugcccccggggggucuggggagaugguucuggccgucacagaugugguaggaauggguagagaugguggaaaggaguggagagaaguauggaugguagaagcuuacuuuccacacauccuaucuucauuucuugauucaagugauucucuucuguaccuuggacagcucagagcaugggccucaguuuccccaucugccaagaagauuuauauuggagugccucucaaauuuuuuaccccuaacccucucugaugaauuuguuauucuucucacuaucauuuggauguuugaagccccacagacacuuauuuucuccauuuggauuuugccacgugcaaagaccagccagagagaugaaaauggguaggauaaagucuuaugcuagguaauagacuuagaaua

SEQ ID NO: 18838 - RNA, 3573 nt, Homo sapiens
uuugaaaauauugcaccuuguuuauugacuccuguaguguguggcagcgggugucuacacggcgugugguuauaguuauauagauagauagauagauaacaugugcugaauacagaauacgaaacagaaaggaaacccgguaacaccuccggugggccaccagguccugaguuuguucagccuccccccacccccaacuuuugaucucauucggcugguuuuccucgaagaguccugcgucccccgacaauccggagaucuggaccgagguaucugcugcggaggggagacagcugcgaaacgaaaucgacugugcuauggcgcuccaggcccgcaaagggggcagaggaucgguagggccuggaauuucucaagccacgacccccauuuuucucuccuucaugcuuuuaauuuguuauguccuugggcuccccgccaacgcuucgcggaggccgcggaaaggcagagggagagaagcccuucucgcuuuggaagaaccaagcgcggccaggguccuagccuccuggucuccucucgcugccagggucggggccaucguccuccccggcgcccagccggcguuucugccucagagacaguccuggcgaccggacccagucauccuccucgccccugaguccccuuccccaggccucgagugagcugcgauccgaagcccugaggagcuagacguacauauuuuuuuaacgaggggaccugaccuuuaggucaggcccuucucgagcuucagucccgcggcgccaggcugcgcuggggugcccgccgcgugacccgccccgucccuaccaggcccggaugcccugcaaggugcccugagcgcacgcggccccggcugcaguacccuggugcaacggcugugcgcugccgccgcugccgaagccuccuagguugcucacguucacaaaggggccgccuccggccgcgcugcaggcgggcugcauggcaguggucgccgcggaggucccgccgccgccgccgccgccgcccgccggguacgcacagccauagcugcugcuguaggccgccgcugcugcggcggcggcggcggcggcggcggcggccgcggccgaguucccauagccguaggcggggaagcuguuguaggaguaggcgcuggcgcccacgcuguagggcgcgccguaggccugcgcgcugggcgugacgcacggcuugccgucccgcaccagcaccgggacagccacgcggcgcggcggcggcgggggcgcgugugcgccaagcuccagagacuuguccugccgcugucucuugcacuuguaccugcgauucuggaaccagauuuucaccugaguggaugugagcuucaggcugcuggcgaggugcucgcgcucgggugccgacagguaccgcugcugcuugaaccugcguuccagcucgaagaccugggcuugcgagaagaggacccggggcuuccggcggcugcguggcuucggccucucgcucuccuccgccgccuugcagucuccggccgucucuagagacuucuucagcuggcagcuuucugcggaagaagcaaacaacagcguccuuagcuguucccggccgcaccgcggcuccuguccuggagcaccgugacccuuuuugguggcugcgcagagcgugcgguaguaaauggcuggacuuuugggaacguuuguggcuccuggcgcugugggacccugagacagccccaguacccaaagaacgcccuuagcaggcggaggcgcguuucguggagagggguaguuagugcguguuuauuuggaucuugagcaucugcgagagaagagauuacucuguauuaaauaugcggcucgacgugcuaaugacuauuuucaggaugaaggcuugcaacuacauaauaacuacaguauuugcaaacucguuugcauucuacuccaccaaggauaacugaaggugugaggcguguugguaugagugggccggugggcauggguugcgcgaaaaucuguucugaguguaacgcuugugcauggcucagggacuuguguguguguguggcuuauaaaagacuacaagcgaauguuaugacgacaucugugugcacuuugaaaaugaaguuugauugacuaguuauagacaguuucaugccgauuuucggcucugggaacuaugagagcauaggccuuggccucugccacaucaaaccgccucuuggggaaagacugugauucuguccucuuaaauacacuuccuuggggacuuuauuugauuaucccaucucccuaucaauucacuucccauccgaugugagcagccaagaucucggacucaaguucggcgcguuuucuauuaggcccgcagccugggacacaaagcaaaacguuacggauuuucaaaaaaggcuggcgccuuagggaugugagagcuauggucgcgcggaauagacauuguucccacgcacuuuccgaucaucuccucucucucuaccgagugccacggguucaaggacgcugagcuccaagcagagaagggaggaaaccgcccagcuggccuccaccaaaguuccugccccugcgggugcgagagacacaggcugcuugggcugucuuuucggagaagaagggguggcugcccugggcuaagagaacucaucucacccuagagggaaaacgaaaaagguccaggcuccugcccuuuuugggggaagagccuuuuggggcggggggaagagcaaaaauacugccaguuaugaggacccaggcgcugagcccacgucgccucucagcaucagggcagcaguaaccaccuucccuucccucauuucccccuuuuggggggaguaguugucagggucaccucguccuugucucuccaccccggcucccuugcagguaccugcgcuuuguggagcugucggugaccagggcggaggcauggccccagccaaaggguaaagggaugggcagcugcgcuggcaaggucugugggcuguuugugugcgcucugccauugcuccaggugugcgggugcguuuucuuucccccucuacucacuuuggcuccggucccucacgaccucgggcuccucuucauguuccuugggcucgcugcacgagucucgcaggaccguguggacauagcccuggggacacagcccugaauccccguggccgucugcugcggcuagugaguucaaauaggacaauuucucgcccucgucuuccucguccuccuccccuccgucagaaaauugcguccccucagcggcggccagcaugcagggcgcagaguggaaguggugcuccaaguccgccugcaagugcgcaccauggaagugcuggugcugcugcuccagauucaaaaugucuuugacugagaaagggguggaggugaccgggcuugguaacaucaucagggccacuuaauuguccaguccaaauaauaaaucccggcgggggcggggaggcagcgcggcggcuccagcucuccuccuggacuccgccgcugcugccgagucgggcuuuugacagacgcggucccacuccagucuaaaucgccuccauuggccgggaccugggggucuggguuuugu

SEQ ID NO: 18839 - RNA, 2281 nt, Homo sapiens
ugguauuuuauuuccuuguaugucuugugaauuuuuauuauaagcucguucuccuuaaaacuuuaucuguggacauucuuugaggccuaaguugaccgugaauucuuccuaagggaauugggaaugcuuuagccugcugccuggggcauuacccagaaccucuuugaaugaaauucuucacuaagggguuucaaaccacagugcaacuucagaccacaauccuguacaagagccagcuugugauuuacaaauucuccagggaaagugacagguuggagauaggcaugggguuuuguuguuguucuuguugacuccugcauucugcauggcaggaccuaggccucuuuaccuguacauugcagguauaacccuuucaugacacagguucaucagaggguuuuagucugcacuguggcagaccuuggcuuuaucucuugccuugaccuccuacauuaucaacaaagugagaguuuaagaucuccugggcaggagauuucagaagccagccuaaguuuugggccuuccucaccuccuagggccuuugugucagguucuuuuggguucuucauauuccuuaccucccuuucagugauguuaugauaaagauuuugauuuauucagcauuucacggucuguuuagugaggugcuuaacauugaacuucugaaaugaagggcauauagcuaguguaagcauaccucugguuugcccugaauaguuauggguuacaucuguuuucccaaaacaauaauagcucccccuuucacacacgcacaaaaauugucucauuuguaugauaaacuugugugccuccuacacauagcccugugaauucgauuuugaaucacagcauggauggagaucaacaaaguuguauagauauugaaguguuggcugggggggcgcuauucauggagaauccccuccuuaauucugcaaaccagaucuaguacauugugaauauucuauaaucauuggcuauuuuuuacagcuagcuuuucagaucuauaccugcuuauguacaugaaauguagcuccuguaaauugcagauuaguguauauuaaucuaagaugccaucaacuguaaaauaccuguuauuuucuauaccacgaagaaaggauacugccaauuaaacuuugguaugcauuguugguaaaaugcauccuauuuguggaaaaaaauuagcauuuuaagauuaauacaauacaauaccuguaaagcucuauaagagcuaagucauguccuuuauuucugcuauugauccuuguucuuuuuuccugauuguuccagucuguauugcucuuuuaauccaauaucaucgucaucaucaucagcaucaucaucaucaucaucacuucccuuaucucuuuuucucaacuauuucacugcuagguagcuaacuacuguuuuuaccaucuauucuuucuaaucauuagaauuucaaaaaacugcuuuuuccuuuuuuuuagugguguuuuuaaaauuuauuuauuuauuuuuuaguguuuauuuugaaagcacauuccauacacgcguacuuuccaacuugcuucuuaaaugaguuuuuagauauagagcauuuagaggggcaggaggaacuuuggaaaacaaaggaacuauuuacgcugacugcagaagccagagaaaugcaagcuagguaaagcaccaacaguaaaagugaaacuaaaggagaagccugauauuuucucaauuuguuucucaaacaaaaugguccaggcugaugucgauauaguuaucaccagagaacuuugaagauuaucagccaucacuuauuuauuuagcuuccaguaaaugucugacacugugccaaaaauuuuuuaaaagcuaucuagggcgggugcuguggcucacaccuguaaucccagcacuuugggaggcugagguggguggaucaccugaggucaggaguucgagaccagccuggccaacaugaugaaaccccgucucuacuaaaaauacaaaaauuagccaagcaugguggcacaugccuguaaucacagcuacucuggaggcugaggcaggaaaaucacuugaacccgggaggcggagguuguagugagccgggaucacgccauugcacuccagccugagcaacagagcaagacuccaucucaaaaaaaaaaaacaaaaacaaaagcuaccuaauauaaacuaaauaaagauuacuuuccauuguggccuaauuaauaacccuuucacaagcuuuauuucacuuaccgauuucagggacaauuuuagauaacuaccuaaaaccuauaca

SEQ ID NO: 18840 - RNA, 2281 nt, Homo sapiens
uguauagguuuuagguaguuaucuaaaauugucccugaaaucgguaagugaaauaaagcuugugaaaggguuauuaauuaggccacaauggaaaguaaucuuuauuuaguuuauauuagguagcuuuuguuuuuguuuuuuuuuuuugagauggagucuugcucuguugcucaggcuggagugcaauggcgugaucccggcucacuacaaccuccgccucccggguucaagugauuuuccugccucagccuccagaguagcugugauuacaggcaugugccaccaugcuuggcuaauuuuuguauuuuuaguagagacgggguuucaucauguuggccaggcuggucucgaacuccugaccucaggugauccacccaccucagccucccaaagugcugggauuacaggugugagccacagcacccgcccuagauagcuuuuaaaaaauuuuuggcacagugucagacauuuacuggaagcuaaauaaauaagugauggcugauaaucuucaaaguucucuggugauaacuauaucgacaucagccuggaccauuuuguuugagaaacaaauugagaaaauaucaggcuucuccuuuaguuucacuuuuacuguuggugcuuuaccuagcuugcauuucucuggcuucugcagucagcguaaauaguuccuuuguuuuccaaaguuccuccugccccucuaaaugcucuauaucuaaaaacucauuuaagaagcaaguuggaaaguacgcguguauggaaugugcuuucaaaauaaacacuaaaaaauaaauaaauaaauuuuaaaaacaccacuaaaaaaaaggaaaaagcaguuuuuugaaauucuaaugauuagaaagaauagaugguaaaaacaguaguuagcuaccuagcagugaaauaguugagaaaaagagauaagggaagugaugaugaugaugaugaugcugaugaugaugacgaugauauuggauuaaaagagcaauacagacuggaacaaucaggaaaaaagaacaaggaucaauagcagaaauaaaggacaugacuuagcucuuauagagcuuuacagguauuguauuguauuaaucuuaaaaugcuaauuuuuuuccacaaauaggaugcauuuuaccaacaaugcauaccaaaguuuaauuggcaguauccuuucuucgugguauagaaaauaacagguauuuuacaguugauggcaucuuagauuaauauacacuaaucugcaauuuacaggagcuacauuucauguacauaagcagguauagaucugaaaagcuagcuguaaaaaauagccaaugauuauagaauauucacaauguacuagaucugguuugcagaauuaaggaggggauucuccaugaauagcgcccccccagccaacacuucaauaucuauacaacuuuguugaucuccauccaugcugugauucaaaaucgaauucacagggcuauguguaggaggcacacaaguuuaucauacaaaugagacaauuuuugugcgugugugaaagggggagcuauuauuguuuugggaaaacagauguaacccauaacuauucagggcaaaccagagguaugcuuacacuagcuauaugcccuucauuucagaaguucaauguuaagcaccucacuaaacagaccgugaaaugcugaauaaaucaaaaucuuuaucauaacaucacugaaagggagguaaggaauaugaagaacccaaaagaaccugacacaaaggcccuaggaggugaggaaggcccaaaacuuaggcuggcuucugaaaucuccugcccaggagaucuuaaacucucacuuuguugauaauguaggaggucaaggcaagagauaaagccaaggucugccacagugcagacuaaaacccucugaugaaccugugucaugaaaggguuauaccugcaauguacagguaaagaggccuagguccugccaugcagaaugcaggagucaacaagaacaacaacaaaaccccaugccuaucuccaaccugucacuuucccuggagaauuuguaaaucacaagcuggcucuuguacaggauuguggucugaaguugcacugugguuugaaaccccuuagugaagaauuucauucaaagagguucuggguaaugccccaggcagcaggcuaaagcauucccaauucccuuaggaagaauucacggucaacuuaggccucaaagaauguccacagauaaaguuuuaaggagaacgagcuuauaauaaaaauucacaagacauacaaggaaauaaaauacca

SEQ ID NO: 18841 - RNA, 258 nt, Homo sapiens
gaacguuuuuccucuugcuguugagauuuaggaccuaacuguaauagauuuaccucugaaguuuggugauccaggaagucugcuaugagcccugcagcucuggaaguuuuacacagagcaggauaaaauuucuccaaguagaaguaaaguaggugcuagaggaaaagcaguggggguugggugggcuggccagaguguugugguaacacggaaaaccaggguuugugauuccuccaggcagggcuggggagaagauga

SEQ ID NO: 18842 - RNA, 768 nt, Homo sapiens
auagaaguaauuuuuuaaaaaaagagcuaaaaauggaaggaaaacagcaguuuaauauggguggcguagacgcuguaaauuaguuaaaacuacuguacugugagagucaauccugaagcuuucuuauuuuaaauucugucuuucguaaaacaaaaaaaauuuauagaaguguucgggugguuuagauaaggguugcucaguuuaaauccugagaaggacugaggcggccuuccacgauugguggaaacucugacauguauccuguuccaucuggaguuguugccuuccaacuugggccaaguuugaaaucagcaaaguguugcaauauaaguaguuucagacgguauaggacagcagauuccuuuacuuuccuacccuaguuucucuggucagcucaccuaagccagcgcaggguuuucauuuguucuuccaguucgacauucuguacccuguggaaccagaguccguguggugagucagugcugcgguccugggggcacgcaggguaggaggccgcuguugaagagcagauggcccaggccgugcuucucagccauguggggaugcugcggccaagagggguccugcuuuucccucaucuguugcuaguuaucugaagaaucucugaggaaccuggcugugacugcugaccuucuguccagagugaacuccagcgacauaaaccauaggaggaagugcuguuuuccuagcuucucucauuuccuuccuuccugaagcagauuuagacuucauuuucugacaccucuc

SEQ ID NO: 18843 - RNA, 35970 nt, Homo sapiens
cagugcugggcgagugggcggggccggcuguuggcggcgguuggcucggcgcgggagucggcugcacgugcgggcgggggcgaugcgucacugaucggugaggcgcggccgaggggucggcuuuccucgcgagccugcggcugggcuucuucucaguuagugccuuccacccgggagcgacccuugggagagggaguuucaggaagcucaccgagcaggggcggcccacuggccuccgggggcggaggaguuggcaaggggucagcgggcucagccagaagggaagaaugaggggacagggguacuggacuccccggcucagccugcgagagagcgccaaguuuccggagggagaggguagaaacuggaggggguggaccugucacucacgggacugaggguccuuuucucccgcucccaggaggaacgagaaugaauaugacucaagcccggguucugguggcugcaguggugggguugguggcuguccugcucuacgccuccauccacaagauugaggagggccaucuggcuguguacuacaggugagcggcaugugcagucaguuagggcucuagagcagauuaaaaggguacuccagaguggagucugggaaguuguucccucugcaacguucgggggcgcaugucccaucucuagggagagcacgggggucgaagcgggcuuuugcggagcacccuccagauguuggacaguuuuagugcuauguucguuuuguugcagagauuaagucucccuacgguuauuccuauacacagcaaacucaauuauuuguagaaaaaugaagaaggaagaaaggaaguagucacucuaccucuaacugaagagauggauaaauuauaguucguucaacuguacaggcuuuaguuugccgcuguagaugcuguauguuuaugguuguuucuuagacuuuuucauuuaaaagcuuccagugucugguuacgucuuguaacaccaugaugacugugauggugcuuaugucccuggaccuccagggacauaagcacaacacugaugggccaugcuccucccuccuuacuguugcuguucaaguuggggacaggaguggugugggagcuguugcucucuuguugagcucgcuuagcuuuuccuucagccuaauuaccacaaguuccuuuugauacagacuaguaagagaggccaguuuguggagaaauugggauaaugguguauucaaaaagagcgucaacuuuuugcuuguuuccacuaucccucaaaacugauauuucuacuuucaaauccauccugaauccuagaaaaagagcaauuuuaaugguauaucuuagcagauggagcucuacauaagaaauuacagauuaguccagauuuccuuccaguuuaaaagcauugucuuucugacaguaaaaccagagaaaggacauuucaaggaaugacucaaagaauuaguaaugaaccucaaacaguucaucuuuccuuguuauuaugaccuugcaaauguguuuauauuuucaagaccgguagcuaaguucuaugaauuuacaaggugcaaaauaggacuuuguuuucuuugcuccccaaaugccuccuuuuuauaauuuccagggcuugcuuucauaguuuucacauuccaggauuugguuaacaagcccuuaugcuauuuauuuguauagucuugucacccuucaucuuuucaugcuaauuuuuuguuuuuauauagaaauuuuauguucccaguauuuuaauuaccuuguagauagaucgaaagaauuauaagccucagaaauuuucucuuuacuucaaaguuugcauugucuuuuuuucaaccuggugauuaaauguauuauauauuuugauuuggcucuuguuauguacuauuaauguaccucuacugaaagccauuagaauuuuuuaaacaaauauuucucagaagguuaaagaccgaggagaauccuuugaaccuuagagcagugcuggagacccagagguacgguugguugagcuuaugaaacaagguguaacauuggcaguuuaauuugaucuuuuucccuuuuuagguguggagguauuuuaagcaguuguucauuaugagcaauucauauuagugaggcuuuaguaggucagcagcaugagcaagagugaguauuuauuauagcauuuuagauuuggaaagauaauuuuucuuuuuauaauuuugucaaauugaaacaucuuuuugcaggggaggagcuuuacuaacuagccccaguggaccaggcuaucauaucauguugccuuucauuacuacguucagaucugugcaggugagugauuccuaggggaagccuccauaccagauagacaggcaugacaggaguuaccacacuuguggguggagauagauuuccuuauugcuuaagcagauggugguauuuacuuaaaugcagaaguuaacguucagaguacaguuguuacaacacaaguuaugauguuaaaccaccucacuuacuugaaaugaauuaaagguaugaaccaggaagcuuggaaggacugacuucuaccaucuauaucgugguauauagcaaauuuucuguugcugcugucacaauaaaaguaagaauuagaaacacaacuagacauacaaaccagugauuaugugguuuagaacaguguuuaguuuccauagaggcaggcuccugggcuacuguuaacauggaggaucaaaauuuuuauacacagccuuucugccucauguuuuuuugccugguauauuaagcacaauuuuauguggaaccuuagugaauguuauauuuugauggcaucccgggauauuugaaauaagugucuaauccucgaaaagugucuuggccaugggagacaauaaaauaaguaucuuucaauguaacaagaugacaaaaccaggauuaggcugugaccacuuucgcaagcccagugugaucauaaaucuuuggauucagaaguuugucugccaucugcugcuaauuuuucaggacucaggaaaauucuguguuauuuaaucuuguaaucuuaugucuaggcuuccugcuaagugagaguuuaauuauaaauucuuaaauccccuagguuuucuuccuguccccuuuuagauggcuuagggaaagaauugugucuacugaagugaaauguauucuuccccuaaucagacugauuuccauauguuguuccauauuuauuuuacccauucuuuccuuaguucaugccaucacuucuuuaucugccaucucacucuccauuccuuuucuccugucuaaaucuugccaggcuuuuaaaggcucaucccagauucuuccucuucugaucuauagcucuuaaagucuauauuguaaauuuuggcccuuugucuuauuuucuuuaauauuguugucuugcauuguuugcuaaguuuuuuuauguguuuucuuuccagaaaggcuccaguuuucuuaaaggcaggaguuguaacacauuuauauuucuggcuuucuauuuaugguggaaguuguuaaauugagcugauuucucaggaagcaaugugguguaaugaacauggggacccagcguuaccgccaguugguggcaugacuuuggaaaaauugcuuaacugucauagacuucaguuagucuucugugaaaggaggaauuuuaauuacauaaccucaucaacagccgaaacaaucuauaauaauguuagcaauggcagcauuagacccuuaaaaaucaagacucuaaggcccggcgcaguggcucaugccuguaauccgagcacuuugggaggcugaagcagguggaucacuugagccuaggaguuugagaccagccugggcaacauggggaaacuccgucucuuaaaaaaaaaaaaaaaaaaaaaucaaggcucuaacaaauagaucuuguucaaaaccagguagaucugucucugccuucaugcuuaguauguuaagucauacugaugcaaaaauauaaauaaaggagauauagauaauaguaaacagauuuuggaguuuaauuguguauauauauaacaaauauaguguguguauauauuuaauaauaaacuaucauaagagauguaaaugaaauuaguacagagacuucaguguaaacuaaaauacuucgcaucuacaaaaaaguuuuacaugggcuagagccagccagugugacuaaauaggaauguucuuuauguguaaaacgguaacauucuaggaaauaauuauauuaauaaaaccauauuuaaaaaguguucuuggccgggcguggcggcucacgccuguaaucccagcacuuugggaggccgaggcaggcagaucacuugaggucaggaguucaagaccagccuggccaaccuggucaaacgcugugucuacaaaaauacaaaaauuagcugggcgugguugugcgugccuguaaucccagcuauuugggaggcugaggcaggagaaucgcuugaaccugggagaccgagguugcagugagccgagaucguacccuugcacuccagccugggcaacagaggaagacuccgucucaaaaaaaaaaaaaaaaaaagaguguucuuaagagaguaagacauaaauuuauuuuuaggaauuuuuggaacauauuagaagacauaguccagauaaacaaaugguuuaacaaacuuggcaauugaaaggaauguauauaaaugugaaauuccauauaugauguaaaaagaaaaagcaauggagaaauuauaugaaaaccuucagccuucauaaaguaaccauagauucacuuuuuaaauaaauuuucugucauacugggaaaguaauuuuuaagaggacauaaaagaaauauaaaaguacauaaagauaggguguuaaauggaagauuuaacauuugaacccuuuccuaguucuucugaguuugaaaauuggcuagagaauauccuuuugguuuaaauaggaacguguauuuaaaguugguguggaauauggaaacugaauuaauguuauaaaggaaauaaauauaauuugucucuucaucaauccccuuaaccuagaacugccaccaauguuuacugucauucuaaugucucaaccuaagaguuauuuuuuauucuuuccccuccuggaauuuuauaucaaccaaguaucagauaccuccucuauuaugucuggauugacagcuuucauggccuuuacugaauuaaucuaaauaaauuaauuauuuagccucccagcugguuuucuuaccucccuauaagauggagaaugagaacuacaucacaugugagaaaaggaauuaaguaaacauauuuuugaaugguucguuuugugacuguauauaaggugaacuagagagaucccaaacuccccagccagcauucagggcccucugucuaguauuaccauggucucuugucagaauuucaucuuucauccaaauugucccuucugcuccaggcaagccuaucuacuuucguucgccuauacacauguugucuucaacuguguguauuucaguaggauauuuauugagcuuaagauguuccucugccucaucuguucuuauuucucccacucuagaccuggcuuauaaauccuucaccucagagagcuuuucaaacuacuauuuuuuucacuuucuguaauuuaccacuuaacaguucaguuuauaauuuguguuuuugguuuuguuuuguuuuguuuuguaccuguugauggauugauugcauuguaacauuuugucuccugugcuggauugugaacucuuuggaaacagggacugugauuccuuuuuccuuugcuuugugcuugauaagaugcaguaugucuagaauguacucauuaggugcugaccuauuugaggccuuagaguacagcaggaagucauucauucuggaucugaacaaaggugugacaagggcaaagcaauuaaguaccagauuguugguucaccaggaggaagcaguacuggugguagcacuucuauuaaaaaggaaacugaauaggacaugugagagaucacuagguauuaaacuaaaauguugaccacagcuuuagagaagaaagguugcuguuggauucaagggcagcuuugagucuuagaguacuuguaugcauaaaaucucuuuuaucuucaacauaaauaguaauauuagcaguggaaucaaaguucagagugcaaguuguagccagaguaucuaugugagcaagcuguguuguuuacaaccccuggccagcuccaggcagguaagggacucuggaagaguuuucuacuuauuagcagacugaacauugaaccuuucccagugaaucuuaauucaaacauucgcuguaggccaggcacaguggcucacgccuguaaucccagcacuuugggaggccaagguggguggaucacuugaggccaggaguucaagaccagccuggccaacauggugaaaccucaucuuuacuaaaaauacaaaaauuagcugagcguaguggugcauaccuguaaucccagcuacuugggaggcuggggcacaagaaccgccugaacccaggaggcagagguugcagugagccaagauugcaccacugcauuccagccugggugacaaagcaagacucugucuccaaaaaaaaaaaaaaauugcuguaaaauauuuucugucucaagucuuucauuucuacuagaauacaaaaagaaaugacuguucugagagcuaaucuuugggaacugaaauugugauggaucucugcuguacuuacugucagcagcuuuccagagauuugccucugguaccaguaguuuuuugacaaugugugucuugaguguugaugagauaucuuuuccucccuagacaacacuacaaacugaugaaguuaaaaaugugccuuguggaacaagguaagcuuucucuuugccuacgagccucccuuuagcucagacagaguuucuguuccuacagcuaugaucacuuagacauaucucaaauaggcaugauaguuaacccaaggggacuucugaucugagcauuguuugagcaaaggccuaucuccaaauaggagcuuuuccaucuuaagaaccauuauuguucuuaugguauuauuggaaaaaacuggaguuuuagagcaaguagaccuaacuguguauuagcacugcugcaucugcuuuauugacuauuuuuuaaagacuuuauuuuuuacagcaguuuuagguucauagugaaauugaccaaaaaguacagacaguuuuuauauaccucuuuccccaacacauuccuuuauugacacuuuaaagcuuaguuuccuccuuuauaaaggcaguaaaaucuaccuugcagaguuguuguaaggauuagaauuacuguauaugaagugccuaaccagaacuuggcccagaauaggugcuuaauaaaacauaguuuaaaauuaaucaucccaccgucuucucaucuguaguguuaaaugccaucuaauuuagaguuucugauucaauaggucuggggugaggcccgagaauuugcauuucuaacaaaaguuccugggugaugcugauacugcuggucugaagaccucacuuugagaauugcuguccuaaagagguuuagggaaagaaaggcaagcagggcccaaauuauuucuaggguauaaucacugcauugaauuguaucaaaagaagaaugugaaguucaagguauuuuuuaaauuacuuauuuuaaaugacuauuacaaguguaaaaaagacauugacaucuauagagggacagaaaugcuaugaaaaaggaagcgaacucuuucuguguuuuaagugaauauuaguauguuucauuaucagcuucuccccaggucuaucuauaacuguguuuuauggauugccuuuaguaguucacacuuuuuuucuuuguuuuuagugguggggucaugaucuauauugaccgaauagaagugguuaauauguuggcuccuuaugcagguauguuacccaucuaccugugguuuuuauaguuauagccagaggauuuauagcugagagauucuuugaggaauagaaggguacuuugaaaguuuuaugacuucauugaucacugauuaauaaauuucuggggaauagaggcaaaaauaggucagaaguucuggacagaguugacuuucugcaacuguaugaguuacucuucucugagcuuaguguuucuaagagcaaaauggucauugguuauuucuagaauaggaaaguaguauuuuauccagucaggaugagagauaauuuccuuggguguuagaaaucuguaacugaucaauuccuuggcccacacugauuugccaucaaagagaaguauuuucuaguugagauuugcuauaauuugcaaagcagucugaaagccuucaacguggggaaagcauuuucuugauaaaagaugaaaaccuacagguaugggguggguagguacuguuguaaucaaaaacuuaauuagaagcccugaagaaagauauaccgucuuauaugcaugcuuguuaauaaaacuggcaugucuaguauguacagaauauuguguuuggcaagaauaauuugaaaagaugaaauuacagccuuugccuucagggguuuuaauuuuacuugagaagacauaauacagagcuaaaaaaggauauauugggauguaaggucauaauaaauuucacauaaccgguacaggcacaaauagugaaaagauuucagaguagagagcaggcguauuacugucaagggcauuuggauuauauuuuucagagaguaagcauuuuccuugucuuuuuuuccucuccuuuccuugauuacaaaucacuggaauggauuaugauugaaaaagggaagggacugaugauucuuuaaccagagauuaaauaggaaacuauuuagauauaauucauuugggaaaugaucaagcaaaugauuuagucauuaaguauuuauuaauggccuguccauuaauuuuuuuucuuuuuugagauggagucuuguucugucacccaggcuggagugcaguggcaugaucucagcucagugcaaccucugccuuuuggguucaugcaauucuccugccucagccucccuaguagcugggacuacagguguaugccuccacaccaggcuaauuuuuguauuuuuaguagagacaguguuucaccauguuggccaggcuggucuugaacuccugacucaaaugauccacccaccucagccucccaaagugcugggauuacaggcaugagccaccgcgcccagucggauuugaaauccaguugcaucuaauaucccacaugggaaggccaguggagcaaauucuuggaucugaagacagaaguagaaagcagcauguuuuuguagauaaagaacagguucugacguggucuaguauguaccuuuugggcauuucuaaaauucucuguuucuuaguuuccuaauaugcaaauuuaggagaauucagugcuaauuuauguaaauuaccugauauaaagcccagcucaguuaauguuuuaacaacuuuaaaaaauugccuuuuuaaaaacggucuuuugcaacugcuuucuucuuuuauuucuacuguuccucaguuugccuagucucucuuuaccucuuagcuaaacuuuugcaguaauugccuuaugcuuucccugccucugaucuuuaugcuucucaguucaucuucacacugcuggccaaagcguaaaucugacugucaugcccuugcuugaaaccuuugauaguuccuuauuaccuccaaaauaauggauacuuuaguguggacuuuaaaguuagccccuguuugaugggcuaaccagcagguguuuggcauuaguauuacaaaugcaaggguauuuggaaaauugagcacaagcaacacaucaagauuuguuaguugugguuuuugguuucacuauuuuguuggcacuuuuccucauguguaauauaucacccugacuuuuacccuggcugaauuugaagguaccugugucauuguuggguaaaacaaacauggguuguaccucuccuucaguguuugauaucgugaggaacuauacugcagauuaugacaagaccuuaaucuucaauaaaauccaccaugagcugaaccaguucugcagugcccacacacuucaggaaguuuacauugaauuguuugguaagugucuuaauucuuauguauguaaauagccaauuggaaaucuuuguucagcuuacuuauugagguuauauugguaaaccuuagugcuauuuaagcauuucuucugaauuuaucauagagcaauugucuuuaaaauauuuuuuaucuuaaguuuaaaauuuuuuauauaacuuguuagagauuggaaaaacuacucagacuguauucuguuuuuacuguaauaacuuagugaaaauuagcuuuguugauguuuuaauagauaauuugaaaaauuuagaaaccugugucuugaggcucccauuuuugaugauuugguaggagacugacaggacucagcacauaguuguguucacagcuaagauuuauuacagccaaaggguacaaagcaaaaucagcgagaggcaaaggcacaccagcaaaaugcagaggaaagcaggugcaggcuuccaagagucaaacaugugccuaauucccacagcaacaagcugugacaacacaugugaaauguugucuacuagggaagcucauuggagacucauugcccaggguuuucacugggggcugauuauguaggcacccucugccuaccacauaaaaauuccagacuccuggaaggaaugcagguguuuggcauaagccacauuguauaaacaguucacagcaagucaauuguauuagcucuggggauagugggacccuucuacaaauccaaguuccuaggugccaaccaaggacgaguuuacaaaaggccuuucuaaggauugcaguaucagcccugcuuucuuaacucacuucuguacaacuuacuuuucauuuaugauaguggaaguucugaccagggaaugaguuguugcuguugguagcucacuuuucccuccugaaauuuuuagugaauuucuaagaugaaggaauaagcaagaguaaucaauuuaaaaucuaccaauugaguccucuuuggugauugucaaccacugaaguggcaugugaggaaacugauggguccugcuuugucucaccaccagucauuuaaauagcgaaaguaccauugaggugaauagaaagugcauaguuacaagcccaaguguucaugcuguguauauuucaaauacuuuucuaugagcuucucucucugucucucucucucucucucuuuaaauccaaaauaacagugaggcugagauccauggaaaugaaguuuaguuauuugggaauuugaguaaagauuuacugaacauagaaauuuguuuuucuuugagaaugaggauacauauugaguaagagcccugaauuaagauacuagagauccagauucuccauuuauuagaucaacauauuuuacccaguaguuguuuauccaguaaauaagucuaauaaguuacccaguaaaaaagcuuauccauaguuaaguaauacauuuaguggguaaacuuauuggauaaacagacuaucugcuugucaucuucguuccuuaauuucuuuauuagauaauuccuugcaauuuuuuucccacacaaaagggaagaaaaggcaguuuaagcucuguaaaagaauaguacuguggaaacuuuaggucuaauaaugauuaguuuuguuucauuaugaauacaauguaaaaaaaauugacuaucaugagaucuguuguucuuggcuuaaaaaacagaucaaauagaugaaaaccugaagcaagcucugcagaaagacuuaaaccucauggccccaggucucacuauacagguaaguucuuuuccuagggaaguucucuggggauuuugagagcuuugaguuuguuccuccuuucauuggauuguuuuauucagcaauuauuugagaugcuauggugauuuauagaauaccuuucucaauuugacuuuagaucucugccaaaauaaaauacucuuguagcuuacuaugggugacauuugugaacuccuagagggaacugauaagcugaggcucuuacaaggaaguaaaauucauauuucugccauguaugaagcauuaagauacaguaaugguuauaaaucaguguaagcauaaucccugcccucaguaagauuaugaaaagggaguucaaguguaaaauuugaacaauccuggacaaaauaguuaucacaaaguauuaauugacagaugaaucuauugaaugauuauugcuguaagaguaagagaacauuggaagacagugugucuaggagagggcugugauugaguugagauuuuaaguagguuuggaaaaauuaauuggauuuaaaugggggaagaaugagaaagguauuucaagugggagggacagcccuaguaaaaacaagguagcaggugaauuuagugguaguggugauggugacguugggaaauagaauggugagagguuuuaccccugcuuuuuuuugggucacuguguuuuccagauuguggguuguaaaaucaacuuuagugagucaugaacagcauuuuaaauaaaauggaauagaauaggaaaagaaaugguauguaauaaguuuaaauauucugugacacuuguguuucacaguguggcgggguagguguuuauauuggacgucagugcaaaauguguuucuuacuguguccacugucaguaacauucgaaagccacugcucuggauccagaugaccuaagaaguuauauugaggcuucucuaguguccuuucucaggagcucuaggagaccaguugauuguugauuguugugaugaacauuacugcaacuaaagcuuaucacaugucucucaauucuuuacacucagcaccacugcuacugagagugugcgcucacugugauuguauguguucgugcuucucaaaaacaagacugaaagauaggugggguuuuccucauggccucauucaugcaaugucauuaucucaggcgcuugagggugagccaccagaguuaaggggucguuugaaauguccagagguaacuuuguaaaauccucugaguuguucaagucaguuguagcuggaguagcuuuuuaguuuuaaagauagugaaugugaaggucagcucuuagauucugcccaggguguuacucagagaucuagcucauucaacuguuguuuagaauuccuugccuuauauuacuuagccauuuuucuguucccaguuuuuugcuauuaaacaauaguguaaugaacauucaugacacauguucuuguauguacaaauuaucuuucaaacugacuguacaaauguacauucuuaacagcaauaugugcaaauaauugugacccaugaacucaccaacauuggaagcaaucagacauacugauuguuaccauauggaugggugggcaauuauaucucccuuugauuugcauuccuuugguuguuaaugagguugaacaucuuuugauacauuuauuggucauuuauacugucuucugcugauugccuauucauaucuuuugcccauuuuucuguuggauuguuuucuuucuuacugauuuguucuguauaaauuuggaauuuuuauacacacacguuauuuauguuguagaaaaaaguuagauacuaggaaaaugaugaagaauaaaaugaaauucaccaguaaucuuauuaugcagggauaacaucauuuguuauaucuuucucgacuauucuuaauguauaugaacaaauguuuguagauauaaaugcauacaugcucaacuaaagcagaaucauaccauacuugcuuuuuucacuaacauugucuaugaacaucuuuccaaaacaaaaauauagguuugguaaaucauuacuuuuaaugguuauauuuagugaaucucuaugguuucaaauuuuuuacuacuguaugcauguuggaaugaccaagcuuauauauucuguacaucuuuuuaaaucccucucuuacaauaaauucuugaagugggauugaugaucaaaguguaugcccuguuugggggcuuauugauacauacuaccgaaucaccuuuuagaaaaauuuuagcagcucccccccucauuagcaguguugguaagcuguaguucuuacacauuugauugcaugauuguacccaaauaauuagcagaugcaagcuuucccuuucucucuuaauccuuuuggagaaaauuagucuguuauuuuguguuaauuauugaaguugaauacccuagguuauuagcuguuuuuauuucauuuauaaauuguugguuuugcucauuuuuguaguuaaugguuuuucuaacugauuuuaauaagcuauuuuuggcugggcauagcggcucacaucuguaaucccaccacuuuaggaggcugagguggaaagcucccuugagcccaggaguuugaggucagcuuggacaacauagugagaccccuucuccacaaaaaauuuuuuuaaaaaauuagguaggugugguggcaugugccuguagucccagcuacuugggaggcugaggugggaggaugacuugaacacagcagguugaggcugcagugaacuguguucaugcuguacucuugucugggcaacagagcaaaacccugucuauaaauaaauaaauaaauagcauuuguauauagagaacuuguuuuugaaccuuacccuuugagagggguagaauucguuuuuaaaaauaaacuuuuucauauguuaguuauuguagcucuuuuuuauauuuauaggaaacauuuucuucaaauuuuuucuuugucauuuaacuuuguuuuuuccuugcugauaacuuugaaguguucauguuuuacauaguaauuucagugauuuugucuuuaugguguguugcugagcuggcauguuuuaagagcuuuucaccaccuuaaaaguauagcaauuaaaauuagaaauuauaaaaauuguaucugcuuuuacaguuguauucuuagauuuaaaucuuuuaauucaucugcaacccauuuugaucucaguugcaagguaggccuucagcuccauccccucaaccccaaauuggguaacagcgguaauuacugaauaguuuauuuuuccaucuucccccuucuuugaaauaguuuuuauguuacauacugcauuccauuauauacuagagucuuuuucugaacuuaguucuguuccauugaucuucccauuccuacucuuucauuaguuauugaguccuuggucuuuucucaucaaaucgaauuuucuccuguguuuuucaucuugucaguuaaugguaacucuuuccccucaagccaaucuagaaguguaggaggcaucuuugacaaucgccucacccucagcaucuaaucagucccuauguccugcagauuccaccaccaaaauccauguauuaauaaaacugaccacaccuccaucuucacugucaucucaagccaagcuaccaacucuaaccuugacaugugcaguagcaguagccgccugucuucuuuccccacuuucacuuuuaccuuugucuacuucauuuucugcacaacagccagaaggaucuuuugaauuuacuuauauuuauuugcuguuuuuauaaaaaguuauugauugaaaaaauguaguuuuguuauacguucuuaaagugguagagaucuccauuguuuuaggguuuaaaaaaauuuuaaaauaauuuuuauauuuugcaauaacuuaagcauacccugagaagagaagagcuccuuugcuuugguugcuuuugucuuguuauaaaauuuuuuuuacaauaguuggaaugcauuuuaagaauuucaaggcuguuuuugagcuuuguuauuuuuaacacauuaccauaugguugugauaauucaacuuuuuauuuuaaaaucuggcaagagacaucaucuuuuaaaaaauaauggccuuugcuguuucugccagcuuaaucuuccagaugaguuuucauuaucgauauuuucaagcuauaucaggcaccuaaguggucauauacauguuguuuuguuuuguuuuguuuugagacagggucucccucuguugcccaggcuggagugcaguggcaugaucauaggucacugcagccuugaacuccugggcucaagugauucuccugccuuagccucccaaguagcuaggaguacagguacacacccccacaucuggcuaauuuuuuuauuuuuuguagagaugggccuuugccguguugcccaggcuggucucaaacuccuggccucaugcaauccuccaauauaaguuaaaaauagaaacauaguuuauggcuuuacuuuaucauaucagccuuuuugguuuuuagaauuucugauuuaggggagaaacucauauccuaaguuaaauuaauaccaauggauuuaaugaauuuuaaugcuguucaauauguagucuuuuuuuuuuuuaaucauugaggaaugugauugauucuugguagauuuaucuuauaucuacaacuugaauucacugccuucuaguaauuuuuggguuacuauuuuuacagucacuauuauauuuuuuuccuuuccauauauuuauauaccauuuuucuucuugaaaaacuacucuggcaaauuagaaugaugaaaauggucaucuuugauuuuuuuuuuccuauguuauuuaagggagugacuauauuauagacuggcuuuugauauauaauauaugcuuaaaacccaggggucaguuucaauacauauauuccuuucauuagccauuuuuuuccuccauucacucuauguaugugagugggaugggggcauuauuuuauuauuugagguuaagagcagagguuuaauaggcaaaagaaacagaaaggagaauagcucucucuccugugagggagaggggugccugagugggacuucccacuuuuacuuuuaaaaucucuuuugaugcaacuuacucaugguaucuguacaguaaguguuuauguuuucacauauuugaaaaucugugagauuucccaagauuggcaagcacaauguaguauguucuucagccucauucagcaaaauaggagucuucaaaagacaguccuggccgagugugguggcucacgccuguaaucccagcacuuugggaggccgaggugguuggaucaccugaguucaggaguucgagaccagcuugaccaacacagugaaacccugucucuacuaaaaaacaauacaaaaauuagucgggcuugguggcgcaugccuguaaucccagcaacuaaggaggcugaggcagaagaaucgcuugaaccugggaggcggagguugcagugaacugagauugcaccaccgcacuccagccuggguaacaagagcaaaacuccaucucaaaaaaaaaaaaaaaaguccuacuuuacgcuucuuuuaauaaggcuaaaaagauauguggccagucucuuaauuaaaugcaguaugacagugcuuccuugaaucauauuaauccauauuggaaguaaucuuaugucugcuagucacauggugaaaucugacaucucacaaaaucugguccugaauuuuuauuugucuucugcaugucuccacugaguugugaggccucacaugugucacugccaguguguugugaguuuuuuccacacagccuucagcugcuuauuccauuccacuguaauccuuauauuuaguuaugauuguccucaaaauuaccuacaaauuugacucaucuauuucauauaggaaaugcuauaucgcuuaaaaguuuuaaaagccuuuaaagaagacuaagugcuuaaaggcuuuguuauucuuaaaagguuagccaguuuucagaaggaaaacuucuucagaccagcaaaguguuuuuuguguguguuugcaguauagguggggcggcgggguaucguauguuuaguaaaaucaaaagcuuuugagagaucaaguccuugauguagaaaagucagccuucaaaaaacaguacuguccagguagauaaucuuaauugugucaaagaacacuaugauuagggaaacaaagugucugguaaacagccucuacaaagacagacuuuguucuaagugagaguuaaggaagaaagaauauaagcuuuuaauugauauuuguuuuccuucagccagugggcuguuuacuuacagcaaauaccaagugauugcagggguuggaagugauagauuaauuuacucacuacucacuguauuaaauuguauacaccaaccuggguuuuuuuguuuguuuuuguauuugacuaauuguuucugacuuuacaauuucagucuuggaacuuugccuucccggcuucuuugguuuacaggguugaaaaagaaagcaaaaguaucuaacgaccuuuguaaaacaucuuuuaagugagaaccuuuuucauaaggcaguuguuuccucaguggguagaugguuuuuccuguaaucuggcauuguguaaggaaauaagaagcagcuugucuuugauucuuggugugauggcaugaaaaguaaauguucuggugggauccccaaacguguuaguaggccgcuauauuauagcuguuguuuauuagauuaguaucauuugaggggcuuuucuguagaagauuuaauuugaagauuuaucuuucaaauauacuuuggcuuuuucacuuuuauuuuuuaggcugugcguguuacaaaacccaaaaucccagaagccauaagaagaaauuuugaguuaaugugaguaauaugcaugggaucccaauauuucuguuuagggcugucugcauauuaauauuccagucuagaggaaacaugugagacaauacacucugggguggaguaugugucuuaucuucuuuacucuuacucuaguaauauugccuauucuugugucuuaauucccacuagacucuuacuaguguucucuuuauguauggacauuucaggagcaguuucaguggcuaaagaugcaguuugcuguaaaacuauugcuggaagcuuaaggagcuauaauuuuauaugaauaguaccuugaauuaaauauuuaauagaggaaagaguccugaagccguuaggguugaagagagugcucauauuuuguuucuguguuguaaugguaggaauagauaccuuguugguauaaaguuugguuuuccauuguaugugauuguauaucuaaaauuagaccugguucuuuauaaugugccucuagggaagccuugcuucuguugacuccugguagucuucucuuuuauguauccagggcugacugggaaugagaagacaugaaauuaguuucugacaggaucccuuuuaggggaauacuuacuguguuugaaauggcaauauuguuuucguaugacugguacugaaaagaagaaauaaaagucuuuaggaaauuuggcugauguguuaaaagggaaaguauaagacgcuggaaaaauaaauuugcacaagucaaggauaccacagauguauaaauacuggaaguccaaggagcaguaauacuacuuuaugagguuguuuacuucugaguccuuuuuguuaccaugcagauuuuuauuguuuuuuucuucuuuuauauuuuccuuuucccucauaccuucucugagcucauacagaguuuuauuucucuuuuucuuaauuuuuuuuuuuuugagacaaggucuugcucuguugcccagacugcagugcaguggcacaaucacggcucacugcagucucaaccucccaggcucaagugauuaagcgauccucccaccucagccuccugaguaguugggacuaccagugcaugccaccacaccuagcuaaauuuuguauuuuucauagagacggaguuuugcccuguugcccagccuggucucaaacuccugggcucaagcaguccuccugccuuggccucccaaaguacugggauuacaggcuugagucaccacacccagccuguuuucucuuuuucauuguagacaaagaacucuucuuuuaaaaguauaaaauguagacugccaggcuggguagauuauggaugugauccacuuauugaaaaaauauuuauaggcgggcugugguggcuuaugccuauaaucauagcacuucaggaggcugaggccggcggaucaccugaguucaagaguuugagaccagccuggccaacauggugaaacccugucuccaguaaaaauagaaaaauuagcuggacaugguggcaggcaccuauaaucccagcuacuggggaggcugagguaggagagucgcuucaaccggggagguagagguugcagugagccgagaccacgccauugcacuccaaccugggcaaaagaacgaaacucugucucaaaaagaaaauuuuauuaaacugucagcaugucuuaggcuuuaaauaugauugcuuaggcugggugcgguggcucaugccuguaaucccagcacuuuugggaggccaaggugggcggaucacgaggucaggagaucgagaccauccuagcuaacacaaugaaaccccgucucuacuaaaaauacaaaaaauuagccaggcaugguggugggcgccuguagucccagcuacucgggaggcugaggcaggagaauggcgugaacucaggaggcgaagcuugcagugagucgagauagugccacugcacuccagccugggugacagagugagacuccaucucaaaaaaaaaaaaaaaaaaagauugcuucuggugacggaaaaaugaauauuguguguuuucugcucucaaauaaaucauaguauucagacugucauuugaugucuuuaucaauguuaucagaggaaaggggaaacuuugaggggaaguguuuuggggaaacuauuggaguuacuuuucagaugauucuggaucuuucuuaauuuuauggacuauuggaauuccagaauuaaaagcuaccuugggaugauccaguauaaccuugcaccugauaguaguguuuucuuauaccauuucugccacgugguuacccaguagcuacuuguacaugcuuaguaauaugccagccauuuccauuacagguuuaguaccccuuauccgaaaugcuugggaccagaaguauuuuaaauuuuggauuuguaaagauucuggaauauuugcauagacauaaugagauaucucagggaugggacccaggucuaaauauaaaauuuauuuauguucuuccuuguugguauagugguuaguuuuuuuuuuuuaagguauuuuauuuaugucccauauacaccuauagccugaagguaacuuuauaaaauauuuuaaauaauuuugugcaugaaacaaaguuuaccuuaagugcuuauguguggaauuuuccacuugugucauaaugugggcucucaaaaaguuucagauuuuggagcauuuuggauuucaaauuuucagaucagaaaugcucaaccuguauuagacacuggaagccuuagaaaauucuccuuacuguaagccccaguuuacuaccuaauaacuaccaccuaguuauaucuucugugcaacaaauauggucacugcacaugggugcccaccugaggagggcaggggcugaaacccagcuucauucugcaugucaaaccaugcaccugcaggacuguagaaacggcuggugccguuuucuaauuggcacagagcugcuguauggacuagcuggaggucuaacagcaaaggaaguauugauauauucccuuccaaaucacaggcuuuacacaauacaacuaggagaagaaagccaaacuaaaauucaaauguacuaaauuuuuuuccuaucucugggugacuuugggcaaaucauugaaucuuucaaccucagauuuauuauaaguaaaauaaaguaacaccucucuuaaccuaccuuaauggguccaaaagcucauguugacaaaacgguucucugacucacuguagggucagaauuacuggcugugacugcacauaggagaaucauuucuaauuuuuauaacauuuugcuucacagggaggcugagaagacaaaacuccuuauagcugcacagaaacaaaagguuguggaaaaagaagcugagacagagaggaaaaaggcaguuauagguacuuggauuucucugaaaugauugucucuaaguacauuuguuuguccuguucuuugucagucucauuuuggguaucaugggacucaguaagauugcaucauagguaguggggaauucuggaaucuccacuguacauucagauguucuaaagccuuuaaaaguaggugagaccaguacuuaaugaugugcuguggcuguccaucauguuguuagaugcuacuguugucucuuucaagaacagggagaauggauaggguuuauaggcagcuugagucuguggauagcauuuucauuuguacagauuaagaauagggaaguuuuuugaccaaaguuucagauuguaguaugcauccuuguuguugacaugcacuuaguuuuaccuggauagguagugccguuuaugaaagcauggcaggauuguuuacaguucauuucagauuacaguggcuucccuuauacuccaggucacuguguauuagauugcccucuuuggcccucgguugaugcugaaaguuuaauacaucuuuaauuaaauaauucaauuauagaggaauguacagagaacaauauaaugaaagcuuaagauuuugccuuauucccuucagaucuuuuuuuuuuuuuuuaagaaaaaaauuaaauaucuguuugaagccuccuuuguauguucacugguccuacucuuugacuuuucuucucagauuaacuucuauucugaaguugauguauauccuuucuguccauauuuuuauacuuuuacuguaaguguguaagaguuuauaaaauuguuuuaccuguuugaaacuacaaaaauguuaccaaacucuuauuuuacaacuugccuuauuuucacuaacauugaguuuuauucauauugauacauguagaucuagggauuuuuucuuuuuuuggcauuuuauccuuauucucugugagaugguagaucguuuauguuuagcugcuacauuuuucguucuaugagcgggccuaguuuuauuguaaugaauuaccaaugaggaguuagguaguuucuaguuuuuccuuauuacaaacacugccacaauaacauucuuauccagugccuccuggauacaguguacaugugcagguuuccauagaguagcauuacucaguguauggugugggccagugcccuaucaccagcuuuuuguuucugagccucaaugagaugaguauagaaauugagaaugaguguuuagaaguuuuuauagcauuuuaauacagcaguuuuaugucuguugaaucaaaaauaaaaaaucagagcuuauauauuuauguuuuuguuuuuuaauuucuuuuuucuaguacuguaauuuguuuuuguuauaguuuacaauuuauugguuccucauaaauugaaauacacacacaaaaagguaagguauuuuuccacaggugguuugagaagcacugcucuagaauagcuaucucaaaguagaauugaugggucauaggguagcaugucuucacauucaacauauugacaaauugcucucucaaguacuucuuugauuuuaccaucucuucaacaauauuugauauccaguuucuaugcugccauauuugaauucccauuuccacacauccuucuugguccuuggaguuaucagacuuaaaacuuuaugucuguuuaauggaagacaugguaucacauaauuucaauuugaauuucccugauuguuaguaaaguugaauauugcuuauuggucauucaaguuuccuuuuuuguuguuguuauaugaauugccuguuaauguccuuagcccauuauuugauugcuuuuuugaguugauuuguaagaguccuuucugucuccuggauacugauccuuuuucagauuuaugcauuuccaacaucuuucaauuuguggcuugucuuugaacuuuacaaugucuucgauauacauauauguguaguuuuuguguagacaaauucauuagucuuuuccuuuauguuuugugcuuuuccuaucuuaagaauucuuucccuaguccaaaguaagacuuuuauucuaaaaguuuuaaaguuuugcuuuucauauuuaagucuuuagcccaucuagaauuuauuuugguguugaguaugacauagggauucaguuuaauuuuuucaaguggcaagccaauugucucagacuguuuauugaauaguuuauuauuuccucuacuuauuucuaaugccauauccaucauauaauaagauacuauacauaauuuauucugaugccauaaucuauuauuuuccaauuuuuuggucucuccuuccucaauauuaauuuguuuuaauuauuguagcuuuuauguuaagucuugcgauguggagagugaguuguguaacuauuucucuuaccuguuaacuauuccuaacuauauuuaaaauuauccuggacuauucuaggcccuuuauucauccacaugaauuuuagaaccagcuccuuaaguuuugugaaauauuguguugggauuuugauuggaauugcauugaauguaugcaucaauuuggagaaaauuaugauauugagucuuauaaaucuguuucuccauuuaggagaguugucuuuuaaaaagugucauaauuuucuucuaaaguucuugcacauuuauuaaagauuuguucuuauauaccuuuauuuuuuuauugacuuuuuuaaaggcacauuuucuaauggguuuuguauaaguaugcuguugauuuuuuuauuuagcaauauugcugaagaugcucuuauuucuaauagucgcuuagauuucccaugaacaaucauauggucuucagacaauagguccuuaucuucacauaaggacaauuuuauuuuucuucuaagucacauacuuuuuauuucuuccugucuuacugcuuuaggcuaugacuucuaaguacaguguagaaaagaaagugacaaguauucuuguccuuaacuuuaaauagucccagugacauuugcuguacuuaacacugguuaauaaaguuucaaucuguacuuugcuugcugagagcuuucauuuugaauggcuguuaaaacuuucagaauuuuuuugagacagggucucgcuuugccacccaggcuggaguacagugguguaaucacaguucacugcagccucagccuccuaggcuuaaguuauuuucccaccucagccucucgaguagcugagacuacaagugcacgccaccacacccagguaauuuuuguauuuucuguagagacaggguuucaccauguugcccaggcuggucuugaauuccugaguucaagugauccaccugccucagucuuccaaagugcuaggauuacaggugugagccacugugcccagucugaaaauuuuuucuacauauauugagauguuuuuaaagcuguuaauaugguaaauuauauuaacagauuuaucuuuguguuucugggacaaacaauccacuuggucauuauauaggucauuauauacauuuuuauauaguuugcugauaauuucuuuagaauuuuuaccuuuauuuucauaaaugagaucagcuuauaauuuucuuauacuuuuaguguuagguuuuuuuguaucaugguuauacuauccccaagaugaguugaagagcauggcuuccuuuucuguguucuauuguauaucacaucauuauguaucagaucuguauaauuucaucuuuguaggucugguggaacucguaaaagccaucuuagucuugugagguuucugcuuuuuuucauuugcuuuuugugguaacaguuaaucuauugauuuaauuccuguauugaguauagguauauucagauacauguuuucuuuuuaagccaguuuugguaauuauauuuucauagaaaauuguucauuucaucugauauuucaaauuuuggggcauaaauuuguucguagaauucucucaugauuuuuaaaaccucuaccaaaucugugugccccuuuucauugcuaauacuguuuucuugugccuuuucuuuugcuguaucaauuuugccagaggucuguuuuauuuuauuuaucuuuucagagaauuggcuuuuguuuugguuuuguugauuguuacuuuguuuaaauuauauuauuuacacuuuuuaaaaaauauuuccuuccaucuuuuuuuuuuuuuuaguucauuuguucuuuuuuaacuucuugaguuggauaguuaaguuuaagucuuuucuaguggaaacauggaagauuauaaauuuucuucuaaggauugcuuuagcuauguuucacagguuuugaaauguacuuuguauauugguguucaguuuuaauucuaaaccuuuuccuucuaauuucuucuuuggcucaugaauuauuaaaaguauaugcuucaauuucugguuuaguggguuuugaggggcuaccuuuuuauuguugauuuccaguguuacuacauuguagucagaaaauaagaccuguuauauggauucuuaaauauuuauugaaaauugcuuuguggccuaccuguacacgguccuuuuuuguaaaugucugugugcuugaaaagauugaaucuguguucucugguuguuggaugcagguuucuuuauauacucauuuggucaggcuuaugaauuguguuguucacaucuucuguauucuucuaauuuuugccuucuugaccuaucaauuacugagaaggauguguuaaaauuucccacuaugaccauggguuuguugacuuguaauuuuuuucuuuauauauuuugggacuauaucauuaagaacauucagguucaggauuguuauaucucccuggagaauugcuucuguuuuguaauaaucuuuaucccuagauauguuuuuaacuuaagagcuauuuugccugauaauauagcuauaccagauuuuucuugguuaguuauuuucuugguguaccuuuucccauucuuuuacuuucaacuuuucuaugucauuauguuuuaggugugucucuuguaaacagcauauagcuggauuuuguaaucuuauccaaugugagaaucugucuuuuaacuggugaguuuagucuuuuuauauuuauugugguuacugcuauauuuggauguguuuguaucauuugauuaugugcuauuuaccaugcauuuuucucugcuucuuuuucccuuuucugauugguauugaauugauugaauuuucuuuucuuuucuuccuuuuacuugauuggaaguuuuacauuccauugcuggaauguauaacuaguuguuaaucauucuauccucuucuugaacaguaccuuagaaugcuuuaacucuuaucacuguccuccagucuuacauuuuauuauugcguaguauuuuaguuucauguugucuuuauccucccaucaauuaugaucauuaugauuaauccuuacaguaaacacuuauuuugauugacauguguugaguaauguuuuuuccucuccauuguuucuggugauuuuuuuuuucuaguaauuuuuuuuucagugaagacuaaggagugaaaguuaucuucgguccuccuuggucugaaaaugcuuuuauuuuauccuugaaugguaauuuagccuacaauucuaaaccaagcuaauuuuuccuuaucaauauggcaguauuauuucaauuuuguuuggcugcuugcaccuauuuacaaguauguuguuaguccaguuguuccuuuugaguaaucagccuuucuucucuuuuugcuuuuaacauguuucugucuguauuuggguguucuucaguuucacugugauguggcuagguagagaagagguuacuucuuaacugggcugguugguagaguguuuuaguuccccuuucauuagaguugcagcccucuagaggucucaguuuuaugcaagggucuuaguccuaauaucacaaggccucaucuccuggucuugcauggguaaaaacccaggucccacucccuucuugucuaauaaccaccccagggacaccaccauacaggcucucggcucccccuuggcuuaaguuacuugaggaucucucauucuuucuuacaacucagccaugcauuaaaaaacaaauuugcuauauuucaucuagcauuuuaagagguuguuagcuaaaggguuuucucucuggccuuuuggccuuuugcaccauuuuucuagaagucuggucgugcuuuuuauugauuuauucccacaugacagagcuuuguugaaugagauuaccacaacagucccccuauguugagguaacauccuuuggguucuagcugcaggcuucagaucccucaccuuuuauucauguuuuaucuugaguuucugcuuacaguucaauuucuagccccauugaacauaguaguuuaguuuuuggaugguguaauauagauugauuuuacauugguggagaaagagggaauuaucuccuggagcaguucguaaagcauacuguuuuauggaaagaaaaaaaucacuuggaaguuuucuuuccauuauguacuuuuucuaggggucagagauaagauguccuaaaauacccaucuucuuugacugaaaaggagaauugagaauguucuuuaagaauagcagugauugaauguaaaguguaauucaagucuuucuuccuuguccugggucauuuggguaggccagagguuuauuaaggguguugaguuuccucugcauguacuugcuugccacaccaacauguucacucccaaugcuuguuuucaccuucucaaaugaaucacccugcuuucugcuuuauuucccuacagcaguuggaauacuccucuucugauaccauuuucauccugucauuucccuaaugguaacuuaacaguagauccugaguauaguaaaacuaagcuccuuagccugucacucaagacagaggucuccuagcccucuuucucuucuuauuuuauguugucuucgcuuguuggcugguuccauaucaccucuccauugugacuuguucauuugugccuucuugucuuucuuuuuuuuguuuuuguuuuuguuuuugaggcagggccucacucugucacgcuggcuggagugcaguggcaugaucauggcucacuguagccuugaccucccaggcucaagagauccucuugccucagccuccuguguagcugggacuauaggcacgcaccaucaugcuuggcuaauuuuauaaauuuuuucuagagauggaggucucacuguguugcuuaagcuggucuugaacucuugggcuuaagagauccuccugccucagccucccaaagugcugggguuacaggcgugaaucaccaugacuggcccuucuugucuuucucugugcuuccuggcaugucuucuuaggucauauccauuauuuccuuuaagauuacuuccagaaggucuuccuugguuuaacuuaugucacucauucuuucuuucuccugccacauuaauuguccuguguugccaugcauuuauguugcucuguuuuuguucugugguacuuucauaaaguaucuuuuuuucccauuagcuuguggaccguugcuacagaguugcaugaaggacuggcacuuuaaccuuuuuuuacuccuucuucccacaaaacuagcacugucaaaauagaacaguaaauuaggaaauaaauucccuuuuuuccuuugaguaguuuacagucugacuagauaaaacuuagugaaacaauuagcacauaaaacuuucuguaauuaaauguuagacugugugcugcugguucgaagugccucagguacuguagaaaugguuuugaaugugucuucuuauguuguaugauuauagaagcagagaagauugcacaaguggcaaaaauucgguuucagcagaaagugauggaaaaagaaacugaaaagcgcauuucugaaaucgaagguacauuguggggagaggaugaagcucugccugucccgaacugccuccucucugcuccaggguucaggccuuugauuguggugggugagaaggccauagacagaauaaucuggucuggaggaaauagcuggccugauagucuaaauaaauuuuuuuaaauugcuaucacauuuccagcuuuuggguuuguuugugacuguggguagcucagcuuuccuuuucuuccuuaaauuggggcuuauuagcuaccacuuuauuuucaggcagacaagguaugaaaauuacccauaaucaauaguaaagaauauacaagauaauaaaccccaucucuggccgggcgccguggcucacgccuguaaucccagcacuuugggaggccgaggcgggcggaucacaaggucaggagaucgagaccaucccggcuaaaacggugaaaccccgucucuacuaaaaauacaaaaaauuagccgggcgugguggcgggcgccuguagucccagcuacuugggaggcugaggcaggagaauggcgugaaccugggaggcggagcuugcagugagccgagaucccgccacugcacuccagccugggcgacagagcgagacuccgucucaaaaaauaaaaaaaaaauuaaaaauaaauaaaccccaucacgaccaguuucuuuuccaccuguccaaaaaaaaaacaaaauuaauuggggggaaaaacaguuuucauggagggccucacacuacuugauuucacauagugagauguugauguucuuagcucggucuugaagucacuuguuauauauugcugcuuccugucugucucuguugacugauucuggaugaaauuugggggggggcuggagacaaugcaguaaauagagcuuuuaugucuggacuuauuuuacuugaagcuuaguaccuggguggaauguaaggcucugggugauaggaggugggagaguggguggaggagagaaggaacaacuuagaguagaaaacaaguaggcucagaugagcugagaguuauuugacagugaaaagaguauuccucguagagaaguugcuguuuggggacugggacuugaaaacugcuaauagguuuuuaaaacuuucaaugugaaauaagcagucacaauauuaagcaguggggaaagggacucuuaacuagcugagggaauggauugacaccuuuccuuuguuuauuugcuagaugcugcauuccuggcccgagagaaagcgaaagcagaugcugaauauuaugcugcacacaaauaugccaccucaaacaaggugacuggcucccuggccacuuuccuaaugaugcauuucgggguuuugcuuucucuuuucaggagcucugauaugauagaagugauuuuauccauugucaagaaaguguagugaccaagacauccuccagaauuagucaguuagcaagaaauauuucacauugauuggguagggacacaggccaaaugccguaauuccauucauuuguacugcuauauaaggcugaauaauuaauuaaguugaaggucuucugaaauaagagugacagaagaguaaagucuauuuagaauugcuuuccaaauaagguaguuuuuuugguagauacuuagcuugauuagagcaguauuucucaucaaaggcauuccuggcauuugggguugagauacuuuuucauuguugaagaccaucucaugcauuguaggauauuuuguaucccuggcccuugucuacugaaugucaguaguggucaccaguuguuuuaacugccacacacacaugcauguauuuccauaugccccuuguugaguacuccuuguuuauuggauuuaaaaaacuauuccagucaugaggaauuucaugugggauaacuugagaaggcagguugggugauauauaggugauaauuugguguaaggacugggguaagcuggcuagacgguacagggcuagugagcaggggcuauuuaagaggcagcuagaacuccgauaguauucugagaagggaaggguauguccaagauuuauaagguuaucguggagcagauuggaacagauaaaggguugagaaagagauuacuaaaguggaugaugcaguuugaaggauuagagucaaguuuuaagauauagacagggcuuuuaauuuagaaaggaacaacauaauccguauuuagaagaaaugauaagaugauagaaugagaguugucaguacuuugaaaaccaauauaaauuuuaaaaugaacauaacauugaaagacacaguucuauagacacagaauggaauuuggccaaaagaaaggcaugacaggaaacuccaguugaggaaacuaggaguccaaaucuaaugggagaagcucgucaggcacaaguuucaagaccuugccauugaggucuaccuuauucagaaaggggcaguaguuuuaugccauuuugaaaaaugugacucagauacuaaccuauauuaaaaaggcuugaggaagaaaugugguugugcacuaugaccagauuugauuggaguguuucgacagaggauaugaaucaccuggagaagauagagauccaaagagugaaagaugucaaaguguagaaaauaaaugcuguaggacugugaaggacaagauggacuuuugccugggggacaggccaggacucaagauaaggagaggaucacagagcagggucugaggggcuuugaaaggcauauguuacagggaacaguggaaauggguuuuaaucaaauccagauagauucugguuagauacaucuuggcauccugauuuagacaaaacaaaacagugugacagagggagaucugguggucgacgaguuuuaaucaaacccagauagguucugguuagauacaucuuggcauccugauuuaaacaaaacacugucacauagaucugguggucgacaaacaucugucugucacaagcagcuuaaacauccagcuucuggggaaaggcagaaggccagaucaggugacaacuugagauuuuauucuaguucuagaauuuguucaagaaaagcagaaucacagcuaaugauaagauaaugagcaccagcccuuccuuugaaguucugcucucauccacugaccuguguaucucucucaagagaaucaacagagaaccaggcaugauggcucauuccuguagccucccuggaggcuaagaugagaguaucucuugagcccagaaguuugaggcugcagcagcgagcuauaauugaaccacuguauuccagccugggcaacagagugagaucucaucuccagaaaaaaaaaaggcugggugcaguggcucacaucuuugauuccgacacuuugggaggccaagguaggaggauugcuugaggccaggaguuugagaccagccuggcaacauagaccccaucucuacaaaaauaaaaauaauuuuuuuagaaaagagaaucaacagaaacuccagaccaauuccagguugaauucaacuagaugaaaugaaagucacuuuagaaauauuaguuauuaucauuaguuaucacaaauuguuuuccaacucccccauccuuuuauuaaaaagugaacagcuucucuugcauuaagucaggagcuuaaugaaggaauuuuaagucaggaacgcagcuguuaaugugauagccacucuccaaagugagagagggucauuggcaguuauucagacuugacucaugauacucaggagagcaauaggugaaauguauauagggagagagaagacuguugcaccagaguauucugaugccuuugcucuuguuugcucccacacagcacaaguugaccccggaauaucuggagcucaaaaaguaccaggccauugcuucuaacaguaagaucuauuuuggcagcaacaucccuaacauguucguggacuccucaugugcuuugaaauauucagauauuaggacuggaagagaaagcucacuccccucuaaggaggcucuugaacccucuggagagaacgucauccaaaacaaagagagcacagguugaugcaagagguggaaauguucuccauaucaagauguggcccaagggguuaagugggaacaaucauuauacggacucuucagauuuacagagaacuuacacuucaucuguuccaccucuccugcgauaguccugggugcuccacugauuggaggauagagccagcugucugacacacaaauggucuuuucagccacagucuuaucaaguauccuauauguauuccuuucuaaacugcuacucaugaaugaggaaagucugaugcuaagauacugccugcacuggaauguuaaacacuaaauauauaacaagcuguguuuuccuaagcugagaucuguugaauaauguuuacauucgucccccggggaaauguaugcucagccaccauucaagagaugacugagaaggagaugguaaguucaagaagacugauugcaccugggacccaggcccuuucuuugggauccagucccagccuucauccaugugauuaagauccaggccgcugaaguuccccaggaaaugaucuuccacuugagcaaccuuuuacuugauacgauuugcaccuuucuguuuuccugcagucagggugguggccugcagggaccugagcuuugcuacccaaccagauuccucauagagauuccuaaucacuaguuucuuguauucauaaacucagagauacagagggcuugguuugaaguuggggugagaugaaaccuuugcucugagccaaagcucuggggccuugcauucccugcauuggguugaugacugucagcaucacugccgcaggccaugcuugacuaagguaccugguuuuagccacagccaccuccuuguauguuaccuuucagcucuggccaagagugggacaggguuuuaaccacaaauaggagcagcaugcaauuccuagugacuugcugcacaguauuguaucauaauuacaggaaguuuuuauuuuuaaaacuggaucugggguauauucauuugccccaucaccucugucuaaaggcccaaguccuagggcugccauggucacaagcacacugaugcuccuuaagauuguuuaucuggagcccacauaguguggaacaaaaagucaccuagaaagcauccuuggucaucauugucuccuucccaccuggcccagagaugcuuaaauccaaguuguuucuccagcugucaccucccccaggagaucaggauuccacugacguccugggcagccagugaauuuaauuuuccaugagaaacaacagaguuaaccuguggcauuaggagaccuacuucauguggacccuuuuuuuccuucaguuuaacuuuucuggagcagugugcugcguaguucggccugaguuugugcagcuuguuaagacaacucuuguguacgcuauguugaagcucaacaaaaaagucaugggaccacuucuagaaaucuuucagcugucaggccugucagucucaugacaguuuguugguugugccaaacacuuuauuugggaaaggaaagcccagauuugaaugggucuuuccccugggccuuauccuauagaggcauuuguaauauggagaaaauaauuuuucauuuuugcucauuuaauucuauaaauucucuuuauaaaugaauuuuguguucuuuaguucuccuuaaaagaacuuuugaauuauaaaaauaaaaucuuuaccugucgaauuguugcugcagaugauuguuguggaaaaucuggaucauugaccucugugcuuucauuccuagagauguuuuauaguuacaugagcaaaagcuguugccccaaagugauggcccuggaggcggggcugaggaacagggaaaugccgcugugaagucuuaaagcacuucugcuuaaacucccaugugugaggagugugccucccugugcccucucagcucugaggcuggccgucuuucgggguguuccuuuuggcaaauauacacuguaaucuugagucuaaauuuauauguugaaaugcuaccuuuuuuaaaauaagaaacuaaauaaaauuauuuuacuaucagugau

SEQ ID NO: 18844 - RNA, 11754 nt, Homo sapiens
guacgaagucacaaaccggcuuuaugccaagcuuugcagaauccacagcuuggacugacaauacauagagaugcuaaacacacaggcaugcagacuuccagagagugucaguaugcagaggguggauuggucgcaccaugggcaagcuguugucugugcuggacucugggauugauccaucaguuccuccuugcagggaucugauuggguacaguucgguaggcagucgaggauacagcuguaugagguuuuuaaaggucuuuaaacacaugagucucuugugagcuggauccaccuucuaauggaucuccaagguagcaacccauucccagaacacugccugcuugacugguuuugucaaauagcugcuaccccuguccuccuuuuucuguuuuauucugggcuacucuuuuccuuuuuaguguucacuuaugccucuuggaaauucaugagcacuugcugacaaacagguuaaugacuguggcaacucccaaacaucuggauggaaaccaaaacuucagucaaucaucuauaaagguugucgauaugaugccaaagaucuggcgauuuagaaauguccacauaauugauugaauuucucaguuuuuuauccaggcucagaaucaacacauugggaaacaccuauuuucagagaaaaauauuccaggaaacaaaguguucucauuagaaagcaucuuugauguguucgagucugauuucuggcuugaaaggaggcugggcugggcucuaagucagauggagaucuggugguuagaguaguuaguauuggaacgagcacagcuggugagagguuuccuucccccgaaaguuggccaggaggguagaucacuuuguccaaauaagcuuaggcugccuguuaggccugguuucucuaagggaguccauuuugccauuuuaagggagacugucagguucuuaagacauguggcuuuuucuucauuuaucuuuucauucauccauucagaagcaaguaggugcuugcuaagcaccuacuaugugcuaggcaauucacauaaagcuauguggcauaguguuagaaagcaggcucuggggagaaacugccagaguuugaagcuggcuucccuacucacuggcuagaggguacuggguccaccuuauauccucugugggccccaguuucuucacucauaaaaugugggggauaauuguguaggucucucauaaguuuucaugaggguuaaaugagugaguccacauaaaccagcuuagaauugcaccuggcagguauuaagugcucaauaaaugcuaguuauuauuauugcaguaguaauaaucaagucuguauuucuuguuaugcgucuauuucaguguguaugcauucugcuuuguguaugcacaaacauugaauuuuuuuuuuuuuuuuuuuuuuuuugagaaagagucucgcucugucgcccaggcuggagugcaguggcaccaucucggcucacugcaaccuccgccucccggguucaugccauucuucugccucagccuccugaguaccugggaccacaggcgcccgccaccacgccuggcuaauuuuuuguauuuuuaguagagacaggguuucaccuguuagccaggauggucucgaucuccugaccuugugauccacccaccuuggccucccaaagugcugggauuacaggcgucagccaccguggccggccugaaauauuuuuaaauaaaaaaguuugaagagccaaaaggauauucugugaacagaauuguguaucaugaaugccagugagaaucauggucccucgugagcccagauggauuuaggaaggggacccacucaguguauuuccagaaaaaaagacccucuaugauucaguaaucugaccauugagcagaauuagucagauaauugccccuuugucaacuuugagagcccagaccuuguggcuguguguguguguguguguacuuuguauaacugcacauuccuucucuuggaagccugcuauugcuugaggaauucaagguuggcauuuucuaggcuucauggcauuuucguagguuguggugcuuugcauuuuguaguuuuuuuaaaagauaaaaugaaaugguaguggggaaaaaguccuuauuugaugcauuugaaggguuccacugauucuuaaaugucauacaggggagaggaaagggagguaaacaggaagaggaggggaagagaggagagaaaauggagauaagacaaaggaagaagaaagaggaaagggagaagugagcaaauacuuaacaaauucaaaugaaaucugucuauucuugucuggcaugucuggauauucuaaggaaguaugggaguuugacaaucauugcaguuauuuccauugcuaaggaguaaaaguuuuuaagaaaaaaauuucaggaaaaaauuacuuugggcuuaaucuauuugaugaauggcuccaacuaacuggacaacugcaaauucuauuuauucuuugccugacaagagcaaauaugaaacccaguuucccaaacucaugacaauguguuucucaucuuuaugggaacuuccauggaacaagacugaggugcaaucccauucuugccucaaguucucccugccccuuuggcuuaguuaggugaccaaguucagcucaauggauggcuguaagacccacacccaaauacuuacagagucacuuaucugauaccuuuuauaccuuuugcaucauucucaaauuccuagauuucauuauucgucauuuaugccuauuagcugguaaagguucugauuuucaaauuagaaaguaaauguuuuuaaugagcaaaauuagaauccugaaagcucaaucauccuuacauuuuucuuguaguacgaaacaagucaagggcugccuauucauuaccagaugcagggccagaugcugcccucuguguggacauaggcaguggugagcucugucaauccccagccccugccacugcccagauggcagggagagaacuacccucugccccugugcuaccuggcugcaauuuuugcacuucucugcuuaaaacacacacacacacacacauacaccucuuaauuugucuuaggauuuuauguacacuagcacacauguguacauguuuauacacauacacaggccaaucuuauggcugcuuuacucagaaagccuuuauauuuaucaucaucaucaucaucaucaucaucaucauagugguuaacaagugcuuacuacaguaggaaccguuacaagcauguuucaugcauuaauugauuuaagcauccuaaacaaccccauagggcuuuauaggauuguuauagaugagguagcuggaguacagagaaguuaaauaacuugcucaaggucacagacuaaguagcagaaguaggauuugaacccaugcaguccuggcucuaaaacccacaugcuuauccccuaugccauacuucauaucuacuuuggaucaagggaagugcaggcacaggcaaucuccuggggaacucuguauauuuugcagucucuuacaagcucaaaacaggaaaccugcacccuagcagauggucacaccucuguguaucucuguacucuuccaugguguguguuccucagugcaggccacugcugagccacaucaucuagagauacugggaaggaagaagauacuaauagccagagccacagaguagaguggaauggggauucuuggaacuagaguuuauauugcuguucccauugggauuggcaaguuuacucccguccauccuccuccagcuccaacagggaucuagacucucaauuggcauaagguuuggacuaggggcuuaacucuccaaaucaggcagaccuguucucguuugguaaagucguaacuguucagcagagcagggacauuugcuuccaagaagaauagaaucguauuuuugguuaucaagaagagauuuguccugcaucucuagaaucuuccuucugaaaagcagcagugcaaaugaccaggccagaguaagcuaaaaaagcuaaaggauggauccucucacccacaaccacaccaagaaggcaauuaaagcaauuaccgaaucauacaccaucacccagauccagcaucauuacucaacccacaucaccaaggagacacccauuaaccuaaucucugagacauacauuagggaaaaaagaugcugauaugaucaaugaacacaauaauucaaagcagaaacacagacacugccaccaaacaauacucaaauuccuccaacucaguguuacacaaagugcagccaccucaauacaauaccacaaaacaccaaguaacaaacauuaagcuagcugccggaaugcgucaacacaaugcaauaauacacgguaaugcacaacacaguucaaacucuguaucccauaggcacacccauacccacaggcugaaaucauguggccacuugagccacaugggcagacacacacagagacagagccaauagcgcagcacccaauucuccugcacacccagcagaaaacgaucacagcugcaguccucccaagcacgaugcagccugccagaaagcagcagcaccaugccguuucuccagcagguggacguguccagaccaucaccucuaauaaggccucugggcucucauugcuaguaagagaguaaacuguccccugagccugcuucccgagacaggacaauucaguucuauccugguugggguuuaauaagacuucgcuguuagugaaaaugacagagcuccagggauaaagggaaaggugguggugggaggggagcucacuaagcugggugcaggaauuccccuuccucuacccagcccuaccuucuguggccauuccagagccaaagcccucaugcuggguguucacggaguaucgauucagucugcaagcaauuuuaauauuucuucagggacuuuccagcaacagcacaagucauuaauucacccucccaaauugcuuauucaauagcaggaacauggcuccugaauaaagucccagaauuuaugugacucgcacgagucaggaggucaaacaacuguuauggagcgaaguuaaaaauccaaauaaaauauugacacuuuuuuggggagggggaggugggaagcaaagguauuuaaaauagguuuuuguugcaaugcccccaggauaaagaauggaaggagacugaagacaaguuggaguuuauaaaaucaauggaauuuauugcacagcuacuuggcauuuaauaauucucucauuuccacaucccccucccccaccccauccuggccauagacagagagauacacagguauacaaaugcacauuuauguacgucaauacuggugcauggaccaauauaaaaacacgauugugaugugaaaaucucaaacaccccaggaagggaacaaugaugguguagagucucgcuguaguuuacauauuugacagaaaugggcauaacuuggcagauacucaugaagcagguuuugauaaauauauccacuauuauaaaucuuagaucaaugcauuggagcagaccugaauauaaagauaaacuaaucauagaaauagauccucaaaacagaaauugagaaacacaucuauauguaguaucauccugcaaucauguacaugauuuggaaacuagauagaugaaaauaauuuggaaaauuugccccccaaaccuaccagugcauauaaaauucaccgaagccuauagcagcuuaaucuaaaauugugauuuguuaguaacacagacaugaugcuuaucaaauacagcuauggcacaugcaugggagaggauaagcguguuuaaaaucacagcuaccugugcucucuguuaauugucuacauauauaauugcucaauuuuccaaaaucauggauaugaaaaggcugaaggaaaaauuuguucauguccaaauaguuaauaaauaaauauauauauaaauuucccaaaaagaucaacugauucagccuacagacauugaagucacaagccuggauccaaugucgggcucuuacccgaugcauauguauaauuauaugucaauugaaaaaaauaaacaccaaccaaacaaacaauuucuggcuccaaugcuauuaagcaugugacuuugggcaaguugcuuggccuuucuguuguuucuuaggcaaaauagagaggauggcuauuugauagaguuauaguugaauucgaaugagaaaacacauucauuauaaugccuuucauacagugaauaugaaauaaacgauaguuauugcuuuuacuauuauuagauucagcucuucuauucaggccuagccucucauagauucuaccaucgguucuugauaugacugacucauucuacucaaugguuagccgcauaaguucuagagugagacacucagguuuaaauucuggcucuguuacuuaacagcugugugaccuuccguaaguuaccuaaccucucugagucucagcuuccacaucuguagauuauggacaauaaucuucauagguacuugugagaauuaaguuaaauaauccauauaaagugcuuugcacagugccugguacauaguaaguguauauuggcccacugugucccuuaagauuaugucauuguuauuauuggccagguacaguggcucaugccuguaaucccagcacuuugggaggcugaggugggaggauuacuugaggucaggaguuugagaccagccuggccaacaugguaaaacccugucucuacuaaaaauacaaaaaugagcugggcgugguggugugcaccuauaauccuagcuacucaggaggcugagguugcagugaaccugggaggcagagguugcagugagcugagauugugccauuguacuccagccugggcaacagugugagacuccaucucaaaaagaauaaaauaaaauaaaauaaaauaaaauaaaauaaaauaaaauaaaaaaauaaaaaacaaaaaacaagaguauauuauuguuauuauuauuaauaauaauauucauuuguuauugaacaaauagcuaucaaguacuuacauuauaccagacaccauugcuaggugcuggggaaagacagucgugagaaaaauagcagacaucugccuucucagagcuuggagggguggacucuaugugaacugaguaagcaagaaaacaagguuucagcucuguguuagacccugagaggaagagggaaacagagagaaauagauuggaaagcuaggauagagccagauaagggaagauuuugaaggccgggcugaagaauucugaauuuauccuauaggugauaggaagugauuguaggguuuagccagaucacauucuuucaggagacagagaaagacugacggacuguuuuugaaugccugaguaggcgaaagguaggaaaggcuagagguagggaggccaggcagucacuagcgggcccuacaucugcugcugcucaugugacugcagagggaggugagcaugccuguggugggacaggguugggggauggacaggugcagagugggagacuuuaucccagcaaugaaucuauagcaguaccuuguucaccuuauaucaagcagucuucaagccucuggagcuucccaaacaggaucauggggguggacagcugguagauuccagcucuagccagaagcucugacagaugagggcagggccaguggugagaggcgcuagucugucacgcucugggcuuggcaugcaccacagacugguuuccaaaugguuaguuaaacacauugccccuuaauuuuuaaaccuaugcauaucuugaaguuaaaucaauccauaugcuuagcauucaucauauaaaccaucacuauugcccccuugggccagccccauggcccaucuagccugguaaauugucucuggccugggcucucaggggcacguggcggaaagauuaucgcccucaaugccagucuuggaaggcuaaguugaugcagaauauaugccugguaucuaaguaacccacugggaauuuaucauccuggaauguaccaaaaaccauuuugaaauuauuucaauuuuuaaccuaugguuuuguuuccacagagcaacugauagcuuauugaauuuuggugacuaugucagcuggagucaggguuaauagauggagagaaauguggaucgauagaguaugagaaaggaacuuucuuaacucacuaagacuuauucccagcucuuccaaggauccccuugagaaaccaaccagaaggaugguuucuucaccuccuggcuuaagcuagucuucucaaauagaguucagaaacucuaauucaggucuaagaugggacccggugauuugcauuuuagcaagcaccccaggggauucuaaugcagguaguucaagggcaguaguuugaggaaacccuucugccagcuuuuugguaggacuuucauuucuuggagcucagcuaugacuucugagagucaacaagaguugacacauuugggaagaacccugguaaccuggaaccuguguauuccagcaacauccugccacagccagaauggaagguccugcccacagcucugaagaauggccuggcccuuaucaguggccauguucagaacccugccugacauauggucaguuauccagacugaaaccugcagggcauaugagugagcaugggcaaaaaaaccucuaaacucagcccaaacugcagccagaggcuacaaaaacaguguguuaagugauucaggccugccuuaaaggaagccacgugcaggagagaugcuguuuccuuuguguuucuguggagaggaggaaguaaauuucaauuuuucaguuccugggguauacaaagggggagacucuaguuccuuagaguucucaggaguagggaccauuuccaggagagguaaacauuuccugggugaucuaugacaucucacucaagguucugcugugaaaagucucccgcuguuaguguugcugacuugccucggggccaagccauggauacgugccugauauaggcagcucucaaagacuuguguugaagcaauaaccaccugcauuagcugggcaaaauauccuuugcugaagcaaauaucuucuuuuuuuuuuuucuaagacacagucucgcucuguugccgaggcuggagugcaguggcgcgaucucugcucacugcaacuuucaccucccgcguucaagcaauucucugccucagccuccccaguagcagggauuacaggcauccgccaccaugcccggcuaauuuuuguauuuuuaguagaggcgagguuucaccaucuuggccaggcuggucuugaacuuccgaccucaugauucacuugccucggccucccaaaguguugugauuacaggcgugagccacugugcccggccacaaauauccuuuuuaauaucuuuuuugugugugugacagagucucacucugcagcccaggcuggagugcaauggcaccaucucagcucacugcaaccuccaccgacuccagucguggguuccacuucaccacugcaaucguggguuugagagauucucccaccucagccucccgaguagcuggaaccacaagcaugugacacccugcccggcuaauuuuuguauuuucaguagagauggguuuucaccauguuggccaggcuggucucgaacuccugaccucaagugauccaccugccucagccucccaaagugcugggauuauaggcauaagccaccaugccuggcugcaaauaucauuuuguucucuaggaugauugaguuuauaaugcccaggcagucugagaccacuggcagaggcccccaugaccauucgucuggcuuagugggcaauggggccagcuagucuggcacauuuucuacccuggagugccuuugauuuacugaaucaggaaagacccuccccauaccagggauuaaauauuuucugcaaagacucuaaaguggacaguuuacuccaggacaauuuaaacugauuuauacauguauauaacacauauauccagauacuugacaucuugcuccuaagagcagccugccucaagccuggucaugucacugguuuguucaagcucugcuaggaaguaauuuuguuccucuagggaauaauucuaaaauugggaaggaagucuguucuagacagcaggaaaggauuucauggugacauacuuggagauccaauguacagggguugucagcaauuggguccagcagguguuaauacucccauuuucuagugaggacaacugagguucagggaaaccucucacccuucauuucucagaagggacugaaaauagaaguuucaauuuggugccuuugggugucucuccccuggaggcaguauaauuuagcagguaagggauuagucccugggauuagucuaugugaauucaaaucccagauuuacuguuuauuaaaugggugacuuugagcaaguuguaauaagccuuaugugcaaaaugcguuguuguaaggauugagugaacuauuuauuugaaguacauagaacauugccuagcacauaguagauacucaguagacaguuuuuuguuuuuguuuuuaaacuggagccucuccugaggaagcauugcuccuagaaagccugcccagccuaguccaguaaaugcugccaccucacuccucccaaggugagcugucugaggucaccucaaugcuaauaggaccucuucuugucuccaccucagggaguuuuugcacaccauguauuaucauauaauauaaugcaauauaauaucauacauaacauaacauaauaugauggguagguuaacuuggaaacccugaggcggacgguggauggauggauagaugaauagauacauuuguacuaaguauacauacauuauaucauucuauugauuuguaaaaaguucccggucugccuggcuguaaugagauuuuugaacuuugcguggcgaucaaugagaggaauauuauuggccuggagaauugauauaccugcucucaguggcuuguucugcucccaggcugccccggccccccagguguaugauuccagcagacacuuaaccuuuuuuacagugucaucaggcuaaaaggaaucuaauagugacacaggacuugugcucagcacucugccacuauugcuuuccugucacaaauaauuuauagccuucuauuuccaccccugagccugcaccccagccuugccuccugcuucccccagcucccaggaaucaauaaacucacauagccacggugggacuucagggugcaaggagacagacagacagacaaagagaggggaaguggagagaggagcagagaaggagaagaagagagggacagagagugaaacacagagaaaagaauggggaaggaggaggaagagagagagcugaacuagaagaugaguaagaaugccuggugcucucuuaaaagguggagcgcuucucucuuucuucuugaguuuaacacaguguuaauaggaguuucaugcagggcuuucauucuuacucacagagccugagacuguguugauauccaaguuggugagaggugggggucuuccgggaauuuaaccaguaagggaguggccuccccaccugcccugucauccuuugcucugaaguccugccacgacccccugccaucccuugggucuccuguggauccuugccagugacccuaguggggcuugguccagcccccagucugucugcuugagagucugacgcaaccuccuuuugggucagaugucgccgccgccacugcugcuguuucuugucuucu

SEQ ID NO: 18845 - RNA, 1140 nt, Homo sapiens
aggccgacagcuucggccuccacaucguccccgucugaccccaccccggagggagggaggaccgacgcgacgcgaugccucccggccaccgccccagccucaccccaucccacgacccccgcaacccuucacaucaccccccucgaaggucggacaggacggguggagccgugggcgggacccucaggcccgggcccgccgcccccagccccgccugccgccccuccccgccugccuggacugcgcggcgccgugagggggauucggcccagcucgucccggccuccaccaagccagccccgaagcccgccagccacccugccggacucgggcgcgaccugcuggcgcgcgccggauguuucugugacacacaaucagcgcggaccgcagcgcggcccagccccgggcacccgccucggacgcucgggcgccaggaggcuucgcuggaggggcugggccaaggagauuaagaagaaaacgacuuucugcaggaggaagagcccgcugccgaaucccugggaaaaauucuuuucccccagugccagccggacugcccucgccuuccgggugugcccugucccagaagauggaauggggguguggggguccggcucuaggaacgggcuuugggggcgucaggucuuuccaagguugggacccaaggaucggggggcccagcagcccgcaccgaucgagccggacucucggcucuucacugcuccuccuggccugccuaguuccccagggcccggcaccuccugcugcgagacccggcucucagcccugccuugccccuaccucagcgucucuuccaccugcuggccucccaguuuccccuccugccaguccuucgccugucccuugacgcccugcauccuccucccugacucgcagccccaucggacgcucucccgggaccgccgcaggaccaguuuccauagacugcggacuggggucuuccuccagcaguuacuugaugcccccucccccgacacagacucucaaucugccggugguaagaaccgguucugagcuggcgucugagcugcugcgggguggaaguggggggcugcccacuccacuccucccauccccucccagccuccuccuccggcaggaacugaacagaaccacaaaaag

SEQ ID NO: 18846 - RNA, 1140 nt, Homo sapiens
cuuuuugugguucuguucaguuccugccggaggaggaggcugggaggggaugggaggaguggagugggcagccccccacuuccaccccgcagcagcucagacgccagcucagaaccgguucuuaccaccggcagauugagagucugugucgggggagggggcaucaaguaacugcuggaggaagaccccaguccgcagucuauggaaacugguccugcggcggucccgggagagcguccgauggggcugcgagucagggaggaggaugcagggcgucaagggacaggcgaaggacuggcaggaggggaaacugggaggccagcagguggaagagacgcugagguaggggcaaggcagggcugagagccgggucucgcagcaggaggugccgggcccuggggaacuaggcaggccaggaggagcagugaagagccgagaguccggcucgaucggugcgggcugcugggccccccgauccuugggucccaaccuuggaaagaccugacgcccccaaagcccguuccuagagccggacccccacacccccauuccaucuucugggacagggcacacccggaaggcgagggcaguccggcuggcacugggggaaaagaauuuuucccagggauucggcagcgggcucuuccuccugcagaaagucguuuucuucuuaaucuccuuggcccagccccuccagcgaagccuccuggcgcccgagcguccgaggcgggugcccggggcugggccgcgcugcgguccgcgcugauugugugucacagaaacauccggcgcgcgccagcaggucgcgcccgaguccggcaggguggcuggcgggcuucggggcuggcuugguggaggccgggacgagcugggccgaaucccccucacggcgccgcgcaguccaggcaggcggggaggggcggcaggcggggcugggggcggcgggcccgggccugagggucccgcccacggcuccacccguccuguccgaccuucgaggggggugaugugaaggguugcgggggucgugggauggggugaggcuggggcgguggccgggaggcaucgcgucgcgucgguccucccucccuccgggguggggucagacggggacgauguggaggccgaagcugucggccu

SEQ ID NO: 18847 - RNA, 25101 nt, Homo sapiens
aaacaaaggcaauggaaaaauuuuuuaguaaaacuggaaaaggcucuauaaaauguccugacuccagcagucuugaggcagcacacaauggcaucagugucuagguggcaggcacuccgggcugacagcuuccuucuauggcucuaugaccaagcaacccagcccgaggcagcucccaccagugaggcccugauauugcagggcuaagcaccuaggauccaauucuaguacaugccaccucaugcuaggcucuacaaaguggggagcagaggagcuugguacccacuguaucacccuuugacuuugaaagccuaggcuggaguuucgcaugaaguccccgauuccccuccagguucaugcggccugaccucacugccuugaaucugaccugcucauuccuaccucagggcuuggauuuccuuuucucucugccuggguccccuucgccggauguucacguggcucucuccuucuaguuguuuaggccccagcucacaugcccucggcucagagacaccuuuucagaccacuuaucuacacuagccugccagcacucuaucgcauuucuauuuucuuuacagcauuuuucacuaaaacuagguuuucugcuaauuuguucauugcuugcuugucucuuccgccagaaugcaugcaggcagggacuuuaucucucuuuucagugcuguauauacaggaccucaaacaaagccugagcaacacaguaguuucucaguagucugcuacauugaauuuucucacuauggaaaccugcucuagguuaggccccucagacugagaagggcacacagcucaggaccacaggauagaggagcccuugcagaguuuuaugcuccagccuauccuaucaggcucauuucagugaccagcucugcacggccuucacuuugaacgcuuggaggugucuggcuggucgggagugggggccuggccugagcaaaucucagaguucugugucguagcccccuuuuugccagaagagggcuuuuuggccacugguccagugucauccuugaucuucuugagccgggccuuguucuuugguggaauggagaaggugagggaguucuuguugaacucaagcgggaagacaccuacaucuccaucaaagcgguucuuggacaccugcagauaccguuucccuggcccgguuaccagcuuccuguccugcaggaucagaacauugucugcuuccuggcuugccuggggaacagggggcagaaggaggaaagcaggaguaagaggacaugagcaaagcagaaaggggggcugacagggcagggaggagugauaagaauggggagaggggcuggguacaauggcucacgccuguaaucccagaacuuugggaggccgagucgaguggaucacgaugucaggaaaucaagaccauccuggcuaacacggugaaaccccaucucuacuaaaaauacaaaaaauuagcugggcaugguggcaugcaccuauagucccagcuucuugggaggcugaggcaggagaaucgcuugaauccgggaggcggagguugcagugagccaagauugugccacugcacuccagccugggcaacagagcgagacuccgucucaaaaaagaaaaaaaaaaagagaaagaaugggagagggaaaaguacuuccccccaugaccaaagcucuuugaacuacugaccacgaugcuggggccacucaaaucuuucaguucccugacaagcuugcuacuguuucagacgcugccugugcuguucccucuccuucuccacagcgggccaccccacucaaccucagcuucuucucuuuuaggucucagucuaaaugucacaucucaugaaggagaccauucuuuuuuuuuuuuuuuuuuuuuuuuuaaagacagggucucagcugggcacgguggcucacgccuguaaucccagcacuuugggaggccgaggcggacggaucaugaggucaggagauugagaccauccuggcuaacacggugaaacuccguaucuacuaaaaaaauacaaaaaauuaggcgggugugguggcacaugccuguagucccagcuacuugggaggcugaggcaggagaaucacuugaaccugggagguggagcuugcagugagccgagaucgcgccacugcacuccagccugggugacaaagcgagacuccgucucaaaaaaaaaaaaaaaaaaaaaaaaaagauagggucucacucugcugcccagguuggaguggagugcaguggugugagcacggcucacugcagucucaaccucccaggcucaagcaauccucccaccucagccuccugaguagcugggaccaaaggugcaugcuaccaugcccagcuaauuuuuaaauauauauauauuauauauauauauuuuuugagacggagucucacucugucacccaggauggagugcaguggcgcgaucuccgcucacugcaagcuccgccucccggguucacgccauucugccucagccucccaaguagcugggacuacaggugccugccaccacgcccggcuaauuuuuuuuuuuuuuuguauuuuuaguagagacaggguuucaccauguuagcaagauagucucgaucuccugaccucgugauccacccgccuuggccucccaaagugcugggauuauaagcgugagccaccacgccuggccaauuuucaaauauuuuuguagagacagggucucacuacauugcucagauugccaaacuccugggccccagcaauccuccugccucagccucccaaaguguugagauuacaggugugauccacuguacccugccauuuuuccacuucugcauuacucucuuucccagcuccauguuuguuccaucauggcacaugauuugugcuccuugcucugaauucccuaggcccagcccaggccucguauguaauaggcauucaguguaacacuagaagcuccaggauugggcugguccugaugcccagaaggcccucacauuuaucugauugucuaauacccauugucuaccaaaccucaacccaaccuuuguugucaccuccucuggaagucucccagaugucccgggcugacucagacaucuuuucucuuugcucuccaaauacuugugcugccuaucauacucuuaucauacugaauugcaaucacugucuuacuguuuccccaggagaggaugugagcuccugggggacaagaagagcauaagaaccaacuaucagccuuuguauuuccagcacauauauuccucaugucauggccccagaggcauugccuccugccuguucggauggacagucaagacgauuaaggcugaaugagggcugucccuggucacaccuacccacucuauuuuccaaagcuugagcuccgcuaaaggccacucacuuuggcugagccaaaaauggacgcugucugcaguuccuugucaucauccucuuuccgggggugaaugaccagugucacauggcaguuauugucuguugcaaacuuccgaaagaccccgaugauguagucuugagcugcgauccuacgccaucccaacaacacaaagagcuuaucagacacagaaggacaagaacauacacauacucuugauccauucacaucuccccacaaacuaccacaacccacucuaccucccucuacccaaggacucacacucagaucccuguccauacauccugcugccauaccccacaccuccauaugauacacaugggggugguacgugccugcacacaucucagaaaauaggagagcacagcaugugugccuagaggccagcugccugagaaguguguguuguauguccaagcgggcucaagcuagacaagagaggaugucaccgucaccugucuguggacagcugcucgugacccaucaugaacugcagguugucgaugaucacaugacaaaugucauagacguagacugcauguugcauuguaucuauuacaguccugggaagaggaaaggcaaggaauuugacaaguugucucuagaccaccccaggcagaagaacuagcauccugaaaacucucuuggcugccuccucugcccuucuauuauuauuacuauuauuugagacaaggucuugcucuguagcccaggcuggagugcaguggugugaucacagcucacugcagccccaaccuacuaggcucaagcgauccucuuacuuuagcuucuugaguagcugggaccacaggcauaugccaucaccaugcccagccuaauuuuuaaaaauuuuuuuauagagagggguggucucccuauauugcccagguuggucucaaaucccugggcucaagugauccucccaccucagccucccaaagugcugggauuacaggcgugagccaguguguccagcccugcccucucauucuuugaaaaacuccaaaccuaaggagaugggggaguuccuacuggagcuggaaaaggaaccaaagguuccugagugcugggauaugucugggaaagcaagguggcuggaaucugggagucucaccugaugcuuugcuguccauggaaagucaugaaauagaggggcagguccucaaagcggucagcccagugaucauauuuguccaguugaucuuccagccgccccucggcaaacugugucagcaugacccgggcuagucucacauugcugaucucgaagcuaccccacaguguguucacccccugggaacacaaauccagggcauacucacugaugaaugucgucuuuccacugccuguuggcccugcagugggguggaacagaccugggugaggaggaaguccuacccuugaaaccaagacauaggucagggcuuuaaaacuggggggaaagggccaaccuucuuuucaacauugucauggcccaaacccacuugcuuuugucaccugaucuucugccccuuuacucuaaguagugauuucucaaaggguuaccugugaagaccgucagcucgcccuuucgaugucccuucaagauacgauugaggucuggaaagcggcuccagcggaggccagcugcuugcuccacauuugacaguucuccuagcaccuccucccgaagcugccggaaagauacgauggacuugugccaggcaggcagggcgguacgaagaauacgagaaagauugaagccuccguucagggccuccaggggacgggguugcuggucuccuggucgcaccaagaagcaucguuugggguucaguuuucgugcaaacaacuuggcggcuucccaggaccgaaggucaucccccaaccagaauacaauccgccggaacuguuccagguaagggaguaaggcaggggguaagcaggucguuccucgggguagaguaaggguaggcagccccguggacugguucaaggccaggcugucaagcucacgacucgucaguaccaccucagcaucucgacgacuaaucagugguaauccaaacagauugugguaggcgcugggucggggaauagugguuuccucguagcucacuccaucccccuggcauuuagccucuaggagcuucaggccucguaauccugagcccccaggggagaaccaagggaagacaagacugcgagcaggucgcagauaucgcacacugaaacgcuugagugugucaucuguaaccuugguaaggccaaacauuguaucagccagcugaaccuccuccugaucaggcagcucccagagagguauugcucgguuccagauccuccggaccuccucgcuguccucaaauucuggugccuugcuaagcagaaaccccucccuggccccauccccucgccccuccacgcuggccuggaagucuucccagcucccuucugcuaggcuggucaugcagagaaaguggccuguggucuugucaaugaagaggcugaaggaagugguaacaccagucuggccuuugagcugugaagacucugcaaaggggcucagugcccgcaggcaacugugaccauccuggaaggggaucccaugcccccgcaaauacuggcggauuucaguugcaguuacaggcaacacuggcauauccaaggcuuggagagucuccuuccuguaacgucugcgaggagggccuggggccaaguuucggggcaggccccuccgacccauccacuccccacgcagggguaacaagauacggaggggguacccacuucggaggaggacccacauuccuagccaaaugugggaagucacuacuugaaaugccuuaggugccugguuagcgugccuucacuagaccaaacucuagggauaucccacgcagcacucugcagagcucacucuaggugcauucuuucucuccaugaauuucuccucuucagccccucuacguugcugcuucacacauaugcccaucuacacgacccuuucgcguccacguccuucuacaauggcucccccaccucuaugguccguuaguuaguuucucuccgccaccucaccucuaugacccucuauacaguuccucacugacacaguuucuuugcaucaucuucucaccucuacugcuccuccacagcaucuccucgucguccucauuucuauagucaucugcauccuuuuuguagucccuuugcccuaggccccgacuagagacccucuuccgcuucuccuuccccucacugggaccucaacacggcgagagcacccagcacgacucccgccaaucccccggcccaaaggaaugccagucucuauccucccccgugucuucacuccgcucuacuacuccgagcuccgccgcgccggcccccagccccagguuaccacuuuucucucucccacuucgccggcaacgugagucucccgcacaugcuacucgccuugaccucggaagcaaaacuccgggagcggucgucccggaaccggaagccucgagguuuagucccgccccccucuccucgcugcuuaggcuccgcggccuccaagcuguagcuaugacggcgcgcgggacuccgagccgcuucuuggccagcguucuccacaacggacugggucgcuaugugcagcagcugcagcgucugagcuucagcgucagccgcgacggcgccucgucucgcggcgccaggugagccaagggaagugcgcaggcgcgggucgggguggguguggagguggcaacgacuccccggguaggucgcccccagucaggggucauacugcucacugucccgggucgcuuagggaguucguggagcgggaggugaucgacuucgcccgacggaauccaggggucguaauauauguaaacucgcguccgugcugcgugcccagaguaguggccgaauaccgugaguggggccgggcucgggcuggagggcgggaucaggggcucgacccgcuauccuccuucucgcuuggucgcaccggccagcuuccacccacucucaccccucuucugccaguuaacggggcugugcgcgaggagagcauccacugcaagucggucgaggagaucucgacgcuggugcagaagcuggccgaccagucgggcuuggacgugauccgcauccgcaagcccuuccacaccgacaacccuagcauccagggccaguggcaccccuucaccaacaagccgaccacguuccgcgggcuacgcccccgagagguucaggauccugccccagcccaggugcaagcacagugaagaguugccccaccaacugcagccccaggcuuuggacuguuacuccgguaaaggugguucuuccccuuugggauuccaagcccaggcaaauggaacccaucaaugggcaaguugacagagguucugcuugggauaaugaagagcugccuguuucuuuccagugccugcuucugggggcagugaccuugugaaccacucauuuuuaugcaaguggcaucccuaaaaccugagaugaggaagacuucaaggguuuuacagggcccuuguuuuuuaaauccaaauugauaauaaugaucucaaaacacagugagaggucugaaggcuggcuucugaagaaucccugaugucuuauuggaacaaccacugagcuacggagagcucugcugugaugggcuaggcacuuuauaucugugugaauacagauuuauaaaacagguuaauaaacuuauccaaggucacauuucaggucugucuucaaaaugugugcauauguuaagcacaagccucaguuuucauuauuuuaaaacuagacgcagaacauauaacaacugucaggugguuaguaucaaaggccaagugauuaaucuaggccugaccccugaaagggagaggggagugauucucagaccaaguccuggcugacaagcuuucucuggucuuagcuauacaucuccuuccccccacgucccucuuugugcagaaauaaaauccaugucccuugagccagcugguggggggugcugagaaccuuggggaagggcaggaaggcugauauuaaugaguauuuucuaaucuuaguuuaaaaaggggggaugguggggaaaugagaggcaggaaaugaaaaucuagaaaccccuguaagaauucuugaacuguugucauuuucuugucaugcccuaacaccaugaucaaugaauagugugaaccuuacuaaagaggccugugugccugccaaggagucaggauggaagcggaggaucccaauuuccucugcaaauaguuguauuggggagcagagccaauccuggaggcagauaucaccuucuguauaggcucaggagccuguccccuggugaucaggggugggcgcaucuagaugaagcagacuagucauagcuguggggaaaaaggguguuuauuaaccaacggcagggggaggagcugagcccaggcuccccacucugucacaugccuguuccacccaccugguuguaagugggggcauuccuaaagaaguguagccauucucacaauaaauacauucauugugggguggaggugggagagguugggugaagggcaguaaaaacccgugggauuccacguucucagcuacaaaaauaacagucauccucacccgaggggaaugggggagcucagucagaauugauugucccauauaggccuagagacuucagaggccccuggccccugaaagugccccggugagguaggacagggguaggagcuaagcguccaaacucccagccucugcccuuugcauaguuccaagaaugggcuucaugugccaguugagacaucagauuucuccucccuuucccugcuguagucuagaggaagcaaaugcuugauucccccaaaagagaggcuggcucauugagugcaguguuggucauccauccuaggcaagggccugugaggacaguuaaaugggagggggaucucccucugaaauguccacggacuaaacccaacagacagguccaagacagcaagggaggcucagaggugcaugugaguggaaauguaagcacaugugugauacagguguguguuaccacaugugcauggggaugggacaugccuggagcucugucucucauacucuugagaaugaccaaggagaguggggaggcugauucacaagggccacacaggaagggagaggaggggagugaugcagucuuaccuccccaggcuggcccguucccaagcucuugacaaagaggucaccacauggggcuggggaagaggaccagauaggauguggcaauugggaggguaccccaaguccagaagcagggaugaaacaagaaugcaccaggagaaggugagggugggggcacugcagcccagccgauaaacauucuuccaugugugcaugugaauguacgcagggcuuagguggcuggcagaggucuugucugguuucaggaccauccagcacacagggccaugcagaggguggugacauugagcccauauggaccugcagagcccugccugggagaaagagaaaggguuugggcagaugaauggaacaggaggauggaguccucaccuauaaguguuuagguuaggggauaggaacuggcucugggucugcagggcaccugauccugagggagcaccuaccucugaggagcaccgaugggccugggcugcucacaugugggucuguggagacugaggagggggcuuuggcugggccugacuggccagcccuacagggacaucaaaaaguugggagaaggguauggaguggggguaaugaagggaggguggcuguguuagggaggcaguggcccagccugggacagauaggcuggcuuggaagagcauuuguucugggaggcugggcucagacagagcucucaucuagcugcuccacgagcugcgugugcuuccuuuuuuccaggaugcggcugaguuccucggcgaaggagcagggcccugcugguacuccauuguugcucugccucagaagcacauagcuauugccauucauccuccgcagccggcugggcagugccaccaagccauuggucagcucagccgguggcggugggggcggugggggugguggggcuggggcucccuccccagggaugaucuggagacagcugcccuccaggcccccagcccccucaucaucacccucaucuuccucuccaggacacuggccugagacugucugcaguugcaccgcagauccuccugcccggcuggcccgacccagugaguauuuccgucggcgcccucgucugccuucccgcagacaggccacauagaggagggaggaggccaggaugaggcagaggccaccaagcgcggcaauggcuagcacauagagcagucucacaucaggugccagcugugccccagguguggcaggggcuuuuggagcuggggcaggaguggcuggccggacugugagacuauaggaggccagcagggugcggaggccauuuuccucggcauagcagccauaguugccacugugcucaggcugugcaucuguaaccagcagcccguccacgcccacacgguagccacccugcccaucgcucaggcccaugcucccauugaguagccacaaggcccgggccagguuggauggcuggucacagggcaggaggacaucaucaccccggagcacagagcgggucuucagugguggugguggcccugugggguuugggggagaggucaguaccagcccgucccaggaagggauuagagauggcaagccagacuguucacugccaagucccuggcaccaagcacagaacccagaaucacagugacagcugacccaggcucugugcucaugcuuccacagaagguucacguuggcccuucccaggaagcaggcagugccuugggcccuuuuccauucucucuccaugcucucauccucuccugugguuucaauuucugccaucugccaguaacuccuaaucucuaccucagacuucucuccugagugccagacucggauaucuaccaugugcugggcaucuccacaugaggucucuuggacaccucaaaaccaaagcuuuucuccccaacgacaccaaguccuuuccuugaaucgccaccacugugaauggcaccaccagccacacaguugcuuaagucagaaaccugggagucucccuucucuuucuugcucgccuuuuuguuuuguuuuguuuuuuugagacggagucucauucugucgccuaggcuggagugcagugacgugaucucagcucacugcaaccuccaccucccugguucacgcgauuaucuugccucuggcuccugaguagcugggauuacaggcauaugccaccaugcccagcuaguuuuuguauuuuuaguagagacaggguuucaccauguuggccaggcuugucucgaacuccugaccucaagugauccacucgccuuggccucccaaagugcuggauuauaggcaugagccaccgugcccggcccuucuucacguuuguaucuaacugucacuaagauucuguuucuggcaucuaucuuagaccuguugauuucucuccuuccaugacuccuggcccacucuggccccauguaauccauucuucaugagagguauuuuaaaaacacaaaucugaucaugccacucuccagccuaaaacucuucagagguuuccuauugcuuuucggauaaagaccaaaaucuucaacauggccuuugcccacuuguccagccuauucuccugucacucaaaugugccagccucccucugccugcugcucccucugcuugcaugucaccccauuaccccauguccucugcuugccuggcuaacuugugggagauagcauaguauagugaccagaagcacaaagucaaaucagacugcuuggggucagguuugaauucuuuuuucuuucuuuuuuuuuuuuuuugagaugagaugaggucucacucuguuauccaggcuggagugcaauggugugaucuuggcucacugcaaccucugccucccaggcucaagugauccucccaccucagcuuuccaaguagcugggauuacagacaugugccaccacacccggcuaauuuuuguauuuuuuguagagaugggguuuugccauguugcccaggcuggucuccaauuccugagcucaagcaauccaccuaccucagccucccgaagugcugggauuacaggcgugagccacuguacucagccagguuugaauucugguccaguuucuuaauagcugaauaaguuugagcaauuuacuuacacucccugggcuucagagaggucccucauggggauaauaauaauggcaccuuucucauaagaaugcugugacaguagaugacaucaugcauagaaguauuuagaucagugucuggcacacaguaaauacuuaauacaucuuagcugugaugauuaacuuuuguucuuucuucagauaucaguucagucauccgaucuuccuuggggaaauacccauuaccguccugaacccuugucauccacuacuuggcuauaagcuccagaagugacaagacacuucacaucuuaaauauguuuccuaguuuauaauucauuugggcaguaaauguuuguugagcacuuacucugugccaggcucuguguuugagucauccuuaccaaauguacauagccacagccacucagauacaaacauauacguacacauggcaguaaauggcaaagaggacagucugcguagcuagacccacacucauaugagucacuuaccuguaucccugcugcucucacagccucgauuuccucucucuauguccuguaucagugcuguccugggacagaagaucagguuuuaugaacaaggggaacuggguuucaguuucccagugaaaggguagauaggucuguuacuaauaacuagccccugcacucccccaguagcuaucaggccuuccuccuccacucagaccacaugugacugucaccccccaccacuucccaccugcuucccugggaccuguuggcuauggugguggcugcugcgcaggcaugggugccagggucccagccacaguaggggucucgggccaagaugcagucauagcaggaucgguagcgggagcagcuggagagugguagcuggaugacuccgcuaggagcccccacauagaggcugugcugggagccagauaggacaguuggucggcagcguccccacucauacagauacacagccucugcccaaccuccccacucccucuuccuauuucagcaaggcuauauuaagggucacagagaagggcuaccugcaauagagagaugacuagauuuuccacagacugggacucccugaacacuugugucucuucaauaaugugcaucccagagcccaggacuacggccuuguggauccagccaucagcugguauggaaagagcagagaguuagaccccaacuaugggaucugcucucagcacccugcaagaggccuaauacgaacagcucaggaguccugagguccagaacaaggacucagccaggagcaguggacccucaggacacugggaacuccagacuagucauggcaggaauuaauggauucagaagcauuagugaucagggccaacagggaucagggauugggaucagaagcaccugugcccagaaagagcaggucauagguagguccagcaggcguggugacaggugucccuguaagguguguguagcguauguugcgcuugagcagcaggggccguccacgugugggcacaacgggccgagccaucagugggugcaacuuuacaaaguccaggaccagggauggcaagucuugggaugaauuguagccuuggcugcgcaaugaaucugugauacacuggcgugggggacgaagguggugaaccucgggacuccaccaccugccugcccucuccacaaggccagacccuuugacccuucccugggcucugucuacucagcacuggccccaggccugggcacucaccgagccaggccggggcucaggcaccccacccucauagcgaccccagcgccgggaaccauccugguauuccauauaggguccugcaaagacagccuggaucucugccaggucauagcggcagauggcugaggccuccagggucuuccuagaaugggacauagggcaaggggggugaguuacauggagucaagccugccccccaacucgugcucagccugaagcucacuguuacccuggccaaccccagcuauagucccacagggccucuccugugagucaguggaccacugcauucauucucuggcucuagccuagcuugaugugcuuaaaauucucacuuugccagcacuuugagaggccgaggcgagcagaucacgaggucaagagaucgagaccauccugggcaacacagugaaaccccaucucuauuaaaaauacaaaaauuagccaggcgugguggcacacgccuauagucccagcuacucgggaggccgaggcaggauaaucacuugaacccgggaggcggagauugcagugagccgagaucgcgccacugcacuccagccuggcaacagagcaagacucccucuuaaaaaaaaaaaaaaauucucacuuugcagccagaccuccccacaguggauccuaucucauccucauugaccucugcuccagccccuaugcuguccgcaguuucuugccucccgauugucccugcacugaccacugugugcucagcgugaaggcugcauagaaguguguacggcuugagguuucagcauccaggcugcagaccccacgcagugucucauacaguggaauguggcagaugagacgggcuuucaggaaggaaguccacuucuucugcaggaucuucuucccucccaggucucccuggggagguagaggcacgggauaaggggccagggucagagguccagccucuauacccgugccccaacgucagcccaauccaccuugcagacacgagccacacgggccacacggugacugcugcggcucugagugaagcugccagagcccuccucaguggcacgcuccgugaagaaguaguacaccuugucaucaucacccacugcacuggccuugcucucccgcacgaggacggagaacacaaacuccgcaucugugggucaggcaguuugagaggcuuuugagacaggcuggggauuccuuucccucacucugaggcugaccccucacuugacaacacacaggaauggaauggacaggcucaccuggggauuugggggugggguggucagcuggccaagggaguaaaaaugaagaaauaguccccuaccccccaucauccugugccucauccuccuaaccauugagccaaugcauuggugucuccucaguucucagggaguguggguggcggcuccggcggaugucaggaaugcuccggaauucauaccuaguggcuguguagaggccuccaucuggcguggggauauuccaggcaugagagacaugucauauucaacagggcacaugacauauacaugguggcagguccuagagaugagauccacauccuaaaaauaccaugucugugauagggaagaaggccugcucaccaaugaugaggccugugaagccacgggcugggucauaaggacacuucuccuuccccuccucgaagcugguuggcaaggugaaggccucagcauccuagggaacaaggaaccagcaguaagugguuccgaagacaggcagggacaguggcucaaagucagaucagucuggggucagggaucagcgaucagggauaggggcagguuguauggcagaugcaccugacagcaauaacuuaagcauccccugagaaugaccuuauggccucaaaacaauguauguuuggaguuccaaaucugcaaguggccaaccuagagauucacuccuuaucuaugaagaacaucugagccccuagcccauccuguggaacacaugcuguccaggggaucaaggcccuuuguuuuggguuaaaugaaguuugccagguggaggugauuagggggaggaugcuaagugaaaaugcuauaaaaacugcaugguuuuuacaaaggggaaugguucuccagugcagcccgccgccacuggagugcccuguauggaaguccccuuaauaaaccauccgucuccuucacuggcucugagucucuucuuuggcaucuugaacaugaucccaucccuaaugaagucaacagagaucuggcacaacacagguauacucacaauggcugcacagaggggcuggaaggcgugagucccacaugcauagagguggguagaauugagccgcugcaggaaccgcacaugguuaaagcacuccgucugugggaugagguggagagggcugugagcccccugccugacuagaagccuccuccauuagucuagcuuuguaguuuggcucuugcccccacccacaggacaaacgguucuuuccaagauaccugugauccuucucacugcuccagaauauuuccuggaacucacuguccuuggccucccaguaacaugacccuauuucucuccucugucccucagauuaccugacaccauucugccaauaucuccugugucucuugcaguucccuccaccucugguucaagagcucccagggauuccaccauccugaggugcuucuccucucccauccagcuccuucucagcaccucuuucuauucuuggaacuccugcccuccucgcuggggugauacaaccaaaucuaucccuagaugccagcuugcucuccacccgauaucccagggauguuucaaacucaccuugucagaagccaaguucauccccuccuccauaaccuacaucuuuccuaaaccuguuuauccagucuuucccaccucacuucauccaaccuacgacucaaccuagaagccagggaucauccuugcugcuuccuacuuccucacccccacauucagucccucuccacaauuaauucauuguccuaaaagucucuugacuugguccacuuugacuccaccaccagcacccaguccaaaugaccaccaugaccucuuccuuagacaucugcaguugcuaccugauagcuccucccaaccuucucuuuuauaaaaacgacuuuauaaagcuauuuauucagucaaugaauacauguacauaguauaaaacuuagaaaguacaaagggguauguuauaaacagggagucucccauuuaucccugucucccagguugccugccaagaagacugcuguuacuauugucugaaguuuccuuccagagauauuuuaccaaacaacacacuuuugcuacucuccaaccacuuuccaagggauauucuaaaaauguaaaccuagccaggugugguggcucacaccuguaaucccagcacuuugggaggcugaggugggaggaucacuggagcccaggaguccaagaccagccuggacaauauagcaagaccucaucucuaugugguggcaugcaccuguaguccuagcuacuugggaggcuuaggcaagagaauuguuugagcccaggaggucgaggcugcagugaaccacugcacuccagccugggcaacagagugagaccaugucugaaaaaaagucaaguggaucacaccacuguaucggcucaucagugaccugaauauagagucccacaugcuccuagcccugugugaugggacucugcccauuccucuggucucacucacccuacuccagccacacuggucuucucugccugucaaaugcccucagcugccagccucuugacuccuuugccacguuaaugauuccuccucuugccuguuacccaggguuuaaauccauacaggccucuuugugucuccuccugcucccucaccugguacaagccacuaccaucugucccccgucuccauaagccugcucaggccccuuccucugacccaaaugaugcccccagccuccucacugcuuuuccugccuccagacucacccuauuuucauccauccagugccuggggccagauaaauauuccuaaagugauguuuccccaagauguuuauuuauuuuuuuaauuuuauuuuuuuugagacggagucuugcucugccgcuagguuggagugcagugcaugaucucagcucacugcaaccuccgccucccggguucaagagauucuccugccucagccucccgaguagcugggacuacuacucucaacaccauggugaugugacugggacuacuacucgcauggaugugcaucaccaugccgggcuaauuuuuguauuuuuaguagacacaggguuucaccauguuggccaggcuggucucgaucucuugaccucaugauccacccgccucggccucccaaggugcugggauuacaggccugagccaccgugcccagcggauguuuacauuuuuuaaagggggguagggaggaauucucuggucaaauaacuuuggaaaccacaggugaaaccuaucuuuacugggcuuacuuccuagagccugaaggauguugcugugcauugugggacugggcauguaguguuucccaaacucauuugacauuuaaaccccuccuuugaaaauuaauguuccucagaacaugcuuugggaacuguucuauaaagccuugcuauccaaaguguggucuggggaccagcagcaucaacuucacuugggagcuuguuagaauugcagacucuugggcccuuccccagaccuacuaaguuuagcaucugcauuuauaauauaccugggugauacauuaaaguuagagccucuaaaguaucaaauucugaggguguucacugucacagaauaaaacccaaacucccagcugggcaucuguggccuuccaugaccugguuccaucugccuccccagccccauuuucuaccugugcugcaccaagaggcagccuuugauggaagcucuuggagaugccuuuuuaaacggagcugucccaacaccaccccuggcccaccuuggcccaguggaucuugggaauuuuuuuuuaauuauuuuuuauuagagauagagucucauuauauuguccaggcuggccucgaacuccugggcucaagugauccuccugccuuggccucccaaaguguugagauuacaagugugacccaccaugcccagcccagggccguuuauuuuguaaaagcucuccagauggagccauuaccuagccagacaugggaccccuggagacacccuauucuuuagcuggaaagggcugaugcuucauuaaugccuguccauggaauacuggguauuugaccuauuccuugaccaaagacucauuuuucucaucugcaaaaugcaggauaauacuauuucauaggguuauuuuagaauuaacugagauaauagcuaaaucaucacuugcuguagauaguugcugacuuaacaaugguucaauuuauuaugaugguuuuauugguaaguaacccaucguaaguaagcaucuguagagguuacuuacuguuuuuuguugguuuguuuuuuugagacaggguuuugcucugucauccaggcuggaauguguggcuuaauuauagcucacgcagccucaaccucccaggcccaagugauacucccacucagcuucccaaguagcugggacuacaggugcacgccagcauacuuggcuaauuuuuguauuuuuuuuguagacagaucucgcuguguugccaaggcugaucuugaacuccuggacucaaguuguccuccuacccucagccucccaaaguguugggauuacagaugugagccaccgcguucagccuacuuauugccauuuugauuauuugggaucccagaggagaugaagaugccacugcgggacaaacuaguaggccaccagaugguugaauuagaaguacugugcccagaugccgggggcaauggcuuacaucuguaaucccagcacuuugggaggcuaagguagggggacugcuugaggccaggaguucaagaccagccugggcaacauagcaagacccuguuucuacaaaaaauaaaacacuuagcugggcguggcaugugcccgugguccuagcuacucaggaggcugaaguggaaggauccccugagcccaggaguuuaaggccacagggagcuaugaucaugucacuguacuccaaccuggaugacagagugagauccgaccucaaaaaaagaaaaaaaaaaaaaugcugugcccauggcuugccacucuggcaauacuuacaauguuuacugugguugcugagauugacuggcaggucuguaccuacccaucuguguccccaacaauccuggcaucccugauugaggaagaaggggaggaaaggagcuggggacagggcagaccacauaccugguuguuuuucccuuuuugaugacauuugcuuugcaucucuggggaggcuucccaguggaucuaguggaggcaaagggaauaggcugaugcacugaccccaauaccuauuacucauaggaccaggcaauaggaccccacagaguuggggaaauugggguggggaucaauuucaggaggaacacugaaugcaaggaacaccugggcugggaagggcagugcugucugaccagggggcuauggaaggcuggcaggguuuuaaggaaguugaggucccagggagcuggauaagcauagagacccucugggugguccagguuccagggccugaccucuuugugagccccaucuccuaugucguuggcacugagagagaacagggcaccucgggcucccaccagcagccuugcugaggccuccuccagcagcaguguugaguaguucugggcuuggcccuugaagugccgggucccagagagcucuggggagagcaggaacagugagcccuaguucuggggugccuccccacccccagcccuggcuucugcugccuuuugagguugagggucuaaccuucauaggguauggucauccgagggguggcaucuaguucucuagacggucuccgcagugaggguccugggacugcaguugcugugaggaugcugaggaggaggggccagagccucccccacaucuuccuggggaggcccagacuaacaagacccccaaagggagccagagucacagguugugggggcggggaaugggaagcacagucacaggggucaaaguccaaggaagucacuuggaaggucaggggucauaaggucauaggagucaaggaaucauggggccaugggggguccuggaaucggggggacauggagucacaggguuguguggccauggaauccccagcuaagaggucagaaggagggagggaucacaugccuuucugcaucaaaugcaaacuccauggugagagggaguugugaaguucuagagggguuguagguuacugauggggucacccugcccccgacaguagagcuaguccugguuuucugagguccguuuucugaagaaaaaacggggaaaaaaaagcccuuugaucuguauguggguggaagauggauggcguuacccagacuucagggggcacugaaagaaggaggcccagcauccacagaacgcccacgccaggaucgacucacaaucauucugucuaucgcuuugcucugaugcaggaggcugggguggaacuuaccuuccuuacaagacccuagaugcccacaacccgaaacccaaggucaugacccucuucuggccaagucagaagcuccacuaggcccucaagucaaaggagcugggguucuuggagagaaugccugcuucucccaacaaugagaugcaacucggucagcagcugccccugcugccugcgggggugccuuaugcaggagggccuaaccagagagguuuaauggaccuuuguuuauuuuguccugcuuucccuuuguuuuuucuuuucccuggccugagagcucccucuggaauuucucuuuaauuauaacuucuugguauuccucuccaagggggugcacaucucugcccacgccagucuguauugcacccucuggcuaggcauccacacgugucccuaucugcaaguaggcauucacaggcauugggguggguaccuaggaucccccugguugcacagguauaaugucugugcagaaggcuguagugugcaaggccaguugagacauaagcaacgugaagaagguaaaugaugggaucccugagcccuuggccccucccgacacaucuuggacccucccucaagccaaccaguuggggaugggauggggguggguggcaggccucucccaaccccuguaacaggccuccuaaucaccaagggguuccuugaagaguuccugggcugggugagguguggagagaccuaauacauuccaucucaucagccacccacaggcagggccagagggugccacuggugccuccucucccaggucaaauauuaacuaucuggccuuggaaagaggggaggaaucaggaacuggccagagggauaacaggagcaauuauucaagagguaaaggucagcacugcaggggcagagcccugagggguagagucaaauaugaaagggagagaagaggauucccugacccugaaagggcauaggcucccuguuugggaucugggacagcaggaagcuucaggcaagccggccaugccccaccccucccuguggaggcacaccuguuuaccuuugggaccuccuauuugcucagugcaaaaggcauguguguggggagcacuauggcuaggaggaacaugccccagguuagaggagccacucaguguggugcaugucacacuuauaguuuaagagucacaugggugacuauuaggaaggugauauacaugcacaugggugcacacacacacacacacacauguucacaaggaggacugugaacacguggauucacaggggucauucacacauauacucacagggaguuuugugcacacauaugcucauacagagggccacagccacagguaaucauacauauucacaugugacguugaauuuacaugcccauccauucagcaggucacacagccucagacauugaggagagauaaacccacacauguggguuugugucaaggacugugcaccuauucaacaggaggguccuauacauacacauguauguguagggacaugcacacaaacccauugauauagugggccaggcaaucauguucacagaagggucaaguacaugugugcucacacgcaguucuugaacacacaacuacauccaugcagagacaagcacacaugcauacagggguccaguuuuugccauaggcuuggaggcugccaguguccacuggggugagaugcagagcagaacccugccucuguuccugaaagucccaauucuaaggcccaauuucaaguguguguuuguguguggggguggugaggggguuguguguguguguguguguggugaugggggaggcuucugaccuuggaugggcagaugggaugggugcaugagucaaggccgcucuacaagggagggaaugggaaaguaacucaggcaggaggaggccccuagcuucagcaaagauggaauggaacgcauaauuuaguacuccuccaccccuauguauauugcgguucuaaaggugggagacgggcuggagcucucagcccccacuuaaccugugggagggggcggggcuaagugggcggggcggagcauaucaccccucccuucaguggcgaaguacggguuuaaggucuccaguccacgccccacacuccaccccaaguuccacaguucggguucuuccccagggccagcccccugaacucugaucaccuuuccucuauuagaucuugggguggagggaacuggggaggagagacccuucaaacaggaucaauggaggaucagcaggcucucgaccuucaucccagauguccaccugccuaguguaggcgguauuucccucugccuaguaggauggcggucucuccuggcuugagagagccccucccccgggacccccucccuccaacauccuggacaguccgcgguccucucccuucgucaggucuaaccucagucucuacugcugcagcucgaggacaagcucuccuucgaucccgccggacgccgggagacgugacccagauccuggggaacacuguucgccacgcggcccccuccccgcgcugguccccgacuccgugguggccgguuugcaccccgcgcagcccgaggccuggcccgcgccccucuagagccgucaugcaggaccgggggacuugguggugagaaaggccuggcccagcuuggaggguagaauggacgugggggaggccuugcccgacccccggcccgcagccccaggcucacgccagggcgccgcccgcacuccucgccuugcucaccuuugcgcucggauccggggccauagagacagcgacgcgcggcuccgcggccccacagcaccagcugcgagaggaaggggccgcggcuggaggcggggcggggggggggugguggaggcggagccggggguggggcgggguccugaaaggcggggccgacuggguggggugaggggaaggucgccacucucuucuuugcgcccccuacucuagcacaauagaggcgguuugagggcgaggcucacacacagccuucggccaucgggcgaccccccaccucua

SEQ ID NO: 18848 - RNA, 9194 nt, Homo sapiens
caagaaguagacaaguuugcaguuuauugaguaauggcuggcuucacagauguuaucacugggggcgguugauagggggaacaggaaaaugcucucagagguucccacugaagcccuuucaucugcccugccccacccaccacugaagccagaggucaugggaguugggaucuaacuacacucugugaacuuaccaccacccauuccauccccaagcccauauuuuauuuggacuagccacugaugcccgggcccuuccucuuccagggggugggaggguggagguggggacaggaccaacccucaagaaagaaaagagguuaagguggggguuuugcugaaugucuaagaaaugucaguggaacaggcugggcacaguggcucaugcuuguaaucccagugcuuugggaggccaaggcagguggaucaccugaggucaggaguucgagacuagccuggccaacauggugaaacccccaucucugcuaaaaauacaaaacuagcaagaugugguagcacacaccuguaauuuccacuacucgggagacugaggcaagagaaucacuugaacccaggaggcagagguugcagugagccaagaucgcaccaucgcacuccagccugggcaaaauagugaaacuccauuaaaaaaaaaaaaaaaagucaauggaacacaaaauucccugucuuaacauuguacauucggggccuagcugcccuugaggauguccuaguuacacccucucugauaccuguggaguuuaagcaccauuccuaccgcugugucccuugggagggggugcaguggaagcucuuaaaggggaaugcuugcucugccucuguggcuuuuuguuugggaaagggaguugggauuggaggauuuagauuugaggucaugaugucagagcacaccaggaacucccaaggcugugccugaagaugcccacgcugucaaguaggguggugggggagacagcgagggcaguacaggacacaggcacuccuuugucugguagagaggaggaggggaaauggagcuauuccaggauacaagggauggcacugagggaugcauaaguccccugccucccuugucucaacauguucuccucugccagcccagucagcuuggggagcuagguaucagaaaccugaaggauucagcccgcuuuguccuacuagugucuauaagucucuguccugagauccuggggcuccuccuauuucuagaagggaugaggugccaucaaaaauaacuuggcugguguaacaguuuagagaaggaagucacaccuguagccuggcuggcaggcagguggacaugaggcugagaagggaagccagaugucagaacauacuaggcuagcaugccugcuucuagcuuucaggacccaauguacacauacacauguguaucauguauguauaugcauggacacucaagcacaggagggguuaugugcucugaucuuugaaaccagagaagggaggaaaagccuuauggaggucccucccccacccuaauagguugcuacccucaauugccaucugcccaccaaggccccugcccagugcuaggcagauagccaagugguaggggugacaugacuccacuaaagcagcagcccaaggaagugagggaggggacagaggcugacccuccucaaagccccuuguuguaguagaccacuucaacgcugggguuuugcucauggaucugagcucucagcucugguuccagguugcuuauguguauggagcugcaauagaacagcacaggccaguuaacguccccugaauccaaccccacucaggcccagggauugccaucccaccuccucccaggcugaaaaauccucuccuucuacugccagaaggacuggcucacugucauucccccacucccagaaucaguggagugccugccaggccuccuccugaacacccuggaagacccuaggucagcugguccagagaugcagaguccaauccagagucccccacccagcccagggacagcacuuaccucuucugggggaauagggcacagcacagggggguugcaaauaccaggcugggggagacaaguguuggaaagguuuguaaagcuuuggccuuaggguguucccucccugcaccccaccccauccuuggagauaggcccuagggguggagauugauaaaagcugaaaggaccuuuuaggaauaguaaacccaaccuggacaucagguucugaggaaagagagccccacaaccaguaaguggcagaaucaggaauuaaaugggcaugaaucuccuggauggcaccaaaagguacauuuccaugguuuccucuuauagaugaagacuggaacccccucacuaggaucuugaccuucaaggacagggaccaccccguaacacacaaaguagacccuauaguuguuccaaacacacacccacugaauguaugaauggaugaugucuauaaacaucuuaaagacaauccauacccacccacauccaccauggacaaggcacucccacacaccccagcuaacuccuugcacacuuaccagaagcccaccagucccaccugcaggggugcccccagccaggggcggcgcuguggagagacagaaagacaauggaacggcuuguguccccugccucacugucaccccauuucacccaccauagcucuaucccaucagccuugccuuggagcccuuagaccuguggccguuuucuuucucccaaggcaaugacagggcugggaccuccagaucacgcccuuccacuccagccaggccugucugcugaucacccuccccggcaucccaugaccucucaccucucagaauugguugccauggcacucccuggcccuuuuuuuucuucccucacuuccuccaggagcugauuucuucaggaaaccuccugugaaccuccacuuaccucuucccaucccaguggcaugaaucugacccuuuccaagcacaucucuuccucggcacucuucucaauuugcucuggccacagggaccaccaaccuguuccucaaaugugcaagccccuccuacugcagugcccuugcacugacuguuuucuguaccccaaacacucuucucugcguuauuuggcucucuccucauccuuugcggcauuaaagaccccuucucugaucauccuaucuaaacagcucucccccaugaaucucaauuacacuacccccauugcuuuccuacaaagcacauauuacacuuucuaagaauguauuuauugggugccuccuuguuuauugguuucugcaucagacuauaaacuucaugaggacaggggccauaaccauuguguucagugccaucuccucagcccuaaaacaugccuggugcauggcacucaauacauuugugaauaaaugauucugugaaugagccagagcuuguuccugugcuuugcuuucguguccuguucaugucugugugugcguguucacccguguguaccucucaguauggaggcacuaggggguaaaagaaugagcaugagaucaagcaugacuaugacaguccccuucugugugucagaagccacuggaguaacacugaugaaguugguuuccuuccuuuguccucuccuccugccccugcagaguuccuucaccccagcccaguucauucuugcugaaugaacgaagguggaggaggcggugcaggggucaggagaagggcuggcaagucuuagagaaucaggcgaggcuggagagagaguuggggccuggucacuucucccagccaucgcccauuccaggacaagagagguacagucgccuaccuucaggaagucuuucuucuccagaguguccaugaucaguggugggauggcuguggggagagcagggccaagaaggagaacauuaguaguggaguuaaagucaggaacugugaagggugaccccccucaaagcuccucccucucuccccagaguccuccaaagucccugagaacugcaccugcuucucucagagucuccuaugccccacccagccacucccgccuuacccauggcaggaaucgccaugcagauucuugaaaucaccaccuggaagauucccugcuuggcugcagucaccgaguagccaagccucugaccugccucaucagccaccgggaugcccaccugcagcucucugcaagggagggggguuggggucagaucacaggccccggaucccaccugcaaugcccgaaugagcagcggcuccucaggguccccucacacaccccaggcucaaaggcugguucucccaccugaggaucccagggucagacugagccagggcccagcagcucaugucuggggagggagagggauguccccauucugagguggucugcguggauggacagugugcuacauucugggcaugcacaugccaggagccggggucacucaccucugccucaucagggggauguugaugcaguuggcagcugccacugcugcaaagggcacaaaucugccgaccaaggggggcaggugcuggggaggaaggguguuguucaguggcccuaagggccaugggguggugagggacucuggggagauauagggggcauauaggucagaacuggaggugugaugaggaagaaggaggcagauagaggaugaaugggguggucaggggagugaggggccuuuaccuuggugagggauuugagucccagggccguggccacagcuccagugguggcacucacauaggcuguccccagcugccuguggguggaaaagccaggucacggggagaggugacaaguccagcagguggcccuuuccuuuagggauaugccaaguccucaauacaugaggcauaaaaggggaagcuccuugcagaagaagccuucccuccaucuccggcguaaacuugucuagaagccccaguagcacccugugaagaggggugggucccccacagcauacauaagaggaccucaugccuucaguuaggcaggguaauucgggguggggcaggcugaggagagggcgcugagcacuggcugcaugguccacagggaaccggagagaaaggagagggcacugcaggcugggaggagagggucagaugggacagugcagcugcugcugggggcuggcucucaccucacagugaugggagugucaccacugcgguuggaguaguuaacaauggcauugaaggacugauucacccacugccagaacaccacgguuggggucuuccugagggaacaaagacacucacuucugccccgucuacaguggcccucaucuuuagaccccuguaaugaaaccaaagguuauuccccaagccuaagaagggacccaguuaauggcccuagaaccuguucugguaaccccuauguacccccacccccauuuauacaaacacaccuacugucucuggggugagagaccuccugaggcugaauucugaggaauggaagcgauucugacacaaucuuucacucacccaguuggcccagacaagaagcgcaccuagucaagcuaugcucuagcuuagggcacugaagaaggggacgugggacaagaccugccuguagaaugugagcaugcagccagugauggucauguucaugggcaccugggcugacaugcggccaaucaggaccaccuucuccccuguguccggauggaaggcggagucauacacauacuuggcccuccacagcugguccucggugaucccuggggucaccacgccggcccugcagaaguuggcaaggagcagacaggcuaugccagggggcagaucugcccucacaggccccaccugcccagcucaggguaacucuggacagagaaccaggaacuucagcccccagucucagcauaaggaagcuccuuaucuuugggagagggccaaaguuucccagaaguggaggcuccuauuucuauuucccuuauagccacacaaagagggguacccuucuguuucugccaaaaugcugggucagggaugauggugguuuccagugggucaaaaauggcugcaagcauugcaagaguuuuuccucccaaagauaaggggauuucccuccuaucuuccugggacuccacuuugagcaccucuauccuugcagagggugaccccgcaaugggauagaucccuguagagguuugugaugcauagagcagccccucccauaaauaucaaugccaucuucucaacccaaaugcccuaaaauccuuuggguuaaagcucugugaugccaacagacggggcuagagagugaggggauugagggacagggucacugucaagcuugaggaggcagguacaaaacauauuauauuaaucacagaaaaugagauccuggcacacagggucagauugagggguggucaccuguaguucugcacgauguuccgagaagcuuccagcugugccccggacagcagcagauuucgaggaucaguaacagugaaaaagugccgggcucugcccaggaaaguacuuuggucccagcgagguuccuggauguugaugucuaaaggcaauucacccauuuucugcaggacagagauaagggucagagcgggaguccaaggguccaagggcuccagcuaggggaaaucuuuggugccccugcccuggccccugagcuuaucaucagucccuucaagagcucaaggugacuagauguagggaaaagaaagagagaucagacuguuacugugucuauguagaaaggaaagacauaagagacuccauuuugaaaaagaccuguacuuuaaacaauugcuuugcugagauguuguuaauuuguagcuuugccccagccacuuugccccagcacuuugacccaaucuggagcucacaaaaacauguguuguauaaaaucaagguuuaagggaucuagggaugugcaggacgugccuuguuaacaaaauguuuacaagcaguauacuugguaaaagucauugccauucucuagucucaauaaaccaggggcacaauuaacugcggaaagccacagggacuucugcccuugaaagcgggguaucguccaagguuucuucccaugcauagucugaaauauggccucgugggaugagaaagaccugaccgucccccagcuugacacccauaaagggucugugcugagguggauuaguaaaagaggaaagccucuugcaguugagauagaggaaggccacugucuccugcuugccccugggaacugaaugucuccauauaaaacgcgauugcacauuuguucaauucugagauaggagaaaaaccgcccuauggugggaggugagauauguuugcaguaaugcugccuuguuauucuuuacuccgcugagauguuuggguggagagaaacauaaaucuggcuuacaugcacaucuaggcauaguaccuucccuugaaccuaauuaugacauagauucuuuugcucacauguuuuuugcugaccuucuccuuauuaucaaccugcucuacuacuacauuccuuuuugcugaaauaaugaaaauaauaaucaauaaaaacugagggaacucagagaccggugccggugcagauccuugguaugcugaacgccgguccccugggcccacuguuguuucucuauacuuugucucugugucuuauuucuuuucucagucucuugucccacccuacuagaaauacccacagguguggaggggcaggccaccccuucaacuagguagguaagcaaggguguggggaggagcuguuuccugggcaaugucccagcccagggaccugcagccacuggaggagggggaagggaagaccagaaacaggaaaacagaucuccuugugcucuauccugguacagauuuucaugagugaggauuuacauauaugugguugacacauaagcagcaacaaacaucccagccacgugugcuacagaugcacaagaauauauaauauauauauuacacacccaugcucaggugagcuuuaggccccagcugcacugagaccuggauacaaacccccaaggcuguuuuggaaaauggcacaagacaucccacacuccagucccugauuggaggagagcaaggccuuacuggccacccagggcuuaucuguuccagaucucaaucaggggacucugaugucagccaugugugugcaugugggcacgcacaaguccucucuacagacccauuuuucuccaacucacacugaaugaccccaggcucucccuggucccuggccaggcagggcuggcacagacacucauccaccucucucugggccacuugccuccggauaagagcaggauucaguggcugcucccuccacccagcacagagaggaaagccuggugcagccaucuggcugaguugggcagaauccuacagaaugacuaauccucuccagccacacuuccucccgcagaggcagagacgcccuccccucacacucacauacccacacacaaagacacuaucaugcacacccugcccagacauacagacagaguggagguguccuguauacaccggccuucaaacaccuuuacaggcgcacacugugcccaucugcagacacuugaaugugugacuacacacagccccacccugacauuccuccccccaaccucccuugugcccuguggacuuggaccuccacagagccgaggacauugacugcaccaggacagacaguuucaaggcaggccuccuucucugacccccauuccagaaccccgcccgccggggagagcgagcacuuacgcuuuccaucgcucucugaagcucucagaaccgccuuccucucugccuccgcugucgccgccgggcccucccagccaucacgcgggacgucacgcgugacgccgaccagcagggaggggcaggagcuucccggccgcgcccacccggugggcacggggauuggcagaaccugagggcggugggugucauucgaggcgaugcccccagccugggccaccuggaccaggcccuaagcugcuucccagagccaaucccaccucggggaucaguucuggcccccuccccagccaaagggaggaggggcuggagccgcgggcgcugcucccuugguuuacaguccccuggcgggccucagcagacccccagcccugcagcaagcggucuaggugcccagagagaaagccccgggcgcaggugggcggugugga

SEQ ID NO: 18849 - RNA, 3174 nt, Homo sapiens
guucuaguaaaauggcaaagacuuuauuuauuggagaaagaggccuuggguacagucuagggaggagaggggaagggaggagcagggaaggggcacucgcagcccacucacauccagccacccuccucuggccaagucggguaggagugggguguucgaaguggcaagagagacccagagcuguggaggaggugaggugagggcuugggucggccuccucucugucucugucacaugcaaaaaaauucuaaaaagaguacaaaauaauuauagggcuuuggguucuguuuucgauaguugguugguuggauuucccccugcauugucccuaagagccggacuccaacagucaguccgaggaaaugcgggagggagggaggaaucuuaaaaacagcauuagugggcauuaggaggcagaaauggcaucgaaaacagacuuuucucucagaggguggggaggaaagaucgauuuugaaacuugcaagucaggaccugacugcccaccucuuccccucccacaugaggaaaaaaggcccgaggaaauagaagucaacugcaauaaggccgagggaggcgaggaaggagcgggccggugcauucgccacaugcagagaaaaaucaaaacagccggagcugccacuccccuagaccgcaggguuaguguuccccgcccugguuucugucucgcccucagcaaacccggcagcccgagagcuuugaaaacaucgaaaucuccgagauuuaaaaaauaauaauaaaagaaaggaaaaaucaggcugcggugggaagaacccgcuauauagguuuaaauauuuauauagaagccauacagaauugcacggcgagggcuuccggggcggcggaggccgcugguggcggccggcccggccggccagccuggguuuauugcuucgagagggaagaggcggcugccaggagccgaguccggggccggggacaggggaggaggcgggaguuggcagaggaggucccagcuccccucggcgguccgguccgggaggcguugggcuuucgagcgcuaggagcccagggcggcggaagacccggggcgccgcucaaucguccacgucgaucucuucgucuuccucguccuccgagcaguccuggcugcuggccggcugguccgugagcggagaggcaggcgagagcugcagggcgccagcgcccggggccuucggggcgccuggggggaggaccggagagccgggccucgacuuggcccugccgcagccgccgccaccgccggcuguggccuccgaguucugcucgaguucggccagcgccacgauguccaucugcccgcuggggcccaguuucuuggcggacucuacgucggccuucaucuccuccaggucccgcuugagcuuagcgcgccgauucuggaaccaggugaugacuugcgcguuggugaggcccagcugcugcgcgauuuggucgcgaucggcgggggacagguacuucugguauagaaagcgcuuuuccaauucauagaucuggugguuggugaaggccgugcgcgacuuucgccgcuucuuaggggucugccgcugcccaaagauggucauaccgucgcggccugggaggaaaggacaguguaggcucgcguugggagagaggaagcccacccuggcucucgcccccguaacuccguaacccacccaggccuguccggccugcagucuaccaauguucccuucucagauuuaauucagccuccaggaccagggcaagucuuggcuauggcaaaccaucuccugucuuuggucucccagaagucccuaggaaaaauuguuuuggucucugcccccuaccuaagaguugguuugaaagacccaaagucucuaaggguaugagaaagccagacagagacacccuaauugcggugugaauguugguucuccaucccuucccaaucacuucaacucuacccuacccauaagguccccggcaaaagacucucgauuccccacgccgaguagccgggcuaagagcgcccaggacacugggaacgcaagggagcccggcaaagcaagcagacugcggaaagagcuuggccacccuucuccugccaccccccagcucuggccuacccagaggucccugggaaauaaggauugggucccgucccacauaucuucacucccauaagcagcugcucaggcuggaaggcccuggcggccggagagggcagaggcgagcagaggcauaggggacgaagcgcgcagggcacagggcgcgaggcgcugggugcaggggaacccagcagcugcgccuaccuucggcugccugcagaacgcugaccuccagccccuuaaacgucuugcuggcgagcuccuccagcgcgcacagcggcgaggucugcgagagcagcgcgcggcccgccaggggcaagccgcccugcgcgugcuuguccgcggcggccagcaggugcgccgccccgcacagcgaguaacuucuccgcacagacggcuuguugaggauguccucgaugcugaacggcgucaguggcuuguuggaguuggcaggcggaggcaggugguccagcgggcugcgccgccgcuccucccccggcgccgccuugccguccuccuuggaagucaucucggccuuguucggggucccggccggggcggcucgggccgcggggacccagcccgcgggcagcucgggcgccggacggcgcgggcaggcagcggcggguggaaaggaggccgcacugggcagggcgcgggccgggcgcggggccgauuagcgcggcggcugaggaggggagaacagcgcggggccccgggaagagggcgcugacgcgggcgccgcugcugcuggggcuuccagcaauccggggccggagccggggcgcgcugcgcggggcuccaguuucgccaaccccggugcuauuuaaaggugucagguggcucggcaguggcuccuggccccggguccuggcggccgcaguuggaagagccgaggcgagggcgccgaucccggacugcgagggaggcggagagacggggcaauugacuauugcuaacaaguuagccuugaucgcgguguaaucaauuaucugcagcggcacuucuuucucuuucucucuccuuucucccuuuuuccucucuucuuugccucuguucucuccuccuguucucgcucucc

SEQ ID NO: 18850 - RNA, 3174 nt, Homo sapiens
ggagagcgagaacaggaggagagaacagaggcaaagaagagaggaaaaagggagaaaggagagagaaagagaaagaagugccgcugcagauaauugauuacaccgcgaucaaggcuaacuuguuagcaauagucaauugccccgucucuccgccucccucgcaguccgggaucggcgcccucgccucggcucuuccaacugcggccgccaggacccggggccaggagccacugccgagccaccugacaccuuuaaauagcaccgggguuggcgaaacuggagccccgcgcagcgcgccccggcuccggccccggauugcuggaagccccagcagcagcggcgcccgcgucagcgcccucuucccggggccccgcgcuguucuccccuccucagccgccgcgcuaaucggccccgcgcccggcccgcgcccugcccagugcggccuccuuuccacccgccgcugccugcccgcgccguccggcgcccgagcugcccgcgggcuggguccccgcggcccgagccgccccggccgggaccccgaacaaggccgagaugacuuccaaggaggacggcaaggcggcgccgggggaggagcggcggcgcagcccgcuggaccaccugccuccgccugccaacuccaacaagccacugacgccguucagcaucgaggacauccucaacaagccgucugugcggagaaguuacucgcugugcggggcggcgcaccugcuggccgccgcggacaagcacgcgcagggcggcuugccccuggcgggccgcgcgcugcucucgcagaccucgccgcugugcgcgcuggaggagcucgccagcaagacguuuaaggggcuggaggucagcguucugcaggcagccgaagguaggcgcagcugcuggguuccccugcacccagcgccucgcgcccugugcccugcgcgcuucguccccuaugccucugcucgccucugcccucuccggccgccagggccuuccagccugagcagcugcuuaugggagugaagauaugugggacgggacccaauccuuauuucccagggaccucuggguaggccagagcugggggguggcaggagaaggguggccaagcucuuuccgcagucugcuugcuuugccgggcucccuugcguucccaguguccugggcgcucuuagcccggcuacucggcguggggaaucgagagucuuuugccggggaccuuauggguaggguagaguugaagugauugggaagggauggagaaccaacauucacaccgcaauuagggugucucugucuggcuuucucauacccuuagagacuuugggucuuucaaaccaacucuuagguagggggcagagaccaaaacaauuuuuccuagggacuucugggagaccaaagacaggagaugguuugccauagccaagacuugcccugguccuggaggcugaauuaaaucugagaagggaacauugguagacugcaggccggacaggccuggguggguuacggaguuacgggggcgagagccagggugggcuuccucucucccaacgcgagccuacacuguccuuuccucccaggccgcgacgguaugaccaucuuugggcagcggcagaccccuaagaagcggcgaaagucgcgcacggccuucaccaaccaccagaucuaugaauuggaaaagcgcuuucuauaccagaaguaccugucccccgccgaucgcgaccaaaucgcgcagcagcugggccucaccaacgcgcaagucaucaccugguuccagaaucggcgcgcuaagcucaagcgggaccuggaggagaugaaggccgacguagaguccgccaagaaacugggccccagcgggcagauggacaucguggcgcuggccgaacucgagcagaacucggaggccacagccggcgguggcggcggcugcggcagggccaagucgaggcccggcucuccgguccuccccccaggcgccccgaaggccccgggcgcuggcgcccugcagcucucgccugccucuccgcucacggaccagccggccagcagccaggacugcucggaggacgaggaagacgaagagaucgacguggacgauugagcggcgccccgggucuuccgccgcccugggcuccuagcgcucgaaagcccaacgccucccggaccggaccgccgaggggagcugggaccuccucugccaacucccgccuccuccccuguccccggccccggacucggcuccuggcagccgccucuucccucucgaagcaauaaacccaggcuggccggccgggccggccgccaccagcggccuccgccgccccggaagcccucgccgugcaauucuguauggcuucuauauaaauauuuaaaccuauauagcggguucuucccaccgcagccugauuuuuccuuucuuuuauuauuauuuuuuaaaucucggagauuucgauguuuucaaagcucucgggcugccggguuugcugagggcgagacagaaaccagggcggggaacacuaacccugcggucuaggggaguggcagcuccggcuguuuugauuuuucucugcauguggcgaaugcaccggcccgcuccuuccucgccucccucggccuuauugcaguugacuucuauuuccucgggccuuuuuuccucaugugggaggggaagaggugggcagucagguccugacuugcaaguuucaaaaucgaucuuuccuccccacccucugagagaaaagucuguuuucgaugccauuucugccuccuaaugcccacuaaugcuguuuuuaagauuccucccucccucccgcauuuccucggacugacuguuggaguccggcucuuagggacaaugcagggggaaauccaaccaaccaacuaucgaaaacagaacccaaagcccuauaauuauuuuguacucuuuuuagaauuuuuuugcaugugacagagacagagaggaggccgacccaagcccucaccucaccuccuccacagcucugggucucucuugccacuucgaacaccccacuccuacccgacuuggccagaggaggguggcuggaugugagugggcugcgagugccccuucccugcuccucccuuccccucuccucccuagacuguacccaaggccucuuucuccaauaaauaaagucuuugccauuuuacuagaac

SEQ ID NO: 18851 - RNA, 12332 nt, Homo sapiens
uuucuucagguaaugcucaugugggacucuguaucagcguuaucugggggagcucugacaccgggcaugcuuccaggaagcccugccucuacauacaagcuucuuacaaugcaugcgugcggguaaacacgcuuauguuaaaaaucucccucaaguaauucugcuauccugccaggucgagaacacugagccgucaccaccaggcuccccucuccaggguggcuaaacuugccauugaggguguugggcuguauuuuauuuucucaguuugggaagggaugaggccccagaacugaaaaaaggacagucaauggccaggaaccgaaugaguuaaaaccgggcccuauagccuucaucccuggugacucuggcuggccucguuagcgcccgcgcagcacgcacagaaggacccuucgcgcaggaugucccggagacucguccacgcucccuagccgggcugcgaaggcccagaucucccagcgccuccaugccgcgucggccgcggccuugggggucuuccggggacaguggccagcccugggccggugaccuagccuuugggcgcuuccccggggcucuagggucccagggcgccagggccaacaccaggaaagccagaagguuccuuccuuuggggcaggaguuggggggagucgccguacgcccacccugccacgcgggaggccuccgggagagggcagagggcgccgggcagggaccaaucaucggcggcgaccggucacucgcgccccagcgaggagacccugagauccgcggggagagcacagggucgcgccgcccccuggcggcucaaugacagaguugaggcccggcggcuggcgacugcggcgucuggcagcuccaggaaaggaucccccuugugaagaaacgccccuacgaagacuguccuguccugucccugcccucccgcucccgcucgccuucucuccccuucuuuauuuucucucuuccuccuccccccaccucuuccacucuuccugcccuuccccccuccccguccucacucccucucccacccccauuccuuucucucguccuucgcccaccgccucccgcccccgcggggcagcgccucggugcacccgcuuggcaguuagcccauuagaucucguacuauugauccgcuucugagcaaaagcugacagcacccccucccgggcuccccacguucccauuccccgcgccccccuccaggcaguccuggccugcgccuccucccgccccccacgcgggccgcgccgaagucucgcccucacgaaggacgagaacaaauguaauuaaagcgaccggcgaggggggugugcccccaccaacgcaggcacgagcgagggucccagcggccggcgcccggccugccaccucccucccccucguccccgcccccuggagcgggagcauuuggguugagcugcgccuguccuauaaauccacauauaauucuccucuuuccuguucagcuaaggaaaauaaacguguaaggcuguuucugggagcccagcucagggaccgcucuaaauucuccucuuauugaguaggggcuggaaaucauucagcucggcggcgcgccccagaaccacccccuacccccgcuccggcccgcggccgcgcccgcgcccgccgcgcacacgcacgcgcgcacacggaaggcaggcgccggguauauaaauaucuccagcucuccccauagccgggcagauuuauuccgcugccaagccugcagaaaauugacuuguucauggaggcggcuauugacacaucaccggggggaggguuaggggagaaagcaguggagccggcgccccuccauuauacguuaauguaaucagcagugugcgaaaugacugcgcggaaaauagcaucacugacauuuauauuagaggauauugauggcaggagcugugaccgcaucacucugccucccguuuccacggauugacacaggagccucuuguuggcuccauccacgcucgccuccccucccccuaccucucccgcccucucucugucuccacccacccugugucucuccagcucucccccucuccgaggaggagaucucacccccacccucccuauacacucuuugaucacucauuuuccaaauaauucuugagcaccuacugggugccaggcgcaagggucucucccugugccuccucucccuagguuucucccucccccucucccccaccgugcccuugcccucuuugucccuccuccccagcucugccucuccccucccccugccuuggcucgguggcuggaccgcugcugucacagcagauagauaauugaaaaaugggccucaccuuugcagccggcaggagugguucaggcaguuaccgccgggguuaccuacuccaucucaggcccaggcuccaaaagagauucugaggaaauuggauuuuacauggauguuuuauucgagcagaggcuuuaguguauauaaauacaggcgaggaggccuuggcggcaaggaugagugaggacagacaaucccgccuggggccuccaggcucaggcgaggcaggcgggccaugugcucagcucccggucccagaccuggauaucagcgcauucccccucaugaucugggacugaaagagguuaaugcuucugaacagcuccucaaaagcugccuugggaauaaaagaguguaguuguugagaacuugacaggacaguauacugagaaaagaaggaaauauacuggagaaguuugaggacugauucuuuuucuuucuuuuuuuucuuuuucuuuucuuuucuuuuuucuuuuuuauuuuuugagacagaguuucgcucuuguuguucaggcuggagugcaauggcauggugucagcucacugcaaccuccgccucccggguucaagugauucuccugccucagccucccgaguagcugggauuacaggcaugugccaccacacuugguuaauuuuguauuuuuaguagagacgggguuucuccauguugaucaggcuggucuggaacgcccaaccucaggugauccgcccgcuucagccucccaaagugcugggauuacagguaugagucacagugcccggccgaggacugauucuuucaauaaauaucuauugaaccuuuaacuuuugaaguauugaguuugaggcacaggagugaguaaguuauggcugcugccuucaagaacagucuaauaguuuggagaaugacacuggggguuuccuuuuuuuuuuuuuuuuuuuuuuuuuucagagaugagggucucacuauguugcccaggcuggacuugaacuccuggucccaagcgaucuucuugucucagccucccaucuaggguuucugguuauggauaaggaaagggagagugagaaagcagaugcugagauugcuuuucuagggcaugaccagcuggggagcuugaaugaagaggcaggagggaaaguggucggauuggggcgauaaaggaccuaacucuccagucugcucucugagccugguuagcaaagcaucuagggaacuuggacaaugguggacaaugaaucuauaggcaagaucacauccaaaguguuugcaaggaauccuggugagauucucuggagggccaagaugaaggaucauugaagaccaaggugaggcccuccagagagaccagguagaaggugggaagaggaccuuugcgggaggccuaaauugaaggcacuugggcaaaugaggggcaucagaagaccagggagaugggauguggguguggagcgggaggaggcaaugccuggggaccuaggauaaagauucuuuuggccgggcaugguggcuuacgccuguaaucccagcacuuugggaggccgaggagaguggaucaccugacaucagggguucgagacgagccuggcuuacauggugaaaccccauuucuacuaaaaauacaacaaauuagccaggcaugguggugcacaccuguaaucccagcuacucaggagguugaggcaggagaaucgcuugaaccugggaggcagagguugcagugagcugagaucgugccauugcaguccagcuugggcacaagacggagcgaaacuccaucucaaaaggaaaaaaaaaaaaaaaagauucuuccagggccugaauguccccuaccccauaggaaggucuacauuucauuccugggcagggucuuuucugugcccuguuugaucucugauuagagucuauguggcugacaggugcagcgcaaaucauuucuguuccuuggaaggagagucaugagccaucccaugauuaaaggacuggaaugaagaugagcggacccaggcucagacugcucacugaagggauaggggcuucuucugagcucacagcacagacaacagcugccuuaucccagccauaucgcugaaagcuggacuguuccucccccagagaaacauuacaaaaccccccuuguccucugccacauuguuauacuguuacaucauccgcuuugggggcaggacaggugcuggauagaugauggccaucccuccagcugccccacacacaucccaggcacucccagauggcacacugggaacuccaguccagcuguaggaugggaguauucugcgguaacuggacucccucucagaacucucccugucugacugccaucagcaucuucccucucaccuacagauuucauucauccugacagcccaguggaaagggagccccuuuccacccaucagggagccagaacacucccacuuaccuuaguuaccugugccaccuccuucccuuugcccucagugaaccacaggaacucauguccuaucugucucccagaucaacuccuguauuugucuuccuuuccuugugacucauuugaaacauggaugcagagauucuggucuugcuccuagcuuaagacccugcugugguguuuguuucccuccaaaauucauguugaaacugaauccccaacgcaauagcauuaagagguggggccuuuaggagaugcuuaggucgugcccucacaaacaauauuagugcccuuauaaaagggcuugagggaguuguuugccacuuuucccccuucugccgugugagaaugcagcaagaggugccacguaugaagcagagagauauccuuuacccgacaccaaaucuccuggccccuugaucuuggacuuuccaccuccagaacugugaagaacaaauuccuauuauuacuauuauuauuauuauuauuauagagucucacucuguaacccaggcuggagugcggcggcguagucucaauucacugcacccuccaccuccuggccucaaucgauacuuccaccucagccucccaagcagcugggacuacaggcaccugcuacuacacccagcuaauuuuuuuguauuuuuuguagagauggggcuucaccauguugcucagacuggccucaaauuccugggcucaagcaauccucccaccuuggccucccaaaguacugggauuacaagcaugagucaccaugccuggccugaauuucuauuauuuauaaauuacccagugucagguauuuuguuauggcugcagaaauagauuaagacagaccccuuggcugggcacgguggcucacaccuguaaucccagcacuuugggaggccgagaugggcagaucacgaggucaggagaucaagaccauccuggcuaacacggugaaaccccgucucuacuaaaaauauaaaaauuuaacgggcaggugccuguagucccagcuacucaggaggcugaggcaggagaauggcgugaaccugggaggcggagcuugcaguaagccaagaucgugucacugcacuccauccugggcaacagagcaagacucugacucaaaaaaaaaaaaaaaaaagacagaccccuugaacaggauggcgaugagaacaugagugcaugcauauacaugugugugcaugcacaugugcucccuugagcauugcaaacccagggaauaagugacaccauucaaggaaccgcacucggucucaccuugccauccaauuuaggaaauugacauucguuagaaaaauaaaggagcagccagggaaguggcuucccacagcaggaaggaugcuccucaaggcuuuaugaagaugggcuucugggaagucauuccuccaggaacaucugcccgauaagccaucagagaggacucagggaaaugggggguugaagguacuggaaaacggagccacauauaauucaaccauuucuugagauuuggaaucuguccuuucucucuccccauguagaggccagguagauguagggugcaaaggagaaugaaccuuugaaagguggcuacucugcuucuggggggccaaggaagccagcaggagcugggaaguuaaggucuagguggagaagccaagcuuggcagaggaguguuuccaacuuuagcaacaaagccaaucugagcuguguaacugaggugaaagucacuucaccacucugggcuucagguuccucaucuguaaaaugagaaaaaauaagauuucuuuccguucuaguuucugugauucuaaaccgaugggugagugugauuggagagcccagguuuaggaugaaagaaggaauuucagggcugaagauccagauucuuacaagagggaugaacagagguaauugcagggccagcggggccugacauucaucagaggacuguugguggcugggaaccugccagggccaggacaaaacagagcauaaaaucagcccgacccuggggcagagagaaggcagggauggaucuagaaagcaugcuaccuaaauuguuucaaacucagacucuuugcucagaaucuggcucauacagcccagagaucauggguagaaacuccaaguggccaggcagguguccaucagccuaagcaacauaaaaucugugcacucucacguucugugcuuuagaagggaaugagugggaggugagggucuuugcuuuguuuccccagaguuuccuaauacgguuuccugcuugagaaauguuagcaucaccuuggcuggauggagaggggaucagggcgccccuagugguggaggcuggugguuggcagaagcggcaccuccuuaagacuucacuagaggagcacgggauaaagugugaagcagcuggagggaggccgaggggcacagagccuaauggaggcaaucccuccgcccuguuuugacucagggcaagaugaaacagggcagguggccagggagaguuggagcagaaagcugccuuggaggauaaaugccuagagggaaaagacuagaagcccagagcacaggcagccagcaggcagcaggcaggggaggagaggugagaagggagggaagauaucccuuuccacggaugugccuuggccccugcccaggcaaagaggggcagauuuuccgucuugucccaagccccugcaucugccaccuuguuuaccuccugccuauuuauaguugcaaauuccaagccuggcaugggacucugcgauuuauaugacuauaaaccuucaaagggcacugagggcuggcggggaauggguaaagacaggggcaggccucgcaaggucaaaauacucagucucccacccccacuguccugacauccuaccuccucacaacagguugaaaggccaggcucacgcaaauaagaaaauggguaggaagccacagucgccgcugacucuuccuacccuaagcuuguccaguuuaggauuuagagcaaggcagagcauguccuggguccuggaacauggugggggaaaagaagaaaaacaauagagcaaaacagagagaaccuguuuuagucucccuggccccuuuugggaggggguagggaagcucagugugggagaguggaucucaucaaggacaauugaauuuggagagagugggugaguccaggcuuucgagggagaggggaaauugggaucagcagcccaacucccaccuaccccauccacuuaacagcagaggggaagaagaaugagaccuggagcacuccuggccucuggcuuccuucugggggugccuuuggaggccugaauggcucaccucuuauucagaacagggugcacugguuuacccaaugccugggugcccagucaccauggaauucugcuagcacugcucauaggccagauccuucccuuuagaggcacccucuccucagccucuggcugacccucugcuucaauucaucucccuuucuauuuucucuggaccuccagcccgccauguguacucacguuaccgcuccccacaaagugccccuugcuuugcaccugugcccucagcugacuauuacagccuccugcucugcucuuccccucaagcccaccacacugguccccacuccacgaugugucauauguagcucagcucugugugugcaugugugugugugucugugugcacgugcaugcauguuuguggcugcauguguaagaaugugccaaacaguuuugaacaugaaggaggggggaacccagaauggcuuucuccuugacuuuuuuguuguuuucccaucaaccuccagucugcuggacuaagucuaaggacuuagggagggaaaugucgcucuuagaguccaugugacccacuggccacuucugacccucuuuuacagccccccuccccgaccuccaccaucuggggucucaaaccccucaccacuagacuaagccuggugagaggcagacagagcugagggucagggauugcucaguugggauugguccucuggcaggggagggcacucagucaacagagacucccaucuggcuuugggcuuggucucggccuuggguaaagucauauagggaaaggcggaggccacaaggaaugaaccaauucuuggucuacuccucucuccuaccgucccagcccagccuauccuuggggacagggaugcaaaugaguaagccaagucaaagucccuucucuaagaagagagacagagaauagagaagaugucacagagccccuuuugccaccuacuagucuucucuuuuuuuuuuuuuuuuuuuuuugagacagguucucacucugucacccaggcuagagucuacagugcagcagcaugaucauagcucacugcagccucugccuccugugcucaagcaauccuucugccugagccuuuugacuagcuagaacuacaggcaugcaccaccacauuuggcuauuuuuuucuuuuuuuuuguagaaacaggaucucacuauguugaucuggcuggucuugaacucguggccucaagcaaucugcccaccucagccucccaaaguacucagcuuacaggcauaagccacuacaccggucucauaguguauuuuuuaucuagugcuuucucuguggugggagaggggguaucaggaggcauugucagaugugaagauggugucugggaugcuuauuuuauuuauuauuauuuguuuugagacagucuugcucugucgcccaggcuggagcgcaauggcacuaucucagcucacugcaaccuccgccuccuggauucaagcgauucuccugccucagccuccugaguagcugggauuacaggcaugcaccaccacacucagcuaauuucuguauuuuuaguagagaugggguuucaccauguuggccaggcuggucucaaacuccugaccucaggugauccaccugccucggccucccaaagugcugggauuacaggcgugagccaccucgcuuagccuggaauacuuaacuuuauaugccaacuugacugggcuaagggaugcccagauagcugggaaaacauuauuucugggugugucuguggagggaguuucuggaaucaguaggcugagugaggaagacucacacucaucacugugggugggcaucauucaaucuguugauggccugaauagaagaaaaaggcagagggagggugaauuugcuuucugcuugaucuaggccauccaucuccucuugucuuaugauuugacauugcugguuuuggggacuuaagacuuggaccaggacuuauacaccagccccuccccggcccccacaguuaucaggccuuugggcuuggacuggaacuauaccacucacuuuccugggccucuagcuugcagucagcacaucaugggacuuuuuggccuccauaauugggugacucaaucauucauaauaagucccuuuaucuaccuucuuccuuccuaccuuccuucuuucuucuuuccuuuccuuucuuucuuucuuucuuuuuccuuucuuucucuaucucucucuuucucucucucuuucucuuccucucuuucucaccuucucuccuugucugcuucuuucucccuuucuucuuuucuuucuuucuuuuuuucuuucuccucuuucuuucacucuuucuuucuaucucuaucucucucuuucucucucuccuucuuuccuccucuuucuuucuuucuuucuuucucucuuucucucuuucuuggucuguuucucuggaaaacccugacuaauacaguguaugaggaccuggggagaaaucgaggaccuagauggaggugaggugcagugaagagaagccaggaggaccugcagaggggcuggcagcagagcagagcucaccguuaugcccucuccagagggaggcagcagaggaccaugggaauugccccauccagcauuagcaguucaguuccccuugcuucacugucuaccauggagcccauaucuagggacucaccuuguuugaauguuuuuacacuuuuagucccugccccaaggagagaugccuugggaaagucagcccugauuuagucccucccaagcuccucucuucauuccuauguagaggcuucucuccuuugugucuagaacuuagagaacauacuuuuguccacuccccaccuccuuacauuucucaaccuccccagcucccuaccuccuacacgcccuuggaggccaugauccagcccagauucacugcccuggagaggcccguaucucugcccuguggccaugcugagccaugacugugacaacuagacauuguuagcaucugacccccaucaucccuagggaguuuccagugagggcccauacuccuaaugucuucuuuucccuacccccauuuagucacucaccaggccuacuuccuggauaugaggaccaggucuggcccuggaagugcacagggagaugguccugugcuggggaccaggcuagcauaggggcagcagcuagguggaggaguucugagguguggccuugagugcgaugaaaaaccagugccucauagccuaguaacauuccccucccugccaacauggcaccucuguggucccucagccugguuggaagugggguggugaggaguuggggggcacagguagauggaagguggggaauggggugggagggcacaggucaagggaacaaauaucuaauuuuuucaaagcucaaaaacuggaagcaaccuagaggcuucaaaguuaaauccuggagcagagagaacaucuccugugcaucggguagagggagccagggacagaauggccuugguuugaggaugaucuuaucaaaaaggaagcuaagagugaccagcuuuuuugagaccaaagagggccaauggguuccuucugaacucuuacugggaugggaguggcugagagagcuguagaccugaacccuggggggcacagcugagaucccaacagaaaggagcccauguguuaauaaccacuauaagccacgagaaagucagggucagggagugguggauuacuacuggucucucuuauccagucuccugucauugacuccaagacaucugggucucagagaguccaagaugcaagguaggcagcuaccuuacagaucaucuggccuaggacucauuuuauagauagagaaaagaagacucagaggggauaggaaggugccugacuguaccacccaccaucucaagucaucuauuagcuuaguuauaagaucucaguuugaccucauccuguggaacuccaggcuuaccugccugcccaauggauuugucccuagauuaaguuuccccuccacccacauuguugcucuauguuuggaccccuccagauaggccugauggaggagcccugauuggaaaauuuccccuccccuucccugucucagaauauagcuucuuagggcgcucccuuugcaacuugagaugucacugucuuucuauuaaaaugucuuuuccacucugccucucccuuucucucgcucuucuccaaacccuacccccuccacccccaccugccaucccuucucuagauagagccccagaacugcugagaugaaucucugcagcuuugug

SEQ ID NO: 18852 - RNA, 9381 nt, Homo sapiens
gcuauucuggccauuugcccuccuuccccccuucguccgcucucauuggcucugcugguaaguggucuauuccugcccacccccgggugacuagcuuggccaguagucgaccccacccggggaccgacucuggggguuggagagacucuuggggccggggucgggcacuccagcuuucuucuagccccgagcugggauucccuggccugcgccagcugcguacacggcgaguacaccgcaccugcccgggacuucacccgcagcugcgagacuccuccauucccggagggcuccccacaccugcugcggccgugccccaucuccccgcagcugcggcgcugagcacccccaugucgagaggcugagaccaggacaggugcagggcguucccacucacccccgaaaguccuccuccuuccucugcgagucuguguuggagguagagaaauaguaugugggguuuaugugcagguccuccccaggcuccgcuccauccccuaaagcuccauuuccuagcccagcaucccauuugguaaagcccuucgaagugggccgcagcagggcugugcugaaucuuuagcgcaaccccucugaggaauggugucguuuccuacuccucaaaaguacccccgauggcaccagccuuccccucauuucccguaauacuccaacuucgaaaggcuggggagugugaagcuaggcuaaaccacugaaguuuaaccggguuugaagagacccccucccccgacccgcuuccccaaacugggcugcuacccccaaagccuggucaggaaagacccuaccuccauaggcaaagggguuggagggccucaauucuggauuuccacgugcagcagcccugaccaacgcuccaauaggccgggauccagccauacuucaauggaucccagggguaucuugaaggcauuucccaagcggcagaaaauucaugcugaugcaucaucaaaaguacuugcaaagauuccuaggagggaagagggagaagaagcagaaggugagcugacccagucucagaacccucgugugcuugaacccacagccuucaugugcuucagcccuacguuguuuauguccagaaucagauauuggagcugacucugccuguccagggccugcaggucuguuuguaucuaccuugugcuaagcuugguccugggucuuggacaggcuauuugcuguguuaccuucuuuucuacccgaagaccucuauccaucagaaaagacucccugggcccucagggaaugaccaguauaauuuuugcccugaggacugggacagaaaccccccuccauuacccaggcuuguuguuaguuguuuugcagccaaauuggcaaauaaauggcagaggcuuuggaggcaggguugucgggucugucagacuguaagggcaagaaacgcgcuuuguugaaagaauaaaugauaaaggauucaaaguauggagagaggcugggcgcgguggcucuugccuguaaucucagcacuuugggaggccgaggcaggcagaucaccugugcucaggaguucgagaccagcuugggcaacauggcgaaacccugucucuacuaaaaauacaaaaaauuagccaggcaugguggcacacgccgguaaucccagcuacucgggaggcugaggcaugagaaucgcuugaacucgggagauggagguugcagugagccaagacgaugccacuguacuccagccugggcgacagagugagacugucuccaaacaaaaacaaaacaaaagaaaacaaaacaaacaaacaaaaaacaaaguaagaagggaggaggcauucauuaaacaaauauuuacagguuacuuacaaugugccagacacuucuagauugcaccaaggaacaggacguaugaaaauccuugucccuuacauucaagugcuggccugugagaaaauuugcuauauguagaaggaaagcugucuggauggaagggaaaugcuuauuuucaggguaggggacugugaacacgucauucagaucauguuagaaguuaugucguggccaggggguggcagauaaaaauuaaaaaguuacaacaguagucaucuggauguuccuuccacagaguggcugagcucccuucgggcccauguugugcgcacuggcauuggacgagcccgggcagaacucuuugagaagcagauuguucagcauggcggccagcuaugcccugcccagggcccaggugucacucacauugugguggaugaaggcauggacuaugagcgagcccuccgccuucucagacuaccccagcugcccccgggugcucagcuggugaagucagccuggcugagcuugugccuucaggagaggaggcugguggauguagcuggauucagcaucuucauccccaguaggugggcugaucccagucuuuuuuucaaauguuuucuaguagcaucuugagcucuuuucuugaauuauuaaaaauaacuaucauuaauuaaaaaauuagccaggcaugguggggugugccuguagucccagcuauaagagguuuaggugggaggauugauugagccagggagguuaaggcugcagugagccuugaucguaccacuguacuccagccugggugacagagcaagacccugucucaagagaaacuccaaaaaccucaaaaaacucguuuucuuaauuggacacacugggaaaccaaguauuucagaguacagaaggacuggggacagauacagggugagaccuuuggugucuuaaccucccaucaccauccccacagguacuuggaccauccacagcccagcaaggcagagcaggaugcuucuauuccuccuggcacccaugaggcccugcuucagacagcccuuucuccuccuccuccucccaccaggccugugucuccuccccaaaaggcaaaagaggcaccaaacacccaagcccaggucaggagccucccaucccucagaacucccuuccccuaggaagcagaucacagaaauggggugggccugguggcuguucagaaagucccaggccccugagagaggagggcucuauugugaagccauuuagcucuucccaacacucaucacugcugcauuuaucuaggccauaucuaacacauaccacuggggauccuagggcuaggcacugcguggagccaaagggaacguggccucacacccaaggagauccaagucugaugcagaaggccccgccucauucuuaggucugacuagaagacccuccccccgcacaaagaagaugacccccaccuuuaaggaucccuucucuuggagaacaagaauuuauuguuuucuuuucuucucuaucccaagcccaucucugaugaugaagccagugauggggaagaaacccagguuagugcagcugaucuggaagcccucaucaguggccacuaccccaccucccuugagggagauugugagccuagcccagccccugcuguccuggauaagugggucugugcacagcccucaagccagaaggcgaccaaucacaaccuccauaucacagagaagcuggaaguucuggccaaagccuacaguguucagggagacaaguggagggcccugggcuaugccaaggccaucaaugcccucaagagcuuccauaagccugucaccucguaccagguacccaggggcuagagugggaggaggggucuuuacuggccagugguuaguaaccccagugggguucagguacaguggugaagauuuuauggggucuaggacuugcacaaaagaaaaaaaaggaaaauugaugaaagcagauuggcaaaaucuugauaguuguugaagcugggagauguacgauacuuggggguuauauggaucucucuacuuuugaauuuuuuaacauaauuaaaaguuuuuuauuuuuaauuuuguuuauuuauuuauuuauucauuuauuuagcagagaugguguuuugccguguuacccaggcuggucuugaacuccugggcucaagcaaucuacccucggcucagcccugcaaagugcugggauuacagccaugagcccuugugucccgccuaaaaaguuguuuaaaagaaguuuggacucugaagccuaacagaccaggguuugaacucugguuccugucauucacuaacugugugacuccagacaaguuacuuaaacucucaaagcaucaguuuucucauuaguaaaaaggggcuacuauuaaaugaaauggucccuguagcacaggaccugacauagaguaagcccucaguaaauguuagcucuugcuguuggaaugaugaugaugguggugguggugguggugacuaauaucaucauuauuuucuacuucuuacugcuggucuccauccuucugggaaccaaaagacaaauuacccagcccucauucuauccaaaauucucaucuucaacuacacccaagcuuuacacagccacacaguugccaagcagccaggcuggcuuuuaugucagcaucugcuagaggagucagcuuccuuuccacuggcucuaccucuuccaucuccucacucuucuuucuugccucugccuccuccuccucuaggaggccugcaguaucccugggauugggaagcggauggcugagaaaaucauagagauccuggagagcgggcauuugcggaagcuggaccauaucagugagagcgugccugucuuggagcucuucuccaacaucuggggagcugggaccaagacugcccagaugugguaccaacaggucacacccuggcucagccccuacuucaguuuugcugugucucagaguuccugccccagaugugugcugugcucugccccagaucccuaugcugugcucugaugggaaugcacccacaguauagggagaccauuuuucaagcggaccaggacucauauagaccccucagcucccagaacagccuuguugcuugguauccuuaagaaggaguagacagggacaagaaguauguuucucagucuccccagaccagcaagggccuuccugaggaggccaggccuugacacugcgugucuagagcagugguucccaauccuggcucugcccacaaucaccagggcagcuugguaaggaugaagaugacaagguccauccucagacugauggaaucaugaacgagcaucuuaggauaguggcagggcuggaugauggcauguuucccaugcucccugccuuucccaaguccugcugaguacagacccaacugccccuagguugguccugccucuagccuucccuagagucuggggcgauggaagccuugugugugugcucacucaugccucuucauugguccuggauccuuacagcuucccaucuggcugcuuuuuuccagggcuuccgaagucuggaagacauccgcagccaggccucccugacaacccagcaggccaucggccugaagcauuacagugacuuccuggaacguaugcccagggaggaggcuacagagauugagcagacaguaagcaggugucccagagcagugaggacagccagguccugcuguaaggucuugggucaaagccaagaacccccaacuccucagcuggggaggacagcaggcagaggaaacuguggaucaccagagguugagcacagagcaaguuaagacugaagcuccaggcccagagguggggguggggagcuuugggaggaaagagcuguaacaccagcccucuagauucugguucucaguagucaggccuauuaggauuggauucaauucuagacugauugguguuaggauuggguuaauguuaggguuagauuacaggugaauuauaucuguacugagguuagggugggucagggcagaggguuuuaauauuuuauuuuaucuuuuuuuuuuauuucaccaacuucuuugagaaccugaugaaaacuguggacuguuuucuccccaaaaugcacaaaugugcaaagguuuaugucuuuuuccagauguauggaccuucuaaagcccacgcaaggcuggcucaggauuugggguagaguugguguaaaagcacagugucaguaggauuugguuuggggcuggaagaaagcuccaucaagauggaguuaagaccaggcacaguggcuuaugccuuuaaucccagcacauugggagaacaggguggacagaucaucugagcucaggagcucgagaccagccuggccaacguggugaaacccugucucuauaaaacauacaaaaauuuccagccuggcaaacauggcgaaaccccgucucuacuaaaaauacaaaaaaguuaggcgggugccguggcucaugccuauaaucccaguuucuugggaggcugaggugggagauuugcuugaaccugggaggcggagguugcagcgagccaagauugugccacugcacucuagccugggcaacagagcaagacucugucugaaaaaaaaaaaaagauugaguuaaaguuaggcuuuaauuaggcguaggauuuucuuaauguugguugcuuuuaaguuaagauuuguaguuguccaagaaauaagauuuggguuugguuuagaguuggguuagcgauuagguucauguaaaagcuagauuagagagacacuggacugcauuuagggcuagauguaucauuuguucaaugggcauuaggauuaggagcugcuuguaauaggcaaguuuugcucacuuuggucagggauucugauagagugggaucccauggagacuggccuaguuugauugaaaucagcccccagcuccauuccaggccacaaggcuaugaggccgguaugagauggauggacaggccucuuugucugcccaucaccaggccuuggugcuagugaugacaccgucacucagccaugguguccgggcauggagaaugccucagucaguacccagcccauuggaacaaaagaggcuucccaccuggccuccugugcccccauuuaagggcuccagccauaggaguuuugaugggauuacucacguggaccuccuccuuccauucucuugggaggcucaagaagggaguaaggggauuagcggagcccuccugucaggauacuugagguguccggggccccagaauuuucaguguccugggguggaggcaggaggccaucugcauaugaaagaaccucagugucucagggguggaggcuaauggguuuauuuuuccucagagggacaauccuucagcuggcaguugcugucucagcucccuccccaccaagaaaggauguggguguuggcucagaacugcccccucuuugcuuucuuuccucuccuuucccacaggugcagcuguauuucugugcuccacuuucuccugggccugggccuggcgcaugcugccagccaccugcucaguccucaaaccccagcucacauauuccaaaccuuuagcuccaaaucaguagauaucuggggcugccuagaccuggcugagggcuuucagcaccuggccccuuguccuaaguggaguuucacagaccugggcacgugggcuggggcaggggcagagagagucugugucucccuacucuuaaagagcuccacagggcaagcucagugcccacucucagaagcagagccggcaccuucucccgucucuccucaggcuugccuccugcacagugagcuuuuucuucucuccuguccuagcgaagggaaagaacagcagcuccucaggguggauuccccugggcuugcagcaggcaucuggaaugggcauaagcugagggugugggcccgagucugggaaggcccuuguacugcugugggagaggagcuccccacgcacagccccucaccugucaccgcucucuuucccagguccagaaagcagcccaggccuuuaacucugggcugcuguguguggcaugugguucauaccgacggggaaaggcgaccuguggugaugucgacgugcucaucacucacccagauggccggucccaccgggguaucuucagccgccuccuugacagucuucggcaggaagguauaagcuccaucucugggugagcagguugacagagggcagcacaggucugggggcccccucagagggagaaccucagaaguuccaguccugaggcaggaagcaggggaacagugcuuugccagcaucccaucucucuaucggggccggaauccucuccagggagagauggaacagccccgccacaccuauguggaggugcucagugaacccugcaggccaaguaucucaucugaucuuucugugacacuaugggggagaugggaauuacuauccauguuuuacagaaaaggagaagggcccagagaggguagugucacccagcuaauaccugggcaagccccagcuuagacaucaggagagaccugggaggaugggacagcccaggccugguucccugcccucccagcaguccccucuguugggccaggguuccucacagaugacuuggugagccaagaggagaauggucagcaacagaaguacuugggggugugccggcucccagggccagggcggcggcaccggcgccuggacaucaucguggugcccuauagcgaguuugccugugcccugcucuacuucaccggcucugcacacuucaaccgcuccaugcgagcccuggccaaaaccaagggcaugagucugucagaacaugcccucagcacugcugugguccggaacacccauggcugcaagguggggccuggccgagugcugcccacucccacugagaaggaugucuucaggcucuuaggccuccccuaccgagaaccugcugagcgggacuggugacccauggcugggggugcugaggagagccgaguuggacuggcuaccccuccuggccacccaguacucccuccagccucagcuggcugaaccucgccgcuccaaccaccagcuuccucagcgagcagggcccagggcucugggccugaagcaagagccagcccggcucccagugucugcccggcucccagugucugcccagcccucucccagacaggagcaggcugccaccccuucuaccucaccacugccccucgaagaauuuugcaaauggccccuugccccauuuuaagcaggagcagguggcugguuugaagccccagguaucccccuucccugcuaugggaaaggccaagcugcuggguggggacagaagcugcaggggagagggaagcagccgugcugucaacaucauccggcacccucugggguaggagaacagccauuccacauguguucccucuauccguccugcuuccugggcagcugguggugcugggaauggggugccccagccuuggugaggacaguguugggaggcccaggggcccaguaaagugcauuugacauugaacc

SEQ ID NO: 18853 - RNA, 24170 nt, Homo sapiens
ugacccucuggaacgguugccauggcagcggcugggcgugcugcuuagcaggggaaagauggcggugacgggcugguuggagagucugcggacagcccagaagacugcgcugcugcaggacgguaacucgaggguccccacgggcuccuucguuuuuuucccucaggguccggcccuccgggaagggccucagggccugggucggcagagcuggaagggucucggcggucagccgggccagguccugcauuugcagaugaggagacugagguucacagagaugacaugacuggaacacaugucuccggacaccccuuagauuccucuacaccaucucgcuccgcucugauuucuguugcuaauauaguaauuucuuuuacauucauuaucucauuugcuccucaccacuguccugagaggcuaauuuucaccccguuuuacagaagaggaaacugaaauccaagaauguuuuagacuuuagagaggagagaggccugggcucuaguuccgacugugccauuaauucaccacgggcgcuucagucggcuccuuuacuuguuugggccucacuuuccucaucuauaaaaugaaguggauggacuaccauuguuaucucugagguccuuuccagcuguaauauuuuuguuaagugaacuucuaaauauuuucugugucuuuaggggagcuagagcaagaaccaagggcugugccuggaagaagugggcacaggggcauggauaccuaacuuuuccccacccuaggauuggccgaugccggccccuuugugcacuuggguccuuucuggacccacuggguagccaggaugaauugcgucugaaguuccugaggcuuucaagauaacaacuggugacucauguucacaggcaggggccaaucagggaagccuggaguuuguggaaauuaaaaucauuuacucguucgugcaacauuuaggaagacuuuuacuaugugccaagcucuaaacuagaacagaaagaaaaagauauguugucccaggacucagagugguugggaaaaacauguacuuaaauaauaagaagcguuaaauagagguuguagucuuguauaaaaugguaggaaagagugaagguguaagugacaucucuuuggaggaagacccaacagaagugaugauguuucuggguccuaaagaauuaauaaggucaggcacaguggcucacgcccguaauuccagcacucugggaggccaaagugggcggaucauuugagcucaggaguucgagaccagcuugggcaacauggccaaaccucaucucuacaaaaaauacggaaauuauggccggauguggugguucacgccuguaaucccagcauguugggaggccgagugggcggaucccuugaggccaggaguucgagaccagccuagccaacaugaugaaaccaccccaucgcuacuaaaaauacaaaaaaauuagccaggugugguggugcgcacccguaauuccagcuacucuggaggcugaggcaggagaaucgcuugaacccgggagauggagguugcagugaacugagaucacaccacugcauuccagccugggugacagagugagugagacugugucucagacaaaaaaauaaauaagccgugcaucauggcacaugccuguagucccagcuacuugugguggcugaggccagaggaucgcuugagccagcgagguagacgcagcagugagccgagaucaugccagugcacuccagcuugggcgacagagcgagacccugucucaaaaaaacuggaaaaaaaaaaaaaaaaaagaauuaauaggcguuugcugagugaagaagaggggauagcuauucaaagaacaacucacauauaaggacccuaugugaaggugugaagguacgugccugauuacuagaggaauaacaaaauguuuaguaauguuaaagcagucacucagucagaacaaaccaccuauaacuaugucagguacuauucuaggugccaggauggaagcgagaauaaaaaggucccuuuucucaaggagcaaugaggggaaguuguggaaaaugaagagagaugacagauaaguugggacauauugugauagaucucuuaugccuugcuaaagauuuaggacauuuucucauaggacagugguuuuuguuuuuauugugguaauaaauacauaacagaauuuagcauuuuaaucauuuuuaaguguacaguucuguggcauuaaguacauucacauuguugugcaacuaucaccaccaucuucagaacuuuuuaaucuuucucaacggaaauucuuuuuuuuuuuuuuuuuuuagagacagggucuugcucugucacccaggcugugggguacgaucauagcucacugcagccuugaacuccuaggcucauguaguccucccaccucagccucuugaauagcugggacuacaggcaugugccacuacacucagcucaagugaaauucuguacccaccaaaugccaacuccucauucccuccuccucccauccccuggcaaccaccauucuacuuucugucuaugaauuugacugcucuaggaaccucgucuaaguggaaucauacaauauuugucuuucuguaacugguguauuucacuuaguguaacgcuucaagguucauccauguugccacaguuggauacuuccagcugugccauuaauucaccacaggaucucuaguuggccccuuuacuuguuuggauccuuuccagcuguaauaucguucauaaaguaaaccucuaaauguucccuguguuuuuaggggagauagagcaaggaccaagggcugugccuggaagaggugggcacagagguauggauauuguagcaugugucaaaauuuugcuccuuuuuaaggcugagugauauccauuguaugucuacacugcauucuguuuauuuauucaucuguugauggacaccuggguugcuuccaccuuuuggguauuguggauaaugcugcucugaacaugaguauacaaauauccacuugagucccugcuuucacuguuuuuggucacagaaguuuuuaaacaaauauuuuaucagccaggauuuuguuaaguucuuuuguuaguagcaucacaaaaugauauuguuaagauuccacccuauccccagacugaaaaacaacucaguauugcauaugugguuaagccuugucaaaccugcagauuuaccccuggguguguaggagggguguggggaguaggggggagguuacucccuuccaccaagaaucauggcuauugauaucuugggcuggauaaugagacuccauuuuacuuuuguuuuuuuaagaaauaauuacauucauuguggaaauaugaaaaauaaagaagucaaauauaauauuaccacccagauaaucauaauuuacuuuuuuuuuugagacaaguuucacucuuguugcccaaacuggagugcaauggcgcaaucucggcgcacugcaaccuuugccugcuggguucaagcgauucuccuaucucagucuccugaguagcugggauuauaggcgcccgccaccaagcccggcuaauuuuuuuuuuaauuuuuaguagagacaggguuucaccauguuaaccaggcuggucucaaacuccagaccuuaggugauccgccugcaucggcuucccaaagggcugagauuacaggcgugagccgccucgcccagcccauaauuuauauuuuuauacauaaacuucuauauuauuucaugcauacacucacaguuauuuuucuuuuacaaaaauauacuaauauacuuaauaauuuauauauacauuuauuucuagaauaaauauacuauuaaaacaaaguauagauaaguaucgaauaaucauuggguaagggaagaugcucugagugcaacuucuaaggcaguaaccacaaagaaagaaaauauauaguuggcuuuauaaaaacuaaacaccuguguuggguaccuguaaucccagcuacuggggaaacugaggcaggaagcucacuugaggccagaaguuugaggcuguagugugcuauaaucaugccugugaauagccacugcacuccagccuagggaacauagccagacacucuuaaaaaacaaaaacacuuguuugggaaaacccacuuuaaacaaaguuaagggccaggcgugguggcucacaccuguauucucaacacuuugagaggccaaggcaggaggaucacuugagcucaggaguuugagaucagucuggguaacauaguaagaccccaucucuacaaagaaauuuaaaaauuagcugggcaugguggugugcaaccauggucccagcuacucgggagucugagguggaggaucacuugagcccaggaggcagagguugcagugagccgagaucacaccacugcacuccagccuuggcaacagagcaagacacucuaaaaaaaagccucaguuggccgggcgugguggcucaugccuguaaucccagcccuuugggaggcugagaugggcagaucacgagcucaggagauugaaaccauccuagccaaaauggugaagcccugugucuacuaaaaauacaaaaauuagcugggugugguagcauucaccuguagucccagcuacucaggaggcugaggcaggagaauugcuuaaacccgggaggcagagguugcagugagccgagaucacaccacugcacuccagccuggcgacagagcgagacucugucaaaaaaaaaaacccucacuuuuccucaucuaugaaauacagguaaugaaaacacauaggauuauugugagaauuaaauuugauaagacaugugaaaugccuggauuuaguaagcgcugcauccugccuggacucaaggcuggaugccaaggggagaagauggucaggcaagacccccucagcuccucccaggcaguaccuuggaucccgcuccugacaggagagcccuuucuaaugccugugagccauccaaaugauuaagggugguauuaccuagggcucugcuagaggcccugcaaauuuaggggugaguuuaugcagaauacagauuaggaauggcucaagggaacuguaucccagagaagugaauuggacaggaaaaaggcaccuuggggcucuuauucaucaagcauacauaggguacuugucuacuggauguuagugcucuguuacuaguuuuacugaggagucugccuguaucuacuucccuaccuauaaaaagaaaggggaaauuacauagccacucuuaagcaaaugcuccagggguagaggaauugggcuaggagacucccuuaguuucuucuucuucuuuuuuuuuagacagagucucacucuguugcccaggcuggagugcaguggcacaaucucagcucacugaaaccuccgccucccggguucaagcaauucuccugccucagacuccugaguagcugggacuacaggcaccuaccaccaugcccagcuaacuuuuuuguauuuuuaguagagaugggguuucaccauguuggccaggcuggucuugaacuccuggccucccuuaguuucuucuguucuuucaacggauagugcaucaguguuuauucauccuuucaaucaguauuuaguugagcuccuaguauaugccaggagccacacuuggucuuuaggaaaccauagcauggggauaaaaccccuccuaucuaguagaagagauaggcaguaaucaaagagucacauaaaaagauguaaaaucauaaccaaauuaagugccaugaagaaaauacauggggacuuaacauuguguuacugugugauaggaauggccuggagauaugcagaagaaggcagggcacuggcauggcuagagggagugcuuggucaggaaacccaauucaauguccugaacacauagagagauaaauacgaugucauucaugggaagacaaaugcuuuuaaaaguaucaugguauguaguaaaugcuccacuauggauacgaguaaaacauuagggaggcacacaugaggaugugauuaauccuaccaaaguggcuggaggugauaguggaggaagacuucccaguggaagugacauuugagcuggauuuugaagggcaaagaagaguuccacagauaggaaaaaauauggagcuguugcugguagaggaaacagcagggcaaagauguucaaggaaagcuucagaaagggagagagucucaggacacguuuuaaaguaaugguggguggugguuggcaaggaguuuggggagguccuggcuggguuccucaguacucccaaggcuggcacuguuucccagguaggccccuugaucugcaagggacagggcaaggggagacuuugagguaaggcauucucuguuuugugcauagggagaaggaagguucacuauuuauucccagacggcaaggaaauggcugaagaauaugacgagaagacgagugaacuacuugguaagugacagaggcucccagugggccuuuaguaauacuuggggcugacauaagcacaaugaacacuccuagccuuaggcuugagguaggagcccagaucaaauguagaggcugggagagacggaagcccucgagacaacaacguuccugagcauaaucugggcaccaaaaguggaaugcgaguccuuuugaccaguaaaauucauccccaccccucaccccagacaaaugagagagggaguaauucuaagauguagagaaacaguugggaaaaaacuuuacagaggaggugguauuggaagugagccuuguagguuuaggagggauaagggcagacuuucacaauuuguuuuuccuuguuuuuuuguuuguuuguuuuguuuucuaaagccacaccaggagcaagcgaguaucagaggcagagcuucugagcuugccucaaaggcaacacuauaaaauaugguccuuauuuugaagaacaucucagucaaagagggucaaaacagugauuuugcagcguggucacuuucauuccugcagcgccuuuccucuaagaacaggcucauggguaggggcuccagcucagauuucugggaauuauuugauuuguccacucuguucccaggugugcacaucagcauuaaccagcuucccagagcuagguggcuggcucuuugacccagggcccaaggcugucagcagugggaguuggucucuuuauuaaguuccaucugaaaugcuaagaccaaugauggaaucacaggcugguuuauuuucuugucauuauucuuggcuuuaauuucuuccugggccugaucgacagguaguauuggugagggaauuucuuuuuccuuuuuucugacagcucauaaaugucuagaaccgacaacauggauuacacgggcuugcauucccucagucuccagucuuaaaauguuuguccugcgcauguucagucgcacagugaaguguugaucccuccuuauuaugagcugcuugggcuccagucccaguugguuuagucuggugcuauuaaaaaucuugauguguuuagcauaugacacugauucgguggaaaccaauacaguaguaauauccucacaaugcauuguaauuuauagugcucccaggggaugacagccuuggaaugccuaacaggggagaacuuaugaaagcagaggucacguggacuagccaccaccauaaccaggccagagaauagccgcagcuccucacucccagccccccgugccacuucucuacuccuccacacagagcaaauaaaacagcuauagcugcugcggcuguaaaaacaaacaaauaaaacccaggccucuuuguugugcuuggauaugaaacugaaauuaaaaacaaguccagguuucuucauuuguagcaccaugugcccugauaucccuuauuaaccugucacuucuccuaguggcagguggggaauagaccauggcuuccaaacuccucuuucuuaaaagcagaaauggagaagacuguucacaggagaacacuguuuggcuaaaguugaccuaauaaugauauuaauagcgugacucuuacugggcaccaugcuaagugcucuacgugaauuaccucauuuacucguccucguuaaagcccuaugagguagauacucuugucuccauuuuacauuuggaaaaaauggaagcucaaagagguuaagcaccuuguugagaauuauguagcuaguuucuaagccaggauuuaagccuaguucuguccaauuaagagcccaugcuuuaguccucaacaacauagugcugggaguugagaacacuuaaauccaacuuucuuuucuucuuacuguuuuucuuuccccagaaaggccugaguguggacugaugggcagacaggaggaccucacuugagccacugggcccagcucuagaacagcagaucuuuuucuuacucuucuuccuauccaccacugcugcccuggcaaaauacucuccauuauuaauuuuuaaguauaaauaaucccagggguugagcuggcuuuugcuugugcauucuaugaaguaaaguagggacaugguuuuuguggcaauaaauaggaauaguuuccauuuuucuagcuaaguauacaaauuugauaauuagccaaaccaguuuucuguuagaaaaauucaaaguaauuuacagaggaagaauugccaauaggugugcgucagucugggacagaguuccucccgucgguguuaauaagcauguuaguguccuguuuuuuuccuacccucucagugcuauucauucccaccccccacaaugauugcugcauguauucauagaggaaaaaacugaaggccccacaacaaugaucggaacaucaaaccagccugagaagaacacagcauguccaagggggcugaggcugaagggcaggccaucccccagcgauuacauucggauuaccgacuuaaucugcuuugguauuugaccgccagccuaaccaccccaggcugcauuuggaggauauugagcacuuucauccccaagcacuucacuggcuuuauaaaugacccacucgauucccuucggccuccucugggaugggacauggcagcuguuuaauugccacauagcaauguugcaguguuuuaaggcagaaaagaagaauccugcauccaguugaagcugcagggaacauuuagggaaggggaauguaauuauccacauuggaagugggccaggguuuggagcuuuggggaaagaggccuuuaggacuucuacuuuccagcccaccugaaagauggggccuccuuucagcagucugggacaucagccugcuuccugcugauuuaggaaaaagcccccaggcgccaccuccuuuauauauuccccaucagacucuucaccgggguggaaagucucuuuuccaaggucuggcuggggcucagcugggaagauaugacagcgucccgggaagcugccucacaccaguuuggguuuaacauauaaucaaaucagagugacagcagauggaaacagucuucuguugccgcaggagccguccuugaguucagaaacaaagacgggggcaagaaagacaagacaaagugugcauuuguacauguguguucacacccaugcacuugugcauaggaaaaauaagaaggacuuccccaaaaucuuuuauugggucuuaucucuagagggaaugggaaaggagacuuucuucuacauucuaacaaagaauuuaauucucaagguguuuaaacaaaaaauaaaggugaagcagccagaggugucaaguucccugagugguuuuuaaggucagaaguaaggaaaucagcagcugacuuucuuccuucuuugaguacuucuugggaaguuuucuguguaaaacucaaaauuuuuuggaguaaaagugcacagaaaacccuggggugguugucgucccuccaggccaccuuggugcauuauuaugcauuaggacacccauuuuagcaaggcccaugacuuacaggggcaccucacuuauccagcccuaggucgugagguaguccucauaauuuacuuuuucagauaaucaaagcuuacccuuuaaaggccaaauauaaaaaauaaauugagcuacuuaaaaaaaaacagaaaccuuucaaaauauuacaugugcuuauugaacacuuucagaauaaaguuuuauuaauaauucaaauucuggauuuggaguuaggagaccuggaguuuagccguggcauuuguaagauugucuccuugagccucaguaauucuucauagucuguuuccuagagaguaguggcaaggguugaaagagagcagucagggaaaaaaugcuauuucucauuuuaaaaauacagacauuggguagaugcuuucuuuuuuuuuuuuuuuuuuuuuuuuuuuuuugagacggaguuucacucuuguugcccaggcuggagugcaauggcacaaucucagcucaccacagccuccaccucccagguucaagcgauucuccugccucagccuccccaguagcugggacuacaggcgugugccaccacacccagcuaauguuuuauuuuuaguagagacgggguuucuccauguuggccaggcuggucucgaacucccucaggugauccgcccgccuuggccucccaaagugcugggauuacaggcaugagccaccacgcccggccuggaguagaugcuuucuaaaggaacuuccaccuuuaaaaucugugaugguuguguucuauuauaaaguggcaccauuggagucuaagggugcuuguuugcccuuacacuaaauggucccaaguguuuaugugguucugacacugccguccagugugaguuguccccgauaccauugucaauaugccugagaaaaaaaguaauuuccugccuuauucuacacacagcauuuuauaccuagucugagcgagaaucugagagugaucuuuccuauaguauagaguaggguacauggaucuuuucacaauaagcugcugcucggaggcauuugucacuucugaguuugcaacugugucagaggcccccagaaggcugcuuccagugaagugagguauuaacacugaauagauuuggauauacuccuggucacaguccguucacuuaagagagaaguauuugugggggaaaaaaguugccuauaaagcauauuuccaaguuuuacucuuccuuauuaauuuucauuauaaacuuggaaauguguuucuagggagaauuuuuggcccuaagagguaauaaaaucacacugcagaaugcagcagaccuuauaaaagcacauauuuaagggaaaauucuaauuuuacagcacacuuuuguguucagcuugugugccuuacuuauaccggugagggcguuuggauuugacacagcugcucaaaaggucuaaaguaaaaccgccggcugccuagugcugagaaccugacuguagcucucaacuccuaccuggaaaaagacacaaacagaaacaacuguaacugaguacugugcacuuuuugaguuguuuagcuccuuaaacagcuacagaggcugcuggucuuuagcaccagcugggcuccucaggcuggaggauaccauagugggcagccccggauuccaaaugcagcaggaagggaaaggaacugggggauaggaggucauggcucagaaaagaucccccugcagugauggaccgcaugguuccugaaaaugaaaaucucagcagggguuuucagguaguccauucaacuaguuucuugauuuauaauuuucauaauauaugugccuuaaaaucuuaugcaagcaucuggguuaugaaacaagguaaaauagagaugguuauuugcauucuagaaggauucccuuuuacaaaaaauucacauuagaucuuuuauaaaccgugcauuuaaaauauggcaugugccuacgauuuuguuuaaaugcagcuuuggagcguuuuuuuguuuuugcuuuuuucuuuuuuuuuaagcaagguauaccugaaaagagugaauuucuauauuuggacuuucugaaucaugauacagaccugccgaacagcuuucacccucuuaauuauuuuuuccucugcauguuuuugagggaaaaagugugcuucaacuccuuuuugggauccaaauuuucuccauuaccagaaacaacccuuuuccuaaucuucacaucuucuccuugcuugaagccacaccugaggguuucuugacuccacuuggcucuucucagagcuucauuccaguuccuuuugccugagcacccaugagaugcgcuuugaggguugucuaauguugaaaugcucuacugaaauuucagaaguugugaggucccuccuuagauuaacaaagcugagaguaaaggcccaacacucccacuuucaucuugugcuaguuaccuaguguggugccggugauucagcagaaaagagcagagacccucucuucacucucauccugaugcuugcuucucaucccgaugcuugcuucucuccccagugagaaaguggcgugugaaaagugcccugggagccaugggccaguggcagcuugaaguaggagacccagcgccccuaggagcagggaaccuggggccugaacucaucaaggaaagcaaugccaauguacguccaucuguccaggugucuugcacggacugaggugggggugggcugugggcugcuggcucuugagggcagggaccaugucuuguucaccuccucgccuccagugugccaccuggacacagcacucuauaaauguuuguuugaaugaauacagacauuuuggcuugaucgucccagggcgggggcucagggccuggagugcuguagcaauagcagcgucagaggggagcaguggagaagagcugagggucuuguugugccccgggguagcgcucugaugaggguggagccuucccuuccccaggaacaguccucgaguuggauuugccuucugcagccuaucuucaugcgcaaggacaccaagaugaguuuccaguggcggauucgaaaccuccccuauccuaaggaugucuauagugucucuguggaccagaaggagcgcugcaucauugucagaacaaccaacaagaagugaguagcguggaaggcacccugugugcuuguguaugagcgggguguagggugggguuugaucuggcguuaggaucauuauucaggccgguccugcagagaggaagcccuucugcuuacagguauuggaagggcuuccucucugcaggaccggccugaauaauguaaucagcuccaucggggaagagaaacuugaaugaguaucuaguauaguaccuggcauagauaggggcucaguaaauauuuguugaaugaaugagaugaugagggaaaucacaggaccauuaacuuguggucucaggugguucugcugaaagguuauuaugaccuuggucuccugacuggagccaggccuugguaaggguggccuggugacaucacugucagagcuggcagggagccauagcuuggaaggcaccccugucugaagugggagugacaguccuuuaaagcaguacuugacagcaguuuaaagcagacugggcagcaguaaaccuaaucccuccccagacugacaguggggcagaugcuugggccgcuuggaagucucuugcauaaugcuucaaaagggguacucaacuucccuuugugguccccuagaggggaggcaaacugcagggguugaaaggacagaagguggccacagugcauuuccauuuuggaaaugcauugaucucauuuagguuucuggagcccugacugaucacaggagaacaaugcccugugugaggccugaagggaaugacccugaaaugaaucaaucuugaccugggcuagagagaauacagucuagggacaacucccacaaaauagauuugggcauugagaugggagguuuuauaaguuaccugucugcaagcugugaagccauucaacaugccucauggggaugcccccacccaucucuugcuuuacaugcaguaauggggacacagcuccuugugcaucuccucaggugauguggugccagucuccccuuccaucucccucaggcucacgaggcccacagggaagcaggguagcucccagacucccccaucgcagcccugggugcugccauccucuugugacccccauaucccauugcuuuggcaggguuaagaggacaggggaaaggguggagauggaugaauuaauuucaggauuauugcuguacaugcagccagcagccccugcagugggccuugucuauaaauauaaagucauaauaauaaggguuuguguuuauaaagcacuuugaagcccucagauaagaggcaguuuauucccguuauuguucucaucauuaacaggagucacugccuaaaguggaauuuagcaauuucagacaacagagaaauugccuguaggagaacaaacuccaugcuucagcaagcauuccuugguggaagaggccuuggguccaaacugggaacaaaagugcuucugauagcacuugaaucugcagcccagcacuuugugaagcuggcugcugccucuuuuuugucccccagaggucacugucgaauacagauaucagacagaaaugugauuaccagggagugaggaaagaggcuagcuagcucaccaaaaaauucaucugccagcauauccucugggucccaucuccugcgcacauccagccauagguggcgcuguuggccaggagcuccauggcuggaggcccaggcuagcucucaaggcaagcagggguuguuggacauuuuugaaaugaugggugaggccaggugggaugggagugaugccccuggaggggcagggcugaggguuggauucccauagaggacagaggaguguuucagggcccacuuuggaacccacacugagccucugguccagugucccagccuggcucaucccugcccuccucaggucucucuguugggagguaaccuagaggccgcugaacccuuagccagaucguucccgaaccuaguggcauuuuuaccuucuaccuggaagaauguauuuuauaccuuuacucccauuaauuauauagaacucaauggguauuccuuuauuauuauuauuaauuuggaagggagagauuuauuucucaucagggguuacagccugcauagacauucuuuuuuauuuuuauuuuuauuuauuuauuuuuuuuuuaagagauggagucuuggcugggcgcgguggcucacgccuguaaucccagcacucugggaagccaaggcagguggaucaucugaggucaggaguuugagaccagccuggccaacauggcgaaacccugucucucuaaaaauacaaaaauuagccaggcgugguggugcaugccuguagucccagcuacucgggaggcugaggaaggagaaucgcuugaacccaggagguagagguugcagugagccaagaucaugccauugcacuccagccugggugacagagugagacuccaucucaaaaaaaaaaaaagagauggagucuugcccuauugcccaggcuagaguccacuucuugcaaucauagcucacuguagcuuugaacuccugggcucaagggauccucccgccucauccuccugagaagcugggacuauaggcgcauaccacccaaucuggccaaguuuaaacaauuuuuuauagcguugagggucucuccauuuugcccaagcugcucucaaaauccugggcucaagugauccuccugccuuggccuccugaagugcugagauuacaagcaugagccaccacacccagaccaggguggccauucuggcagguggggaaguguggccucuggccagaagccaaaaacucaauggcuacucccuuccacaguguuuagcuuuuuaaggauauaguacauuuaaaaucuguuuucugaucaucauucugucaggagguggacaggauccauacuuuuauucuuguguuauagaugauuauauaaauguauauauaaagucagcaugaugaaccagcuugcugaaaguuagugacugucucuccugauacucagacaucugcacuucagaaaugcacaucauggcauuucucucugauuugaccucuuccuucaccuggagguuccauaaccugccccaguucuaauauucuggaaugugguuacuaaccaaagccagaguuucuuuacccauacuugccuugucucugaagagcuggguuggugacuuuacuugaaggaauugauugcaguguaucauguccuuggccucacauauuagugagggaugaaucagggaaggaaaaaagugcuuuuccaggaucccaguguuggaccaucuauuccugauaacguuugugcagaaagagggcuccuagccucagccuggaaguuggccgcuguagguggaaugagccagggugcaggagugagaaguuguuggguuaaaucuggccucugccacuguuagcuguagaauuuaggcaagguuuccucaucuaucagagaagacucacagcuacuucacagauuuuggggaauuugaugaaaucauauauguacaggccagcacaacggcuggccugaagcagguccucaacaguucuuuggaaauuggaaucugaggagagcuuggcugauuugacaucggugauaguaacacugugggagguguuaauaggcuucacuagaaaaaaggauucugugguuaaauaaauuuaagaaacucuggauuaaacaggcuucucuuugguggggccgagagccuuuaguaugugugugugauugugacugucuagcagggggcgacugugggugggggugccaaguuugcccagagccuugauguuuaagaagauuugcuugcugcuuuucuaaaggcggacugguuggaggcuucucuggaccccucuggccaugcggugugcaggugugcauggcacccccucugagguaugugaggcaugacccaagugauuguccacagcagcccugcuccugccuucagccuccagagucucucucccucugagggccuggccucuggugcccuuuuggguugaaaggcuggauuggggaggggauacaguagagaguggugggaggcaauagaucauuacugaaauagucaaaauggaggagucgucugucaaacagggagaagacagguacagaguuggccuguucugggcccuuugacauugacuucaaguucaucuagugcagcucuuuuauucgaagaaggaauguggaaacugaggcccagaaauuaagugaccuguccggggucacaaggcagggccaggaguucugcuacaagccuuuacuuccacauacaucuuuugaagacuuuugacauucagaaaggaaggccacugauguguuggagagaguacccaggggacccgcagaguguucggaccccaggggagacaaccuguucauuguugaacauccccaccucccaccucaauaucugccccaucauuggacaaaugcaaauaaucuagacuauggcgggcuauuacuuuguggugagaauguggagacauggaggugucaggagauuuggggaauucucacuuuaauacgggcuucucuguuuaccagcuuugugaguugggcaagauaucuaacuuuucugggccucaguuuccuuuuguuuaaaaguggauaauagaaguaaccaaccugagagaguuguuuugacaauuaaauguguuuagaaccuggcacagaauaagcucuuaaaaugucaucuuucauuguauggcugaaauagaacauugaagggaggugggaaugggggagagcggggcaucugcaggaagccagggaacuauccugcuguaaggguucaucuuuuagcagaaacaaaacaaggucugaucagcagggauauggccuuguuccuuuuuuugagauugagucuggcucuguugcccaggcuggagugcaguggcacgaucuuggcucacugcaaccuccgcccccuggguucaagugacucuccugccucagccucccaaguagcuaggacuacaggugcugcuaccacgccuggcuaaguuuugugcuuuuaguagagacaggguuucaccauguuggccaggcuggucuugaacuccuggccucaagugaucugccuaccucggccucccaaaaugcugggauuacagaagugagccacugcaucuggaggccuuguuucuucuucauccuuuucuuuuaauuuuuuguagagacagggucucgcuauguugcccaggcuggucuugaacuccuggccucaagugauccucccaccucagccucccaaagugcugggauuacaggcaugagucaccaggcccgcccucuucuucauccuuaaauccccagcucacagcucaaggucugggacacaguugaugcccaauaaauguuugcugccuaccuacagcugccugaggcugaacguuaugacccuuccagaagcacagugggucucucucuuguccaggugcuggugagaaagucaaguacaguaccuaucauggaaaaacccuaugucugggggaaugggugugagaagggggugggcuuccccaggaggagaaaaggcagaugcucccuacucccuugagccuaucgggagcuucuaagaaguugguuaaccucgaccaauaaacuaaaucuauuacaagagacucaaaaccaagcugagccuccaccugcucugccuccauuccucuugccuggugguaggaguaguucaaggaaagcaggugcaagcuaugcaccuaaaguucccucugauccuguccuugcuguuguggccaagcccugggauucauuuuccggucccacugccccagccugggggaaugguucugcugggcugcuucccuccugguucugcuuuuuguguauauuugcagggaagauguuaacacuuccuaacaagucuuuguguucaucuaaucucugcuguuuaaccuuugacucuccccuauuaucagugucugccaccuuugcuggccagaccaaaggccccaggaagagcccucagccugagcuggcuaggaagaggaugaggcaggcauuccauccccgguuugcaggcagauggaucgccuuucccuggggcagagcuuuggaaaauaaagcaacuugcaaugccauuaggaucccccagcccccacuccuuuugaacugucagccuuuaaguaaacauucuuuuccugccaugggucccaguaccuugguggggaguggggaaccugggaggagaggggccccgagagccucuguugaacggagggauuugggcagggaggacgggggcagaagugcugcauugaugucaacucucugaguccccagggcauaggggcuuuugaaguggacucaggguagcugucaccacaaggaccaggccccucugaaguacuaaaagccccauccuccccaggccucucacuugaguuuguuuguaccugccugagguguuucccuucacagcccauacaaccucugcagcagaaagugaugccuugcccaagugacaggucuagcagccccuggccagagccuaagccacauuuccaccaaggaaaaugccaaauugguguacuguuagagaugaggaggccauucauugugcuuugguguaguaaggaucagaccaaggacaaggaaucuuacucuaaucuugacucccaucccuaccgacaacuggccgugaaacaaggcaagauauuucaucucucugagcccgaguucccuuuuagguaaggggggucaaauuuccugcaaagucuaguuauacacauuacagacuggguguugccaucuguucuauuuuuuuuuuuaauuaaaaggcaucauuaaucgcugaaccggcaccugcagaugauaaggaccaugugugauauguaaaaauggaggaguagggacuuggggccagccaaguaguccagagguccagcuuccgugaugaguaacaugguucguccucucaaagagauuucuccuaguagauauacuuuucccucuggccuacaaggccaggcuaacaaggccuugaaaggccccaaaagaggaagagguaguugaggccuucaguggaccucccauguaaaugguaacaguagggccccagcuuugggagacagaucugaauguccuuacucuguccuuuguuagaacacgucccauuuuucuggugucuccaugaggcuuuggggguagaggagucccaagcugcuugagcuauuuguguguuccaggcuucuucugccugucuuugggagacccagcucugagaugugagucacuacaaccccuggucuaaucacagaauuauaacuagguucugcucuucugccacuggacuggacauaaggcuugcauucuaugcuuuccagggccacugagcucugaaauacugguguucuaacugguuucccuucucccucucugcguguguggaagguguggaagaacuagguagaagcuaggcagcagagggccugacgccuggcuguugggucaccuugccgagugccccaauggccucucgguguccccacagguacuacaagaaguucuccauuccugaucuagauagacaccagcuaccucuggaugacgccuugcugagcuuugcccacgccaacugcacccugaucaucucuguaagauucacccagacuucuuggacacugcaucagggagagucuuccucuuucccugcccacuucccaucccauaagaguccucaguucuagccccaagcccuaggguaugcuugugggagaauaggcaucucuaauucagcaugggggagagcagggagggggcucaggaaggagccugaccauauaauucacagcuagaagaggguagagggugaaagggaagcgguggaaauugcugaacuuggguucuucugguccaaggucugcuccuacucaggcacaugaccuugagcaaaucauucaauccuacaggccucaauuuucucgugcaaauaaggggaucagaaggagaaggggccccaaguguguguggaaggagaugggacagugacugaauuauuuucuuauuccuggcugcauccacaguaccagaagccaaaggagguugugguggccgagucugagcuacagaaggaacuaaagaaggugaagacagcccacagcaacgauggggacugcaagacccaguaguuggccccugagccuuauaccuccaccacagggggugccgugagacuucaaggcuuggcccuucuugaccacggcagccuccugucuucuaggagcuaucaagggucucuaagaacugggcauggggcacuccuagccagugagucauggucauauuuccugaguaaagucauucugaguuacuuacugcacagggacugcccucuuguuccccucuguaugcugccuggccccagaccccacuggccucccucgggagggugugaugacauuccuuucucuaucccggagaccuacaacauaaagcuuuccacaaaaagggagaauagggugggagcacauggcccuagcagggcagggcuggccuuucccugcaaccuguuuacacaaacucagaggaagaccaggcuggagggacccugugcuaccguagcuugcagaaguggcucagaggaaacuccugaagaugugugggcaagggaaaaguuuuaaaaaugcagaaaccggccaggcgcaguggcucacgucuuaaucccagcacuuugggaggacgagacgggcggcucaccugaggucaauaguucaagaccagccuggccaacauggugaaacccugucucuacuaaaaacacaaaaauuagccggccaugguggcgcaugccuguaauuccagcuacucgggaggcugaggcaggagaaucgcuucaaccugggaggcggagguugcagugagccaagaucaugccacugcacucuagcuugggcaacagagcaagacuccgucucaaaacaaaacaaaacaaaaaaacaaaaacaaaaaacaaaacagaaaccuuggaaguagaacacaggauguuaaggcauuguggguaaaaagccagaaucagggucauaauuuugccaaggguguguguugggguaggggucaccacaggcaacaacugagcuuccagcagccuguacccuuuccacaguccccucuccaaacccacaggugacccuccauaccccaaaggguaagggauaggucaucaaugggaacucuuccugaaaaaaagaaaccuuuguucuuugggacacagagccaugaggcuggucuugucguuucagcagcacauacaacccugagcuugggucugcuguucccuucuccuggagccugcuaggacuacucagccagugaggaaccagaucugugaacaaucaagcuuuauuuuuacaaaaaugaaaauuguagcaugucucaacagccagccugagguagggcuggcucagaacucacucagaacugcuggguucccuuugcucuuucuugguuucaaagcaaaaccaggccacagugccccaggaaugaacccccagccccgagagguuggucaagggugaggucuggcuggugccaggaggcuauuggcagccucaccuuuccuuccaggaaggggcagaaaggaaccaucugggaaggugggagcaccucaccucacucuguaggcugucauggcucuaauaagggguauaggaugggccucuccaggccagauccuugcucuggccaaacagggacgcaaggcccggguucagccgcacucuaaagcagcagguccugccucuccaacagguuccugggagggacugcaucucugguaagcuccaaagucccaggagucagaagccucuagugcaaggugccugagcacuggggucacaggcccaggagcacaguggggcagugaggaggagcuaucacugcacccuccaggcaagagaagucccugaguagcugguuucccuggcccagaggcagggguggcccugacggucauggguuuugaaaauccaggacguggagguuguaagacagggcagcauagagaugcuugguggugagacgcaggcaguacacagggcugcugaggggagucgacgucagcgggaaggccuggaagggagggcacaggaagugguaagagcuuuccaagugggacaugggugugcccuaacccaggauccccaggcccaggggaagagggacgugugccauuguaggcuucuuccaacccuuucuaggcacguccuuggcuaccucacccucucccaaaugcagcccauaaucaugaguccuggcaugcuggagaagaggugggcaggacacuuacgugcaggcaggcccuuugacgccggucccacagccguacaacaccguaguaggaggaaccuguggccagcaggugguugccaucugucugcaggcaguacagggugcugucguggggcuccucccacuccaugacacauuuccuguccaggaagaggagaagcagagggagguuuaggguacccuccaccucuaccccagcuuucuugggccuagaguggcugaggggagcguuaaggagccauuccgggauggaagagaaagaagccuaaaucaucagauucaucaaaaaccgaacuucaugggagaaagcaucuucuguagagggcucucgccauggcccagacgacacagcagauuaugccugcacuucuguuuucacauggccagcuacuugucacuggacucaagaaagguugaaguaacacaggccucaagaaaggcugggagagaauauugagugacaguacccugacggcuccagaggcucugggaaacgccugccuuugccaaggccuguuggcuauagccaagccacugggaccagggcugcccaaauguaggaagucuagugaccuugcaggccucuuccuucccagcccugacauggagucucugugcccucucccaugggccaacccaggacuggaggaaggaccaggauuggugcagggcccccaccaccuguccucccugcccagcacacucaccggacgcuggugcggaggucccaguagcgaacauaggugucauagccacaggacagcagugugaaaggggacucauacaugacauccagcaccccagccccugggggaaagu

SEQ ID NO: 18854 - RNA, 6033 nt, Homo sapiens
ccucccgcccgcuccggcucccgagcagccagcggccaccggcuccggcagcggcgcacagcgauucggugcggcgcggcgagcacgacguuccacgggacccgcggagccgcgucgugaucgccgccggccucccgcacccgcacccucuccgcucgcgcccugcucagcgcguccucccgcggcggcccgcgggacggcgugacccgccgggcucucggugccccggggccgcgcgccaugggcagcccccgcuccgcgcugagcugccugugaguaccgcgccgcccugccccgccacccgccccccgcgccccucgccucacccgcgccucucucucccgcccgcuuuugucucccacaggcuguugcacuugcugguccucugccuccaagcccaggugaggaggggugcgcggaggcgggggccgggcgcgccggugugagacccgggugggcagcgccggucgggggcaccgggacugacucugcggccggcgcgggagggcugagggcaccuuagaaacccagccccgagccaccccgaggagggagcugaggcacagagagguagcaccccuccugaggucacacagcgagugaguggccaggauagaaacgaaggucucggagcccagcacugucccccaugcauccucgccggcugggggcauagggaacacccagccgccgaggaagggggcagccgcggccaggggauggauguucgaugccaggggaagccgggugacugcagcagagacccucucagcgccccucgggggaggcuuguggccgauuuggcccaaugaucgggugcccagguucccugcacucucaacauuugcuccguaaauuugucuuuauaaaugucaggggucggggagggcugccucccuacuuaaaagcgcccugcuccucuaggaaggcccgggcaggggcccugcgcugggcagggagcucgcuucccuguuccgggcuggccgggagccccagggugucucccaacagguggguccagcuucucccuggggcucguucauccugggcugggucugcccgacuugcgugggugggggaugguggccugggcuggcauguugggggaacccccagcaccugcuggcggcuuggggcagugagggggacgcagggugauggggccacucgggccccugggcggaguagcauuauaaugguguauuguguauuuuucaauuuccuaaagguaacuguucaguccucaccuaauuuuacacagcaugugagggagcagagccuggugacggaucagcucagccgccgccucauccggaccuaccaacucuacagccgcaccagcgggaagcacgugcagguccuggccaacaagcgcaucaacgccauggcagaggacggcgaccccuucgguaaggcgcgcugaagguagcuugugggaugcgcggcgccuggaccaccagucccaacugcacuggccgggggccugcaggguccccagcucagaagggaaggaguuaaggcagaaaggugucuugagggucagcuggggaagagagggcuagggaaggggccucggggaguacuuggccacaggugcccccuucccugcccagcaaaugaaugaaucuaggaaucucccuuuacaccuccccccuucauacacuccuccccagcugcagguggaggcaggggguucagggggagggggccuagguuuaaggcaagcgcuugaaagaggauaugucgccagggcccacaaaaggagagugggaaagagaagggagagaaauccccucaacucucccaguuggaaaaggagguugcugggaacccuuaaauacuuuaaucggaugggucaauuuacacguggaaacugggcuuggaagggggcucucccugcuccauucccuggggaacccaggcggcuggggcagggcucccggcucccugugggguggcaagugcggagagcuacugccggcagagaggcugaggacugauugauuucuaaaacauucaauauuccugccuugaaacggggccaauuuccagaguccuggauguaccaagagaaaagcaagcccucugggcggcugguguuguuuuuagagagcgauuauugugaguuuaaaaaccuuuaaauaaugaccacguuaaacaagcaugaaaggagaggggaagacucuauuaaaauguaauaaaaaggugaggcauuuuaagagcuaagaagaaaaaugaagaaugauauaaaacagaaaaagaacgagcuuuuuuucagauguggaguuugaaaggaguugcaagucuguaaauguuaaaaaagagguucaagauuguucucucugaaucucuggagagaccccugcgucuggcagagcgauuaaaacucuucuuacuuucaccuuuuuuaacauuuccugaauacuuucuccucuucuugagccaguuugggggaucgaguaugucucgcugcauuuuuucugcaucgacguagcugacuucccuucaaagcuggaggagacauaauuuuccugggauaaaucugucacugggguggaagaauagguuugaaaauguuaagcuuuccaaaagcccggucgggagagcugccguaaacugcggccccagcuccccagaucggagcagauucaaccgacaugggagagagcgggcuuucuggggugggggugggggcggccugccugguggccgagcuccccuacugggcuggcagagcaggccuaccaucccuuugucccuccaaauuagcugcuugcugcccuucucagcuucuaaggagaggagacgaaugccuggcucuuccaggguuugcucugucagagcaaauggcccagcauccuuggauuucggggagggaagcagaagucaagcuggugugggggaauucaucuucagacaucagaggaagccugauguccacuucucuccguggccauauaagagguuucccgccuucccuagucccugccccacagcaggauaggagcuggaggcccuaagaacagaggcucaggguguucagccaggacaggaguaguccggggagaauagcagagaggucucaauggcuucuuuaccggccccaggaagaugcagaggcaccuacuucaucccugccugccgcaucuggccagaauccccagaguggcauccucucacuccuccagucagcauccuuccuggcccuuaaaaauagcugccucuugcuguggaaggcagagcgggagagggaugagcagacuggcuagguccaggaggaggugggcaggcagggaggugacagcugcauuucccugcugacuuggggccaaaccgggggcuuggccacuggucccagcacugagccugugugaagcggggaacauuacaagcugagcagugaugacugacuugcugaccucgaugccccaaaccccugccauggguuucagggacagaggaggugccauaugucaaugcaggcuaaguccaagaacugcuuucucagggaggggagaggcugggcucugcggcagggacggcaggagagccagcgccuucugucccuuccuaaacagugaagucacccucacuacuuucuugaggacagccuauaagagaugauugcacagagaggugaacaggacaggcuucuguggcaaguuggcugucuaaggggaggggaaugggaaaggaggcauagaauucagcccugccuccuggccuccagucuaagaggccagcaggcaggauucucccuccuccucacccacagaagcuauuuggucacugggcugagaagcccagcugugaugaggcugaaagagaaaagacaauugaguuguugauuucuagacacugggcuggggacccuggugacugggaagccacagggaagaggcaggauccuccuggcaggugucugagguucugggaaagcagccugcuuugggcuguguguuuagggagagcuguccccaucccuagcaccuucucagcagagcagagccuggugauguugaggggcuggggguggccaaagcugugaguuagaacccaaaguggcagaaacaggagacaaugcuuucaucuuuggccuugggacuggaggucaccccuucacccaaguguuuguaaugaccugugagacacgcacacauaauauuuggaguuggaaggauccucggagaucuuuugauuagcuauggaacucugauucaauuaaauuuuacuuagauccucaaucuaagagacaucacugucugguuuaaaaagaggguggaaggaauggcacuucagccuuuucaauuugauagucccaagaccucucuugagaacccaguuugaaaaccauaaucccguccacugcccucuguaaacccagggguggggcccgagguccagaaaagcccuuucucuggguugcacagcauguuaguagcugggcuggagcuggaguccauguuuuggguuccuggucuuuggagcaguugcugcugggcugugacaagugugugggccagcuggggucagggaucugccaauagccauccugcuaccuucucugacagcaaagcucaucguggagacggacaccuuuggaagcagaguucgaguccgaggagccgagacgggccucuacaucugcaugaacaagaaggggaagcugaucgccaaggugaggccccagcaggcaggugggguccgcgggaccuagggaguggcuugggcuggcuggacuccuccaagacaguccugggcucugaucccaacaagguaggcagaaggccacagggccaucuugggguuaccucacgauugggugcaggagugagggagaaggaagcuguuugagagaugaaaacuauaaaaggcgaaggaggaagaaugaaggcuagggaaggggcugggggguggugguugguaaauuccauauaucuuuuuaacaaaucgccaaauugcuuugcuauuauguccaauuacaugguaccagcauuuggaauguucaguaagccgcaggcccagccccucggccgagcucugaaauggcuccauuagucacggcuccucuccagccucgagcuccccacuuccugggcuucuggggcuggggucuuagcaucuucucccaggccuccccucccccauaggguggcugcccuggggccagggaaccgaaguccugggggggugagaggggcagguggggagacggguggccagacuggugggcaggaggccagagcaggccaggcucugggccccucucucugucuuucugcguuggggcccagccccuccguagacaaccaugugucacugcugccugggaggacaggaaguugccgggugggcugcgaguugugagggauuagagagcgggugcccaggcaggggguggggcugcggcuccugcccaccucgccaucugcuggggugcccaccugcugucuggggccgcucgcccucugccucugcugggggggcucuguaacguggugucuggcuccccuaccugcagagcaacggcaaaggcaaggacugcgucuucacggagauugugcuggagaacaacuacacagcgcugcagaaugccaaguacgagggcugguacauggccuucacccgcaagggccggccccgcaagggcuccaagacgcggcagcaccagcgugagguccacuucaugaagcggcugccccggggccaccacaccaccgagcagagccugcgcuucgaguuccucaacuacccgcccuucacgcgcagccugcgcggcagccagaggacuugggcccccgagccccgauaggugcugccuggcccuccccacaaugccagaccgcagagaggcucauccuguagggcacccaaaacucaagcaagaugagcugugcgcugcucugcaggcuggggaggugcugggggagcccuggguuccgguuguugauauuguuugcuguuggguuuuugcuguuuuuuuuuuuuuuuuuuuuuuuaaaacaaaagagaggcucuauuuuuguauuccac

SEQ ID NO: 18855 - RNA, 4100 nt, Homo sapiens
ggauagcuggcugcgccgccgcgcacaugccuagguucgacgcccuccucccuuugcccaggaguuccuucugucccggcucuguuccgucucgccccgagguucacgccauccucggagccccagccuuucacccagcgccuccaagcuuuggaccuugacuucugcaaaacuagauggucacagccaugaaugucucacaugaaguaaaucagcuguuccagcccuauaacuucgagcuguccaaggacaugaggcccuuuuucgaggaguauuggugagacuuugggagagggaaaggccaugccagggccccggggccggggcgcgaggggguggcauugaaugcccacaaugauuuucuuacagagcagaguuaugggacucccuuguacuggcuucacacuaccuuuguccgaggugcagguaguauguggcaccucaaagagauuagagcugaaagcaagcaagcagaaauaagaggaugagggagaacguggaaauauacagaagucaaagagagcguguagugagaagggucuuggaggcgugagguugaucugaagccuuacuagaugacuuccccguccuuuguggcugugugugcgcgcgugugugcacagugcagggcccgggggacagccugcccuuuacaauuaucccaucguuccccaggugcuccaccguuccugcuguggagaaggaggcgaagucagagagcucuuccaagcuuuccccaggaagagcucucuggcuuugccuuaaagcuccccagagguuuuggaggcugacuuuaugcuccaaccaauuugccauaccccagccagggagaagcuauugccacauucuucuuacgccacagcccugguaugcuucuaggagccccaaccagggagaagcuauugccacacuucuuacaccacagcccugggcugcuucuaggcgcgggccagacagccgucacccaccucuaaccccacugagagagcaauaaucacagaaaccuuggacauagcuccugcccugugcuagauacuuuguauacguuaauacccccaggagagauguaguauucgcgcucuacaaaugaggaagccaaggcucagagaauuaaguugguuuuuccaaugucacauagcuaguaaguggcagaacugggacuccaacccagagcacucaccuggagagaugagugggcauuucucuaaucagcacccacccaugagcccaucccucugccuucugcuugccagggcaaccucauuccccauagcccugaucuaccugguucucaucgcuguggggcagaacuacaugaaggaacgcaagggcuucaaccugcaagggccucucauccucugguccuucugccuugcaaucuucagguaagaccccaucccacucccugccucuucucuagaucuuagaccaccauucuaucccuugaagcuuucccgauugcaucaaccuccauccuguccccaaguugccuuguaacacucuccccaucucauucucggcuuuaguuccccucccagccuucacccucuucuguuauauuauccuguuuuccuucucuuuuagaccccuaccugguggucucugcuuugucccucuugccuucguagagucuguacucgcaacuaauuucuccagccucuaauagugucaccuccuaacacccucucucaagacccuccaauaacuuccccauauuuucucccccaaacuccuucagucuuccccuaucccucuacacaucuccucccaggcuccuaaccccucccaagaaccccauuccuuaacucaacuuucagucccaucccccugcauucccugaucuuucuccagcccucgucuccucuagacuacugauuggaucuaccagauuggcuucaggaucucaggagcuuugacccacccccuguggacagguggggaggugguagagcuuggaacacaguaaccuggccaagccgggggaaggguggauuauuggugccuggggaugacacuuacaccaucuuccuuugucccauuucaguauccugggggcagugaggauguggggcauuauggggacugugcuacuuaccgggggccuaaagcaaaccgugugcuucaucaacuucaucgauaauuccacagucaaauucugguccugggucuuucuucucagcaaggucauagaacucggugaguggcaaagcuuugucuuucuggugccuugugaacugcauccuuccucagggcccucccuucacccaucccauggagggucucuuuccuacccuugggucccaauaauaccucucacccaagccccucuacagauucucugccacaaagacccccuucccuccccugagaauuucucccgugucccuacauccagugcagaggguggucccagcacugggugguaugccaacuaugacucuccaucucccaggagacacagccuucaucauccugcguaagcggccacucaucuuuauucacugguaccaccacagcacagugcucguguacacaagcuuuggauacaagaacaaagugccugcaggaggcugguucgucaccaugaacuuugguguucaugccaucauguacaccuacuacacucugaaggcugccaacgugaagccccccaagaugcugcccaugcucaucaccagccugcagaucuugcagauguuuguaggagccaucgucagcauccucacguacaucuggaggcaggaucagggaugccacaccacgauggaacacuuauucugguccuucaucuuguauaugaccuauuucauccucuuugcccacuucuucugccagaccuacaucaggcccaaggucaaagccaagaccaagagccagugaagguuuggagagaacaaugaagcuccaggcucucucuucuccagggcaccaagaggcugggcuuaguuuugggagaaugauuagguugccuuaccugcaugguuuccccagaggaugugugccccaagguggcuggaauuuuugacagacaagaagggugaccuugggauggggguguggucuguuacuuuaauguuucuguuuuuaaugugaaggccaagcaggcccugggaugggaguggggcggaggaggguccuaagagcugauuauuuaauuucuauccagaaaucuuucuucuucuugcucuguuuuuuuaaauuaaagauuucaacaaaauuuugagaguugggggauuuggggggaaagagggcugcugugauggcaggaggcugcuaccaaggggaugaucugcaggugggacgccugaggguguguggaagggugagaggcacacacacagacacugaaagaauccuaggccugguaggcacuuaacaaaugucuguuacagaccagaauuuuauugcuguuagagacccaagccccucauaggaacagugagaaacaggugcagaaaggcggaguaacuuuaucuaaagucauaggcucccugaauagcagagcugacaccuacaaggaagcguuggagaccagaucuaccagcuagccucccugagaccacgagguggcgccgcagcaccggcuguggccgaugccagccagguagccgguuucccacgucccccgcacgcacgcaccucuuugcugcaggaaucccgggcugccccgaccuggaguaggggggguggugagugggacugagucccuagaagccuggacccucacuucguuccuguacauccagcucgccuguagacagugggggaggaugaagggaagaggacucaagcgcaacuuugaaucaucacgccuucgacaguccgcgcacguuuauuucauuuaucuuugaaaacgagggaggggaagccuggagaaggcgggaugggccaagggugaguuggcccccggggagcuggucccuguuccuggcuuuagucccaggggcgcggucuguguguagggccuaguccaccccucagggcugggaggggaaggcccucuccugagccggugccccccagcugcccaaacaccccuuucagacccuggggcgggagcaagccagucaaaaugaccccaguccgcggaggcugugaau

SEQ ID NO: 18856 - RNA, 4616 nt, Homo sapiens
auaggaccaggucauguucacauagcacaaaagggcaagaggcaacuugucugggaccagguaugugguagagagccaggccuuaucccccaacauggaggccaaagaagagauauauuuaggggauggaauaccuuugggugucucuuaauacaugccucuaggcugggcuucugcauccuguuuaauguuuuuccugucuaauuuuuucucuuccuaucuugaauccuuuccccacccaaauggcaauuacuggguuauugccagauguacaucaaaaagcuuauggagaucaucacuguggagaaccccaagaugccuuaugagaugaaggagauggcacuggaggccauugugcagcucuggcgcauccccagcuuugucacagagcucuacaucaacuaugauugugacuacuacuguuccaaccucuuugaggaacucacaaagcugcuguccaaggugcugagcacuauaacuggcuucuaggaaaaaacgcauuauaaaggaaaucucccuggugguagugaggauguuacauacagagaggggaacacuugagagcugggaaauagaagaaaggcauuuucuuuucuuuucuuuuuuuuuuuuuuuuuuuuuuuugagauggagucucacucuguugcccaggcuggagugcaguggcgcgaucucggcucacugcaagcuccaccucccggguucacaccauucuccugccucagccucccgaguagcugggacuacaggugcccaccaccacgcccggcuaauuuuuuguauuuuuagcagagacgggguuucaccauguuagccaggauggucucgaucuccugaccuugugauccacccgccucggccucccaaagugcugggauuacaggcaugagccaccacgcccggccagaaagacguuuucuaagggcaauguacaaguuagaagaaguuuuggaaauuuuagaaaaugaucaaaguguaaaguguucuccuaacuacaaguccaauugaucuguuuacuuuccagaaugccuucccugugucuggucaacucuauacaacacaccuacuaucucuugaugcccuauugacagugauugacagcaccgaggcccacugccaggcuaaaguccucaacagccucacccagcaagagaagaaggagacagccagaccaagcugugagauaguagauggcacccgagaagcuagcaauagugagaggcauuucuuucuuugaugaacccaguguucuaugcuuaucccuucucuacucucugagucguuuuuccuguccccauaucacuuccccugggaugcucccaauucuguuucugggcuuuggcaguuuaaaucacaggccagucaggcagauuaguagaacucauagccuucucccuuuuuccuccuccccacuuugguuuuuuacagaauuauuauuucuuuauggcaagagaagagaacagagauuaaagaauauaggauuucugucucugaaagcuccaggucccaccaucccucauccccaauaucugccuccacucuaauuaguccucucuagcucccccuugaaauuugagguugcagaagaucagggaaagugacuggguaaucucuucauuaaauuagagaaucuaaugcuuggcugggacagggacuacuuauuuuggcuuggguuuguccugcucagggcuggcgcccugugcaggaaccaugcaggucuucugggcuugggauuugaucuauccugcagcucugcuuggcuucauacccuauaagucuucacguaucuucuucucucuuaccagcugagagaacugccagcgaugggaaagcuguaggcauggccucagacaucccaggccugcaucugccagguggagggcggcugccaccagaacaugggaaaucaggaugcagugaucuggaggaagcuguugacucuggggguggguacuggguguccaugacccuaagcuccucaccuggagggccuggugaagagcagagggagggagcagacaccuaggauaguaacuaagcaagccuugguagcccgccucgccuucagacucagagagagggaagcaaacauauggacccucaguugauaggacuuccagggaaguggaagacuggugaggacaagauuucugaggcuccuucuugaaacuggggaguauauuggugaccuuccaaaaguccuuaucuggguaaaaaaagguguuacagauauuuccccccucuucuuccuacuccuagcugacaaaaaguuugcccggaagccaccccgauuuuccugucuccugccagauccacgggaacuaauugaaauuaaaaacaaaaagaagguacauacauguauuccccagccucuguccaccucugucuggguguccaguguuguaggguuuccaucucagaagaugaaggagagucuagcaccucauuguacagcuuccugaggccagucuuugggcuuguugggacuucagcaacucccauuugaagcccuucccuuacuccuaagcuauguaguugagcauacccuauguaugccccugcgcaaaugcuguaccaguugagagccaagugucacuaguggcagugacaggagccuugggaguuggugucuugugggucauugaagguuacugucaucuccagcucuugcaagaugauuggcaauaaagggaaauugauauucauucuggugcuuuaguaagguucaaauaguaagguucaaauaacuguuuguacuuuggauuucuuuuuuuuuuuuuuuuuuuuuuuuucagacggagucucucucuguugccuaggcuggagugcaguggcaugaucucagcucacugcaaccuccaccuaccggguucaagcaauucuucugccucaggcucccaaguagcugggacuacaggcgugugccaccaugccuggcuaauuuuuuguauuuuuaguagagacgggguuucaccguguuagccaggguggucuugaucuccugaccucgugaucugcccaccuuggccucccaaagugcugggauuacagucgugagccaccaugucuggccuguacuuuggguuucuuaacacaaagaaaaccuaacccuuucuggccgggcgcaguggcucacgccuguaaucccagcacuuugggagaucgaggugggcagaucaccugaggucaggaguuugagaccagccuggcuaacacgaugaaaccccgucucuacuaaaaauacaaaaauuagcugggcaugguggugcaugccuguaaucccagcuacucgggagacugaggcaggagaaucaguugaaccugggaggcagagguugcagugagcugagaucacgccacugcacuccagccugggcaacagagugaaacuccaucucggaaaaagaaaaaaaaaaccuaacccuuucuuucucuuauugccagcuuaaaugacuuugguucaugugugcccuugaguaccuggccgugacuggacauacagaaauaugaguugccuccacaguuaguccacuuugucuuucaaacccagggcauuaagcuaggcaaccaaagaagcuaagcuaggcuaaaaacaagaggcuggcuaucaacaaaugucagggauggauauaaaacuggagagaagaauuaccuaguuucuuucuucuacuuuucccccaauccuaaguuagagaagaggaacuguuuuauguaucuugagcacucaggaaaggaguaaaaaagagcucguaagccaauucaauuagacaugaagaugggggaagcuaaggccauuaugaucuagccuuaguucuguaaucacuaagaaccacauccuaggagcuuuuuagcugaccaacugugggugggcuaugguggacuccaggcuggccuugucuaauuuagaggcaaaguagcuucuauaccucuaguuuuucucaugcagcugcuaaucacuggcacagagcaguucaaucagaaaccaaagaaggggauucaguuucugcaagagaaaggccuccucaccaucccaauggacaacacagagguugcucaguggcuccgagagaacccucggcuggacaagaagaugauuggagaguuugugagugaccgcaaaaacauugaccuguuggagagcuuugugaggugaggaagcuguaagaaaugugggauauagccagguaugguggcucaugccuguaauccugacacuuugggaggcugaggcaggcagaucacucgagcucaggaguucaagaccagccugggcaacauggugaaacccugucucuacaaaaaauacaaaaauuagcugggcaugguggcaugugccuguagucccagcuguucaggaggcugaggcaggaagaucacuugagucugggaguucgaggcugcagugagcugugaucaugccacugugauagagugagauagagugagauagagugagaucaugccacugugauagagcugugauagagugagaccuuggcucaaaaaaaaaaaaggugggacaugguuagugaucaguuuaaagggacagaacaucccuaccucaaagcggucucuauaaauuucuucuggagacccuagccaauguucuuccucua

SEQ ID NO: 18857 - RNA, 8818 nt, Homo sapiens
uccuuccucuuccgcuaacuucccggcagcgcgccgcucagggugggggccccgagggcuggggccgucggcuucccccuggggaucccccgcuucagagaaagccaagcguuaggcgcagccaaagccgagaggcagcggaagcucccggcccgggguggcgcugggucagcggguaccuucucggcgguccccuggccggccgaacucgcgccugguguccugucaccccgcuccccgcccugagugagccuguccccucucaggggcgcgcccgagucgcuccggguuggcugcgccaguccagaguuaaacuuucagccaaugaaaaagggcgcgaggcgugacgcacggaaacgucaugggaauuccccccuccggggggccgagaaggggcuuucccggcccugagcccugcuggcaggcgaggugucgcgaccggucccaggugggucgggcgcggagagaagccgcaaccagagccgccgccacggugaguggcuggauucagaccccuggguggccgggacaagagaaaagagggaggagggccuuuagcggacagcgccuggggcuggagagcagcagcugcacacagccggaaagggcgcgcaggcgacgacacucggauccacgucgacaccguuguacaaagauacgcggacccguacguacaccuguaccugugcuggcgcacacacggcagcguccgugcagucgcacucgcacacacaugcacacggagacgugcccaccggugcacuggugccugcacccacacccuucacgcacaaacucaagauacgcucacccguguccguacaucaagacaggcgcugacacacacccacacugagaagcucgggauucaccuaucuacacacaugcucgcuugcacacucauguugacgccauggacacacaacaugcaaccaagcacuacagccgaaacacacuuguggagcugugauggagacacacucuuguauuaggugggggggggggggggggagcgugcagagaucucccugucgccugcgcgcccagaaccggugcggugugggaccagcugcuguugugagguuugggagagagagaaaagagcccacuccgaggaggagacacuuuucccgcagccccagaaucgcguucucggggcagaaccccggggccucccacaggaaagagcccccgccuacaggcuguucgaaggggaggccguccgacagcaggaauguccccccaaaagcccccgggguuuaucagccguggccucccuccuggcagaaaaucccaagguugcuccagaccgggggaggggagcgggaggcggacuuggccccagacugccagccuccucccggccgugaaagacccuccuguucccugcccuggagggaggagggggcuuaacccccaccggggcuucccggauucuccuagaccucugcccgcugaaaagcagcgggagcccguagacugucgagggccucccgccccucccgucgcgagggcggggccaguggcgucauuuccaggcccgcccccuccggccccgccuccccuugguauuuucgggacuuuccuaagcugcucuaacuuuccugccccuuccccggccaagcccaacuccggaucucgcucuccaccggaucucacccgccacacccggacaggcggcuggaggaggucggacccucccccaaaucugggcccccaucucccgcccacccccauuuagaucugacccccucccccacgccacuccucccaacuuuaggcgggcgucuaaaauucugggaagcagaaccuggccggagccacuagacagagccgggccuagcccagagacauggagaguugcuacaacccagugagucaugccgccugccccugacccggccggcugccccucgugucuguccaccugucugcccgagcccccucugcugccuuacaccuguaugcucgcagaugcucucagccugccagucuguccaucugucugcaacucugccuccaaaaggagcuuucucuugggucugaggaggaggggggagugaccacugaagacuuggagaugggagguggggcuguggggggugcugagagucggaugccacccccagucugucuccaaaccagggucuggaugguauuauugaauaugaugauuucaaauugaacuccuccauuguggaacccaaggagccagccccagaaacaggucagcaaguucacuaaccuccccuaguccuaaagcgggggagggagagcaugugcccucucucugggggaggggcugggagaucguggcucagcaaggucucucuguccccagcugauggccccuaccuggugaucguggaacagccuaagcaggugagugagcaaaagggaggguguggaauggcuucagcuuuggggacaaaugggguagugguagcuggcuggccauggaggagccauugccgaaggaggccacaggggauuggauggucacugcugcugaucagagugcuguaguuugguucagggcuacuaccaggcacugcggucacugcuggccuggguggucuucccugaucacaaugcuacuaugcccuuggaccuucagagaggcuuccgauuucgauauggcugugaaggccccucccauggaggacugcccggugccuccagugagaagggccgaaagaccuaucccacugucaaggugagccaggauggugcuggagggugggcuaaguggacagcaugcccaaggcccugacugacagucccugccucuccuagaucuguaacuacgagggaccagccaagaucgagguggaccugguaacacacagugacccaccucgugcucaugcccacagucuggugggcaagcaaugcucggagcuggggaucugcgccguuucuguggggcccaaggacaugacugcccaguaggugcccucuacgccuggcccccacugguaugcccgucugccagucccaggccccagcccaccuccaugagcuuagcaucugaccaaggggaaagauguagguuggccccaaacccaagggccuaaguagaaacuccaauggcuuccuugaggaaguaaggcugagcugagcccuggcaaugggaaaggugccucaggaagaaagaacugcauggccaaaggccuccgauucucucuucucagauuuaacaaccuggguguccugcaugugacuaagaagaacaugauggggacuaugauacaaaaacuucagaggcagcggcuccgcucuaggccccagggccuuacggguaugggugcagggggugggucggguaugggugcagggggugggugggucaugggaggugcucauggaaggagcagggagggagaagcccaggggucacacauguaccuacugcccagaggccgagcagcgggagcuggagcaagaggccaaagaacugaagaaggugauggaucugaguauagugcggcugcgcuucucugccuuccuuagagccagugauggcuccuucucccugccccugaagccagucaucucccagcccauccaugacagcagugaguauccugauugccuggggugccaggccugguggcagagguggcaugaggggugaccucaagcugugcagucaaacagacccagguuucagaaccuggcccugccacauaugagcugagugauccugagcaagucauuucccccccgaagcuucugucuuuaguaaauguguauauuggguguuuccugcagcuccagggguugcugagauaaggaauacaaagcccccagcuucuuaaauguggccuuggcuauugcaucaucucaacuaauccauaucccacuccauagaaucuccgggggcaucaaaccugaagauuucucgaauggacaagacagcaggcucugugcgggguggagaugaaguuuaucugcuuugugacaaggugcagaaaggugagacuggagcccacuuugggcaccaaggacaucgaguauaagacuggggccagggaagcucuaggguaaauggccccagagauuccaccgggagcuguggccaagcuuccguuuuccuuguagaugacauugagguucgguucuaugaggaugaugagaauggauggcaggccuuuggggacuucucucccacagaugugcauaaacagguacccagggcuagggcccgggcccgggcugggggcuaaauuaggcuaaggacucacugacacccugugucucccugcaccccccaguaugccauuguguuccggacaccccccuaucacaagaugaagauugagcggccuguaacaguguuucugcaacugaaacgcaagcgaggaggggacgugucugauuccaaacaguucaccuauuacccucugguggaagguggagcugggcugaggaccucagggugcuggcggggggccaggcugggcuagaagaaggucccaagagcuagauguggggaugcaugagccaagucagaagugcgagggucccaggaggugcuuccuaggagccggcccugagggcucuucugggaagggccccugaggcaugacacaauaacugggcucaaucucauuuuccucugcccccagacaaggaagaggugcagcggaagcggaggaaggccuugcccaccuucucccagcccuucggggguggcucccacauggguggaggcucugggggugcagccgggggcuacggaggagcuggaggaggugaggggguacugauggagggagggguaaagguaagagaagcuguggaggaaaaaaaucugggggaggccgggcgugguggcucacgccuguaauccagcccuuugggaggccaaggcaggcagauuaccugagaucaggaguucaagaccagcuuggccaacagcgugaaaccucgucucuacuaaaaauacaaacauuagcugggcaugguggcaggcgccuguaaucccagcuacucgggaggcugaggcaggagaaucgcuugaacccugggagacaagagguugcaguaagcugagaucacaccacugcacuccaggcugggcaauaagagcgaaacuccgucucaaaaaaaaaaaaaaaaaaucugggagagucauggcuggugcccgcuucccacagcccugccuguauccacagguggcagccucgguuucuuccccuccucccuggccuacagccccuaccaguccggcgcgggccccaugggcugcuacccgggaggcgggggcggggcgcagauggccgccacggugcccagcagggacuccggggaggaagccgcggagccaagcgcccccuccaggaccccccagugcgagccgcaggccccggagaugcugcagcgagguauggacuccggggcacgggcggucggggcgccggggcugaggaccuagcccugacccacgcccucuguggcccguagcucgagaguacaacgcgcgccuguucggccuggcgcagcgcagcgcccgagcccuacucgacuacggcgucaccgcggacgcgcgcgcgcugcuggcgggacagcgccaccugcugacggcgcaggacgagaacggagacacguaggcaacagagggccuggcggacgaggcgcggggugggggcaggaaagggaccggcacggaggcgggcucugcaguuuucggacacgccaggcuucaaguccggccucgguguucacaagcucuguucaagcugcuuggucucuccaaacuucaguuuggucgaccgugcaagggguacagucauagcacuuaccuaccucaaaaggugcugcgaaacguuaagugcaggcacagcgaugcccugggccacgugcuggguuccaugggccccagcgagggagacuaugagggcgguggggccuugaaagcgaaggaugcucugaguggcugggccagacucucgcuccccaacccccagaccacugcaccuagccaucauccacgggcagaccagugucauugagcagauagucuaugucauccaccacgcccaggaccucggcguugucaaccucaccaaccaccugcaccaggugcgggggcgccuacuggggaggugggagggguuggaaggcaagugggucucgggccuggcucacccugcuuucauccccagacgccccugcaccuggcggugaucacggggcagacgaguguggugagcuuucugcugcggguaggugcagacccagcucugcuggaucggcauggagacucagccaugcaucuggcgcugcgggcaggcgcuggugcuccugagcugcugcgugcacugcuucagaguggagcuccugcugugccccagcuguugcauaugccugacuuugagggugagcuccccaucucaccugacuaagggggcaggcggggaccagggaggguaucuggccagugcccagaauggacuaugaggugucgagauugaauggucagggcugguccaggggcugccuuaagggucacagcugcagguugagcauccugcauccuuaggacuguauccaguacaccuggcaguccgagcccgaagcccugagugccuggaucugcugguggacaguggggcugaaguggaggccacagagcggcaggggggacgaacagccuugcaucuagccacagagauggaggagcugggguuggucacccaucuggucaccaaggugggacugaggauuguggaaggaguggggccaagggugguggaggggccaaagauggugaaggggggggcuggccaaggggaccaugcuguggugucaacucucgcugcucgcacccccagcuccgggccaacgugaacgcucgcaccuuugcgggaaacacaccccugcaccuggcagcuggacugggguacccgacccucacccgccuccuucugaaggcuggucagucucacccucaggggcacuugaacaggguggggggaagggagagaggugccucccagucccccgacuuugcaguccuuaauguaggcccccaccauaccgccccaugacggccucccucucccaggugcugacauccaugcugaaaacgaggagccccugugcccacugccuucacccccuaccucugauagcgacucggacucugaagggccugagaaggacacccgaagcagcuuccggggccacacgccucuugaccucacuugcagcaccaaggugaggccagcccgggacuagaagugcucugagugacgggguccagaguaucuggacuuaaagacacaggcuuaaggacgaggugggagguagucagaacugcggcugucuccccaggugaagaccuugcugcuaaaugcugcucagaacaccauggagccaccccugaccccgcccagcccagcaggugagaagcaucaggcauccccagcccgacuccucugacuccucacagaggucucuucuccuucaggaccucugaaggaggccucccuuucucuacccucagccccguccaucaccccucaugguccugucugucgcuuaccuugggagaaaggcaguguucagguguccauguccccacccaacucuggagguaaaugacaugucuguaugugugucccccuaagggccgggacugucacuuggugauacagcucugcagaaccuggagcagcugcuagacgggccagaagcccagggcagcugggcagagcuggcagagcgucuggggcugcgcagccugguagacacguaccgacagacaaccucacccaguggcagccuccugcgcagcuacgagguggguuggccugugcccugcccccuccccagccuccuuucccgaucugaguccaggugccuccuuggccccagggcucccgagcacaugcccuaaccaugacucagaccucauuccucugucuucucagcuggcuggcggggaccuggcaggucuacuggaggcccugucugacaugggccuagaggagggagugaggcugcugagggguccagaaacccgagacaagcugcccagcacagguaaaggggccucccuggaagguggaucuggaccuggagggccggaggccugaggcuuugacuaucccauuccuguccccauuuacccccagcagaggugaaggaagacagugcguacgggagccagucaguggagcaggaggcagagaagcugggcccacccccugagccaccaggagggcucugccacgggcacccccagccucaggugcacugaccugcugccugcccccagcccccuucccggacccccuguacagcguccccaccuauuucaaaucuuauuuaacaccccacacccaccccucaguugggacaaauaaaggauucucaugggaaggggaggaccccuccuucccaacuuauggcagccccugaugugacucuugucccuggaaccagcuacccacccugcccacaugccaggcauggugagaagagaaggaggaggcccagccagcaaguccagagcaguuuuaauggggguggaggcuguacaaagggcaaggcccacugaagcgggggaaagccaggccgugcugcccccggcccagguauggggccuuggcauggacgcccuuccuccaccuccagcaagagaaagaguaagcccuuggggaggaaggaggggaaaccagcucagccccaaauccuggucucuguccaagccaggccccaggacagagggggacugauggugucaggguggggguggucucagcagaaagcagaaacggcaucaggccucucccacacaaaaaaaaag

SEQ ID NO: 18858 - RNA, 17648 nt, Homo sapiens
gcgccugcgcagugcgacaaaucuggcgcuguccccuucagcaccacgcggaguccgcgccgccccuccccgcggugagccccgcgcgcccccgccucgcacguccucgcgcccccugacugcccgaacagaccccuucuuccuuccgaggucaccaucugcccgcccuggcccucccaaagagaguaguugccauaguaacuccagcggcucuuucuuaaaauagcagggcccccuucuacccuggccaagggcacaaggguugccggucccccacgucuuccggucccuaguucaucccgucuaaccucuuaccccugggcaggcgugacgacaccuaacucaggcagcaaggaaguucuuccugaagucugauuuaacaucccccugcugcauccugggaggguggucaggguuggaucuccuggguccgagacucaaaaccccuggcggguucaagacgguguucccuagaucuccuuuccauaguugauggucuccuggauuuagggggcggguccagucuacacccauaccgugugcuuggcgcggccgcgugcucgugggggcgggagcgcguguggcauguaacaggucauguggcagccuccuagggacacgcguggggucuggagcgggacacgcgugugcagccgggccuuacguguggcucaaggggcggugggcgagagagacguggacacaagugggguggggcacgugagggucuggggaauagaaccagggguuccaugcgcccuccuccuugucuggggcgggucuuagguuggcgggagagcccagcggggaccuagcgacaaggggggcuggcagccuccggggcucugggcccugggagagggcggggggugggggggauuagcguugccugagcggcgcguaggggguagggggagggacugagaggcgggcgggccuggagcaaacgggagccgcgcugccuucacagcucagcugggcccagccucuccucugucucuccucggucucagcucugggcgagcagcggugaguacugagguggcauugaguuggggcugcaccggguaugcgcugggaccccguugagcuuccggaaccugccuggcaggguugcuacuccugaccucugccccuccccugcauugccaccagaggccccuuuaccugguuauggucucuccugggcgggaucugucuuaccccuggggagagagggagaggagaggaauaugggugcagauuccccucaagagaccccaguaggugggggggaggggacggugugugucccugcuugaguguguacaucuguauguguacaucuguauguguaugugacugugagcaguaggucucugugagugucugauacaccuggaccucugugugcacuggagaaugacagcuuguguauauauuuggguaccucuuuguguguuccuguuugaugaugguguguguguaaaacaagcaugugccuuuucauuacacacauacuuguuaugacugugagagugcaugagggugugucuuugagcagugugugugugugugugucugugugugugccagaggguguugccuaugaauguguuuaacuguguacugacauauuuguccuuauguaugugugugcguguguguguguguguguguguguguguguuuguguguguguaggugccugucuguaccuguaugaagaaaagaaugucccuggccgggugcgguggcucacgccuguaaucccaacacuuugggaggccaaaguggguggauccccugaggucaggaguuugaaacuagccuggacaacauggugaaacuccaucucuacuaaaaauacaaaaauuagccaggcauagugcugagcgccuguaauccaagcuauucaggagucugaggcaggagaaucacuugaacuugggaggcggagguugcagugagcugagauagcgccauuccacuccagccugggcagcaggggcgaaacuccaucucaaaaaaaaaaaaaaaaaagaagaaugucccuuucccacucaguauguauauauuggggguaggagccucugcucaggcuuuucuccccacuuccaugcugugccucucagcccuucagcaucccuauauaacaccuguuccucuucccucuccuuccaggaggccugaguuucccuucccugagugaggggccuccauaagagagacuauaggggucacagggcuguaugauggugacagcuggcugacaccccuuuuccagagggugggguaccaacuuccccuauucuagaaguagcuccaaagugccauaagaacuccgggcucacucaacuuugaaguugcuuccucucuccucccagggugaugcucagggccucaggcagaaggaaaggagccaggggcccacuggguguauaagucuuuucucgucaggccucuauggaaguaguccccaggcgugggaucaaugaucccauauuaccagggugugcuaggucccugauacucagaggcccuagccaacuuucccuucccuaucucugcuguccuauccaucuaacuccuuggcaguucaccccaugcuccccuuccucucuuacaggccugucugaagagcaugcagcccccuuacuccccgccuggccucgccaucccugcccccccagccugacccccggccccagcauggcccagggugccaugcgcuucugcucggaaggcgacugugccaucuccccaccacgaugcccacgccgcuggcuccccgaaggcccggugccccagagccccccagccagcauguauggcagcacaggcuccuugcuacggcgaguggcagguccagguccucgaggccgggaacugggacgugugacagcacccuguacaccucugcguggcccccccucaccccguguugcucccucacccugggcacccucuucacccacugggcagcccccacccggggcccagagcucuguggucaucuuccgcuuuguggagaaggccagugugaggccacugaaugggcuaccugcuccagggggcuugagucggagcugggaucugggugggguuucuccucccaggcccaccccagcccuugggccuggcuccaaccggaaguuacggcuggaagcauccacaucagacccacuccccgccagaggaggcucggcccuaccuggcagccggaaccuuguacaugggccgccagccccaccccagguuggagcagauggccuuuacuccucucuccccaaugggcuggggggccccccugagcgccuggccacacucuucggaggaccugcugacacuggauuccugaaccagguaugcaacuuccccugggcucccugggcccccagugaaggggcaaggcucagccuccugucagacaugggcuugucugcuguucacucugaauccuuuaaucuguucuaaaucugccucucucuugcccucuguguuugucucugugucucugaaccuccaucucugucgaugcauguuuuaauuucuguuucugucccauauucuuguguccuuguaugucuggcuuuaucucugggugccugugucucccucguuggcucagggggauaccugguccuccccccgggaagucuccucucaugcccagagaaucgcuagagccaaaugggaauucuucuauggcuccuuggacccccccagcucagguaaggccugggacugaggcagggagaacagggcagggccuuccccacagcagcugaggcucaguagggagcccuccuucaaacuucccccaauccuuggaauuggcucuugagucagccaaugucuccccaggccucaaucuuuccaucugcgcuaugaugggaggcuggaggauaggacugggcagggcaccuggaggaagcugaguaauggagggaggggacagaaggauauugaggggcauuccauggaguagaaaagaggcucagcagggcucaguggccccaguauuuugggaggccaaggcaggaggacugcucaaagccaggaguccaagaccagccuggacaacaagcaagucucuaccaaaaauuuaauuagcuggauguaguggugugcaccuauaguccuagcuacuggggagguugggugggaggaucccuugaguccaggcagucaaggcugcagugaguuaugauugcaccacugcacuucagccucagugacacagugagacccugucucaaaauaaauaaauaaauaaauaaaaaagacagaaaaaggcuggucuucccccagcuccucaaagccauuugacaagaacuugauuuaaaaugagcuccacuggcaccaggaacaagcuaaguauguagcaggaggaaugguggcuagacagugaaagaacuuccugucaauaugaggcagugggcagagauccuagagcagaauuaggacagggagcugacguggauaaccuccugaccuggaugccuaugcacacuacaggugcuaagcccccagagcaggcccccccaucuccaccuggggugggcucaaggcagggcucugggguggcuguggggcgagcagccaaguacuccgagacagaccuggacacggugccccugaggugcuaccgcgagacugacaucgaugaggugcuggcugagcgggaggaggccgacucggccaucgaaagucagcccagcucugagggcccaccaggcacugccuacccaccugccccacggcccggcccacucccuggcccucaucccagccucggcaguggcaaugaggaugaggacgacgaugaggcagguggggaagaagauguggacgacgagguguuugaggccucugaaggggcccggugaguggggaagugggagggggaagugggagagggaagcggcuugcuccuucgcacuggcccacaggcagagccgggcucaaagggccugggauagagauggguguggggcuggcggggcaguguguauagcaggagauucuagacagaggccugaggcuuggcagaacacuggggauguggggagcaaagaggccagggguucuagcagaacagggggcagggugagaggccagaggccacagucaagcccaggaacacaggagcaugagucuggauccuggauccuggugggagaguggggaguguggggacauuccuuuccgucucacaccccagugucgcuuggagccucaucuucuccuaagauguugcuagaaauagaaaugggauggcagaagggaagcggaucacggaaaaggaggagaaagggagauuagcagggagggaggggauggggugcuggggacugguagggcuggugugccccagggggcacugaauagcuuggcgcccuacccuagaggcucuuuuuuguuagugggcuggagccagugaaaaggggaugauaauccccuuagcagagucagugugagaguucagugaaauccugccccagcccugugaucugggccccuaaucagagauucucccugccccugcaggccagggagccggaugccucucaagucaccugugcccuuucuaccugggacgagccccucggcugaugggccugacucuuucaguuguguguucgaagccauccuggagucacaccgggccaaaggcaccuccuauaccagccucgccucgcuggaggccuuggccucaccuggcccaacccagagccccuucuucaccuuugagcugccuccccaacccccugcaccccggcccgacccaccagcucccgccccacuugccccucuugaaccggauucugguaccagcucugcugcugaugguccuuggacacagagaggggaggaggaggaggcagaggccagagccaagcuggccccagggagggagcccccuagucccugccacucagaggacagccuugggcugggggcagcaccccuuggcagguaaguaauuccuuuugucccucagacuugaggcccccagggcuccagaaacagcugcuguaagggacagauccugagugugaggauugguuuauauuccugaccccugaguaggggugguuaagggaugcagauccuguuuuccuauuuggaggacuacugccauuagcugugagggagagucccucacagcaccccucuuggucucaaguccaguggcuugagaaagcaugauucagcauugaaggaucccaggagaauacccuucuugcucuccuggagggcccuuucuucccuuggcagagucuuuagccugcucagaauucuugugaccuuacccucacccagccugaaggcuucaccaaagaugcagccaccagccucucccacugccucccucccaugucaccccugccuaaucaggcaucucucguccagcuccaggaaguccuuucacagucuaaccuuucugcucuccccucugccagcuacccucucagucauggaagccauggcaacaggaggggguggccagggagaccggguugccuagcaaccaggaguuuccggccucugucucugggcugacagguggcuuugcgaguagagcagcuggggugggaaggggaggaaagaaagggaaugaggguaugcaccccgacccuuaacccccuaacuccagagccugcuucugugugggcagagggggagcaccaaggagagguuccucucccuaaaaagcaggagggggaaagccuucggaccaguaucccugcugcccucaaaucuuucccuggcccuccacaguuccuccgugguagcccaucuauuccagcuuuguccauagucuaagagacaaaggacuauguucuguguagggccagggugggaacagauaaucuaugucuaauagcaaauguaggccccugggagcuugaggaagcagccagaacucccacagcagcaagacggauguggguuagauuugaggcaggacuuccacagagaggugguaaugauggaguaggcugauggagagaaucuaaucuccuucccuggaaaaaagaagaaugcuuuccccaugucccuccacucccuccccuucuccaucuucugggccuggaggcagaaggagggucuggauggcuccuaaggacccugccccagccugagcugguguucuaccccggcagcgaaccaccccugagccagcugguguccgacucagacucagagcuggacagcacagagcggcuggcccugggaagcacagacaccuuguccaaugggcagaaagcggaccuggaggcugcgcagcgccuggccaagaggcuguaccgacuagauggcuucaggaaggccgauguggcccggcaccugggcaagaaguaaagccacuaggcugggacugaggaugggggcagagggaaugcauccugaaggcagcucuccaucuaauguccccuggucauuggguaauccccaccugacccccugcacuuccccuugagacccuaccugucucucugcccugcccacagcaaugacuucagcaaacugguggcuggggaguaccucaaguucuuugucuucacgggcaugacucuggaccaagcucucagguggguguugaccccuuggaggacagcccccacucuccgggguucguguuagggccccaggaugccuccuuugagccccucugucccccacaagccguccugacaucacccuucccaagauggcugggcauggccaagggccagagcugccugguaaagggaccuuggguaggggugauggguggagggucagggugcauacccucauccccuuucucuccuccccuucccaccccagcugcuguacucucaaagccuccugucaccccagagacagaggcuggaaacuccugguugcuaggcaacccucucuugccccuucuccaggguguuucugaaggagcuggccuuaaugggugagacccaggaacgagagcgcgugcuggcccacuucucccagcgauacuuccagugcaauccugaagcccuguccucagagggugaggaguuccgagagcagggguguccuuagcuggccacaguggcaaaaugggcugggcccuguguguguguacaggagcaugaguguguguacagcagggaauggauguacaugcguguaggcaugugaacuugcaugugugcagacagcgcugucauggcugcauguauguggaacuauacaugugggcaggcauauugcuaggguugaguguguugugaagaggcaggaguuugcaugccugugcaggccagugcuuggcuggagaggggauucuguuuggcugcacuggucuacaggacugugcugcgguucacuuucucgugguccaggcuuagaggcaagggaacguuggggcaacuaguacguuggggcaacuagcccucaguacuugagggagccagggacggguccuugcugacggaucugcuggaagaggagcucuuuguggggaggguuuacuagcgggguucaggagguaggaaguugccggccaaaggggguggggaugaaaugggagguuggggaagauggcugugggaagggucccugggaggcagccaaggcugaaagucagcucuccccuagacggcgcccacacgcugaccugugcgcucaugcugcucaacacggaucuccacggccaugugaguggaggcgggcgggcaggagccggaaaacaaaccccuggccagacaugcaggaccugggaggccaagggcccuccaaacucacaggccuccguucccuuccuuagaacaucgggaagcgcaugaccugcggggacuucaucgggaaccuggagggccucaaugauggcggcgacuucccuagggagcugcucaagguggggggcggggcaggguagaagucgcuggaggggaaggauggaggacccagucggcgacggaguccagagucggagggagggcagggcuggggcuugccgacccccggcuccugccacggaagcccgggcucucgugacucagccuggggaccgcccccuccccaggccccacgcgcaggcucucccggaacaugcgcacaugcgugcggucgcgacugcgcacggcgggggaggggacccggcucuggaaaacgcgagcaggcggccccggccccugcguuugccuucaguuccccuccuccagugugcgcugggguggaaggcgggaguugcgggggucccugcacgggacagggauuggauggggguacacuccacacugcucccccgccgcguggacagccaaaaagaccuucccggugcugcugcgcugcaggaacccggagggagaggggccugagagggacuaagcuuuuccaaggucuggcagcgaguuagcgcaaagcuggagcuagaaacugcuuucuggcucccugugagcaggucccguucccaggcgccagcuccauggcccgcaaccgagggcucagauacguaggggcuggugccgguaggagaagggaguggcucauccaguggguucacuccucucccugaucuggugguaguuuaucuagagaggccuggacucacuugaagaaacccccaggcuaggacaaaggugucucugcuccacuacauacauguaacagcacaggauuguccuagggcguuucugugagcuuggggugcugggcuucugaguuugggguauaucugagagggaacguccauggugagcugggguguugcuugaguugaguugcaucugugugcccgggcgucgugaaucaaggguuuguauggcuugguguguuugugcuuuagggcuuacgauucagaguguguguuugaguugggguguaggcuggauguuuauguguggugggguuuacaucuucgaauuggccgugucugagguaugccauaugccucugaguaggggguguaucuuugugagcuaaagauucuaaguuuugaaguguccaucugaauggguagugucugcgaguuggggugaccgugaacuggugcgucugguuuguugggguguaugucagaaucgagguguguuacgugacuucagaucuauauaugggugggguaucugcgggugagcuggaugaggccagggcuguuccuucccugccuccguccucccucgaggccccucuuggcucaguggaaaagggcugcagggaagcgguccgaccucuccccucccaccaccccaacccagaccagccagaagggaguuccagacccugccggguccgcccagcgucacagccccaggccuagcggugcucucagccucccuggagcugccacccacgcuggccuccccaggcuccuccccguggccgcgcggggagggcccccuucgcgaucgggcgccuccauuucaugcgguccccgcccccagcccucgcccucccuuucccgucggcgccccccucccgcucuagccaagccgcagagcagacagcgccgccgccgccgccgcgcacuccgugcguccgugagagccgggccggcucgggccgggccgcgccgcucgcgcuggcugucgggggagcgguccgcgggccguccgggcggcccgggggccgagggcggacgggggcauggccgggggccgcggcgcgccggccgggccagcaugaucggcgucaacagcauccacagcagcgccgggcggcugcgcucgcgcucgcugugcuccgugcgcuacgggcgcacccaccgcggcgcggagacccugugcuacggcuggccgcagcgcucgcgcagccucaagcccgugcucuacaccgaccugguggucagccgccugcagagccgcaagaagaaaaaggcggugagggcguuggggccgcggcccacgccagguugcggggcgaccgagggggcggcuugugggaggcaccgagggcggugccaaccgagggcggagccugguagggacagaggucaugggcagccagaggcgggcacgggcugggggggcagggagggcacagacccuggggccaaggugggccucaaaaaccgaagaggcuuuucuagauugaauaugacuugcggcccaccgaugggguucagggcccucgaaugaggugugauggugggccgaaggggguccugagacagggcaggggaugaacuagaaggcgggaggcaaggauugcagguuggaucuugguggccacuuccgcuuucuggccagagaguugcggagugaggguuaagggucugagccaugcuggguuucgucugggugugugcuggaaggucuauguguugauuugccuugguugugcugggggcgguggaguggggguuggaggcugugggguacacccauccccagauagggugugaacagugugugcccaguugggaugccugguuugccuuguggcugggcauggcugugggcagugagagagucagagacugugguuuguugggaggagugaaggggaggcugugucccaucacagggaaggugccuacgucaccacugcacccagcucacaugcaggcagcaucacacgccacacacuuagcccaacaugcacaugcuggggacacacccacucacggacaggcugacggaaguaccccacaguuggaggugcuggcguggacccauauuccagaccacucuggagaagaggggaccccaugccacuccuggagccuauucucucuucugaccaccccaggacccccaaauguccccaggccaacugcacagaggggaaguggcugguucacaucgcacagaguuugggcuaugcagggauuggaagcuaaaaccacugcuuuuuagaggaguguucacucuccagugacaaagugugcacgugggcagggcguuggaccacccuggcauuuggcuugguggggcugucaggguuagggggaggccucagcuugucuugguguugggagccaugauaguguauucucuauuagggaaggaaagugcugagagggcgaguccccuauccuggggucgcaguuuccccauaugcuaugugugggcucauccuguggaaacaggccagagcgcgugguugggggaaggggaauuucuugggcugcuuuucccguucccuccagggcugugcuucuccagcccaggaucugagcaggacagccccuuaacaacaauaaagauaauaauagcaacaaccauuuacugugcgucagccuugugcugggaugcccugugcuaacugccugugcccacauguuacuacguuuguuccucuccauggauacuugcccgaagucaugcagcucaggugguggagccgggucugggucuccauucuggagccuguauuuuuggucauuauaucuugcugcccuuuccccuuaguucuggcucaucucucaaguuagaggggaaggcucuaagcucugacacugcgguacugacccacaacccccuaauuuguuccccccaccccccaggccuuguacagcuccaucaagaaugagaagcugcagugggccaugugagucccggggcugcgugguggggcuaggauggggcauggggaaggggcugccuggggaggcugagagagcugggguaggcccuggguggggguaggggaggggagugagaggccaugagaggcagugaggcugccucacuuccuucuuuggagaugucugccuggauuugggguucuguaucuugucucuagcuggguuguuaugacaaguggguuggggugggaggagaggugcugaaacaucaaagggagguccccuggcaaccugagugggaaagcagaagccucuggaagcagggccuugaccagcagcacaagaggcccucacagguccuagggagcccagaugucacagaacaaaacaaguaaccaugcugucuguucuuggaaggcuccaauagaaacauagauacucggccaggcgagguggcucacgccuguaaucccagcacuuugggaggccaaggcgggcagaucacgaggucaggagaucaagaccauccuggcuaaaacggugaaaccgucuccacuaaaaacacaaaaaauuagccgggcgugguggcacgcaccuguagucucagcuacucaggaggcugaggcaggagaaugcugugaacccgagagguggagcuugcagugagccgagaucccgccacugcacuccagccugggugacagagagagacuccgucucaaaaaaaaaaaaaaaaagaaaaaagaaacacagagacucauaaguaagucuuggaagagucuagucuucuagucugagggaagaaauccaguuugggccuugggguccccagucugaggguagaggccuuaucuucacaguucauagaucauucaaauuugccguuauccacugagacucccucacuguccaguuagcugggaguucccagucauuggagaucucaggggaggugcagcucaggauuagggugcagggggagaucagggaaggcuuuuggaggguugagacuggggccaugaaguuggggcaacauuugggaagaggaaaggggaagcuggaauuugggaggcaaaggugugguggcugaaaugaguauggggugggggaccaagggaggcaggccuagcugggacggagaaaaacacuguugggggagaugcaguguaggcuccauaugggaaguaacagggaacuaccacagguucuugagcaagggagugacaagauagaauccgaaauuuuguaucugacugagccuguagaccaggauguaugggguuggggugggggcggcacuaggaaacuacuucuuccaucugcuaccauuuagcccacaaaccgugagcaaagccuggggcuggaugugguugagccagcggaggcaggcccggggcuguccugguggagaagggugugagggcugcaggugugcagcaauggagaggauagugcuggcccuacuugcugggaggaagggacagugguggcucuaggcuggggagcucugagggaggugcccugcucugaggaggcacagcuacacauuguggaggccugaucugagacgggagacauggcaggacccucagguugagccccccaagccacaaacacugggggagcuuuuccagggcgagcagaggccagaacugaagcgggggccgcggcuccauggccagcccccucugaggugaucacaccugcagagacgaggaggagcugagacgcucucugucugaguuggccgaccccaaccccaaggucaucaagcggaucagcgggggcaguggcaguggcuccagcccuuuccuggaccugacucccgagccuggggcugccgucuacaagcacggggcccuggugcgaaaggugcacgcagacccugacugcaggaagaguauguggccgaguugcggggggcgggcgucuaggggauggaugggagugggccuguuccagggcccccugaccugucuucucuccccgcagcaccucggggcaagcggggcuggaagagcuuccacgggauccucaagggcaugauccucuaccugcagaaggugcggggucaggccagggggcuggggcugggacugaguuggcugguggguguggggugaugggugggaauaggaggggcugggccaggcugcauuuggggccaggacaagauggacaccccugcaggaggaguacaagccugggaaggcccuuucagagacggagcucaagaaugccaucagcauccaccaugcccuggccacucgugccagugacuacagcaagaggccccacgucuucuaccugcgcacagcugacuggcgggucuuccucuuccaggccccgugagugcccuccuccugcccaucccggaccccuucccccaccucccauccugcuccccucccugucccuggauuuuuucauuccuucucaggccacacuugagccaggacuggcauccugggacagaaacccugggcccaggucccaaagggcugugcuuucuccccaggagccuggagcagaugcaguccuggaucacucgcaucaauguaguagccgcuauguucucugcgccccccuucccagcugcuguuagcucccaaaagaaguucagccgcccucuccugcccagcgcugccacccgccucucccagguagcccaagcucuguccaccuagugccagugggauggaggguguuaggcucaggcccacugcacucaaggcugcugcgugugaucguggagauguccccugcaccaggaugcuggccacaggggugagcagggacugaaauccagcccccacugggucccgcuugccggcugggaacccaaacauagugcuuuguuuguccaaaggaaggggcaucuuuuuuuuuuuuuuuuuugagauggagucucgcucuguugcccaggugggagugccguggcacgaucucagcucacugcaagcucugccucccggguucacgccguucuccugccccagccuccugaguagcugggacuacaggcaccugccaccacgccuggcuaauuuuuuauauuuuuaguagagacgggguuucaccguguuagccaggauggucucgaucuccugaccucgugauccgcccgccuuggccucccaaagugcugggauuacaggcgugagccaccgcgcccggcuggaagggguaucuuuuuaaaaaucugcagaggcacuguauagggcagagugaccaugaccaugccucccccuggccgcuaggaggagcaggugcggacccacgaggccaagcugaaggccauggcaagugagcugcgggagcaccgggccgcccagcugggcaagaagggccggggcaaggaggcugaagagcagcggcagaaggaggccuaccuggaguuugaggugagccucccugucugccccucuguccacacacgcaggcccauacuagggugaagggcaugaacucuaacaguggaaccggccggagguccuugggcagguugcuuaaccuaagccucaguuuccuccucugugcaacaaggauaacauuugacauccacuggggucucgaggugaggcaugucucaagcgugccauuuccccagcucuaguaaaggcucaagacacauuagguuauagaugauggucccaggagagcccagagggggcaccagcccgcaugggaccaucucacaguccugggugggcaccugccaucuucugcccugcuggcggcccucccugguccagaugguggggugggcagaaggcagagaagaggcucucacagccccugccccucugccucagaaaucccgcuacagcaccuaugcagcgcugcuucgggucaagcugaaggcaggcagugaggagcuggaugcaguggaggcagcacuggcccaggccgggagcacagaggauggacucccuccuucucacuccagucccucccugcagcccaaacccuccagccagccccgggcucagcgucacagcucagagccucggccaggggcaggcagugggcggcggaagcccugagaugagguuuaggguggggagugccugcugggcaccugaaggaugacauggcccugccugagcccgggccggccucgggccacccacgagggccucccggccuagggcccgaccgcgccggacgcgguguccggggcagggcagggcuggggccugggccucaggagccuaggcuaggggcaccuccgagagccccuuuuugugauaauguuuugcacuuuuucguacagggugggcgggggcgggaggggcuagcgccccugaacuuuugaugcuuuuuuuuugugugggagaggccugaugccguuucugcuuucugcugagaccacccccacccugacaccaucagucccccucuguccuggggccuggcuuggacagagaccaggauuuggggcugagcugguuuccccuccuuccuccccaagggcuuacucuuucucuugcuggagguggaggaagggcguccaugccaaggccccauaccugggccgggggcagcacggccuggcuuucccccgcuucagugggccuugcccuuuguacagccuccacccccauuaaaacugcucuggacuugcuggcugggccuccuccuucucuucucaccaugccuggcaugugggcaggguggguagcugguuccagggacaagagucacaucaggggcugccauaaguugggaaggagggguccuccccuucccaugagaauccuuuauuugucccaacugaggggugggugugggguguuaaauaagauuugaaauagguggggacgcuguacaggggguccgggaagggggcugggggcaggcagcaggucagugcaccugaggcugggggugcccguggcagagcccuccugguggcucagggggugggcccagcuucucugccuccugcuccacugacuggcucccguacgcacugucuuccuucaccucugcuggggguaaauggggacaggaaugggauagucaaagccucaggccuccggcccuccagguccagauccaccuuccagggaggccccuuuaccugugcugggcagcuugucucggguuucuggaccccucagcagccucacucccuccucuaggcccaugucagacaggg

SEQ ID NO: 18859 - RNA, 2781 nt, Homo sapiens
ccaccacuucgcucagaggcggcuacuggcucaagaggacgacagaagccagucucugaugcccaccgcauucuccagcuucaggccucaagcccuguagccgagaaggcgaggccuaauguuacaccaccggucuguuccgccuccguuucgggguccacccgaaaagcuuucagaucggauccucggugagacggcacucgauuaaauaggucugucucuacaggccaaggaggcggguuuggugcggccacuccaaggccaaagcgagaaaaucuuacugcgcacgcgcaauagacagccgauggagccaccgauggagccguccggaggggagcaagagcccggagccgucagguaccgagcaccggaggggccgagagggaagaggaaccugagggaggggagccgagccggggcugggucugggggccgcucuugggagcuggggcgcaggaacauaacggaggcggacucgcagguaauaguggccccgggacgccagugccaacgccccuuuacucgcagguuccuggaccugcccugggaagacgugcugcucccacacguccugaaccgggucccgcugcgccagcugcuccggcugcagcgcguuagccgggccuuccggucgcuggugcagcuucaccuggccgggcugcgucgcuucgaugccgcgcaggugagccgggggcugaagccccgccccugccuggguaccgccccgccucuagcccagcccccagccccgcaguaugcccuucuggacccccuugggccgccggggcugcccggaagggauccacgcaccaaagggcaaauacucgguagcgacucagagggaaaguggggucucuccugggagagcaggaggcugccagaaaagaacucaggucaggggugcauaggcggcugaggagugcgggacgggcugagaguuggggugccuccccgcccgcagguggguccgcagaucccgcgggccgcauuggcccggcugcugcgggaugccgaggggcugcaggagcuggcacuggcgccgugucacgaauggcugucagacgaggaccuggugccggugcuggcgcggaauccgcagcugcggaguguggcguugggcggcugcgggcaacugagucgccgggcgcuuggggcuuuggccgagggcugcccacgccugcagcgccugucgcucgcgcacugugacuggguggacgggcuggcgcugcgcggccucgcugaucgcugcccggcccuggaggagcuggaucucaccgccugccgccagcucaaggacgaggccaucguguaccuggcgcagaggcgcggcgcuggucuccgcagccucucucuggccgucaacgccaacgugggggacgccgcgguucaagaguuggcucggaacugcccagaacuccaccaccuugaccucaccggcugccuccgcgucggaagcgacggugucaggugccugggccugauagggcgggaggagggcagucacuuagccucugcugguauggggcgggcuguaguuguuaaaaggccggacugaggguucugaaucuuccugcaaaccacagcacccccauucugaacagaaagggccucuaggauugccuaggccagagagcccauaguuuaaaaacuuuuuucaaccaauguuuacacauugggagauuucacauagaaagucgacuucuggcuuuucuucaacaagggggagaucuugcaauccuaggcggagcugagggccagguuccccccuuaaaugagacaggaagucuccagcucacuggaagccaauccaggcgccucccuuguguagggacggaaaaaguaugccccugccccgagcuggagggagaccgggauuuugccggagccaguccgaggcugagugagcccgggccuccaccuuaccccaccaaaggugugguggccucaugucccuagccucacccugcuccucccucaggacauuggccgaguacugccccgugcugcguucgcugcgggugcggcacugccaccauguggcggaguccagccugagccgcuugcggaagcgcggcguggacaucgacguggagccgccgcugcaccaggcccuggugcugcugcaggauauggcgggcuucgcaccuuuugucaaccugcaggucugacccgccugccaaucggagcacagcuggacuguguggcuggggccugacacugagcuguagggaaacugaacugugaggaccucuggugagaggccagugcccugccccacccuggagcuucaaauaaagagcuuuuuacccccucuugccuggugcugcccuguugaagauaggggauucgagguuggggaggaaaggucagacaggcauaguaucccaguccugaggcagaaaugaccagaaugcacucacaccuuccuugggccaccuuuacugugcccauggaggcagcuccgagaguagguuaacacuauggagcaaaggaguagagaagggggacaggaguuagggggccccuguguagggguauagggcuccugcaucccucugggaucugagccuagaaggcucgggcagaguccggcgagugccucaauggaagcgguacuuucuggcuggcuugagguugauguauguggccuucaucuccucggccucaggguuccgcacaucuuugaaucgcuccccuuuggugcucacuaccugguugucgauguaucggaucagcuucuugggggccugucaggcaaucagcagugaguggcagaagcca

SEQ ID NO: 18860 - RNA, 1899 nt, Homo sapiens
guuuuuaaaugauucagaggucugggguuaagaacagagcuggcucugaucccuguugcucacugguuccuucuuccccagggacgaggaugggaagaccgccuguggccaugagcccuccccggugcuccuggggcuaaggcuggggcugcagccauggggcugggucagccccaggccugguugcugggucugcccacagcuguggucuauggcucccuggcucucuucaccaccauccugcacaaugucuuccugcucuacuauguggacaccuuugucucaguguacaagaucaacaaaauggccuucugggucggagagguagggccagugcuggguggcuaacauggaggagggggugggguggagacuagaggcugcccaggcugcugggcagauugcaggugccuggucccacccagucagaggccugggcaguccagguuguucaccaagacucaucaagaaaagcuguggaggccuugaugacuccuccucgauggggacuagacuagcuuuccuggccacugucuuacauaguugcuguucuguguacucauauauauaauauguucacguauaugaauuuaucagcugcauacauuuaccagcugggcccuggaugggugggaguuugaagggggcagugguuugacuggcagaguagguuuuuuuguuuuuuuuuuugagauggaguuucacuuuugucucacaggcuggagugcaauggcgcaaucucagcucacugcaaccuccgccuucgugguucaagugauucuccugucucaaccucaugaguagaugggauuacaagcacccgccaccacgcccggcuaauuuuuguauuuuuaguagagacgggguuucgccauguuggccaggcuggucucaaacuccugaccucaggugauccaccugccucggccucccaaagugcuggugugagccaccagcgccuggccagaguggguuuuagcagaggaacugacaccagcaaagguuugcagguaggaaagcuggggccaucuuucagggguggugagcaggcugaggggggaggagcccuggagaggaugcugucuagagcccaccuuccugucuccccucugccugcagacaguguuucuccucuggaacagccucaaugacccccucuucgguuggcucagugaccggcaguuccucagcucccagccccgguugguguauugggaacagcucguaauugguucagucccacccuacugcuacccaggagggaggaccccugccuguguuugggguggggaaggaaggggagacuauuucaguguugcccauggcucuucccuuacugggguccagggugcucuguuuggguuggagagguggccuuggacguacacuugccuggcucggcaggggaagagaucuacccuggcuuggcuugguuggccccucuggacuguggacugcaaacacccucugcugcuucuggaagauuccuuugccccaucccugcuugagcccgucaucacccccaaccuugagaagugggcaucccauacccuuuggccaucagcccaacaggcuaauaaggggguggaaauuggggcagaggaggagaguguacccacuggugaguugugcuuccuaaguugcagacuggggacuuaggggacaguggcaccacccuguugugagucccacacccugggccuccaucccuccccuggggccugggcaaggggaacuucagccugccaagucugacacggcaucucccaacaacucuccuuuccccggcaggucaggcgccgggcucuccucaagggcuguggugcuggcccgggugcaggcccugggcuggcaugggccgcugcuggcgcugucguuccuggcguucugggugcccug

SEQ ID NO: 18861 - RNA, 23543 nt, Homo sapiens
aggcgaggucgggccgcucccucgccgcccugaaccggcggcuagacugcgcaugcgugucaguggcgcuagcggcggacccggcugggcaguuccuuccccagaaggagagauuccucugccauggaguccuacgaugugaucgccaaccagccugucgugaucgacaacgugaguugcgucuuuccuaucuauaaggggacuugggcucuccuccucgaaaggaucgcuucccgggguucagccugagccgccggcucuuugucacuggcccggccugucaggcgcguucagccaccgccgccuccuuccuccccuuaucacauaguccgcaggcaaggcggccagccagcaaaagugggauggagaacucuggaguggauaaaggaaagaguuauaguccaagccaguccuugggcccuuggcucuaggggccuuaaccgcugugugagauucccgucgcccgcccucucccccauuuccgaucgcucuauugguugcucuggcuguccaucuuagccaaugauaccgccucuuagccuugccggaugaggcuaggccucugcggugauuggcucacgccccugccauucuuccuugccgccauauuguuuucccucuugaaggggcggggcagugcuccagggcuguggggauuggcuuccgggacucugggugguggggccuagaggcgagugcccgcccgcggguggagaacggcuaaguuuuccuucggucucagccggcgcugcggcuuggugguguggaucuggguggggcccgagaaucuggugccagaaaccgcuguaggaugucagcuauuacugugauuauaaauuacaaaguugguaaaggucgagaagaaaggagagugacaaaggaagcagagagguuguccuccucuuuggaacgccuaguucuuacggggaaaaaauuaccaaacuuaauauuugccuggcgcucuagcgcuuccagggcguuuucacauacauucgaguuggauccucacaaaaacuggacgcauaguuuaaaaggaacuuugaucuucguguuaccgaugagaaaacugaagcgcgaagacguaacgugagcccaaggucacauagcagaggugcccuaaauccaguacuuuauccgucaucccuuuugccagcaccaccaugcagaagcaucaauauugaccaauagaaagaaucuaaauacugcucuuauuuuggggggaaaggagaaaauuguaaaacgacugcauuucugccuucgauucaaagcuuuggucccacagagauugaucccugucugugucccuuguaggucccuccauugaggcaaaacuaccaguucccucuguuguaagcugacucugucagauucccuuuguugauucagcucuugggaccuuaggcauauuacaauguucucguuuaagcuucagcucuguuagguagauaggaauuacuauccccaguguaugcagggauguuaaauaacagauuucaaaccauccaguuuaggaauugaggagccagucaucagacuaagauccaguuccaaguugcuugcuuuuuccaauauauuuuuguuguuguuuucauuaaauuuuccuucucuccauggguauuuuguuuuuauuauucccccuuagaaaggggcaggauugagcucaaugagacagcucauuuuuuuuuucuuuuuuuuuuuuggagacagggucucgcucuguugcugagucugaaaugcaguggcgcgaucacagcucacugcagccucaaccuccugggcucaagugauccucccgcuuaagccucccgaguagcuggggcugcaggcacgcgccaccaccccuggcuaauuuuuguauuuuuuguaggaaggguuucaccauguuguccaggcuggucucaaacuccugggcuguugcgauucuccuaccuuggccucccaaagugcugggauuauaggccugagccaccgugccuggcagagacgccucuuuuuuugguguggggggguggagggaacaggaucucgcuuugucacccaggcuggagugcaauugugcgaucucagcucacugcagccuccgccuccagguucaagagauucuccagccuagacucccaaguagcugggauuacagaugugcaccaccacgccuggcuaauuuuuguuuguuuguuuguuuguuuguuuguuuguuuguuuuugagacggagucucacugucgcccaggcuggagugcaguggcgcgaucucggcucacugcaagcuccgccucccggguucacgccauucuccugccucagccucccgaguagcugggacuacaggcgcccgucaccucgcccggcuaauuuuuuguauuuuuaguagagaugggguuucaccguguuagccaggauggucucgaucuccugaccucgugauccgcccaccucggccucccaaagugcugguauuacaggcgucagccaccgcgcccggccuaauuuuuguauuuuuaguagagaugggguuucaccauauuggccagacuuguccugaacuccugaccucaaaugauccacccgccuuggccucccaaagugcugggauuacaagcaugagccaccacacccagcccagauacuucauuuuugagaggaucuuuuugucucccucacuagacuauuaaauccuuguggaaaaagaugauauucucccacagguuuagugguguugggaaaaaaaauuuaagaaagaugauauuccuuuagucucacuucacccacuucucuccacacacacacaguauaccuagggucuggcaccucugugugcucaauaaauguuuuuucauuggauugaugggugauuggaugaaugacugaauaucucuaucaaaguaacaaagauauuccuaaauaaagaaaagauggggaguuuucucuaguuaguuacugcagauaauugaguaggacuuuuuguucuugauguugauuuucagagagcacuacgauuucugucuuuagccaggcucuuugugcuucuucugccuuuuucuuaguuguaaaaaggaaaaauauauagaaauucaauuuccuguuuucaucagcaaugcagaaggaacaaccugucuaucccaccagcuccuuugcuucuugaauugcuaggcaggaguuccaucuccggccauuuucuuuaauaucacuuacacuaaugcgucuuaauuuuuuucuuucucuuuccugguaguauguuucgaaaugcauuacagcagugaugcauuuuuaguuucaagauuuaaagaauugacuugucuuuuuuuucccccucugggaaaacauguccuuuauuaugccaguauuucugccaaaaggugaaguaggagaaacuuaagucauuuuccuauuaguauuugcugaaaaucugccacauuuuuacaugugcggucucagguaguccuuguuguuuaacauuuggggggucauuuuguuuuuauuauuuucaagaugguagauguauaggaaacauuauuugaaauaccugagacaacuuauuacauauaaugagaauaauguaucacuagcuauguuaacuccauagcuuaacauguugcuacacuuuauuuaugggcagaagaguauaaucaaaagaaugcaggagaaagaaagcagggaaagagccccauuaaguucacagccuuucccaaucauaagacaauugugaccacgucuuucaucuuacucuggcaucaagucauuucaucagaauuuaaugaggaaaauggaggggcagguaggugugugcuuuaaugacaacaauaaagugauagguauuuuuuuaaucacccaagaagcuuuaugaugauagauauuuuuuaaaaccaaauauaagucauuucuucccaaagacauagagaauaguguaagauaggagcagcuccuaggccacauuuugaggacuacacuuugaucagaauacuauguuuauucugaaacucaaauuuuuccuaagauccaggccaaaugugguggcuuacuccuguaauuccagcauuuuggaaagccaaggcuggaagaucguuugagcccaggaauuggagaccagccugggcaacauagugagacuucaucucuacuuuaaaaaaaaaaaaaaauuagccaggcuugcuugguggcaugcaccuguaggaggcugagaugggagaaucacuugagcccaggaguuugaggcugcagugagaucgugcaccucacuccagccuauuuaaaaacaaaaacaaaaaaacucuaaguuuacaguuuugccugaaccuaaaauggaucaacauuccugucaaacuuaaaacugucuuugugacuauauggaccuaaaugcaggcucuucagaaguucaacaauaagcuaagcauuuguuuguuuugcuuuggauguugugcugcuucagcccccuuuaaaaaaaaaaaaagagagagagagauacuuuaaacacacagaaaaauucggugugguauauaacaagcacccagguagcaugugucuacuacccagauuuaguaaauauugauguugccauauuugcuucaguauuuuuuuugcuuuaguguucccauccaccuucauguuuuaaggaaauaaaacauuacagauauaauugaagacucuuuguaccccuccacaacccuaucuuuuuuuuuuuuuugagacaaggucucacucuguugcccagguuggggcucauuggcacaaucaaagcucacugcagccucagcuugccaagcuuaagcaauccucccaccucagccucccaaguagcugggacuacagccguguaccaccugcucagccuuuuuuuuuuuuuuuguagaaauggggucucccuguguuccccaggcugaucuagaacuccugggcugaagcaguccucccaccucagcuucccaaagugcugguauuacaggcaugagccacugugccuggcaacccuauccuuucucucuguuuuacaaauaauccgcaaaacaaccaucaucauaaaauuguccuccuuuuauacucuggaagauaagucaggagaauuguguuguucaaggccagccugggcaauacagcaagacccccaucucuuuaaaaaaaaaaauugugcuccuuuccaccuaugauuuuuuuuaauuuuuaauuauuauuuguuuuuaaauuuuuuuuagagaugaggucucacucuaucacccagauuagagugcagugcugcagucguagcucacugcagccucaaacuccugagcucgagcaaaccuccugccucagccucccaaguagcugggaguauaggaggagcaagccaccaugccuagauccauccaugauuuuaugugcauaugcauuuuaaguuuggcaggggagugugcuguuuguguuuugaaaguuuacuuaagugcuaucauccuacuguuaucucuuuuuauuauagcaauuucaaacauacaaaggagaaggaauaguguaaggaacauccauacguucaccuagcuguaacaguuaucaaacucuuggccaaucuuuucaacuacauuccugcccauuucccucucccacauucuuuuuuuuuuuuuuuuuuuuuuccugagauggagucugcuguguggcccaggcuggagugcagugaugcucacugcaaccuccaccuccguggcucaagcgauucuccugcuucagccucccgaguaguugggacuacaggcaugcaccaccaugcccagcuaauuuuuguauuuuuaguagagacgggguuuugccauguuggccaggcuggucucgaacuucuggccucaaaggauccacccgccucagccucccaaugugcuaggauuauaggcgugagccaccacgcccagccccacacucauuuaaaaacauaaucaauauacuauuaucaugccuaaucaaaucaacaagaaccccuuaaucuuaucaguuaucuagucaauguucagauuucacuaauugucuaaaaaaauuuuucuuuuacaauuuguuaucagcuuuucugauccuacuaaugcugauucacuuaaguuuuuagggacacuagaauuagcugaggaaaugaagucaauguauuuaucuaacacugucacuugcagugugauauucaggcuguugguuguacagcuucagcaagaauccaucccuagcuugacagaaaaggugaagaagaggugacuuauaaagauauuuucacuguucaauuauguauauuuugcaagccaaggaugugcuucacacugagcuaaguccucugaggguaaaaaagaaaucagauaccauguggaagaagaaacgucaccaauuaguggcugcaaaugccuagaauagggauuucaaauucaaugccugcagaggccaagcaggaauggaaauauacucaaaagagaagagagagaauagccugaaaggcaccucuuccaggcugggaaaucugaaaggugcauugaauugagcaugccugaccaaaauguuaacugauucuccuuucuauccaauuguccccaugcaggaauaccggccuaguguugccagauauucugauuuuuaaaaauuuguguauuuaucgaggucaggagaucgagaccauccuggcuaacauggugaaaccccgucuuuauuaaaaauacaaaaaauuagccaggcgugguggcgggcaccuguagucccagcuaugcaggaggcugaggcaggagaauggcaugaacccgggaggcggaacuugcagugagccgagaucucgccacuggacuccagccugggcaacagagcgagacugcgucucaaacaaaaacaaaauaaaauaaaaauacaaaaaaauuagccaggugugguggcaggcgccuguggucccagcuacucgggaggcugaggcaggagaauggcuuuggacccgggaggcggagcuugcagugagccgagaucacgccacugcacuccagccugggcgacagagcaagaguccguaucaaaaaaaaaaaaaaaaaaaaaaauuguguauuuauuuauuuauuuauuuugagacggaggcugucucugucgcccaggcuaaauugcaguggcgcaaucucggcucacugcaaccucccccuuguggguucaagagauucuccugccucagccucccgaguacugggacuauaggcacgugccaccacacccggcuaauuuuuuuuuuuuuagauggagucucgcacugucguccaggcuggagugcagucgcgcaaugucugcucacuacaagcuccgccuccuggguucacgccauucuccugccucagccuccagaguagcugggacuacaggcgcccaccacuucacccggcuaauuuuuuguacuuuuagugaagacgggguuucaccguguuagccaggauggucucaaucuccugaccucgugaucugcccgccuuggccucgcaaaaugcugggauuacaggugugagcuacugcgccuggccuuauuuugaauuuuuuguauauauuuuuugaggcagaggcucacucuaucgcccagucuggagugcaguggcaagaucacagcucacugcagcccugaccucuugggcucagccucccaaguagcaaggacuauggacccgcaccaccacacccgaguaauuuuuaaauauuuuguaggccuggugugguggcacaugccuguaauccuagcacuuugggaggccaaggcggguggaucacuugagaucaggaguucgagaccagccuggccaacauggugaaacccccucuacacuaaaaauacaaaaauuagccgggcgugguggcgcacaccuguaacaacaacuacucaggagucugagacaggacuaucgcuuaaauccaggaggcggagguuacagugagccgagauugugccaccgcacucuaggugggugacagagccagacuccaucucaaaaaaauuaaaauuaaaauuaaaauuaauauuuuguagagacagcguuuugccauguugcccaggcuggucucucgaacucuuggccucaagcaauccucccucaucugccuuccaaagugauggggugacaggcgugggccaccgcacccagccauacuuuuuguuuguuugguugguugguugguugguuuugagacagggucuuaucuuacucugucauccagccuggagugcagcagugcaauuacagcuugcugcagccuugaccucccagacucaagugauccuccaaccucagccuccugaguagcugggaccacaggcacacaaccaccaugcccagcuaauuuuuguauuuuuguagagacgggguuucgccaugugcaggcuggucucgaccucccgggcucaggcagucuuccuagcucagccucccaaguagcuaggaguacaggcacacaucaccaugccuggcuaacuuuuugguauuuuuuguagugaugggguuucuccauuuuggccaggcuggucucaaacuccuggccucaaagugauuugcgugccucggccuuccuaagugcuuggauuauaggcaugaguuaccacacccagccaagacuacucaagaagccucuaccaggcauuuuuucauuuggccuugccagagugaauaacaaagacaguggcagcuuauuugccagguacacaguuccuaguuguaaauacuguuaaagaaauggacauaacccuuuuguaugcucuugagcagaauuuguguggcuugagcagaauugaggcagcucagcugcuccucauucuccacugauucuucacccuaugacuggcauggcaggccugcuugggggcugcaaggacacgcugggucugguuccaccuugugcaucacucccagugcugcuuuccccuuugcugaaccgccucugccuggggcuucugucauuucagcuggucauucagguuccauacuuuagguucuaucugccagucauuugcacuugauuuuaauuuuacucagccagcaucuguugaguacccagcaaaugccagauacugccaaaauguauuuuagccuuaaggaacuucaacugaaaagagacgaaaguggaaaccuuacauuguaauaaaaagcagaaugaagugcaugccaccucgugguacagguaauggaaauuugcugugagauaauaggaagaugaucauucauuccaacuggggauguuucuucaggaggaaggugaugauauuugaacugggcuuuuuauacucuuugcuaggaaggacagagaagaaaaaacaaaucugacuucauaaucugccuguuuacccagacucuaguccuuuugcuaguaaacuaaaaauaaaauacccaggaaaaucaucucuuaaaaauauccagggucugaaggacagaucucauccucucuuguuuuuaaccucugccgggagacccaauuagucuguuggcaucaccacacccagaugaaggcagugagcaaucauuggaagccugagcaaacaaguucuaggaguuccccccuugccuguccgugccuugcucucagagcccuuggguuuguaggcaaauugccccuccuucccagucuuucagcucacuugacagcugcaccuuuuccaggcuccuuguuguacugcccaguccaaugaguuugcacauugucuucuguuuucacucucuucuguuggcaaagauuccugcucccuuagagaacuggcugcccugcucuccucucauaccacuuucucugcccuucaaccacuucuuuuuuuuuuuuuuuuuuuuuuugagguggagucucacucugucucccuggcuagagugcaguggugcgaucuuggcucacugcaaccuccaccuccuggguucaagugauucuccugccucagccucccugaguagcugggauuacagacguguagcacaccuggcuaauuuuuguauuuguaguaaagacaguguuuugccauguuggccaggcuggccuugaacucccuggccucaugugaucugccccgcuucggccucccacagugcugggauuacaggcgugagccaccacaccuggcuuccuucaaccacuugcuuccuccaccaaccucugucuugccaaaggcaagcaccagauggccagucucacucccccucuuccugcagaagagcaggaauaagagagucaaggagggaagcaggcauguugcugggaagccuuuggugcagauaaccuuggcuacuuagagucuccagguguguucagugcuuguagaaugaggucaguaaauaccacacuccaccccaggagaguggucaacaggcagcaggaaaaggcuugccccagcuacgggugcagcugcaaaccauguuggguuagaaaggugaggguaucagguguggugguagaagaguuaagaaggaagaagaggccaggcgcggugguucaugccuguaaucccagcacuuugggaggccgaggcagguggaucacaaggucaggaguucgagaccagccugaccaacacggugaacccucaucuccacuaaaaauacaaaaauuagccaggcaugguggugcgcgccuguaaucccagcuauucaggaggcugaggcaggagaaucgcuugaacccaggagguggagguugcagugagcugagauugugccaccacacuccagccugggugacagaccgagauucugucucaaaaaaaaaaaaaaaaaaaggccgggcacggugggcucacgccuauaaucccagcacuuugggaggccaaggcgggcggaucacgaggucaggagaucgagaucauccuggcuaacacggugaaacccugucucuacuaaaaaaaaaaaaaaaaaauuagccaggcaugcuggugggcaccuguagucccagcuacucaggaggcugaggcaggagaauggcaugaaccugggaggcagagcuugcagugagcccagauugcaccacugcacuccagccugggcgacagagcgagacuccaucucaaaaaaaaggaagaggacaggguguaucuacaagcaauacuaagccuugacaucuguccugcacaggguuggucucuguguccagagucacuguuuacauugauugggcccugggugguaccugagaugcugggagaacucagauucuuuucuggacaccucacucgacauaccaaguguuggagcagcaggacugugguucucuucuauucucagaguaggcuuuagucuuugcuucucuuuaccaucaggagaccaaggaguaaaaggaaagcauaguuaaaaagaaaacaacaacaaaaaucucccaaagcaucgugcucugcccuugcaauaagaaccagacagcacguguuccaugggaguccauuucaagcaugacagugcucauggcggugucugucacagaggcccuggaagcugggagaguucaggccugagcugggaaaguagguuaaaagcaccccaggguggcguaacaaggagucaugugcuuuuccuaccuuauguuccugaacuuggcugcuuugaugcuucuagguacuuucuucuuuccccagguuuucugucuuuuucuucccuuuauuacuaguauuuuuaauucccaaagcaaaacauguucaauguagaaaagucagagacuacagaaaaaucacacauacgguuguguauacagugagaauccuccucaccauccuauuuccacuucccuucuuuuggugugcauuuaccuuuuucuagguucaaauaaauguauauauuauauacaaauauuaguuuuguuuuuuuuuuccugugagacagagucugucacccaggcuggagugcaguggcacaaucuuggcucacugcaaccucugccucccagauucaagugauucucccaccucagccucccaaguagcuggaacuacaggugccugccaacaugcccagcuaauuguugcauuuuuacuagagacaggcuuucaccaugguggcuaggcuggucucaaacuccugaccucaagugauccgccugccucugccucccaaaguguugggauuacaagugugagccacugcgcccggccgcuuucuuuucuuaaauaaaaaugguaccauauaauguauuuuuccuuuuguauuugugauaguucugacuccucauucucucuccucuuuccucagggauccggugugauuaaagcugguuuugcuggugaucagauccccaaauacugcuuuccaaacuaguaagucauucuguagcuuagacguuuuggaggcucaucagcuuuguuacaggcccagcccuauaagggacaggagccgaguuuggagucaacaaaggaaaacaguugucuacaugguacaauuugagaggcacagauaagaggccucuuuuuaaaaauccaauuuuaucugaugcuaaaaaauuuuaucauugguaacuuauugcuuuggaggauugccucuugguggagcccuccuuuuaaaauucuccuaucacccaggcuggggauuaacauuuaacccaucuaccaucuuuuuuuuuuuuuuuuuuuuuuugagacggagucucgcuguguugcccaggcuggagugcaguggugugaucuuggcuuacugcaagcucugcaucccggguucacaccauucugccucagccucccgaguagcugggacuacaggcgccugccaccgugccuggcuaauuuuuuuguauuuuuaguagagaugggauuucaccguauuagccaggauggucuugaucuccugaccucauggucugccugccucggccucccaaagugcugggauuacagcccuucuaccaucuuaaugaggaguuucucagaacuuuccuccuaagacagagagacugcaggcaggagaagagcacagaggcuuacaggaagggcuuaaagggggaggaaaggaagaggcuaucuguccgaucuauagcaucacaguuuuuuuuguuuucugagauggagucucauucuguagcccaggcuggagugcaguggcgcaaucucggcucacugcaacuccugccuugcagguucaagcgauucucgugccucagccucccaaguagcugggauuauaggcaugugccaucacgcccagcuaauguuuguauuuuuaguagagaugggguuucaccauguuggccaggcuggucucaaacucuugaccucaaaugauccaccugccucagccucccaaagugcugggauuauaggugugagccaucgagcccagcccagcaucaguuuuacuuagagguccugggaaggggacuaaggacacuaaaauguuuugaguuaaucacuccuuuagaaauucucauuuccucaucuuucuuggucuguucauacacugcagaaagagaagaacuagagguauuaaauacucuaaaaauuuguuuucauaauuuauaauaaauauaaaauaugaaauaauauauaaauaauacauguucauuuuagaaauuguggaaaauacagaaaaguauaaagaagaaaaucaaaaucaacugugacuucacuccuugaagauaaucucaguagaauuugaguguguauguacaucuauacauccuuccuguguucugucaugaaaugaaaaaugaugguccuccucacugucuuuucuagugugggccgacccaagcacguucgugucauggcaggagcccuugaaggcgacaucuucauuggccccaaagcugagguaauucccaggccuacagaacaagccuuaagccagcagaggaccuucauuauucaccacauggaacaugucccaacauuuggacauacccauaaguaaaaggggcaacuuucucugaaaaucuccuuuuugauucucucauccuaggcuuaggugguuuauuuuucccaggaacagccuguggucuuggagaagaaaauaccugggaccucacuuugggacacacugagaccagucuaggaaacagggcuguugucuucugcauccugucacugccuugucagugaucaaauuuacuguguuuauuauuuuuuucacaaaaaauauucaguggggagauccuggcugggguacccuagggaugaguuaauucacacagcuuugucagagcccucaugcagccucuuguaagcagauagcagaaucgcuguugccauccuuggcuucaagugcugaggcccagaggugggagccaggagauuguguccuggaaccaggcaaugaggaagaugccuccugccacuugcccuagaggcaccugaggggccauggaaaugcagaagccccugcuuugccggcuccucgggaaugagggcaguuugcagcaaacaguauuuagccuuggagaaugagugcccacccuuagcccugggcaaggacagcaggguggaagcucaggaagcugaggcuucuuugcaagggauucagcuugcacugcuuagucuugggagaacaggguccuggguggagccugacugcagucguaaguccuguucucuuuucccaggagcaccgagggcugcuuucaauccgcuaucccauggagcauggcaucgucaaggauuggaacgacauggaacgcauuuggcaauaugucuauucuaaggaccagcugcagacuuucucagaggaggugaggauccuguguguagggcacuccuguaggguaugcaaagcugugucaaacuccuacccuagagaugaugaggaggacgaugaucacugccaagagugcuggagccauuugauuuucaggcauauucagauuuaaucuuaacaccauuccuaugagauauagguaguauuaucucauuuuacaaacaagggaacaaguucagaaaagccaagucguggccgggcgcgguggcucacaccuguaaucccagcacuuugggaggccgaggcggguggaucacgaggucaggagaucgagaccauccuggcuaacacggugaaacccugucuccacuaaaaauacaaaaaauucuccgggcgugguggcgggcgccuguagucccagcuacuccggaggcugaggcaggagaauggcgugaacccgggaggcggagcuugcagugagccgagauugcgccacugugcuccagccugggugacagagugagacuccgucccaaaaaaaaaaaaaaaaaagaaaagccaagugguauuuccaaggucaccaagugaacaaaggguagagauggaauucaaaccuaugucuuuuagaauucaaagccugugcucauuaacuucuuucacccagacuggagugcaauagcucacugcagccucgaccuccugggcucaaguaauccucccaucucagccccaccccccaccaugcccggcuaauuuuguguguguguguguggugggguuuugcucuuguuggccaggcuggagugcaauggcgugaucuaggcucacugcaaccucugccucccggauucaaaugauucuccugccucagcuucccaaguagcugggauuacagcaugagccauggcaccuggcaaauuuuguauuuuuuguagagacaagguuuugccauguugcccaggcuggucucgaacuccuggguucaggcaaucuauccgccuccaccucucaaagugcugggauuacaggcgugagccaccuugugcagccugugcuuauuaacuuguaaggaaguaacucuccauucaaaaauguaaagggaggcuggucacugugggucaugccuguaaucccagcacuuuggguggaucucuugagcucaggaguuugagaccaaguugggcagcauggcgaaacaccaccucuacuaaaaauaugaaaaaaaaaaaaauagccggguacaguggugcgugccuguagucccagcuacuugaaaugaugaggugggaggacugcuugagccugggggcaucgagguugcaguaagccaagaucgcaccacugaacucgcagccuggugacagagugagaccuugucucaaaaaaaaaaaaagaaagaaagaaaaugcagagaggugcagacuagguguaucaauuuccaggugcaggugggauguuuucaguuuuggguuuuuuuuguuugcuuuuuugagauggaguuucgcucuuguggccuaggcuagagugcaauggcgcaaucucggcucaccgcaaccucugccucccagguucaagcgauucuccugccugagccuuccugaguagcugggauuacaggcaugcaccaccaccaagcccggcuaauuuuguauuuuuaguagagacgggguuucuccauguuggucaggcuggucucgaacucccgaccucagaugauccgcacgccucagccucccaaggugcugggauuacaggugugagccaccacgcccggcuguuuucagacaguuuuuuuaaagcagugguccccaaccuuucuggcaccagggacuaguuucuuggaagacaguuuuuccauggggguggggguuugggguggccagauaguuucaggaugaagcuguuccaccucugaucaucaggcauucaauucucauaaggagugcccaaccuagaucccucacaugcgcaguucacaguaggguucacacuccuaugagaaucuagugccuuggaugaucugaugggagguggagcucagacaauaaugcucgcuuaccugccauucaccuccugcugugcagccugguuccuaacaggucacagacuagaacuggucugcggcaggaauuuagaguuucacaaaaucuucuugacaguuggagauacacaguagacacaggggccuguauaacaaucuuggaggacaaggaggggaguuggggggcacagcugaggacagaaugaaauuuuaaagugggcauuaacuugaaaaguugagaaaacuacuugggcagggauaguugacaggcacagcuugccuuuuuuuggagugaggcugacugaaguccccgggcucucaaaccagcaaggcagggucuucuccccuaagacuaaugaagauggaaaucuggccuuggccucauugucucccgggcuccuuucaccagcauccugugcuccugacugaggcgccuuuaaacccacgaaaaaaccgggaacgagcugccgaaguuuucuucgagaccuucaaugugcccgcucuuuucaucuccaugcaagcuguacucagccugugaguagcagcuggcuagcccggccccugcggggaaagcaguccuuuggcacagcugaggcuggcucuccucuggaaugguucagaguaacuugagcccccucugcuagggaaagguuaaagauggugggaaagagagagaggcuuuugcugaaacugagcacugaggcuucguaguugaaagcaaagaaggacauguggcugcuauugaccauaucccagugucaggacuccuaguggguuugguccccaaggccuuggcugggccugccgaggcagccacaugcugcagcagcucuucccggaggcccccguaauguguccacuuauuauucagcacuuacuguggccagcugcucugccaggcugugagacaaccaugauccgaaugccaccacaguccuuguucccaucccccguggcuccugucacacuccuaccccaccucacaccagagugaggucuacggcagagauuauccacaagugaccuacacgugggauuuauuugaccccauuaacaaacugugagccagcauuuaaaaaucaagaggugucccaucaaaacccaaauuuuuggcuucucugaaaaaaugggaagaucugggaaggucgggcacacauucccacagggcaaaaaucagcuggagcugaagagcggcugccacuugagauggggcuggcaagcccacccuccccacagccuguccaugcucuguuggccucuccgcacugaagcagggggucaguugccucacuugccuuuuuuuggagggaggcugacaaagguccccgggcucucaaaccaguaaagcagggucuucuccugccuuuguuuuuuauggaagugaaaaauauucuuauuuuucuuuacucuuacuuuuccugccuggccccuguugacauuugaggguuuuugccuuuugucuagagaguuaaaacuggccccuaggcugggucucugaagcagcugaaggccaggccaucucagacaggaaggccugcucuucuggguacggggagggaacuuggagaagaucagcaacuuccguucagguauuucauggcuugcuccaacaccugggcuuccuuaguacccaguccauucuacagacccuggagagaggcaggcccaagcuuuaguuuagcugacauugaacccuaaauaaagaaguguauuucuucccagcgugaggaggcagugcugagugacgguuugccccuuugcuucaguuacgcuacaggcaggaccacagggguggugcuggauucuggggauggagucacccaugcugugcccaucuaugagggcuuugccaugccccacuccaucaugcgcaucgacaucgcgggccgggacgucucucgcuuccugcgccucuaccugcguaaggagggcuacgacuuccacucauccucugaguuugagauugucaaggccauaaaagaaguaagugcugcccccugggccuagggauggaguggggguugggagcauagcacccaggaccuuggugaccugccagugaagccaggcaaagcaccugccugggggucccuggugaggccuuguucuucccagccaggucuccccuacgucacacugacagauucgccuuccugacgugcugccaucuuguugggggaaagggagcugcuuccauuucuucaguugggugauggcuacauaggggcucaguauguuuuuuauaccuuauaugcaaauuacauaggguuugguuuuguuucauuuuguuuuguuucugagauggagucucgcucugucgcccaggcugcagugcaauggugugaucucggcucacuguaaccucugccucccggguucaagcaaucgcuugaauccugccucagccucccaaguagcugggauuauaggugccugccaccacaccccacuaauuuuuguauuuuuagcagagacaugguuucaccauguugaucaggcuggucucaaacuccugaccacaagugaucugcccgccucagccucccaaagugcuagaauugcagcaugagcuaccgcgcccacuccugguuuuuuuauuuuuauuuuuuuaacauccuugaagaagucauaauacauuuaaaacauuugucuuuguaaguaaacugaaaccuccugccaccuguggcuauagggaaaacucgagcuggguaggaccagaaccauaugagugguagaaggagaaagaugccugggccugggcugaacuuagguuguggucucagaccuaggauccaggggccaaguuuccaagcuugcccaucaggaagguggagcgguuaagaacucauaugcuaaaugccacccagugaaggccaacagagaccucacugccccugcuucugggcagcagcuauagugaccauuggggccaucacaacguuuagacagguuugugcagcagcacauuccuccccugggccuuugacuggaugugcaccagauuuccugccagccugacugucuugcuuggaucugcagagagccuguuaccuauccauaaacccccaaaaggaugagacgcuagagacagagaaagcucaguacuaccugccugauggcagcaccauugagguagguggccugccuucuuucuucgguccccuuagguccacaaaagcucugggcccaaccagaauucuccaucagggucuggagucuggcaggccagucccuuuacaccaagcuuguccaaccccuggcccaugggcugcacguggcccaggauggcuuucaguaaggcccaacacaaagucguaaacuuucuuaaaacauuaugagauucuuuugcaauuuuuuuuuuuagcucagcagcugucauuaguguuaguguauauuauguguggcccaagacaauucuucuuccaauguggcccagggaagccaaaagacuggacaccccagccuuacacccucucucuggagcagcagagcuccugagcaugaguggcccugucuccugcagaggaggcagccagaacuuugcucccucccgcuagaggggaggaagcuccuaagggauugucccacaucaguaugagauuaggaagugggaugguuagugccauccuucaccacaccugggugcaguguagggugaguuaccacucccuugaacccccauugcuaggaagacguuuccaugagcaaauaaauccauguacugaugccaaagaccucuuggcuggaaaaugccagagcgagaaggaaauauaggagccuccccucacuaguuuccaggaggccuaucuuuguuccuuuaagcccuugacauguagagucugucuugagccuggccuucauagccacccaguuacuaagugacgugcagaggggcgucuuccauucccacucccaaagggaccuuggucccagcuccgaccucuucagcuggcccuccuaccugcagauugguccuucccgauuccgggccccugaguugcucuucaggccagauuugauuggagaggagagugaaggcauccacgagguccugguguucgccauucagaagucagacauggaccugcggcgcacgcuuuucucuaacauuguccucucaggaggcucuacccuguucaaagguuugucucuucucuuggagcccuuccccuggaaguguucagcuccugcuggcuccaggcacccugagaauugacuugaaguucuccucuuugcccauucagguuuuggugacaggcuccugagugaagugaagaaacuagcuccaaaagaugugaagaucaggguaggagcaugguggggccuggccuggguggaacuaggcuuccauggacagagugccaccuggcguagcuucccucuagcuuugcccaagcucuucaagcagccauggcucuacaagcagcgccagguucccagccuguacacugacccugaggucuaggucagccacagggaggcugaguucucauucucccucuucacaccaaaggcaggcaguucuaauacccagaugaggcaggguacuagguagagggcccccugcgugaucuuucagggaaacuauaaucuuaagaggagacugacuuacuguugcugugcccccugcccagguggcuccccugucacacagucugacaccuuagugauaggugaaggagguuggcugucugaggagagcggggauccuaaaggaaggaguacaguucuugccauggagucugcuucucccugccccccccaauagucccagcuucccugggaccuguggggacuggaaaccugcuuccccagaugaguggcaggcuggccacagugcccuccagagaggccagagcuucaggcuuguguaaaauguauccccugccaugggcagaaagaggagcauuguagggaaagggagcgggagggcuggaagucucagauuccucuuucccccaccuuugcagauaucugcaccucaggagagacuguauuccacguggauugggugaguagcucuuccaggaguaagaacagaacaggaagugauggcacugauaaccccucagcacccucuaaagaaaagccugauuugguuuggccccaggggacugguaggcuccacacacagccacuucucucucacacaguuccucuggguuuccucccuccaggggcuccauccuugccucccuggacaccuuuaagaagaugugggucuccaaaaaggaauaugaggaagacggugcccgauccauccacagaaaaaccuucuaaugucgggacaucaucuucaccucucucugaaguuaacuccacuuuaaaacucgcuuucuugagucggaguguuugcgaggaacugccugugugugagugcguguguggauaugagugugugugcacaugcgagugccguguggcccugggacccugggcccagaaaggacgaugaacuaccugcaguggugauggccugaggccugggguugaccacuaacuggcuccugacagggaagagcgcuggcagaggcugugcucccuccucagguggccucuggcuggcugugggggacuccguuuacuaccacagggagacagagggagguaagccaucccccgggagaccuugcugcugaccauccuaggcugggcuggccccacccucacccccacccccagggugcccugaggccccaggcagcugcugccuccacuaucgaugccuccugacugcacacugaggacugggacugggguugaguucugucugguuuuguugccauuuugguuugggaggcuggaaaagcaccccaagagcuauuacagagacuggagucaggagagagcaggaggcccucauguucaccagggaacaggaccacaccggccacuggaggagggcaggagcaguccucacucugaauggcugcagaguuaauguucccagcccaguccccuuucgggggccuugggagaguuuaaggcaccugcugguuccaggaccucgcuuuccaucuguucuuguugcaaugccaucuucaaaccguuuuauuuauugaaguguuuguucaguuaggggcuggagagagggagcuugcugccuccugccuugcuacacuaauguuuacagcaccuaagcuuagccuccagggccccaccucucccagcugauggugagcugacaguguccacagguuccaggaccauuugagauuggaagcuacacucaaagacacucccaccaggcucuuucucccuuuuccucuugcucacugcccuggaaucaacaggcugguugcugguuagauuuucugaaacaggagguaaaauuuuucuuuggcagaggccccuaagcaagggagggguguuggagagccagugcccuuaagacuggagaaagcugcaauuuaccaaguugccuuuugccacuguagcugaccaggggacuagguuguagaggugggaaggcccccucugggcugaucuugugccauucuugaccuuggaccugcuugguuaaggagggagugggccagaccagagugccaggagcuaauggagccaggccugacuccuaggagugguccaaaggccuucagccuagauggugcaaagcuggggccagccugucuucaccggcacccucaccugugacaccaagacccaccccaaucccagacuucacacaguauucucccccacgccguccuaugaccaaaggccccugccaggugugggccacagcagcagguaugugugaaagcaacguagcgccccgcggacugcagugcgcuuaaccaacucaccucccuucucuuagcccaagccugucccucgcacagccucgcacaaaccacauugccugguggggcccaguguacugaaauaaagucguuccgauagacacgucag

SEQ ID NO: 18862 - RNA, 15575 nt, Homo sapiens
gggugucccagcuuccucuccccgcaguggccucugugacaagcagcagggaggacccugaccaccacaauggcagcacuucucuaaacccaggauaugggagaauagaguuaaaaaugcaaauuccugggcucucagagauucccgaugagucuaagcuaggccucaggaaucagcacccuuacccuuuuuuuuuuuuuuuuuuugagacagggucuugcucuguuguuuuguugcacaggcuggagugcagugacuugaucuagaccuacugcaaccucugccucccaggcucaagcaguucucccaccucagucccagaguagcugggaccacagguguggugugccccaccacgcccaacuaauucuuguauuuuuuguagaaacaggguuccgacauguugcccaggcuggucucaaaccccugagcucaggcaauuugccuuggccucccaaaaugucaggauuacaggcgugagccacagcaaggaaucggcccuuuuaacaagcucccaagacaugcuugagacuuugagaagcucugccgaaguggaugggggcaggaugucuuuuucaucuugccaccccaccuccaccccucccaaggccaaagccccaaguccaaaggaaguauggaccugagugguccccucucccuaugggguccaaggcccagcuagauuacauucugucucuaugccugcagcccugcacagugccuggcacguagugugcacucaaauauuuguggccugaaggagguaaacuuugcaagacucauagaaagguguuccuccuucguccucagcuaagagcacauuggcagaaccucaaagagaugccggggcccagguggcauggggcugggccugggaggcccugggcaaauauuugucaaaugaacccaaggccaagagcagacggagucagugcccgacgaacugacauucacaggccuggaaccagcuggacccaggggagcaaaaucaaggcaaggagggcaggggccccuccccacaccgacgccugaagaucccaggccugggggggauaggggaacaggcgaggcagggagugggacugcgccaucauguuuauuagaagguuggauuuuggugugugcucuagacagauacagaauaaauaccugcgccuugagaacaggaaguccacgauucauacaaagugcucacuacaggaaguugcugugucaaaauccaggcaaggacccaacuccgggcagccccuccucccugcugaccucaacaagggcugugcuauuguuuuuuauuuuauuauuuuauuucucuuuauuauuauuaauauuauuauuauuugcuuuugcuguggucacuaucauuggcaaaguuccuuuuccccuuuccuggacauagggguccugucuuuaaaagauuccacucugaggcugaaggugccaaaagcugcuugagaaguggccuuugaacuccgucugggaagauggugaggagaaggaagcaggagaaaucauucuugguuuaaaaaaauuuaaaaaaacaaaaacaaaagucgcacaaucuaaaggucauuccuuacucgaucagugaucaaacugcccaaaaggaaaacaagaggagaaacaagcccggggcccugggcguuccucccgggugggguaagaagggugggacccccaagcuuucagggaagccgagguuccuuccagccacgggggugugaaggggaaggaguagaggaaaaaaggagaaacagagagagagcucagcgccucgacacagacacuuucccaucuccagggccaccugccguccuggcccaggccagcucccacugucaccucugcguccaggagauucauaauaaaaaaaaaucaaaaacaaagccaaaaccaaaacaaaauccaaaaggaaaagaccuggggcaauggaaugaggaagaggggaggcgaggaagguagaagggcaggucucuggaugcauaacucccgagcccgggggcuggggaggaagauuccccagcgccccgccgccugcguggcguuagcucgucacguaguguuugguggacggcugcccauacacccuguagaaauccugguggccgggcugcugggaggcgucaagccagucucugaccgccaggcugggaagggacugggggacggagggugugggcgggagcgggugugaguacuccugcgagggcacuguccagggaaaguggccggagcggggguagggcugguggccgccaugguuggccacggaagaacaguaacaguuguccacagaacagacgagaaucuugcggccgccauacugggggagcaugggcugcugggcggcggagccauugggauacugcgauggggggaacacggggcuugagugcacugguugggcgccgcccggcagggccaccaagugcugcguggagcugcagggccccaggggcugcccagacuggcccucaccgcuggcugugcccgccgccccguacuggccgcccacagggcccgacgacgucucuaggaaacuggccucugggaaggccguugagugcuugcgcuuuuccgccccagagcugcucacgccgcaaggguacagggggacacucugcaggaagggcaccggcgugcugaaggggccuguggagaguuggggcaaaagucgccaaagcucccaccccaagcaacccaggccuccucucccuggguuggaccuggggaccauugacaccuagaggcccaagaauguuacaucucaggugaugcuugcuccucuaccauuaggagguacagaauaguuauauccccacuuuaagcugaagaaauggaggcuggggaggucauguugcuuacccacugucccacagcuacaaguggcaaagccuggauaugaggacaggucucccagacugggccacacugccucuuggagggaaggcuguggcgcugaaccccuccccaaaggucccugucucccuucggcggaacaccccacccucaccuucuagcauuuuccgcagcugcuucuccuucuuggccacuucguucaggaagagcuuggaguucagguggccgaucuuagugggggaaaggcugcugcucgugcaggucuggguccugggggcaguggacggggcaucugcugugaggaggcaucaccggugagcccgcccuaccuccccgccaugggccuggccccccugcccuccccaggaugugcccccgggagggcuagggcccucagcuuaccuguccaucaggauuuucacagacuugguguucuguuggggagagaaaagagucaagucaguggaaaaggcaguccagggagagcccggggagaggggaagacaaaagcugcccccccugagccucccccaggcuggguggauccucucauucuggacagaaaguggcagggguagggguggccauuugcggaagaagagcuaacauuuacugagcucuugccacgugacccaggcauuguaagugcuuucugugcauccauaacuucauccauacccgaggagaagggcucugcaggcccacacuguuuuagcucaagucuuuggggccagauguguuuuggaauuuggaauuuuuuggauuuuagacggagaauacagugccuguaucauauauuacauuaucauccccagcaagacacaacaaucuaauacagcaacauuucugcagcaaaauguuugaauuuucauacuaagcaagauaaagaccauaaauugccuaacaucaguuuaggucaauuuuugcuguuaaauuagaugccaaaauuuguuuaguuuccagagauguuuauaaauguggaauuguggauaaagaauaguagaccuguaucaucaacaccacuucguaggugagggaacaaggcccgggauguaccuaugacuugcccaaggucacagugcuagaaagagcaggcagguggauuugaacccaugcaugcuggcuccaaagguaagggcaugugagcuacaggugcaggaaacugcagaucucaauuuggaaauggcccucugggugccaccagccugguccugagcccagcccaccuucaugaagcugacauccuccgucuuaucaaagagcagcugcagggagcccagcagcuucuuggccuccugcaugcgcuccccgaggugcagcgccugcgcugcguucucgcugcagaacuuggccugggccuugucuaggaccuccacugucugccgcagguccucguccagcagcuggugcagcuucucguacugcagccgaacuuccuccuucaguugguucacuuucuccugcgaguacagagggcaggagugggcaggcagguaagcacuggaaaccuuugguuucccccccucuuacccuucucacauccuagaacccuaagucaccaggcugccccaggcucccaagggcaaggucugaccugccaguuccccacugguagcacagggcucugggccagcauccccuggcaccagugggcauccacgggcaguugauugaaugacugauggagugguucuggcauagggcuacacaaucaauccuuaguaaggaacucacccaaagcccugcgcucaagccacccccaccccgcagcauggccuugggcuuagcuaccuccaccaggcgcuugucugacucgaguuuguacagcugguccucaauguccugcucucgcuccuccagccgguccugcugcuucaugagcaucuucugcagggacauuugggugggaguaucagagggacuguggcuccaacccugacccaugcuucccucuacacaacacaugcauccuauggauccuuugacccgauggcaccaagccucugcuacccagccccuuuggcccccuccaaucccaggggccuauucccagcucuccccagaauagcuucccaugcauauuuauuuaucuuauuauuuuuuuagauggauucucacucuguugcccaggcuggagugcaguggugcgaucucggcucacuguaaccuccgccuccccgguucaagugauucuccugucuuagccucccgaguagcugggauuacaggcgugcgccacaacgcccagcuaauuuuuuuguaguuuuaguagagacgggguuucaccauguuggccaggcuggucucaaacuacugaccucaaaugaucugcccgccucggccucccaaagugcggggauuaugggcgugagccaccaugcccagcccccaugcauauuuaaacccugagcuuucugagggcagggcuacaccaaccucuguucuaaacacuuuuccuguacagauuuaucuaaucaucccaguaaugucaugagauaaguacuaucauuauucucauuucacagaagaggaaacugaggccuagagagguuaaguaauuuguccacagucacacagcuuguaaauagcagagcuugggcacaaacacaggugaucuggcagcaggguccguucuuacccaggcugugcugccucucccuggggagcauccucuaagagaugaguacccuaagaugcagggggucaaauucccuuccauagccacgugaaccucugucccaguccaaagaucucacuuuacccucgccuuacauuagggggcaucaggccagucacccccucccuuguucuuaagacugagagcuaggacucuggaguccuggcuagcucccucagcccccucagugggacccaggcagaaaggagauuugaggucuccuaagaccugaggccaggcugcuggaaggugcuggaccaaagugcucuucucagcucauaaucuccuguccccacaaccccuuuccugccagucacuccaucucuccugcccuccucucaccagauaugccucuuuagacaggcucucuccccugcucaaaaacucuccgugacuccguccuaucaacuacuuuagcauggcaaugaaggcucuuuuacacccugacucuuccagccagcugggcugguauccuguccccagcccuccacacauggaaacucccuguagcucuagguacauucuucugcagcccacagugccuccucccuccccugucuauucuucaaggcccaacugaaguccccacuccucuaggaaacuuuccaugaccccugcucugagccugugcaggucccucccuguccuggcuacgggguggggcugucccauucugcccucccucucagguugugcuguccaauaugguagccacuagucauauguggcuauuuaaauccaaguuaacaaaaaauaaaaaauaaggucaggugcuguggcucaugccuguaaucccagcacuuugggaggccgaggcaggcggaucaccugaggucgggaguucgagaccagccuaacauggagaaaccccaucucuccuaaaaauacaaaauuagcugggcaagguggugcaugccuguaaucgcaacuacucaggaggcugaggcaggagaaucacuugaacccgggagacgaaggcuguagcgagccaagaucgcgccauugcacuccagccugggcaacaagagcgaaagucugucucaaaaaaaaaaaaaaaaguuaaguaucgguuccucaugcaccaaccucauuucaagugcccaguaccuacguaucacuagucucagauacuaaaguuauaaaauguuaccaucaugcagaaguucuauuagacagcacuauucuggagucuucuaauugccucacaaaccauggucucaucucccuacaagacacagggccucuuaagaauggggauuugcugcugucuuucuccaccuuccuucagaggcaggccacacaaaggccugggcggccugagaugcauaacaaauucacucaauaagcccauggguuccauacacaaacuaaaauuugcaaagcagcucuguguaaccacagacauucacaguaacugucaugcugcaaggagugguucucuuucuuccucugugggggccucaaaguaacccuccaguucaaccccaugacucccaucccagccacucccagcuggcuccccgaagacaagcugccaucaaucccuuccucaccccgccagcccauuuuacguaggggcaaaccaaggcccaccacagacuucagccugacccuauuuuguguuggaggcuacuguggaaaaaaccagaacccugggagcaggaggaagugugggggugaggcuuucaccuuauaagcugggugcagggggcccacacacaacuuaaccuuucagugacccaggacaggaccucuaaaagaaucaggccugggagaccuugcccugcccccagaagcaccaagaggcacaggaaucugcugccagcccaagggucagagcccgacagcacacacagcaugagugggcaggcgcaggggcaccuggcacaaagcugcgcacgcacaugggaauaccuugccaccugagccccgagcccgccucagguaugcuggcgggcacagccagaggugcaaaggcacuugacccaacccccucacagggaaggcuggaccuccuggaggccccagacaauggcaagaggccuggcacgauggcgagguggccaggacacucugggaacaucaggcccacugaccuccccuggaacaauuggcccucaaauucuugccugcugguugccccaagcccacccucaggaggacagggccccccaggugcucuucagaguccaggcugaucccuccauccagugcccaggacaucugaaaggcccugcuggccccacacaucucacaccacaggcuuacugcauggcugcuucuccacgaccaaacccaccaggagcugguucagggaggauucaggugagucccaggggagggguaggaaagaggcagcuccaaggucccagcgcagcuuccuuggggacaggaacugagcuguccacacccaccccgcaggcuggugggugccccuuugccccaucccuugcugaugcccagggagugaccccucagggcacagcagagggagggccuuccuguccaguccuggggggguggggcucagccccuucccucuucuuccgggcuuuccucagccuccccugacagcacuucuacccugggagccggcagggucuucccaagcuucugucugucccaggcaaucugggugggacaccagcccaggccacacagucccuagcaggugggaggguuucauuucccccuccugcugcugaggccacugggcuccugucucugcugcagggguuggagugagagcaggaagaggaaggaggcuggccagggggugccagccagggaggaguccggggggcugcacuggucuggccugcucucccucagggccaacuccugcuacagacagcgccugggagaacagugggagcugcugccgcuucaagccugggaaacuggaaggaagaugggaaauaccugccugccguccccuucacgaccccaccccaguucaccgaaugagcaaaucagguugccaagacacuggaaaaugcuggaaaacagggagcagaggaagcaaggcccagaccccccaccaccagcagccuccuuuccaucccaacccccaccugccuccccagggaauggcuaagagccaaggccccacuucccaccugggaaaaacccauagcugagauccgaccagauuucccagcucaguucagagcaaguacucucugcgcaggcaggugggcuggaggcaccuuacacaugccaccgccccauccccccacagcagugcauggccuggacugcguacacuggagcaugcaggagcagagcagaguggaacguggccugggcuagaagcucuggaggccccaggccaccagggagacugggacuagguggggcccagggaggaccuucacacccccagcccugccugucgggccucaggccuuuggugaucugcccggggccuaugaggacaaaagcaugaagaaucaggagccgccauucccacccuccaccaccugggcccccacuccucagcuuugccgcugcuuccucugacuccccucccggccuggagcagcgaacccugagccccuacauuccugccccaggaaagccucaugucccucuggagacugacuggccaggccagcugccauuuuugaugccagacuagacugggcagacgggugaggcuuggggacucugggcuguauaaaaguuaauaaauaauaauaauaaaacccucaagucaaccuugaagagaaacaaggucaggaggaaacagggccccagggacugggacagaggcagucccuagguuuucagacaagaccauggcuagcuccagaagccccugugguggugggaggggcaagaagagggggcugggcagccucuuccugcuuaggucccugcccggccagcuccaguucuggcuccagcccccuucucagagccaccccauccuaacccuccccuacuccucccccuggucccuguccccaucucucccugggucucugcgcucauagcacucuccccuuuccucagaaaagcuucugccugcccuaaacccccuuuccaugccucaagccacugccuugggcuaucaugugaacugaaccccaggcuggggaaaccacaagcugcagagggaaggggcuccagggcaggcgccagggcaaggagagaggcagcaccucagaugcgagcccggcagaccccagagagggcuucccagcugcagaguggaauuagcuuuugccaugcagagagcagcgcucuggggcagcagaacaaagaggcgagagagaaagccccccuuugucuggcuuugaaugccaggccagccgggaaaggaaggcuuucccagagccagggaggaggccagccaggccagccugcucggcccggggcaggggcccaagccgggcuugcuccgccucgccagacugcacccaacacaacagcgcaggacccuuucagcuccugccuccaauacccgccacaggcucaccccaaggggaagcccaucuuucccuccuuuccccaacaaccccaccacagggggaagucccaggaccccugacaaacucacagccaccaagcaaggaucaccugagcgggcacucacacagcagcacaguagugcugccaacugucaggaaggcacacucaacuucaacucgcaggcgcucagcaagcccggcaggcagacacggcugcgcaacuagggacugaagucaggcaggcugcgccuucucagagacacccaugugagaugcaaaaagaucagucacauccaagauacacgacccagacgugcuggcuacacaugcacgcacacacacacacacacacaccugcagacagacacagaugugcagccacccagggccgcagaaggcagaguaauaauagugugugcaugacaggugccuggccaugucagcaggauccugggguaggggugggcagcugggccucugccugaggcucccuuucacgggcaacggagaaagccaagccagggccuccuuccacgaagacucggggguggccaaagaaggggccacaugaccgucacaccacaaacacacgugcgugcacacaaacacacacaccccugcaggaguauggucugcuguagggagagggagcagugagguuugcacugcuggagucaggcugcagccccagccucagcaccagccccaguagagccagcccucacucucacugcguacucagagacagauaaauggagaggaaacccaggauucccuccagggucucagggugaccccuccagccaccggcaaugugcacaggauacccucacuccaagcaggggcaaaccccacacuggcccaagcagugggaucuccucccccagagaaccucuucuugacucugaaccucugaaaaugcaaggaacagggcccuagcaacaugucuggccuugcucugggacaccagggacgaugcagaaacacaaccguaacugcacaagacucaagcagauacaccugcauagacacauacgcaccacauaccugcaggccccucacacaugcaaccgggccugcucuugggucuucuuuccaugucauggggggucaugagauaaggaugccccccagcucccaccaguccuucaaugcuuagaugaaccccugaaccugggggcuaggaggggucugaccacucaggacugccaggccugagcccaccuggauguccaaaucuugggcccuuagcuuccccacagccucaugggagagcacauuuaggaucuaggcacauccuagacaauggucucgggaucauccagugaguauccaggccucggcaauguggccgacacacuggcuucccaagggaagauuagggcaacaaccugcuugggccugauucugagagucccccuuguaguuccccaggauggauggaggaccuguuugcucuccugcugggucccugcucuaggcuauggcccaugugcaccuguggaugcuguaaguauaugagggugaggccaccagggagggguuaaucagaguuuccuauuucuagccaguugacaggcaugucagcaaucccccugggagggcagaagaggacgcacaagaagcagagccuagauuuuaaggcaggugccaggucucugugcuucugccccuguauccuggggaauucuguggcccucgcccacaacaccagcaaaggcccuuuaaggcagacucccuccgggaagagaaaaggggccaaggaagagcgcuccacccacucccccuguuuggccuacagagagugcagaggguucuuccauuuagguuccuaugguucacccccuccucucccuccugggagggcaggcagggccccuauuccuccacauucaauaagucaaacucauacuugagugacacugggcuacugaaggguuuccaaccccaguggccuggggcaccagaaagaaucaggggccuggggagggggaaccuggagaaggaugaggcucaggcugccacugcagggcacagcugcugaacgcacagaauugcacaucuggcccugaugcaacccacuacuucugagccugcccacaccaggcacaagaaagcacgcgcaugcacgcgcacgcacacacacgcacacacgcacacacacacccugcggaguugccgacaaaguucagugccugcuuccauccaauccacgagucuggaaaugaggggccugcuggggggcaccccagggaauacucugcaugcacaugccacccacccaccccugccugugcccugaacuguagagacaggagacaggugcauuggagggcgaagcacacagucucaaagacauucaaaaacacagacaccuaaagcuauccuccuacaccaagucagguauaaugacguuuucucccccaccccaauuaaagacaucccuagaacucagaccagcuacagcagcacugugggugcgggcaggcauccgcccaucgcccagguugcugccccuccccuguuccuuucagccacaucuccuuuccccuccucucauuuuccacugccaaucccaggacagaacuggacagcccuccuuucuccugccucugcacuuuucccggccuccucccccagcccuuccaucuuuauuaauagcagcagcuucccaauacuggggaaagugugggcugugccugcccugaacggggauggaggacacaggggguggaggacacacuuccuuuaagaaaccagaggccuauccuggcacacaaacccagggcuaguccauccgauuggaaacuaauuauacagcaaaucguauuugcugcccccgccccagccugugguggcccuccugccuuuuguugguuguauguguauguuuuuuaauugcuaaacagugacucauucugacugguccccccacacaggaaacagccccaucuccaaucaugcccugaacagagcuuccucauagccagccuccgcacuggccuccacuaaccuccagggauccccacccagagacacucccagucccaccagagugcagccuagcccccagauaucacacccaggccccaggccccaagguggggcuucagagaggacuccucggugucaggccaaccccuucauuuugguaugacucaacccugaaagccagaggacuggggagggaccuaggaggagcccccuccacugaaggggacggaaguauugccucaguccagcuccaaaaccaggcccagaggccugaggggggaggcgguuugacauuggccgcggccgcaggguguauacaaugggaggggacgcgguuccguaaucacccagccggcagcccaggggagccagcugccugaaaccagauuucaaggcggcucaaccuuaaacccacaggauucuuuuuccgucuuccacuuccccuccccaaaugugggagggcggcgagagggcugugcuaggcgaaagggccaggaugaugaagacagauacuugaaggcuuguucaugcggcccgugcgacacacaggcacacagggcagcgauucucacacagggagagccggcucucgggaggaauccaaauagcggagccgcugucggggccucgcuggcugcccaggcccuguccagagagacggccggaguucugcucucccucuggaaacuccccccacuccccccccaguguguuuccaauagcgcugaaaacuaacauggcugcuuuuguuuacuuccucauugguaugccagcaucauggaucaugucagccacagcagcggcaccgggacacucauuacauaaacagcagcuggagaggcaggaccggggucacugccucggugacuucccguagggccuacagcaacaagacugggggagggagcugcgcaccacagaaaagcaacacccagacucuaccccugacggucccacaccccaaucccauaaagcacucagaagacggacccugugcgcacaggugcgagaauguaccaaguagcgacccggggcccuucuucccaggacccuguccccaaacuuucagagaagaguuuggccaggggccacuggccugaugucacaagagucagccugucgggauggguggucccggggcgggagagaggaagggacugugugucugugugugugugugugcgcgcgcgcgcguaggguacuugcccggauuucauuccuucggaucuccacgucgcacaccgagugucccugaugcgcgccgcuguaguagcagcaguacuggcacacggccaccugcucggccucgcagugguagaggcgguaggcguugugcugcgggcagcuccaggcccgcacgucguccgccuccaccaggaggugcccgcgggcgguggagggcugcugcaggugcgucugcacgugggacuggcagcagggcgccucgcagcgcaggcagaccuucugcgcgggcagcggggggccgcggcggcagaacacgcagugcagcgccgccggcggcuucuccacgugcagggcauugaacuucuccacgauguuggugagcuucagguucuucuccaggcccggcuucugguuguaggccugguugcacucugggcagcguacgaggccgcuguccuuggcccacgccucgccgaugcagccccggcagaaguuguguuugcacggcagcugcacuggcuccacgaaaacgugcaggcagauagggcagaugagcuccuccucgaagcaguucuuccaauucuccgccauggcggccgcgggcagggggccggggcaggccuccccgacuccccagccccggggguccguccggagccgcuguaggcccaccgagccccgagcuccggccccagccggccccgacggucgcucagucagcagcgccuuccgcgugcccgccccccggaggagggagccgcgguccucacgccgcgcgcgcagcgggcugcgucuccuccuccucccgagcgccuagcgggaggcggcggacugcgccagggccgcggccgggacuccagccuuggaggggagcgccgggguccaaauuccauauaagaggccgccuccccgucggcgcggcuagggcaguggcggcccgcggccugcgcucguccccgcggcugacauuggggcgcgccccgcggcagacggagcuugggagcagcacacuucuuccggcggcggcggcagcggcggcuccugccuggcucgucggcgccgcaccucccucgcaggggccggagcccggggucugcggggccaggaggcgagggcggccgcgccgagggcugcuagauccggacggggcgggaggggcaggccggcgguccccgggccacggugcaggcgucccccggcuggcuggccgggcgcgggcugcggggcgcgggcgggccgacuccggggcgcugcgugcgcgcaggggcagucauucagaugaaauuccaguccccggccagagacaccagcccgccucugccuuccuccucccuucacaaauagaaacggaagggggagggagagaaguggaaaaaaaggcaaccggc

SEQ ID NO: 18863 - RNA, 3386 nt, Homo sapiens
uuuacaaaagcggugguaggggggcgcgggaugugcuuguagaauacaaaagagguagagaaacauuaaacauuuugaauguuuuaaguuucuuuuuuuucuuuuuuuuuuuuugauacggagucucccugugucacccaggcuggagugcaguggcgcgaucucggcucacugcaagcuccgccucccggguucacgccauucuccugccucagccucuccgaguagcugggacuacaggcgcccgccaccaugcccgguuaauuuuuuguauuuuuaguagagacgggguuucaccguggucuacgaucuccugaccucaugcuccgcccgccucggccucccaaaguacugggauuacaagcgugagccaccaacgcccggccugaauguuuuaaguuucaaggaaaagaccaauuuggcagcuacucugcuaccucgucaccuccaggugacguugggaguacuggggagcuagguuuccagaacuuuuugcucuugagugaccuaagacccuagcagaguuuggucagugugauuaagaaugagccucugugggucuguuuaggaugcuugcccccucccauuuccuuaacuugccugaauuccugcugggaauacagauucggggcccuucccacucuguaaauaugggaaaaggucuaggaaguauauacuccuagcaauaauauguagggguucuaugacuaggaaauuuggggaacugucccccugaccgcuccauccguaacuucugcacaccuuuugggguacgccgccgaccuggaaagcguugcagggcgcucaugcugcccgcagguggcgccacgugaucgcgagccgcagagagcccguacccuaggagucucgaggcgcgaggacugcugguccgcagcugugccggggccaccgacgccgcuuaccccggcggagcgccgcgcagguggaguuggggacagcggccggugccccggcuuuuuaggcugugugcaucccaagccgccucuaguuggcuucucgggcuuccggggcaggagggcgcgcggcuuugugccuacgaauugagaacuggagagccaguaaccggugcaccgggaaccugccgccuugcgccgcagggcuuuaguccaaaccuggccgguccaggcuccgggaucuacuacaggggccccuggggagcgcgggccccagggacggcuccuucccauuggcagcaggacggaugccacgccccuuuuucuucagcucucaucuuugacuggcucucgagucccagauggccacgcccccuccccucgcacauacacaagagucacgcgccuuucaguuggaaacuuggcgugcagacggggacgguggcucucgucgccccacccacuuaccuugccauugguccgcggagcggcacacggucacgcccccauuccagcccccuggcugggagggcgggcacccgcuugugauuggcuggucggccugccucucgcgggagcagccggcgcuccucucccucccucuuucccucccgcgagccucgggguuccucagcuggcugagguggagucagugucagucagggaggcgaacugcugagcacuggccgcggacgcuccguugcagucucgcccaggggccgguaccugcgcucgcgccgccggguugaaaggaugaagccgcagcuggagcagccacccuaugauuggcuguggcgcuugugaacccaaaguaaagauggcgggcgggcaggcagccgccgcacugcccacuuggaagauggcggcgcgccgcagccucagcgcucgcggccgggggauccugcaggcggcugcggggcggcugcugccgcugcuccugcugagcugcugcugcggugcgggcggcugcgcagcggugggcgagaaugaggagacggugaucaucgggcugcgacuggaggacacgaacgacgugucguucauggaagggggggcgcugcgggugagcgaacggacccgggucaagcugcggguguacgggcagaacaucaauaacgagacguggucccgcaucgccuucaccgagcacgagcggcggcgccacagcccgggggagcgcgggcuggggggccccgcgccgccagagccggacagcggcccccagcgaugcggcauccgcaccucagacaucaucaucuugccccacaucauucucaaccgccgcaccucgggcaucaucgagaucgagaucaaaccgcuacgcaagauggagaagagcaaguccuauuaccugugcacgucgcucuccacgcccgcccugggcgccggcggcucgggguccacggguggcgccgucgggggcaaggguggcucggggguggccgggcucccgccgcccccgugggccgagaccaccuggauuuaccacgacggcgaggacaccaagaugaucguaggcgaagagaagaaguuccugcugcccuucuggcugcaggugaucuucauuucgcugcugcugugccugucgggcauguucagcggccucaaccuggggcucauggcccuggacccgauggagcugcgcaucgugcagaacugcggcacggagaaggagaagaauuacgccaagcgcaucgagccggugcgcaggcagggcaacuaccugcugugcucacugcugcugggcaacgugcuggucaacaccacgcucaccauccugcucgacgacaucgccggcucgggccucguggccgugguagucuccaccaucgguaucgucaucuucggagagaucgugccccaggccaucugcucccggcauggccuggcugugggggccaacaccaucuuccucaccaaguuuuucaugaugaugaccuuccccgcuuccuacccggucagcaagcugcuggacugcguccugggccaggagauaggcaccgucuauaaccgggaaaaacugcuggagaugcuccgggucaccgaucccuacaacgaccucguuaaggaggagcugaacaucauccaaggggcgcuggagcuccgcaccaagacgguggaggacgugaugaccccacuccgggacugcuucaugaucaccggcgaagccauccuggacuucaacaccaugucugagaucauggagagcggcuacacccgcauuccaguguuugaaggggagcgcuccaauaucguggaccugcuguuugucaaagacuuggccuucguggaucccgaugacuguaccccccugaaaaccaucaccaaauuuuauaaccaccccuugcacuuuguuuucaaugacaccaaguuggacgcuaugcuggaagaauuuaagaaaggugggaaauuuuggucucuuucauuggcuugcucuuucucucuccauccuccucccuacuugaguccucu

SEQ ID NO: 18864 - RNA, 3386 nt, Homo sapiens
agaggacucaaguagggaggaggauggagagagaaagagcaagccaaugaaagagaccaaaauuucccaccuuucuuaaauucuuccagcauagcguccaacuuggugucauugaaaacaaagugcaaggggugguuauaaaauuuggugaugguuuucagggggguacagucaucgggauccacgaaggccaagucuuugacaaacagcagguccacgauauuggagcgcuccccuucaaacacuggaaugcggguguagccgcucuccaugaucucagacaugguguugaaguccaggauggcuucgccggugaucaugaagcagucccggaguggggucaucacguccuccaccgucuuggugcggagcuccagcgccccuuggaugauguucagcuccuccuuaacgaggucguuguagggaucggugacccggagcaucuccagcaguuuuucccgguuauagacggugccuaucuccuggcccaggacgcaguccagcagcuugcugaccggguaggaagcggggaaggucaucaucaugaaaaacuuggugaggaagaugguguuggcccccacagccaggccaugccgggagcagauggccuggggcacgaucucuccgaagaugacgauaccgaugguggagacuaccacggccacgaggcccgagccggcgaugucgucgagcaggauggugagcgugguguugaccagcacguugcccagcagcagugagcacagcagguaguugcccugccugcgcaccggcucgaugcgcuuggcguaauucuucuccuucuccgugccgcaguucugcacgaugcgcagcuccaucggguccagggccaugagccccagguugaggccgcugaacaugcccgacaggcacagcagcagcgaaaugaagaucaccugcagccagaagggcagcaggaacuucuucucuucgccuacgaucaucuugguguccucgccgucgugguaaauccagguggucucggcccacgggggcggcgggagcccggccacccccgagccacccuugcccccgacggcgccacccguggaccccgagccgccggcgcccagggcgggcguggagagcgacgugcacagguaauaggacuugcucuucuccaucuugcguagcgguuugaucucgaucucgaugaugcccgaggugcggcgguugagaaugauguggggcaagaugaugaugucugaggugcggaugccgcaucgcugggggccgcuguccggcucuggcggcgcggggccccccagcccgcgcucccccgggcuguggcgccgccgcucgugcucggugaaggcgaugcgggaccacgucucguuauugauguucugcccguacacccgcagcuugacccggguccguucgcucacccgcagcgcccccccuuccaugaacgacacgucguucguguccuccagucgcagcccgaugaucaccgucuccucauucucgcccaccgcugcgcagccgcccgcaccgcagcagcagcucagcaggagcagcggcagcagccgccccgcagccgccugcaggaucccccggccgcgagcgcugaggcugcggcgcgccgccaucuuccaagugggcagugcggcggcugccugcccgcccgccaucuuuacuuuggguucacaagcgccacagccaaucauaggguggcugcuccagcugcggcuucauccuuucaacccggcggcgcgagcgcagguaccggccccugggcgagacugcaacggagcguccgcggccagugcucagcaguucgccucccugacugacacugacuccaccucagccagcugaggaaccccgaggcucgcgggagggaaagagggagggagaggagcgccggcugcucccgcgagaggcaggccgaccagccaaucacaagcgggugcccgcccucccagccagggggcuggaaugggggcgugaccgugugccgcuccgcggaccaauggcaagguaaguggguggggcgacgagagccaccguccccgucugcacgccaaguuuccaacugaaaggcgcgugacucuuguguaugugcgaggggagggggcguggccaucugggacucgagagccagucaaagaugagagcugaagaaaaaggggcguggcauccguccugcugccaaugggaaggagccgucccuggggcccgcgcuccccaggggccccuguaguagaucccggagccuggaccggccagguuuggacuaaagcccugcggcgcaaggcggcagguucccggugcaccgguuacuggcucuccaguucucaauucguaggcacaaagccgcgcgcccuccugccccggaagcccgagaagccaacuagaggcggcuugggaugcacacagccuaaaaagccggggcaccggccgcuguccccaacuccaccugcgcggcgcuccgccgggguaagcggcgucgguggccccggcacagcugcggaccagcaguccucgcgccucgagacuccuaggguacgggcucucugcggcucgcgaucacguggcgccaccugcgggcagcaugagcgcccugcaacgcuuuccaggucggcggcguaccccaaaaggugugcagaaguuacggauggagcggucagggggacaguuccccaaauuuccuagucauagaaccccuacauauuauugcuaggaguauauacuuccuagaccuuuucccauauuuacagagugggaagggccccgaaucuguauucccagcaggaauucaggcaaguuaaggaaaugggagggggcaagcauccuaaacagacccacagaggcucauucuuaaucacacugaccaaacucugcuagggucuuaggucacucaagagcaaaaaguucuggaaaccuagcuccccaguacucccaacgucaccuggaggugacgagguagcagaguagcugccaaauuggucuuuuccuugaaacuuaaaacauucaggccgggcguugguggcucacgcuuguaaucccaguacuuugggaggccgaggcgggcggagcaugaggucaggagaucguagaccacggugaaaccccgucucuacuaaaaauacaaaaaauuaaccgggcaugguggcgggcgccuguagucccagcuacucggagaggcugaggcaggagaauggcgugaacccgggaggcggagcuugcagugagccgagaucgcgccacugcacuccagccugggugacacagggagacuccguaucaaaaaaaaaaaaagaaaaaaaagaaacuuaaaacauucaaaauguuuaauguuucucuaccucuuuuguauucuacaagcacaucccgcgccccccuaccaccgcuuuuguaaa

SEQ ID NO: 18865 - RNA, 13210 nt, Homo sapiens
cugccugccgcaccucuccuuucuucuguagcucgcguugaagccgcacguccggccccgaucccggcaccaugagcuucggcucggagcacuaccugugcuccuccuccuccuaccgcaagguguucggggauggcucucgccuguccgcccgccucucuggggccggcggcgcgggcggcuuccgcucgcagucgcugucccgcagcaauguggccuccucggccgccugcuccucggccucgucgcucggccucggccuggccuaucgccggccgccggcguccgacgggcuggaccugagccaggcggcggcgcgcaccaacgaguacaagaucauccgcaccaacgagaaggagcagcugcagggccucaacgaccgcuucgccguguucaucgagaaggugcaucagcuggagacgcagaaccgcgcguuggaggccgagcuggccgcgcugcgacagcgccacgcugagccgucgcgcgucggcgagcucuuccagcgcgagcugcgcgaccugcgcgcgcagcuggaggaggccagcucggcucgcucgcaggcccugcuggagcgcgacgggcuggcggaggaggugcagcggcugcgggcgcgcugcgaggaggagagccgcggacgcgaaggcgccgagcgcgcccugaaggcgcagcagcgcgacguggacggcgccacgcuggcccgccuggaccuggagaagaagguggagucgcugcuggacgagcuggccuucguacgccaggugcacgacgaggagguagccgagcugcuggccacgcugcaggcgucgucgcaggccgcggccgagguggacgugacuguggcuaaaccagaccugaccucggcucugagggagauccgcgcccaguaugagucccuggccgcuaagaaccugcaguccgcggaagaaugguacaaguccaaguuugccaaccugaacgagcaggcggcgcgcagcaccgaggccauccgggccagccgcgaggagauccacgaguaucggcgccagcugcaggcgcgcaccaucgagaucgagggccugcgcggggccaacgaguccuuggagaggcagauccuggagcuggaggagcggcacagugccgagguagcuggcuaccagguaagggccggggcugggcguggggaggggugcccugcccucuuccgcgcguacccucuuccucugguaaaacugggccccaggacuuaaggggagggcaaaagagaggagagaagagccgcggcuggaggcgcugguuaacaaaaaacccuggagucuuuaauguuaauuuuagggaacgccccucauuuaugucccugccccagcccuucaaacaaagaagcccuuaaauuuauuugagguucgaaaacccaacucugccugucugucagcaagcgggccuacacacaccggcgacccggagaacagugccccacccaaaguaagacugagcccaacggggcagguuacgugggcggugcugucucggcuaucuggcuuguuugguugacuuugaaaagcuuucugugcgcccuagaaguuauuuauggaguauggucugcuucagggcugaaggaagaaugcgauccugaacugggaagaguccuaucccauuuucuugacuuucgcgcuccaaaaaguagagauugggagccaacaagcugagcgaugcuugagcuaguaguaaccacccugcucuacccaccuccccaacacacacacacacacgauucccuuguccaccagcacacacacacacacacacacacacacacacgauucccuuguccaccagcugacauuuccuccuuaagaaagcguucgccgguuggcaaaacgugaaaggucggggcgcuguccacggugcugaucucgaguucuucccaucucagaaauuaugucucuccugucucgugucccaguuaugaaucucuaggcaauuaacugcuuugauuuuuuuuuuccugcaacaccaacacaucagucuuggcuaccugcaaucaaaggucaccucauagacaacaucaguuuuggcuuucauggauggcuuagcacuaaacaaaaaacacuuaauuugcucagcagcugugaggucccacuugaaaauuccuguuuuguuaguauuuuuuucauuguaagugcaugugauaagucacagagaugguuuuucuuuguucuaguguauguauuuuuuccauauuucccuguccucuaagcuccugugaugguauugauuggcuauuucuucccaacaaaggccacugugucuucaguuuuacuauauaagaaauucugggauuaugaccgcaaauggcacagaggcaggggacaggguaaauggaagguguagaaaagaauuggaauagugugguucgguuucaagguacaauaaaagcuccuuugaauagaaugacuauaauucagaaacuugcaauaauucuagcuaggauuaaaguuuacauuuggugagauuaauagggcuuggaacauugguaaaauagaaccaagaaaggaaugaaaucucaaaaguaacauuuuaaucagaagcuaaagaauucuuauugaugugcagguauuugcuguuuguuacaauaacuuccuuugauaaaggaaaaaagccugcuuggacuguuuagguuaguuugguauugcauuaucauucaaauaaguacuuccauuucugccucaaaauccauaacuugaacuuuucauuauguacccuaaccccuggauggccugaauuaaucacauuuggcuaauugagacuucauuuuuuucuucuagaagccuccaaguacgagcuagguggucuucuggagggcuagcccaguauuucuacaaaaaaaggauaacuuacucagagcugccagcugaauugggcuucuccauuuucucugcuuguuauagcccauacauucuaagaaguagugacaguuuugccuggcuuguuugcuguaaaaggcuuucaucauuagacaaugguagcgucauccagacauggucuacaggaaacaaacaaaaaacaacaacagagaaacugcagcaucugcagcucugcggugcugcccccaucagcuugagccuuuagagccacagaggaccugcugaugggaguggaagaggaggucagacaacagagagcugguucccuacuccuugggaccuaaggcuaagguggagcucaagucuuaccugcagauccuaacggccugaugccacaagggugucucugacuguucuaacaaucuuagcagugcugaccaaggugaaaagccucccuuucuacagugagauuuagccauuguuuucuugcccucucaucucauccccaccuuucacugcaguaaugggaggcuguucuccuucuucugcuacagagauuagugguagggccauuuuucuuuucaaacuuggcacccucuaugaaacauaggaaggccccauuaaagucccaucuucucugccccagauagcugauagccuauuuaaggagagaaagcuucuuacacuuuugaaaggguaaaaaaugauucacggugacacaguaaguacacaauaguggaugagagagucugaaucaggcaagagaagagauuaggaagagcuaaggcuauugucuucaaaagccaaaugcaacuccccucugcauaaaaagcugaugggguuuccauuucugacauagggcaaugcuggugccuacauagccacuucggcaccauuagaguccuaguucuguuaaagauguccaaagacauucuuggaggguacucagggucucagaccucuacuguggucagucuuggaaaguugaagcuuuccuugaaagaccuugcugaaugaucaagaucaccgcagguuaaugcucuccagggagacaagccaagucuucucuuuuuucuccauuaugagauuggaguacagccuaauuaaauagcaggaaggggcuggccccuuggagacuggaggugacaguggcugcauauaaauccauagcuugauagauccauuucuaaaauuagcuacauuugaucuuuuuuaagcucuuccaccugguuuuuguuucauuuuguuuuguuugccccucccuaucuuacuguauuacugucaccugggcuaccaugauagcaucuuuauagaaaaaaauuuaaacuaguggauccuaaacccagugacacucuaaggucaauugggggcuuaaaaaaauuaucaggcccacucccaaagauauggauucagcaguucacagguagggcccgggaauaugcauuuuucaauaaaagugcugcauccuguugguccucagacugacuuuggaguacauugaucuaaaccacuucuuccaguaaaguaguuuacggagauacguauaauacaggauuuucgagugugguggaggaaagaaaaagauggggacaaaggaaagguaggagugagaauaaagcacgcauggugaaccacaaauaaaaauccuccguccccacucaaguugauuaugcagagcaguaauucuaaauagccucuuucaaucagacuguggggcacucacuacugccucccugacccagggcccccaaacgugcugaaauccacagcucugucguucuucuucaccacugcagauguuaguguggccauucauuucucuuacuccacccggcauccuuccagccacgggcugcgaugcucagacgagcuaagacgaugcucagcguuugucuuagcuccuccaggagagaccccagcuggagcugggcgugccgcucuccgguucccucaggcuaagccggcagcagcugcgugguugggggaggggacagacugcagcgcucugcucagaucucgagcuggaggccaucuuuggcagggcuucugaagggcaaugcaagacacagccugauguggggaggagagcacaaacaaagagaccagacauugaagagcaaucaauggucagaacacagcacacuuccuucugaaaggagcaaaguugugcuuuucucuacagugaucuguaaaauagauauaugaaaucugcaacauagaaguucaaggaaaucucaucugucuagaacucagcuccccaaccaccucuuauucagaaaacacagcugugaaacaaaaauaauguuuuaagcaaggaccuaauuaaccugcugaugagacauaucaucuaucucuaagccaaacauuaggaacuuggcaccucuacugcccccagccuauucauucuuaacacgauuucaaaaugcuuuuuuauuugguuucaagacugcagcaagauggagaauggggaccacuggagucaggcauuguuaagaaugagcagcagcagauccguucaucuuucagaacaaagaaaaucaaugagcaucaacacuaauccaaacaccgcacuuuggggccauuuaggguagaauuaaacagccugauauaccucgaaugaccuaaaagaugucaccgaauuauuuuuaaaauugauuauuaucaugacccuuaauugcuguggaagguggcauuauguuuaguguccugauugugagugguauaagccacuuuagaaaggcuuuuuauucaaaauuguuauuaaaaaaaaaaaucuggugcuuuaagguauaugccuccaacuauccaauauuaaaguguuguuauauguuacuuuucguaguuaucuaagggguugguaauagugagggcuugugauuaauuugucuauaucaucaaaaggauagagggccaugugguaugauauuaucaagaauaaaaaucacuaacauuuauugaguucuuccugugugccaugcuguucugaugccuacuaauuuaacagauaauggacucaucauauauuaauguauaugugagauauauuaaauugaaauccuaauuugaggaucucagaacaccuuagaaaaagaguaaacauaacuuuccguaugcagaaguagaagauuggaaggaacuaaaauguagaaaacuggcugagguccaauggauguuaguggcagagcaaaaacugcaacccaaguuccugaugaaauccuccucuuaucuucauauagcauuccuccuccuucuuugcauaaucauauuuucuucuuucuccuuuuucccucacucuagacucuuuucccucuuaccacaguaauauugauucucuugucaguagcuagagggucuaugucagugauucuaugucaguagcagaauugauuauaaccucaaauaggaacuaucagguaaaauuucuugguaaaaaucucuuuaaggccucaugaucucuuaacacacuuugaaauauaugcaucacgguccaguauaauacguauuuuuccuacugacugucauuccuuguucuguacccaucagucaauugagacuccucuuugcaguauuccugucaauauuuauagaacagguaggugguaugaauuuuaauucugcaaauucucuugauuuggaaguuuguacccccugaugucucagcccuaccuuucaccauugcuuuaucauucucacacaaggggaguuucaagggccugucaacacuuacuuucuugagguuucugauauguuuaucugcaucacuguuucuuuuuuuuuuuuuuuuuuugagauggaguuuugcucuuguugcccaggcuggagugcaauggcacgaucucagcucacugcaaccucugccucccagguucaagugauucuccuaccucagccuccagaguagcugggauuacaggcacacgccaccacgcccagcuaauuuuuguauuuuuaguagagaccauaguuucaccauguuggccagcauagucucagucucuugauugaccugaacuccugaccucaggugauccacccgccucagccucccaaagugcugggauuacaggcaugagccaccaugcccggcccugcaugacuguuucuuaaaaauaacccccaaucauugugucuuuuuuuuuuuuuuuaagacggggucuugcugugucgcccaggcuggagcacaguggcgccaucauagcucacuucaaccuccgccuaccgggcucgagcaauucucucagcucagccucaagugauucgccugccucagcuacccaaagugcugggaugcccuagagauguuuucuuguuaucgcaacugggagagggaaguaugugcuucuggcaucuagccagggauguuacuaaauaucccgcauuucacaauaacaaauaauuagccagccuaaaacaucaacacugccaaaguuguaaaacucuguuauagaggaaagcaacagaaaauaaacuaguauaaaccaguaaauugccggggccggacacugugacucaugccuguuaucccagcacuuugggaggcugaggcgggcggaucacgagguuaggaguucaagaccagccuggccaacauggugaaaccccaucucuacuaaaaauacaaaaauuagccaggugugguggugcacaccuguaaucccagcuacucaggaggcugaggcaggagaauuacuugaacccaggugguggagguugcagugagcugagauugcgccacugcacuccagccuggguaacagagcaagacuccaucucggaaaaaaaaaaaaagaagaagauaauuucauauaaugguaagagcugagagcaggguggcugcauucaacugagugcuuuuuuucuaauuugcacaagguuccugcaugggccaguagcugcucuggcuuaagguaaaauaaagugcuggguuggucgaggauggauacuuaaauuggaugcaaaugaagaccugucugaggagaggacauuauauuuuauuuuauuuuauuuuauuuuauuuuuugagauggaguuucauucuuguuguccaggcuggagugcaauggcacgaucucggcucacugcaaccuccgccucccagauucaaacaauucuccugcuucagccucccuaguagcugggauuauaggcaugcaccaccacgcccggcuaauuuuuguauuuuuaguagagacagaguuucuccauauuggucuggcuggucucgaacucccaaccccaggugauccucccgccucagccucccaaagugcugggauuacaggcaugagccaucgugccuggcaggagaggacauuugaacugaaucuuuuuugagacagaguuuugcucuuguugcccaagcuggagugcggugguacgaucucagcucacugcaaccucugccuuccagauucaagcgauucuccugccucagccucccaaguaggugggauuacaggcgcuugccacugcacacagcuaauuuuuguacuuuuaguagagacgggguuucuccuuguuggucuggcuggucucgaacucccgacuccaggugauccuccuaccucagccucccaaagugcugggauuacaggcaugagccaucaugccuggcaggagaggacauuugaacugaaucuuuuuuuuuuuuuuuuugagauggaguuucgcucuuguugcccagcuggaaugcaguggcgcgaucucgucucacugcaaccucccccuccuggguucaagcgauucuccugccucagccucccaaguagcugggauuacaggugcaugccacugcacccagcuaauuuuuguauuuuuaguagagacggaguuuugccauguuagccaggcuagucuugaacuccugaucucaggugaucugccugccucagccucccaaagugcuaggauuacaggugugagccaccacacccgggugaacugaaucuucuaugacaaggagucggccauguaaagaccggcauuuuagauagaggaaauaacaagccugaagggccugggacagcaaugaacuugguauaguuaaggaguaaaagaaaagaccaggcugggcaugguggcucauacauguaaucuaagcacuuuaggagguaaaggcaggagugucucuugaggccaggaguucaagaccagccuggacaacauaaugagaccucaucuuuacaaaacaaaaaucuuuuuuaacuagccaggcaugguaguguacaccuguuagucccaacugcuugggaggcugagacaggaagaucgcuugagcccaggaauuuugaggcugcagugagcugugaucacaccacuguacuccagccuaggcaacagagcaagaccuugucucaaaaaaaaaaaaaaaaaaaaaaaaagaauuccuucuggcugcucaaggacuauaaauauauaaauauaaagcgauuucucuuccaugccucgguguuuuaaaaauucuguggaguauuucugcuuucuccuuaccuauaauguaaaaugcucucaguaaagugacugauuagcaggcuucuaggaaaucaucaaaaugaauggaggcagagaggucuuccuggaaagcucucugugcuuuccacauucggaauuuucugaaucuaagcugcuaaccugaggcuuuggguuuuggaaagcacaugcuacaacagaguuauuuagcagcaacacaacaagcaagggagggaugguaaguguaaaaaaaaaaaaaaucaucuccauguucaguucagaacuauaugccguguggcuauccugaaaagggcagguguucacuugcccucuggguaaaaguucccaguccucaccaugaguccaaaucuccuggggaccuuuaugaaaaaaaugcaaaugcugggaccccaccccagaaccagugaaucuggaucuggacucagggacagaccuggauauaagcaaguuauaaguucauuagaugauuuuaauguguagucagggcugggaauccuugccuucuggaaaucuugaggaauuucagcugguuuggccuaacuauuuuggauauguuacuuuucaggauagcauugggcagcuggagaaugaucugaggaacaccaagagugagauggcacgccaccuucgggaauaccaggacuugcucaaugucaaaauggcucuugacauugagauagcagcuuacagguacugcaaaggaccugcuuacccgaguaaauccagucaccuaggggcaaugcugcccaaauaaguggaucuagucucucuggcuucugacuggugagggagggaagaagggcaucacuggccccuuucaggugagcugacugcucugucccucuacuuagauauaauccagcuccaucugacuagucccagaguauucuguguaccucugaaaggauuuaaggggauaaugugaguacacagagguuaaaauaaaaacccaugagacucguaacuuuaaaaauaggguuuggggccaagugcaguagcucacuccuauaaucccagcacuuugggaggccaagguggguggaucacuugagaucaggaguucaagaccagccuggccaacauggugaaacccagucucuacuaaaaacacaaaaauuggccaggcgugguggcacacaccugcagucccagcuacucuggaggcugaggcaagagaaucgcuugaaccugggagguggagguugcagugagcugugaucaugucacugcacuccagccugggagacagugagacucugucuaaaaaaaaaaaaaaaaaaaaaggauaauuaaaaacuauuaagaguuaugagaaacaugguuuggggccacucuuuuauaagacuguuuucgucacgcugauaaaaaucuguuaucugaaacagugucauucacugguuuuuguuauugcugguucuauucccuuuguacccguauacacugaaaaaguacaaaucucaaauccagguugaguaagacaguuucuaccaccuuuguggacaucucaccuccuuaucccuauugcagcuaagguguuacuuaggaaaaguacuucucccuagagcuuuguugcuaauugccaaaaaugggugugauguggccaaguggaguugcagguuuuccuccuggaauauauuugugaacaggauagguuuuccuuugacaaugcuuuaaacauagcuggugcugaaggggggugugugugugcgcaugcguaugcacgugguccaacccuuugagcuuugaaauuaaauauuuauugguuucaaucucaugaagaaacuccaaaguccuuuggaaucucucucaaaugaaucaggauuggaggguugaguucugggggggaaaaguuauugacuuccuaagaguuuuucucuguugaauuuacaggaaacugcuggaaggcgaggagacacguuuuagcaccaguggguuaagcauuucggggcugaauccacuucccaauccaaguuaccugcucccaccuagaauccucagugcuacaaccuccaaagucucauccacugggcuaucacuuaagaaagaggaggaggaggaggaggcaucuaagguagccucuaagaaaaccucccagauaggggaaaguuuugaagaaauauuagaggagacaguaauaucuacuaagaaaaccgagaaaucaaauauagaagaaaccaccauuucaagccaaaaaauauaauuccauugcuuugaaaaaguuaaugcuuaagagggaaugauaugcauuugacuuguuaaacagccuauuccugaacuauaacaccugccaccacuauaaaaugucuucaaggcuucagucucauauuuaguauugaauacuuacauucucuaauaagaaaaccaccccuuagauugaaguaaacugcaguccuggagcaaucacagaugaguuaucuaagaauacagcuuucugaccuucagcucacgcuucacagugaucgaugauucaggugcagaggaaguacaaacuaaggugcuaaaucugcgaucaucgucauuugcugugaacugaaauuaaaacuauucaugcuacccagccauuacccagcuaaauaaucuuacucuagauaccuaaaacauaagaucacugccagagauaaacuaaugguccacacccaauuccacucugauagaauuauuucacaaauaauagguguuuguuuaauggacacuuuucaccuccuucaauuccauauauccuuuucuucuauguaggaaaaaaauagucuaguguaguauucuucccuuuuaaacacauuuugguucuucucaaaagaacuuacccccauucgcgcucugcucaguggguaaaauuagaugcauguugaccaugucuaugauucguguaauuacuuaucccugcccauuucauauucuuucaauucuguagguuaaaaaaauggcagugaugaauuuuaaggguuucccccaacauauaaaauaaugcaaagaaucccuagacuuuaggcuuucagcuuacacaaaucuauuuaauuaggaaaaaaacuauuaaggauguagcuuuucaccuuuacuuuagaagcacaguaaauaucccaaacugugaugaagccgaccuuagauuuaguaguguaagcuagaagaagugaguguuucuaugaguggaaaaagccaaggugucauuuaugugucaguucauuuguggugauauagaauuagcuuuuucauccccuuacccuuagaauccacguauuccccuucccacuagccuaggucauaaagaggcguugcuuucacucuccuaugccuuuuacgagugcuaaguguaggauauuuugucaccagaacacaaugcuaccgccccaaaguaaaagaaaccacuucuggucaaucaacacuaccagcguauauauaagaaagacaucuuucucuuuucuaaaagacuucccuaacacuuaccccauggcugcacaguuggugggguccugccggagaggaagagacacucagaccagagaaggggugugcaugcgccuacucgcuugcuagaaguagauucuggacagucagcucuucaucugcccaacuguguagcaucugcauugcccagucuuucaugugugccaaggcugaugcaggauuuguucucuguccagcagucacuucggccagagcugaagaguugccccgucucuguuccaugucuccuuuaagagcucuggugauaaggacaugaugcuuuuacugaacuuucuuauccuagcacaugcuucaauaguucaaggaacuugaaaaauacuuuuccuuaccuuuaccccaucccugucuuuacuccucacacuuacuguaagacauuaguaacauaauaaauuaaaagucacacgaaucucaccaacaua

SEQ ID NO: 18866 - RNA, 3483 nt, Homo sapiens
caguuccugaggcaugaggugguauuuuggggugaaggugcuauuucugcaggcaagauuuugggcugaucuugaggcucccauuugggaguauggguuccagguugaggaugaggguuccauuccuggagggcagguuuccguuucaggguccaggauuugugauuguguuucagucuuguggucaagaguccauuuuggagcucaguauucuggaauuggguugagauucucucccugggugggguuugaugaucaggguggaggucuuguacccugggaggaagggaagagcuagaaccuccuuccucuucuagaggagacuuccuggggccaucagcagaugaaggggccgguagagcaaccucugagcugacaccugggaggcccaggcuccagcccuggccuugguguaagacuguuuguggguaagucacuuauaagcucuaggucucuggcugcaagcuuuggccggacagugauguugacucacaaagcaccauccauguucacuugagcuucccaaaaugacacuaauggugggcuccguagacacccacggccacugcuuugcuuggugagucaaauccauggugacaggacucaggcugcccugggcacugccagcuugguccaauuagugccaauuggaucuuaacgugugcugagcggccccuggggagagugagcacacaucgagugggacauguuaaaucugggucccuggggcuuggcauguggcucuguggggcgggagaugggccagguugggccaacagccccccuccuuguaggccagcucuuaccuaggccaggcagugggcaaagacauguggcaagccagguucugaaggggcccagcugucucccuugugcugugcugaggggcugagacccagaggggcuguucuucaccccuggcugggcugaccccugccugagaaacaucugugucuauauaggacugccacccacaccccuccucuguuucucucuugcuaccuccaauguggauccuucucuuggagagcuaaaguugcugggaagaaaaaguuccauuccauuuguccugggcuuugagcucugggaagcccucuuccuucccagguguugcucaagaccccccuagaaguuucucaggcaggcggucuuggccuuauuuccuggauguuuccaggccaccccccgccgcuguuucccauuuccacugcccaggucacaccauugccagugggccuugaaugggggggcuccugacuuggccucuuagcccgcauccacccugcugcagguggacuuccccaucucagaggcccuccuuuguuuuaccaaaacaggcgacaggauaggagugagugggggacaugcuuuccaggucuagggcaaucucuucugugcucugaaaggacaucuuugggauagaguccuuucccugaagugcaggaaacucaggcacuugagaagagggggaacuuucuccaccagccagucugucccagggacacagggggagcucugggucugcagggacccccaggcccccucucuuggccuggccauggaaccugagaggcugagaggccugggggucccacugggcuauggaaacccaacccacaugcugacgcuggugcagcccagcaggccucuggaauucuccagcagcaucugaggggaccuggggugcaaggagggaagaggaaagguaggcaggauagaaugcacuguagccaaggcauagacucuggaauuggacuuugucuuggcucccugggccucaaagcuuaacuucuccauguccuaauuccuuauuugagguaaugcuugacuaguaauaaaagcauaauaaauauuagcuaugguugccaucguugggcucauccuucaggucuuggcuuagcuucgccuacucuaggaagcuuucccugaccaccggguggguuagauggcuucugcugucccucucuggcugcccugggcuucaccauccucgcacugaucacacuagcugccaggccuguuugcuugucuguauuuuuuacugucucucuugcuuacugcuguaucaccaccaccagugccuggcacacacaguaggcacucaacuauguuuugaaauuaaugcaagaaugggcugauucuggggaauucaaacuuuucuucuaugggcucuucagggcugccgcagccacauccaguuaguucucugcugaaaugacauuuucugaauaccaggcucuggagcccagacaagagcaagauggaaccauugcuucauucauucauucauucauugauggcacagauguucuuugggugcucuuuaggugucaggccuugugccaggcucuggagacagacaugguucugcccuuauagaacuugugcugcugaucacuugggcagagggaggucagaagucagaggagagaguggucaguuaggcugaauggaaucagggagaacuuccaggagaagggguuugcuuugaagaaugguggagaaguuuagauggacagagaggggcuuucucuugggagugggcaaggagcugauggaggagauggagccaccuauguguagccaugaggcaaggcugaccagugacaguguggccugaggcugugcagccaacccacaggacucaaaagcuguggggaccauugguccuggcucugccagccacagauaggugaccuugggcagggcacuucucugucccuccaaguaguuuagucauuucuaagaugggaacuggcugggugaggugguucaugcuuggaaucccagcacuuuggaaggcugaaguggguggauugcuugagcccaggaguucaagaccagccugggugacauggagaaaccccaucucuaccaaacaaacauaaaaaggacgggagcugugcugcucggcaguuuccccagcgcccgcaggguugggcugggcucaagggcagguauguguggagggaggcuugugugggaaaggggagggcuucaggugucucuguuuuguaaauaauuaaauucuuaucuuaagcuaguuguguccacacugagggaggcaggagggggacugggaacaaggugcuguguuguccaggaaguggcugggucccuucucuccccucuucccucccuccuggccucccagucaaggcagguggugggggccccuagggucuucucgucucuggcugccucacuccuuccccgucuuucucucucccucuaccuucucauuucugguucccugucacauucccaccucuacgacauaaaggacccccugccccucuccauugacacccccccaggccaccauggccaccaucacccggugcccacccggcuuugcugccugcugaagucuugcucgcuccccagcagcccucccuggcagcccccaggucugcugagccucucgggaggccucaggggagcacuggccucucccuugccccagugcuccagagacaagca

SEQ ID NO: 18867 - RNA, 2144 nt, Homo sapiens
aaaaggguaucuuggauagaucuacuucucagccuguguccugacauggcaaugguagccucaaaaggugauuguuaagguuagaugagacaauguacgcaaagagggugucuguguguuugcuggggggugguugcucccuggcuuuccaggauguuaggccuucgucagugcacucgacagacgguuacuguuugucaacagaaugcuuggcgcuguucuagcugcuagggauaagacggaaggagcccaggaguuaaauuuuugaaaauuuuaaauuaugaggaauacaaguuuacuguagaaaaugaggaaguacacauaugcauauagcaagcaccugugagcauuuggaagcauccacaugguuucaguuucggugcuuccccccaccuauuccucugcuuaaacagauguccugcaagagucguuucuugacuguguucgcuaauuuaugucacaagcaucgugugcgccauuagccauccgggauuguaacggugcgcgcguagggaccggacagcggggcgcgccggggccgccucccgagagcccugcgugacacugccccgugucucccgcgcagauagcgagcuggugcucccggacugucugcggccgcgcuccuucaccgcccugcggcggccgucgcugcggcgcgaggcggacgacgcgcgccucucggugagccuaugcgaccucaacgugccgggcgcggacggcgacgaggccgcgccggccgccggcugccccaucccgcagaacucacucaacucgcagcacagccgcgcgcugccggcgcagcucgacggcgaccugcguuuccacgcccugcgcgccggcgcgcacguccgcauccucgacgagcagacgguggcgcgcguggagcacgggcgcgacgagcgcgcgcucgucuucaccagccggcccgugcgcguggccgagaccaucuucgucaaggucacgcgcucggguggcgcgcggcccggcgcgcugucguucggcgucaccacgugcgaccccggcacgcugcggccggccgaccugccuuucagcccugaggcccugguggaccgcaaggaauucugggccgugugccgcgugcccgggccccugcacagcggcgacauccugggccugguggucaacgccgacggcgagcugcaccucagccacaauggcgcggccgccggcaugcagcugugcguggacgccucgcagccgcuuuggaugcucuucggccugcacgggaccaucacgcagauccgcauccucggugagugcccgcagcugcgccugggcguaugccuuuccuggaggcggggacgauccggguaggagacaaagggcgagcuccccuuccuccaggcucaugaugguguugcuaaggaaucacagacaccuaaggugaguucugggcgggacuuggucaucuugucaguggcccuuauaugucaccugggagacucaccuggggggugaggcgagggaaagcgcggauuauugaguuugaugcccagaaucagaucaacccauagucucacagauacauaaacaguccagaagcacacaacccacugaccacucaaaaaugagaggaaaaggccaggugcgguggcucacgccuguaaucucagcauuuugggaggccgaggcgggcgaaucaugaggucaggagaucaagaccauccuggcuaacacggugaaaccccgucucuacuaaaaauacaaacaauuagcggggcaugguggugggcgccuguagucccagcuacucgggaggcugaggcaggagaauggcugagcccaggaggcggagcuugcagugagccaagaucgugccacugcacuccagccugggcgacagagugagacuccgucucaaaaaaaaaaaaaaaaaaagguuucccccagcaguuaacuuuuugagucucgguuaccauuucuccaaaauggaaauaaagguccucaccuuuaaggaaguuugugaguccaaaugagaaaaaaagguuggaaugucaguagucagguggugcaggguggugucugguugggggacucgggggaaucccugagcaggcagccuugggggaaguggggcugcagaguucugggccugccuuuucucgggggcacaggguuug

SEQ ID NO: 18868 - RNA, 2172 nt, Homo sapiens
agcugggcagugccaaaggguagcucaggagggaccuaccuuaaaagauucuggacccuuuccuuccuccaucuugccuucuuuucucucacugccuccuagccacucuguccccucaucugggguuggagugggucagaaguggggcugcucagagcucagccucuucccuugugcccuggaaguuggguugucagggugaacaggcagauccugauaaauggagggggacacaagaggccggggagcucucuucccgugaauccagcgccggguugggccaugucuccuccugacuggugcccccuuguccucagggacagcccccaauucgccagugagccugcccgagucgccagugaccccaggucugggccaguggagcgaugagugcaccauuugcuaugaacacgcgguggacacggucaucuacacauguggccacaugugccucugcuacgccuguggccugcgccucaagaaggcucugcacgccugcugccccaucugccgccgccccaucaaggacaucaucaagaccuaccgcagcuccuagcccguugcgguggcccaucccgcauacccaucuucucgggcuucagcccagucccagcugaggaacaagccaguggggccccuucucuuccucauuuuggaaacuuuuccuccucuauuaaacaugggaaacugaagcccuugaagguuuggggagagggggguaucaggcagggagggggcagaggcaaaucaccgggcagagggaggggaggagaggaggccgcacucucccugucucucccgucucugcacccagcuccucucugcaugcugagggcuaaauugggaucucagccugcccuaaucuuuccccaucugaggcagguuucuaggaggugucuguaguccauguggcaccuuugugagaauuagaaaacauguaccuuccucugggcagcugcagcccugagccaggacauguggccuggcuagugcagcauggaguggauuuuaggcucauuugcccucucagccaacugcccuugagcaguguacagccugcucaacaaccgcccugggcaggccgcuccugagcugcugucucccucucugaccuaugccuaccuucucuuucuucguucccugcccacugggcauggcagcugggggugagaggcuggugguugccucccguccugggcaggcugcagccucaugccaugucucucucccacuaccugaugggcacauggacaggcugcagagggcuccagguucugggccccuggcugagaaggggaggauccuguccuggcuguagccuuccugccccaaucaucucgcuggaugccauugcccagggguagcccuucgguaugggcuggggagaaggguuggucuucugccagggucccuaagaacagguuugcagcuacccucucugaccuuuuccccauaucuugugcuguccagggccuaggcugauagucagagccuguggcacaccugggaugggccagggcccuggguggggagguguggguucccugggccaagaccagccuuuuuccucaguuuaauuaauuuauuuauuugguuugugguuuuggguuuuuuuuguuuguuuguuuguaggugaguucccauccucugggccccuagaaaugcugccuuugugugugggguaccugggaaaggguguggcugaggcagucauaaugcaguaucuuccccugacuccagccacaaagcucauacccagcccuaccaaucaugaacuggaacuccauaaggaggggccaaauugggaggccuuuuggcaaacagugucuauuuuacagagaggcaaaccaagccuccuuagugcccuggggcugauggucacccagagccauagagcacccuuccuccugggccagagcuggguuaucaugguuggcuuagguaccucagguggcccaggagguccccccuccauaaggacgucaaacuuccaggagggccaguguuccuagugugggccaggaacaggacagggagaccuugugauggcggggcagggagccuguucguagggaagaugaggaggcaagggcugccucucacaccuccagguucucuaaguucuggggagggagcgccccaccugcugaggucgguccucucagcccugcc

SEQ ID NO: 18869 - RNA, 6832 nt, Homo sapiens
gggcgggugauuuugcuuuuguuuuuguuucacauucuucccccuccacaagccaaagucguuucauuugguuuccacuguguggacugugcuggagcuuggcgccugccagaaaaauuuggggcuaggcaagccccagguugcagacauggugaagcagagaaacuguucuucugguuccugcacaaccucagaggggcaaaaacccuccccaggaaggaggaggguguucaggagccagacuuuuggagagaaggcagcucccagccugcugggugaccgccauucugcguguguuccccagcugggcagggcuggaagccuuacguaugaagcauggagaagcagccauuguccccacuaugggcagaggggggacccggcuggccccuugggucagacuggagccaacaccgccagccacccccucuggccugcuggcaaugccacaggugcccaagaagauggaggaucccugugccaggagccaaccuggucuucccgagggucagugccccagugaagacagaagcgagagaauaaaguucccuguagguccucugucaccuuuggguuguguuuuucaauuguugacauuucagaggggacccuccagaagcccagccggcuucccccaaggacucccccuucgcugggaguggauuuccacacgugccuuugauuucggacagauugggccucacagccaccgauucagcugccagggucccuggacuggggguugguguuuucuauagaggaggaaaggcccucccucacccugcuccccacccaggcagggcagcaugggacccagugucucagugccuucaaaacccacccccaccccuacccuaccccaccacaccccaucccagaggccuugccugggcaacccuaagccccugucccucgccauacacugaugccuggcagcuagagcaaauggcucguguucuuugucgaaggccuguggugagauuguuuuguuuccuuuuguuuugugaguuuguuuaaaauugaaauuaguuauuuucuucugcuggacaguauuaaauagagcaggauguugaguuaaucugcuagauugcaguacuaaugguagugguuuagugucuucauguuaauauuauuuguacuuauuugaacaauaaugauaaagaagugguucauuauuuuuuaauuaaugcacuuuaaauaagguagaauggaaaaaacccagagagcaaagugcauuacuuaaagaugcaguauauacuuuucucauuuuuaaacagcacauauuuauuaagagaaaaaaaguaauuuaugacuauuuaaaauaaaauuuaaaaguagagugacugucagguaaagaaccuucaauguagcuaucuuccagggggagggcccugcagccucgcuccucagaugucugcacugagccaguucagucacuagugcgccagccaggccaggagggagugcagagcaugucugccaagcacagagcaucucaguuggacuggaccacagugcucccgagagccugccuuuccugcccuuccccaccaccugcacugccccccacauucucccagccccccccaaggacccccucuccuugacccccagugcuguaaguaauagagucauuaaaaugcaggacugaaagagaccucagaggucucuaucccaucccuuccuguuacugcggcccaaggacaggaaacaacuuuuccaaaaucccacagcuaguuaaugacagaucuccccacuacauuaaucccgugcuccuccucacugccauuauaguuuauuguguggucauguuuacauugugacauccagccccaaggauggcugggaguugcucaggcauccaggaaaaguggggaaugcugccaucuggugacagcauguagauuugggcagugaacagggauugccaugccccagucuucgcaccucgcccccucacccccuaacucacagcacaaacccugcaaacccaaagagaauauuaauacuugaagcaagaagggugcaugccaguccuucuccgacauggccaggggguaccaggccuugugcgccuggccuccuagcccuagccagggcgagagggccuuucccuugagcuacugagcugcuuugugaugcugaaggauacugccggcagcaggcagaggagggagggggccuagggcucugacccaucuggaggaaaaccagaucggacuaaaaaaggaaaaagaaaaacaaaaucuccgcaguguccaaaccuaguuucccaugaguugcgacugaaaaugugaaacgacacuguauugcuguauacugcaacuuuaaccauaaugagcccuucugaggucauuauugagguucauauaaugcccgaagaugcagcauuuggugcuuuguuuuccuuuccguuucaagaccuuuuucuuuuauugcaaggggaaaaaaaugucaucuccccccaccucaucccucuuugugacagcagaccuggcuguguugccccucuccuccucacuauucucaccaggccaugggacuuugggggcagugagagagagcuggaaaggggcaacccugagcagcaggugugccccaugcccuguggguuuccccuauguccaaugacuguagacgggcugucuugccaggccucagccccgucuacccuaagccuggccccaaagguuucucuuucuuccuccuugauuuuccaucuugacgaaggcauuauauagaaucauuuuaaucacuuucagauguuagagcagcguauuuuacaggcauuuauauccauugcuuuccucagcaaggcauguuacuacuuuuaucaucuaaggaaaaaagacaagggaauuccagucaggcauuauuuuccuauuacuaguguuugcagaauagguguaggacuauuuaaguuuagaccuugguuugguaguucuuguuuuuaauaaggggaaaaagauaaaauaaccccuauuuuuccuguuauuguauuuaacuaauauauuauuucuuuaagguuacucacuuccccuaccccuccaaauaccuugcauucucaaucaaaaauggaaacaaucugagagacaggaaaagugcaauauuaccaagauggaugccagggcucauuggggacaauggagggaauaccaguggcgcucagagagcaagaggcagggagcggggugcugaaggaauccuagcuguggaacagguggguggguugguggaguuugaucuuguggcguucuccucucccccuucuuugggaagaugauaggggucccugccagauccacccagaagaaagggauucaggcauggggcccuugaccucuaggccccagucccuggagcagaggcaggcccucgggagcuguuccuuguuuugauuucuguuguggugcagccagcugcucagagagaccuggccuaaaaaugacucccagcagcccucucucaccccaguguccugauauuugggcugugauccuucugguguauguuugaaucuuucuaaaacugggugcccucaguucaguuucuaggcaggaagccuagaagucaccagaucuuuuugggggaugugagaaccuugagccgcgcacacccuggugagacaccaauucccacaagccugcagcagggccuggggcugagccugggcugcccauucaucucagcgacuucagccugagaagugagcccugccugggcuccacacccagagaguccauacaaauucugcuccgggaagagucggggggucuauucaaguuucucugcagacaaaacuucccacaacagguaccaaucuggccuccuuccucagcaccgguagagaaagcaacagaaugggaaguuuccucuggguuggagccucagagcucugccccucaaggugacagggacgucccuguggcuuguucccuccaccuccaguacuguaugcuugcuacuucaacccccuauuuggugaauuucugcacagacacagaucucugugccuggaaugggacugugcccugugcgggucucucccuuggcguauauccaucuagauauuuagucuuugagaaucucaaagcagagcucucugggaagagaacuguccacauugcuaaauaauuaagauucccucacuuuuuugagggccauguguugugagagagagagagagagagagagugugugugugugugugugugugugugugucuguguaugcaaguguugguaacuucccacuugaacuaaauaacaugggguuagagaaaaaaaaauaccaggcaagcugucuccauugaacaaguccuuggcaaugggcaggucccaagggacucacagcuucuggcagcaagugugucauucacacacaucauucuggcuggagagugcaaugugucauuuuuuuuucuuuuuguaauuauuuuauuaaguauuuaguuggaaauuucacacuggcauuaacaggucuagcauaaguggccuaggcagucaucccaggcuccaaaaugaagaugugcaaaagagaugccacugggaauagaaacacugaguugguucaguuaggucauccccugcagacgugucaucgagcaggcugacucccaccccucagccaugccauggguaugagaagccccuuauaaugaaagcugccagcccuuucguccuuguuucagagggugggucaggugguuggggugagaacuugcucacggugcacccaacaagaccugcaggugcauauaaguuuagucccaacugcagggccagaccaaacacuuccugggaaguguguggagggcugugcuagaccuuccugaguuucuggcuaaaucaucagcccuguuuggugcagucucaugucucugugguucccaagcugcaugaucagagccagugagaagacaggaucagugacccacagcuuuggggaaaaacagccccacuguuaacuucccuccugcaaaccuggguccccaggccauaaggugggcacacuggugcuuacagacuggguggagagcccuaccuuccaaggucuugaucccagccugccuauaagguugggauuagcaugcaaucccccuuccccaauccugucuuuuuaaaaucucaaguuugcacuuaaccuugacaacagcacccucuccuacuccaguccuagaacucaguggccuuagagaaugggguccccugcacugaagguccccgccuugcucccaguuccauccuggccaauaggcugcgccucaagaggugaaagagaaaaaagggagggagggaggaagaauuauuuagaacaaaaggauggcucgagcacguuagaggcaagugagaggcacguuggugagaagagcaugugcauguuugggguagcuggggccuacugucccuucauuagggaaggaggcuuccagaagcggaugucuucuagaaagaaaaauugugugaaggcugaaaaggggcuuggaguuuugucuuuguugauuagaaagaaggaagaagucagcucugaguguuucaggaagaagagagcagguagaaagggaauuuagugauuuaacacccaaggguccagccauagcagguuggaaaauccuccaaauuuggccacagaaacuggcuaggaaaaaacugccacucauugggccacacgcuggguccccaucaguucucaaugaauggucauugauuuacuuagcagagagaagucaccagccacaaaccaaucuuugaguuugcaggcccugauuccagaauauaugcauccagcucccggguucucagcugguuuugcccacuucccuuugacuguccaauccaaagccagucucucaaguuguauggcucaaagagcagugaccacaaugggucauacaguagggacccaccuccacaaauuagaaccagaguucagacuccauugggcacaucugggaggaaggcaaccuccuuugucgucuuguugguaccagucauucucaaguaucucugacaccuguggugguucaguuugcugagccugccaccugguaugaauuagacugggugugaugaacauucauccauggauauacccuaccauuuugcguugccuuauaaccaaggcacacuccccauaagaguuuacugcagagaaagaacagcaaaacagccacccuccuugaauuuacaacucauuaucugcaacagguuuucuuuaaauccaagacacaggaugggaaauggguuuccccaccagguacucagaggucugcaggaagugacucccgggcaaggcagacuucaguaaucccugaagcgugagcauguggacugcauggcuggguggggacugguggaugucucuggagcuccagaaccuuggagaauuccucauggaauuccccucccagcucuuagugggcucuguggggucaggaggagcccuuccuccagguuuuccuucuuuccuccucagcagagaaacuggagaaaggacauuaaacucagugcagucgauuugagugcugaaauauuuccagaaucaaugguggugcuaaacuaucuccauguuucuagcauuuuuaauaguggaguugguuuguuuuuaaucucaucacaaaaaugcagugcccuuggggaagggaccagccccuuggccugccacuuuccagguguccuuuaucacuuugacgggacucuuuggucugcagaaaaugcucugucuuggcaugcuucuagacuguaagauuuggguuuuguuuuguauuuuauguuuacaugcaucuuauauuucccugaaaacuaaauaaaguuuugggccuuuuuaaccgaac

SEQ ID NO: 18870 - RNA, 4022 nt, Homo sapiens
gcagcuagacggccagggagggcaaggagggacauuuaagcugagaucauucccuggugggauaaagaaaguaaauaaaugagucacguuacaacaacaacaaaccuaagaacugcaaugaaagggaaagccuaaaaucaaugucucaaauaauucuuaauuccaagcaauacgucaacaccaagcaacaaaacaaguuacccaaauaaaacuagggguaaaaacauggagauaacuuuuucuuuuuuuuuuguugggacaaggucucacuccgggugacagucaggggucagggucacccagagugagacccugucuaauuuuuguauuuuuaguagagacaagauuucaccauuuuggcuaggcuggucuugaacuccuggccucaagugaucugcccaccuugaccucccaaaaugcugggauuacaggcgugagccacugcgccuggccccucguuacuuaaucuuauuaugcuuaauauuugaguagaaaaaaauaauaauagucuaagguccauaguaguagguuguuaguauucauugagauggauguuuaaucucagcagaagccaagugacagggaaguagaugagaggagguaauuauccauccaagaugauuuauucaucagcaaaaugauucgcgaacuugaaccaugguuuuuaaugacuugcucugucuuuuucagaauaagauuaacccauuguguuuuaggaguuuaaauaaagaccgaguuguauucagacucauuuguaaguaaaauuucaaggaacacuuaaguaauuuuuuauucuuuaauuuuuuauuccucuuagaaaaaguuaucuugguuagccaggcgugauggcacaugccuguggucccaguuacuugugaggccaaggcaggagaagcaccagccugggcgacagagugagacucugucuccgaaaaaaaaaagauuagguaaggaggaagaaggggcagguccagccuuaugccucauuucaaguucuuaguagucaaugaccuuuccagaauagaaauaaugugugacagaaccauucccuccguucccugggucaacucugugaaucuucaugccacagucacuuucacccacaccugcaguugcagaucuggggcagggaaccagaauucucacaugggcaugcugcacucacuuggucggaggaggcacugugaaucacaggcugauuggcaagggacagcaaagacuccaccauuuccagcuccugcugguaaaagcucugcacucuguucuccaugaggaauucuuuggcuuuuucacucagcaaacucgugagacuggggagguccagggcgccuggauugcugcggagggaaaguuuuaaagagcucugcagaaaaccaucaccuuuguuccuuuuugguguauaaaaaccagaaaauuagcuagaaaaugcaacacuauauuggaguuuguuuuucauauacagaguaauauauacagggaacaucaugugguuguuuaaaaugaugaggcagaacuacaggaacuaagauauucaugacagauuaggagaaaaaagucaaacugcagaacagcauguaagguaugguccuauuuuuauauaaaaaaaauggaaacccacaaaaucuaugggugaauauucaugcuuguguaagcacagaagaaacuaauuuaaaaagacacacauuggcuuaugaacauugguaaucucuggggaaugguccugaggcaggagacaggaaaauggagaauuuucacuuuuuauaugagucuauaguugugcuuuuaauauacuuuuuugaauauauaauauauucauguuaaaaaacauuaaaggauacacaguaaagucuccuuucuguccccuuccuguccuauccuccgguccccacccccgagggagcugcuguuaccgguucucugugucuccucucagaguucuuuuaugcacauauuagcaaauaugcacacauucucauuccuccuggguuuucuccccuauaaaaaaguaaaaucaucccugguugagaaugaccggugcagguuuuuuuaaaacagguuuuugauuaugacgugcuaugguaucauauuuugauuaugaggugacuuggugcauuuuucuucagguuucuugccuugggguucauugagcuuccuggaucugugaguuuaaaguuuuuaucaaacuuggaaaaaugucaggcauuauuauuucuuccaaguguuuuucucugcuccugccuccacuccuccuucagugacuccaauuacacccauaauuuccucacgacaacccuaggacaucugugcuauuauucucuucauguuacaguugaggaaauugaagcauagagaggguuagagggcuugcccagagccccacagugcauagguggaugauucgggauuugaaccuaggccgaucccagcaucugggcucagcugcuucaguuuucugccguggucacgugcucagcagugauaagucaccacuuaccuuagugccucuucuuucucuagggcugagcugugaaaaggcuggucauaaacuuuccuguagauagugggcagcucaagcauccuugcaauuugaauguuccacacugggucguccacuuuaucuaacaagugaccagaaaaaagaugcuacagaaauuacaaauuacauugagaucaauucuuucccaggcccaaacugcugcuaagacaacaguaaaugaggugcugggugggccuccuuccuugugagugcccagggaucacagucuagaugcacuaaauggcucccagucauccugcaugagggaaugcgaugcccuaagugucaugggcuuggccagggccaaggaaccaggaaagcacaucaauguauugauucgucugcuccucugguggacagcaggggcuguccuugagauuuccaacugaaaaccagccagcacgugcaaagggaagaugauggggaacugucauauuucugauuagcuguuuucauuuaaaguuaauggacuuaaugguauucaagaaauuucuggccaggcacaguggcacacggcuguaaucccagcacucugggaggcugaggugggcggaucucuugagcucagaaauuugagaccagccuggacaacauggcgaaaccccaucucuacaaaaaauuagcugggugugguggcgcaugccuguaguuccagcuacucagaaggcugaggugggagaaucuccugagcccaggaauuugaggcugcauugggcugugacugugccacugcauuccacccugggcaacaguguaagacucugucucaaaaaaagaaaaaaaauaaagaaaaaauaaagaaauuuccauuauuuugaagaauauucauauuuugcccuaauggauugacauucugaacuugaaagugcuuuggaaacucuacuaugucauccaaauaaacuugccaaccauauauaaaguaaauaauucauuuucuuucccaacuuauaauuagcugucuucaaaauaaaaguaagaaaugcugauuuucuaaagaaagcauguuaaacaauguaauucacucauuaaauagaguuauaccuuaacugaacuuuuugaaaguuugacuuccagcugaacaagagguuuacuggacgcacauccagaaaaaccaccaauuugguagaaauaucuugugcuuacaguaagugguggcaugaaucucucgcucuucucuguaugugcggauacugccucugacucggaucguguccccgaucucuaucuuuguuuucugcucaauggucucuuguagcuucuuaaguugugagguuaagcugagcucucuugcugcacuuggagcagcuguaguuguuuagagccagagggaaagagaaaaaguuauaacacaaucacucuaccacaucugugagacaguuuuaggguaagaccaacacaauaugcuuauuuauucuacuucugaguaauuguucuacuguuggaaauccacauaaccuuuuggaguacuccacugagaacaagguau

SEQ ID NO: 18871 - RNA, 12578 nt, Homo sapiens
cuacuacauauuuggaaaccuuucauuuauaauaaaugauggugagaaguuaaccaaagaaggaaaacgagaaaguuaaaguacuaagaacaaggaaaaaugaccaaaugauagaaauauggggagacuggaaaggguauagaggaggcaaaacuuugccuccacccucuuagcgucccugcugggcccgagaauuaaacugacacaagauagaguagaggagaaaagcauagacauuuaauauaaguuuuaugugacaugggagcccucaaaagaaaaugaagucauagagaaauggcaaaaccuacaugcuuuuguguuagguugaaagaagagaggcgauuguagaaaaguagauauguuauauggggaggcuaaaggaagauguuuaauuuaacaaggucuguuuguacacaauucucuugacugugacucccuaucaaagaauguuucuuuucuccugggauagagaagacgucuuuuacaggaacauuuucaucuccuaguuucaggaagaaaagguggaagauuagaaugcccuucuugcaucugcuauuuuucaagugccuuucaaacucaaagugauccuuaugucagaguggcauguuugaagugguguauucugccacccuucacggguaaugauuaugccuaguguuccauuaacggaacgcuaagcuuguggggguuauuuauauccuacugcccaagguaauugccaaggucugauuuuucacaaaaaaaauuugcaaccucuagcauaaauggguuaauuucacacacaaaaauuugcaaccuccggcauaaauggguuucaaccuccagcagaaagggcuuuggaaacagaccuggauuuaaauucuguuucugcuucuuacuagcuacaugaccugggaaagccuuuuaaccccucaaagcucauuuauauccuccuuuaaaguagagguaauaauauaucaugggguuguugugaagauuaaauaguaauaguaauuacagcuaacauuuuugaauccuucuauauaugccagauaguauauuaaauguuuauaugugguuuuuuuuuuuacuuggcagauauauguuaucuuaauucucaugaacuugugagauguagauaauuuuuacugaugaggagacuaaaagagggauuuuguaaauugccccaagcaacacagcuaauaaguggcaaaaccagaauuuaaauccagcagucugacccaccagaggcugugauuugaaaugcuguccccuauguauaugaagcccuuagcacagugcauagccauagcaugcauuaauucauauuuauguuuaggcugucuuuuauaaauagugugucaagagaaugagaagacaagccacagacugagaaaauauuugcaagacacauauuugauaaaggaaaguuauccagaauaugcaaauaacuccuaaaacuuaacaauuagaaaaugaacagcccaguuaaaaaauggucaaaagauuugaacagacaucucaccaaagauuugacaaauaaguauaugaaaagaugcucgacaucauaugucaucagggaauuguaaauugaaaagauacaaguacuacuauguagcuguuagacuggugaaacccaugcuugcuggcaaccccaaaugcuggugaggauguggagcaacaggaacucauucauugcugguguguaugcagacucuuucagccauuuuggaagacaguguggcaguuucuuuuuuuuuuuuuuuuuuuuuggagacagagucuugcucugucacccagacuggagugcaguggcgcaauuucggcucacugcaagcuccaccucccagguucaugccauucuccugccucagccucccgaguagcugggacuacaggugcccgacaccacgccuggcuaauuuuuuguauuuuuaguagagacgggguuucaccauguuagccaggauggucucgaucuccugacuucgugaucugccugccucggccucccaaagugcugggauuacaggcgugagccaccgcgcccggccaacaauuuggcaguuucuuaaaaaacuaaacauacucuuacgauaugauccagcaguuguacuccuuguuuauuacccaaaugaguugaaaaacaugucuacacagaaacccgcacauacauguuuauagaagcuuuauccauaauugccaaaacuuggaaacaaccaacauauccuuaaguaagucaauggauaaacugugguauaacuagacaauagaauauuauucagugcuaaaaagaaaugaguuauuaagccaugaaaacauuaaggaacuguaaauacauauuacuaagugaaagaagcuaaacagaaaggucuauacauacucugauuccaaguauaugacauuccagaaaaagcaaaagcaaaacuauggaugcaguaaaaagaucagugguugccagggguuggaggaaggaggggaugaguaggcagagcacagaggauuuuuagggcagugaaacuauucuguaugauauuauaacgagggcuacaugucauuauacauuuguugaaacccauagaugcaagagcaaacuguaauguaaacuuuggacuugggugauaaugauguguuaauguagguucaucauagcaacagauguaucacucuggugugcaguguugaugggggggugguuaugcauggagcacgagggaacuuucuguacuuuccacgcaauuuugcugugaaccuaaaacuuuccuuuaucaaauaugugucuugcaaauauuuucucagucuguggcuugucuucucauucucuugacacacuauuuuuaaaagacagccuaaacguaaauaugaauuaaauaugaauuaaaacuuaaaaucuauuaaaauaauaaaaaauuagaaaaugaugcauuugaaaugugacacuucugauacuuucauuuucaggcccagaauaaagagaccaguguuuuagcugcugcaaaagugauugacacuaaaucugaagaagaacuugaagauuacaugguagagauugacauauuagcaucuugugaucacccaaauauagucaagcuucuagaugccuucuauuaugagaacaaucuuuggguaaguauuuucuguugaucuaaaggaguagccaaaaugaguuaauuguccuaaagagauguuuaugaauuauuaaaaccuauuuuaugucuuaucucuucuauuuaguuacuugugucacuugaaugagaguugaucugcugauaagagaguaauaacaaaguuauucucagcuucaacagauguucagauuuauguuucagauuguacaguuucaucaugauuguuugacauuggauccagguggaaaaauuugguuaagaauaauaaauuuccuaaaauaugaaauuagauguccuuguuuauaauuuaaauuuaaucauuuaaaaguuuuaaaaguuucucuuagaaauuguuuauaauuuuuuauccuaaacuuuuuguaaaucuuguaauaaacuguaaaauacuagaaauguuaaauauuuaucguauuaucagguucaacuuuagugcaugaugugauggcuaaagcuguauguauaaauuuuauucauuuucagaaaauauuaagguacaaguagauauagaaauaaaacuuucauauucauuauaauaaucugucaaucacuuguucuguaccaacauuaguuuaaucaagaggacuuuuuaaaaugcagcuucagucuuucuuccugaaggaagaagcaaaguuuuaugagagagaagaguaaguaguauaaggaauaccugacuggaugccuaaaggucuauauuuuuuuaucccagugcugccacuuacggaacuuggauaagucaguuaacuuuuaugagucuguuuacucaucuguaggaugaguaaugaucuaccucccaaauuauuuucugaauaauguaaugaauuugaaaacaauuucuaauuggcaagcacuuguaaaaaaaaauaaagcauuaugcugagggaaaaaaggcaggaagcuaccuaauuaguuaaaaauauguuauuuuuuaaaauuauaguuauuauuaaugugguguuuucugaaauuauuguucagggcugucgcagaauguuuccaaagauuauaaugcaaaugaacccauagacuaguuaauaaacagauaagaccuuuacuugggacuauugcacaauaaaaauuuagacaacugugaggggaaguuuagugggagacauaaauguuaauuaaucaaauaaucacaauaaauauaaaauuacaacugugguaaggguuaagaaggaaagguacaugguguuaugucuuaccagggaagucaagauaagcaccuaucagcagguaauaauugagcucggaucugaagcuuuuguggguauuucuucuguuuuuuuuuuuuuuuuuucuaaaagaagucucuguauaaauauuuucaggauuuauuccuauuuaauacaguuuaaaaaaacaaauguauauuuguucacuuaaagcacaaguugccuuaaaaauauaaguaauaaaaucuuucauuggugaccaaauagcugugcaguacaauaccaaaugaaaaaguucuguaccugguaguuguagagaagcagggacaguaaacauggcaauuaacaaaaaugcccaugcuuucacagugggcuuuaucaaaugcauauuguuugagauuuguaacucuuuugacaaaaucuucguuuaguauaucguuuccauaaccagauuauuugauagcuauuucuuuaucuuuuuugcuaagcugaagaaaaaauacugaaacucaaaacuccauguaguuuuagacacacgcuuuuuuuuuuuuuuuugcaugcagauccucauugaauuuugugcagguggagcaguagaugcugugaugcuugguaaauaccuuuuuguucuuucuguucauaucuuaaauuauacuugauaagaugaaagaauuucaaccauauauaaauauauucaaauauguaaguaucgaguaaaguucaguaaguuaacucaaguauguuuuuauauucuuggauaauuauaguaaaauucuaaaaugaaauguugagugugucaagaaugugaucuuuguagauauaguucuuuuaaaauaaauucccugcauaugaucuuugacagugaugauauauacagaaagguauauagccugcuaauauguuuucacuguauaaaaagcagauuuuuuuuuuuacuuucuccuuauagaacuugagagaccauuaacugagucccaaauacaaguaguuugcaagcagacuuuagaugcauugaacuacuuacaugauaauaagaucauccacagagaucugaaggcuggcaacauucucuuuaccuuagauggagauaucaaauuggguaaguuauucacuuaaauaaaacauuagaauuuuuacucugaaauuuccaucuuuauguaugugacuuaaugugguuuuauuacuacuuaaauaugugaaacauggagaacuaacuccaugcugguuuuuaaaaaacacuuuuuuagguaaauacucauuuuucuauaauuucuaaauaucagcaccuaauugaaugcuuuaaaaagaagauaagaaagaaugaauuuuuauuuucaaaaaggcaugcuuuuuaaagaccaauuucaaguuuguacccuuaaauuuuuguacguagacuuaauacuuguaaauguuuuauguuuagaauauaauauaguauguaaaacugcuaacucaguuuuuucuuuauuuccaaaguucaugucuagugaguuuuuccccauguuuaguuuuauauucuauuuuauugauaugguacguugacuaaacuaacaaaguaaucuuaguucugaagagaauaccuaaacguaaggacuagaauuuuuaauuuuacucuuuauacugagggaagaaauguuaccuucauaagaagaauuagauguaggucuuaugaaaguuauagcgcucuuuacccaagauaggaauuauuuaaaaagucuagagaugaaguccaaauuuguauauuuuggaaggcuauucaaaggacaaaauauauucagaagucaaguugauaccagugacuauagucauuucacuuuacuuugucaagacauuuaaacagaugguguacuaaauuuuauucuuuuuaauuuuuuuuuaacggagucuugcucuguugcuuaggcuggagugcagugaugugaucauaguuuacugcagccuugaaccccugggcuccagggauccuuccaccuuauccucccuaguagcuggaacugcaggcaugcaccaccacgccuggcgaauuuuuaaaaauuuuuuuguagagaugaggucuugcucuguugaccagacuggucuugaauuccugggugcaagugauucuucugccuugggccuccugaagugaauuuuaaccuuuugauugugaaaaauuacagauauagaaaaccacaccagaaauuguguagcuuaaguuuaguacuuuguagacauagcuuuguaaucacuaccuagaucaaaaaguagaacuuugacaggcaucccagaagcucuuccguaugcccaucucagccacugcccuucucuucuccacauuuuauccugacuuuuauauuauuuccuuccuuguguuucuuuauggcuuagucacccaguauucaucucuagauguuaggguuuaaacuugcucauauaaaacuuggguuuuuaaagucucuuaacuuacaggccuucccccauuccuuucuuuucuuuauauuauggcauguguaaugggggaugagggcaauaucacccacaugggugcaaaaauuaguucuuuagggccaaaaaaaaaccuuaugcauuacaaugguuugugaccuuccaaaggccccaguacaugaagagauauaacacuguaucuauggcauuaaaauuuuaugggaggagggaugaugugaaaaaaauguuuaaaaugacuccuuagaggggcuaguaaugaaacacugauccauggaaccugggcuguuuggccuguuguguuucccucaaacugcauuuugcuauugcauacuccugaugauugaaguuccuuucuguauuuccuucaguuuggcagaugaauccaaaggcuugaucagucucaagccugauccuuuggcaagacuuacaggugguuuugcauucuuucauugggaggcacaccgugucugcuuugugcccuuuuuugauguugcaucuauugaggcuuaaugccuacaccucugucuuuugggguugcaaaacgaauuccauuauuuuguuuucauuauuuucgauaaugauuuugauauaaacaccaauuauuucauuauuuucauucauuauaaaauuaguaaugaagauaaugacuuggcugucucuuauccucaauugaugaccaguguuuuaaaaaauauuguuaguucauggauuuaauuuuauuugguugguuucaaauccauugcaguuuuuauucuuauugaagcucauguuguuccaucuuuagucaguggggucuuccucgugucugcuuguuggucuucuugacagcacuaguaaucuuugauagcuuacuugacaguucugagauguuucaggcucaucuguguauuuccugugucagaccuguaauuaaccauuucuuuuuucuuuucuuucuuuucuuuuuuuuuuuuuuuuuuuuuugagucaaagucuugcucuguugcccagguuggagugcaguggcugaucucagcucacugcaacccccaccuccuggguucaagggauucuugugccucagccuccugaguagcuaggauuacaggcauguaccaccaugcccagcuaauuuuuguuuuuuaguagagaugggguuucaccauguugaccgggcuggucuggaacuccuggccagaagugaucugcccacuucagccucccaaagugcuggaauuacaggugugagccacugcacccaguguaauuagccauuucuuuaagaagcccugguuucuuuuaguagaauauaguauuucaagaccacagucugguguaagagaugcuugcaguuuucuauauuggccauuguucuaggacuuuucaaaggacagagcuagaacccucaugaguucauauauauuuccuauucaaauucaggauaaagguuuuuaaaaucuaaccucuguaauaaaugugcaucuccuuucuucuauguugagaguucugguucucaaggacauugauagguuuaggauaccucauaauucauuuuaacccucauuucuauauuuaaugcucaccaccacuccuuauguugaugugucuuuggugauguugguuaucugaagcucagcuuuugguagauuccucugaaagggcucucugaauucuuacauagugauaacaguuguacccuuauaguugaagguuaguuuugcuggauaacaaauccuuggcacaaauuucuuuccuucagcaucugaaauauguuacucuguuuucuucagucaugaaguguuguuguugaaaagucugauaaucugaauuucuucauuguaagucaugugcucuuuuugcuuagaugcuaaaaguuuuuuuuuuuuuuuaagaccaguaguuugaccagucuuuucuaauaaauauuuuuuuucuuuucuuuuuuuuuuuuuuuugagacggagucuugcucuuucacccaggccggacugcaguggcgcuaucucggcucacugcaagcucugccucccggguucacgccauucuccugccucagccucccgaguagcugggacuacaggcgcccgucaccacgcccagcuaauuuuuuguauuuuucguagagacgggguuucaccguguuagccaagauggucuugaucuccugaccucgugauccacccgccucagccucccaaagugcugggauuggugugagccaccgugcccggccuucuaauaaauauuaugcucguacaauauucgagugcuuucuuccccgcccccgacaggaaaguuuucuggaguuauagaucugagcauuuguuuguucccuugcauugacuugcuucuuuagagacuuuuaguauuuguuuguuggaucuuugccuguuguccauguuuguaacuuuuucucaaguccuuuuuuagcuugcuuucuuuuuuaucguaggaaaauauauacaacauaaaauuuaccuuuuugaucauuuuuaaguguacauuucugugguauuaaguacauucccauuauuauacaaccauuaccaucaccuaucuccauaccucuuuucaucuugcagcaguuaaagucuauacccauuaaacaguuaguccccauuuuccacuccucccagcuucuggcaaccaccauucugcuuucaguuucuaugauuuugaccacucuagguauauacguauguggaaucauacaacauuuguccuuuugugacuggcguauuuuacuuaccauaacguucucaagguucauccacguuguagcguauuucaagucuuccccuuuuaagauugaauaauaugccauuguauguauauaacacauuuuguuuauccguucauccaucagugggcacuuggguugcuuucacuuuuuggcuauugugaauaauacugcuaugaauguugguguacaaaugucuguccuacucccugcuuuuaauucuuuugaguaugcacccagaaguggaauugcugaaucauaugguaauucuauguuuaauuuuuuugagggaccaccaugcuguucuccauagcaacugcaccauuuuacauuucuaacggaaauguacaaggcuuccaguuucuccgcaugcuugucaacacuuuuuuuuuuucuaugcuacauccauccuacugggugugaagcgguaauggguaugaauuuguuguauuauuugcucuugcuuucccuaguuuagccuuuguuucuaaaguuuuucuuuuuuauuuuaaauuuuuucuggagcucugucgccuuucagaauuuuucuaauucugacuuacauggcucuuuuauguuuuucaucauuuuuaaaaguguccuagcuuauuuugaaauaggauguuacaguuuugaucaauuuugggggcauuuuuuuuguaaauauauugaaauuuuauuugaauauagggacauacuuguguaaaauaauguguaccuuaucaauauacugaagguuuaggaauuguaaaauaauauuuaguuaguugacaauuaaaauauuuguaauuucuguuuaauuuacaaauacuuccagagaaccuuccauuucugcaacacagauauauagaacaaucuuauccccaagaaccauauaauagauaaaaguaauucaggcagaauugcaugaccuuuaagaguucuacaacaaaaacaacaaagguuagaauugugaauauggcuaauaauagcuaccauuuauugaguguauacucugugguaggcaugagcaucaaauacugaauuuuugguacuuauucaacuuugagaauugucgcaucaaaugugaaacuuaaaaauucgugcauuuauagcaugaggugaauuaugcagcaauagcaguuuuauguugcuguuaauguugugugaacuccaggcugaaaaggugggauuaacaacugaaaaagcuauaauguuacuguucuguauaauuuaaaucagaaaacauaagguucccaauuuuuucuugacaauauaauuuuaugaggaauuuagcaagacauacacuguccuaaagguugcuuuaguauaauuucuauuuuucacacuauagaaaaaauguuaaugacucuuaguuuaauugugccacauagcacuaguuggcauuuauuuugaaguggauagacuggucugcuuuuagaguuaccauuuuuuauuuucaauuuuggaggauuugucaucugaagauaaggugguauuaaauguauugauaaugggaucuuuagcagguuuuuuugggagaugguagaaagagauggucaagauuaagaugggagagacaucuuuuucuuucuguuuaacuuacuuuuuauaauaagauuagccuuauuaaagacuuaaaaugcuuuuucuccccauugaauacaaugaacaaugcuuaaaaguucucauuaaugcuuuugugugauuauuucaagcggauuuuggaguaucagcuaaaaacacgaggacaauucaaagaagagauuccuuuauugguacaccauauugguauguauucaguuuuaugaauuuauaguauuagucaugucagcaguuauaauuacucaugaauuuuuguccacauaauugauuauaccauguguuuugcaaucacuguucuuaaacauguuaacuuuuaauuaucugucuucauaggauggcuccugaaguagucaugugugaaacaucuaaggacagacccuaugacuacaaagcugauguuuggucccuggguaucacuuuaauagaaauggcugagauagaaccaccucaucaugaauuaaauccaaugcgagugcugcuaaaaauagcaaaaucugagccaccuacauuagcacagccauccagaugguaaaaauauucuuaaaaaagcuuaauaagaaacaaaugauacuaggaagcagaacuugauguuauauucucacaauuuuccaagaguauuuaaaauuggauacaugguucgaagacuauaugaauuagaaaagugauuuuugguauauuucucuuaaagaccauuaaaacucuucgagcucacuuuucccauauaucugaaaauaugaaugauuugaguuuugcaugagaaagguauuuucuguacuaugaggaagugagguauauagauugaucuauauuugugaaauuuauuagaaauuuugugcuuuuuggcauacuugugaguauauggcugucucagugauuauguaccuacuuacauauaugucuaacauguauuuacagaugaauaaguuuuacaaaaucuuaauagucucauuaacuaguuauuuaaauguugaauuaauacuauuacauacauaaugaaacuuaagcauaacuuaucaaagaguuuuguuuaauuugauuaacaagaaaguaaaauagaauguuguuaaaauuuauuuuaaaggucuucaaauuuuaaggacuuucuaaagaaaugcuuagaaaagaauguggaugccagguggacuacaucucagcugcugcagguaagagaguaugacaacagcaaauaauauaauuauuuuaacaucuaagaauguaauuucauauucagugugcuuucuuuccacuuaaauuucccuguggagagucaaaauggcaguaguuaacauuugcuuuacaaaauaaaugcugcuguuaccaucaggcauuuagcuuaaacguuauuccuccugugcuuuuuugauucaguuuaauuauguucuuuucauuuugguaguuauuuccauuaugucucuccaguuacuagaaagcaagcuccuuggggacaggggccgugaacuaauuaauuaaaaaaugucuuacagugaggguaaauaguaaauauuguugacuuaaaaaaauguuguu

SEQ ID NO: 18872 - RNA, 4701 nt, Homo sapiens
uuauaagaaguagaugguuuagccgggugugguggcucaugccuguaaucccagcacuuugggaggcugaggcgggcagaucaccugaagucaggaguucaagaccagccuaaccaacauggagaaaccccgucucuacuaaaaauacaaaauuagccagggugguggcucaugccuguaaucccagcuacucgggaggcugaggcaguagaaucacuuaaaccucagaggcggaaguugcggugagccaagaucgugccauugcacuccagccugggcaacaagagcaaaacucugucucaaaaaaaaaaagaagaagaaauagaugguuguuucacuaaaugaugaauaugcaaaacacauuugaagagacagggaagaauaugguuuuggacauauaaguuuaauuaccugcuagacuaucagauggaaauaugugguaaauggauggaaacaagguacauaaacuuaggaggcagaaauuuuuaaacuuuaggguuagacauucaccagauuggacaauuuuuaacauuuaaaauaaaacuuuuugucauaaaaaacaaauguauuaaaacuaguuuccagaacugcccaaaugacuuuuuaaacaugacuuaaaugucguuuugacaaaucuauccaaaauacuaauuuuccuuuuagaacuuaguuuauaauuuauauauuaaagugcccuuaauugauauucauugggauaccuuccucugagcccuaaugguuuugggaggccuaggcgguggaucaccugaggucaggaguucgagaccagccuggccaacguggugaaacccagucucuacuaaaaaugcaaaaauuagccgggcaugguggcgggcgccuguaaucucagcuacucgggaggcugaggcaggagaauugcuggaacccgagaggcagagguugcagugagucaagaucgcaccaucacacuccagccaggaugacaagagcgaaacucagucucaaaaaaaaaaaaaaagugccuaaguaucuuuuaauuaaguugucauucucaaagauauucuggagcaaaaaucaggaauuaaacaucuauaaauucuucuucacuucuguuauaguguaguaauuuaucaucuaacccauaguggucuaucaauugaguaaggcuuaguuucuuguucucuucagacacagcugacugcaacucauaaagcaagagcuggcuacagcuucuccacuucuuuauuaacaacuguaacugagacagaucauucugaaacagaaaaaaaaacauguaugucaauaacuagucaugcuaguucaacuuaauuaaaguuguuaaauuaguggaugugcagguuuaaaggcuaacauacacagggaugaaugggacuucuaucuaggaaaaaguaggauggucauauguagaaugguuacaaugucacucaacuugaguucuauggcuauuuuguuggcuuaagcucugggccaucuuuaugauaagggaaaaaucaaaucauuaaauagggccaaaacuaugucaagaagcaauaauacagggaaaaaucuacuguauuacaacuguacuuuuuaaaaaaugacacuaugcuuuccacuaaauguugcuaugaaccuaaaacugcucuuuaaaauuacaauauucaaguuaaaaauauuuuuuuaggcuggggaugguggcucacaccugggaucccagcaccuuaggaggccaaggugggaggacugcuugagcccaggaguucaagacuacacugugcaaaauagcaagacucuaugucuacaaaaaaauaauuuuaaaaaauuagccaggugugauggcacaugucuguagucccagcuacuagggaggcugaguugggaggaucacuugagcccaggaguucaaggcugcaauaagcuaugacugcaccacugcccuccaggcugggcaacagagaccaugucucuaaaaaaagaaugaauaaauaaauaaaauauauuuuuucaacauucaauacuccuaaauuuuauuuuuuaaaaacuccagaauuucaagagaacaaaugagauacacuaucccaucacuuauuccacguaauucagggaaaaugagcuauugcauauauaugaauuuuccagguaauaaagauuauucuccuuccaaguacccaaguucuauuuaauucaaccuauauggguugaaaucuaaaauauaauauauauauauauauauuuucucaaauaaaauggcugaaucacauuaauuauuugggggagacacaagaucauuacuaaaaauaccuuuuauuguacucuacagcccauuuuuaguuuuacuaauucacugucagcuuucacuucuguucccauuguacuugcaucuaacauuuaauacuucuaauauugcugugggcuagaaacuagagagaaaaguuuaacugcauauuaaaucagagcugagauucuuaaaaaguuuuaccugguguuuaagggccuuuucuacucuaaaucuggaguugaauuaaagcuguuggaagccagguuucugaauauuuggcuuauugcuuauuaugguaaaaaaaaaaauucuauuuuugaaauuacuuuccuguaauuuauguaaaaauaaaaauuaugcaaugguccugaaauucuucucaccuuugaucuauacauuuugacuaguuuuagccuccgaagaaggucuucuuucuccugaaccugcuucaccaauuuggcuuuuucagcguuuaaucuuuguuuaggaagcuucucacucacaaacucauuuuggagagcacugcaugauccagaaucaagugacugagauucacagacauugagauucuucaaaguauuuuucaaauuuguauuuucuucaaauucacugucuauauguuuaaaacuuucuugaaauuccaaacaguuuuccucuguggaagaugcugguuucucugaaaaggucugaucauuuucuucacucucuacuuuaagacguuucaccacauuguaagaggaauuaaaugaaaaucuuguuuuccuuaaucuuucucuaaguguugcacucauaggcuauaaagagcacaaaacauuaaaaaugugaaucaagaaaaacauucuuaaugucaauaaaucaccagaaauaaaguccuuccauuucuaugcuagacaccacuagauggcuuucugucuccacaucuaaagaaggcaucacaaaaugacuuuaauuucuggaagcuccauuuguuuuauuuccuuuuuacuucagcaagaucaacaccuuuccaaaaguguugagaaguuuaucccaguaaucaaggaacauuuguucaguaacaagcacaugccugauaguacuccaggugcuucagaauuacagaguaaggaaaagaccuagacucugccacuaaagaccuucauaauaauauugcacagaugcaaacuuucuccaucuggaguauuguaauaaccuaaucugaaacuaacugaaaugaauucauucaagaggaaaauauggaagggggcuggugggugucauauaugucaccuuagaagaaaaacaaaauuauuuaauaaaaugucuacuuauuuaugcuacacauuauguuaauuaacaaccuuccguagaauuuaaaccaccacugccacaauacuuagaaacacauaauggauccacuggaagaacaaagauuuucauacuuguuuucgggaacuauuuguauagggagaugauggauucgcagaggccugaggagugcuagguaaaaccacagcugagucugacggacuuuccaucuugaaagugaaaucuugguuuuucucuaaaaaagaaaaauuauaaaauaaucgaauuaaccacaccucucuauagucgacuuuuaucaaauaauauauuguauugguguacaaagcauccacaaguaagccagauauuucuucuaauuucacuuuguaauucauucuugcucuuuuugcaguuuuccauuuaccuucccacauagggaccacuaaguuuuucaugauacaucaaccagcuaguaucucauagucacaagacucuccuuguuuucguuucauccaccaaaauauauucaaauucugccuuggaaguagggaagaauaacagcuuuagauaaucaggaauucuuuauuaugacagcuucauaauucaagaagcuauagccgaaaccuugacucaaaaacaauaggaccugaaugucacccauccugaacucuacaagcugugacuagaacccguuacccugccggcccgaggcauaagaaacacagcggagacgcauuuaagcccgucuguagccuuuuaguuuaagcggccaacagggacugaaaaggagaguggacugaaauugcuuccuccgacaaaggcauuaacuuuugagggguaaacuaggggcgggagucguccccuccuuccccccguugcagaaagcccacuaguuccccggagaccccaggcauaaggugagguugaguuccccagacccggaaagggagcucaacucgacuccacagccgacucccggggaagcccaggugucagggauccccccuuccccucagcaggguaccucccuccgccauucccagcgagagcaaaaaagcgcgcgcaccugcggccguaaaucgauccuguggcaggggcggggccgugcgguaggcggaaaagaugcgcaauuggccagauugccugacgcgcga

SEQ ID NO: 18873 - RNA, 12201 nt, Homo sapiens
aaaauucaugaaauaaaaacuuauuuuccccuuccaccaaaaaucuacaaacacccauuaaaaugaggacauccuauaaacacaggccugguuugcccuuuaagauccaauuucuucuaauggaaggaauacuuaagcauuuacugaaaccucucacacacucaguauucucuugcaugaaugccgugugcaaguacuuggagguuuaauugcuuuaagugcugacagcuaaagacuuuacccuuuuguuaacacacccuggagauuuuaaaaacacuuuauuuaauaaaaguuaaacauacaaaacugaaauaauacacauccuaaaaauuaccuucuuccauuaauaggaagacccuuuucuaugcauguauuuggcuuaaacucaacucaggauaacugugaugauguucacuuacaccaacaaaugcagacaaccugaucuaauuaacaaaaauuacaaacagcuaaaugaacauaauauacagggaaauuaucgucagauuaaugcacaagaaauacaagaaauuuuuaaugaugaaauauucaguauucuuguucauuaauuuagccuuguguuuuuacaaaaauaguaucuacacuguauacagggcuauacaucagcuuuuuguucucccauauaaacaucacacauccaaaacaugguaccacugccguaaauggaaaaaacaaaaaacaggaaaaaagcaaacauacaaaaaacaaaaacaccuuagaaaagggagcucauccuaagguuucuuacauaaaacuaagaguacauaaaaauaaaacagcuagaucaauuuuagagauggccuaauaggccugggaaacaaguuauugaggaaaaaccucaaaacaaacuuugccauuuacaaauuaaccuaucuuuaagcuuaacugaacgacagcuaaguuuuaaagcugaaaauaagaaaaaugaaaagaucucuuuuagcagguugguguuuuugccuugguguuccaaugaauugcuagaguaugugucaaguucaaagcaucugaaaauuucaaguuacaacuuacaaaaaguacacaccauagguuaaguaggcgccugauauuaggaagaucaauaauucaucuaagugcuguaugaaacagcaucuacaaaaguugcuuuauucaacaaacuuugagggaaccgugguacugauaaugagaaaaguuaaaugaauagcaguuaucaaaugcaauuucuucacguuucauucuacugaagccaaccaaugacgacaaugguaucuugcuuacucaucuaacaaauaauuuaccuuuagaaaaauauaaggauaaaaagguaaauguaaagcccugcagagaugaaauccaacaguuuuucugauuauugaggcaucaaaugccugacauuguauuuagagguaucuugauauugugucauagguuuaucagcaauuccacagguuccuacuccaacuuuaccagucacacucucaggugaagcaaaaauacuccucuuuaccuaagggaaagaaaacagaaaucauuccugauuaguguuggaaaaaauaaaaaauuucaaauuuuaaguaauguuaaaauauauucugguuucaacguuuaaaagaagaaaaacauauugccuuuguuuaguguuaaaaaauggguacagaaguggucccaugcuggaagccauuuacuguaacuucuaaguuguggaaaauaucauuacauuuacuaauacucauaacacuugccuucugauacgucaaaauuuuaguuuuguaaacgcaaauccuaacuucagcugugagcuagccauucuagcaugauuaaagcucuggcuguauugugguuuacuguggggccuguuaugauagccaaauugugaagucccuuggccuuugucacaaaauaaacaucuuuaugaaaaggaagcgcuucuuuccagaagccauguccaucaauggaagggcuaccuugauggcagugaagaguaacacaugggugaaagucagguuauccuuauucucaacuuccuauaugaaugcuacaguuauuuucuacccaacacacacaagguaaguguaucaagggaaacugaaugcacuuuuaaauaaaaucuaccagugaugcccagcaugaaggcauguuaacaaagcagauagaguuaagcacacugccucuaaguagcaacuauuuuuucaaauauuaguuuauagaaggaaaagaacauagaccuuuuguaauuucugauauaaauucucucauuuguaauauuuuuauugcagagacaauggcuaacauuuuucaauaaguuaaauugagcaucaacaaggauucggaauacaaaaucugaguuaaucauacuuuacaaaaaaucuccaucucuuuucauuuuaaaguuauuuuaaugacaguugcauuucucaaauuuacaaaguguaaaaagauuuaccaaccuggccuuuuuuguuuuuagaauaggcucuguuguugaauuguugccauuucacuuucugguccucucuuuccugcucaaguucuuuuauucucugagcuuuuuucaaagcuuucuucuuuuuauauucacgcugcugggcaaucauuucuuuucugcaugaaaaaaaguuaaaugucaacuguuaagacuuaucauacaagaaugacuuccuugaagacaccggcagugcaaaaaaaaaaucuaauaaacauauacaauggucuaugaauaaaaaguacuaaaucauuaaaaucaguaccaaucacccagaauuacuaagaaauguuuuuuuaaaaaauggcauccuuggaagcuuucaaacauaacuguaaucuauuuacccauauaagguaaauauuucaacuaugccuuuuuuuuuuuuuuggcgacaaagucuuguucuguugcccagacuggaguuggaguacaguggcacaaucuuggcucacagcaaccuccaccuccuggguucaagagauucuugugccucacccucccaaguagcugggacuacaggcacaugccaccaugcccagcuaacuuuuauauuuuuaguagagauaggguuucaccauguuggccagaauggucuuuaacuccuggccucaagugaucugccugccuuggccucccaaaguguugggauuacaggcuugagccacugcgcccagccuuaauuaugacuuucuauuuuacuuuuguauagcuguuaccaguuguuuuaggaauaaguugaguuucaguauuaauggguaucuaagccuucaacuacuuccaaauagacauaguuaacaagugcagcauuuagaaaaaaauguaugaagagauucgaugcagauaaaauauuuuaccuacauuggaagaaugcagcagcacaaauggaaaucauagcuaauaauucucaccaaaacaaaacaccuggggguuucaaaaacauucuaaauaagauucuaaauaggaucagagccuaaaacccccaauaauuucugcucaguuaacacugacuucucaccaaaaggaugaaaagaaagauccuuaagaggggcaauaucuagacuccccgguaccauauuaccaccaugaagcuauggcuuuuuacacagaugacaaagacauuaaaaaauauauauauacauuguucuagaauuuuauuuuauuggaaugcuuacauuaauauauaauuuuugcauauucaaauauaaauauguagcaacuuaaguuucaaaaacucuugacaaaucaaaagacuaaguuguggcaaauaugcagaaguucaccaaaauauuguuaauucugccucuuacuuuucaaaacugcauaguuccccauucccauugcaacucccuggguucaggccaucaucuuauaccuggaucacagcaguaguugccucucccuacugacagugaucauucuaaagcucaaaugugaucacaucauauccccucuacuuaaaauguuaucgguggcuuacaagcucuuuauguucuggacuuuaccucucuaaucucuucucagaccacccaccuuccaggccccaaguuuuuaccacagggauuuguuacuuguacgugcucaccuccccccuuuaaaaaaaauuuacuaagcucuuacuacauguaaagaacuguuacaagcuuuacuaacacuuaucguuugaauccucacaacccaauaauguacugccccuaucuuacagaugaggaaacagaguuaaacagcuucuccaaggucauaaugcucauuaauaacaaagaauucaagcccagaucaacaucauaccgccuuguagcuuuguacuuggcucuuacucuuuucaaaucucaguuuagaugucauuuucucaaagaaaucugcccuaauaauaaaaguggaggcugaguaccucuuguucccuuacaguaccuguuauagcuccuuuguaauguuuacacuguacuauuaaagcacuucauuaaugaugaguuuucuucucuaaauauaaacucaguugggacaaggccugagguggucuccugugguauagccccaguaccuggcuuauaaaauaugcugggaagauguucauuguacauaguuaucuucuuaauauuuacugaaugccuaaaugggaaucaaaauuaucuucacuuuacuuaggcacacuuacacagacaauguugacccuuuguugcuaaucuucaaaacaacgguaaaacaguauuacaacuuucuuaugcauagauucucucugcagacuacuucaaguauccaaauggggaagauugcaccuaaaauggaaaagucaaagucacuuacuuugacauggguuuguugccacuguccuccuuugccuuccuuccuucuucuacaggcuugagguucaacaguggagucacuucagcauugccauaaccagcaaaggugauugcagcggugccauuuucuucaucuaucuccucaaucuccgcuucauaacaccuguaaagauaucauggcuguaagcaggugaguaaagguuuaguacucagccuacaagacuuauacuguagugauaaaauuauuacaugugucuauaaugaaacuucuauaaucaaaugguuguuucagcaaagagaauacaaaagagugguugaaguuaguuaucugcuaucaaaaaaggacaucccaaucauaauauugcugggcaagucucuuacauguaccuacucaacgugauuuaaugucuuugagaauagagguuucuuuuuuucucuuuuuugcgacagagucucacugucgcccaggcuggagugcaguagugcaaucucagcucacuucaaccuccgccucccagguucaaacaauucucaugccucagucucccaaguagcugggauuacaggcacacgccaccacaccuaacugauuuuuguauuuuuaguagagaugggguuucaccauguuggucaggcugcucuccaacuccugaccucaagcgaucugccugccucagccucccaaagugcugagauuacaggcaugagccaccacacccagcgaaaagauauuucuuauaggaaugaugucaguguaugcucuucacagaauucucagaaaaaccaaccauucacucaauuuucaauuagagaaaauaauuuagauuauuuuagaaaacacccauucauuguccuguuuuucuuuccuccagaaucccagccauucuucuccccaaaacuuaaucuaaagcuaaaacuaaacuguauuaauggcaaccacccaagaaucaaauuggcucuauaaaucauacugccuaauagaagucaagauuaaaauaggguaguuaaaacugaauaaaaacuucuuaccauuguauuuuauuauuucauguuauaguuagaguuuuuuuuucuacacuuacuguccaucuucacuccagacugccauacacuugucuccuacuuuccaugaaugaguagguugaguagaagcaaaacugucugaacuugcaagcgucucagaagguugaguugacagaaggucuuugguuaguucuauaacuuccuaaaaaagaaaaacaaaaacuacaacauuauuuuuauaauucucauugucaacuuaguuucugaugacagccuucauacuguacguuaaguacucuacauauauuucauuugcagcucauaacacuauuaagcaaguacugugauuauccccauguagaaacugauacaguauugucuaccaguuaaguggcagagcugugacuuaagcccauauaguugccuuucaacuuaaccacaaauacuaaugaaaauauaagacuugagcuuauaccaugcauuauuucuaagugccuauuuuagcugaauagaucucucuaaagaugagaaagucaaguaugaggcacugaauuagauacucuuauuguaacauauuuuaugcaacuguacuguuuuauagggcauuacucagcaguauuaacugccaagcaaucccaaaacacuuuaagcagcuuuauuaguaacaaaaauguuccuacuuauacauaucucgacuaaaauacuacaggcaauguaaaagaaaccaguggucuuccuauucaauuauuguaaaacucaccccaucuggguaagcaaauuaccagguuagauuuuaaauguuccauaccuuaauguuaagcacauuagcacagcuucauuuaaaagggggaaaaaaagguaacacacaaaggcaaugccuuucuguguggcaaauauuuuuuucuaauucaggcuuacauuuauuggcuucauucaaagauguuugguguagggauggcuaaaaaauugagaacaguacaagccgacagauucugcuaccugucuacuauauuguuacucuaaugaagauccacacuaugcaucuuaucugaucuaagaacuugcauagcuguucacccauuguugcauuuaaaacaucauacuguguguuuggggagaaaaauuaacaaaguuaaacuauguacugaguuucuucuaguucccacugagguuucauaauaguaauuuugauuccaguagccaagaaaguuaaauauuaccucucuccuaaagauucuaaaucuuccuggcuauuucugaaaaaacuaauauuugagucuuaaaucucuugaagaaagguuaguuuuauaaauaaauaaauagaacacuuagguuugauuuaaaaauuuaguaggaauaauaucucuaaguuuuauuaguugccaacuagccauuaauuagaucuuuuuaauuagacaguccuuugcaaacaaagcaaagaaccuuccaaauaacuagaucaaguaguacacaacagaagaguaaauuaucuggucuuauuuuuaaccacuuuuagggguaggaauguaauccagucagccugacucaagagcccacacaaaucucuaucauuaaauacuuccagauccaccuagggaucauuuaacuuaagcacagacaugaauucugcacuuguagguuucagauuuagaacucuauuucuuuuaggacagaacuguuuuccaaauauauuuuguuaaagaaauauauuucaucaaagaaaaggguccugaaaagcugugcauauuagugaauucagaggccugugcugaaaugacccuuuuuuagaaaaaauccagagcauuuacuccuaauguccuuuaacuuugccaugguuuuacauaacccucccaacaaacuaugaagaaccuucuaaauuucuauucuucacaugugcguauggaccaaaguauuagaaaaacuauuuuauguaugaggggguucuugaagguacauaccauuaauuacuuuuccucccucaagucugaguucugaaacugcuccuucaucgacagaugggcagcaguuacaguaaucggcaauuccaggaagcaucagguguugugaucuacauaucagcaggucaaauggggugcacucaagcacucugcuuacugaaggaaggcguuucggggaugcagagagccacuguaauauaugagacaagugacuugaccccugccuccuuuagaaccagcuuauucagcaaaacagccuaauaaauugacuaucucugauuaucauagacugcccggggagcuagucagcuagcuagccuggauuuuaucacacccacuuuuuuaagugaaaaaagaaaggcaggacuuuaguagauuauuuugcugccugcugaauaacuuuagucucuaugaaagacaguacaugaaagagauaaacauggaaaccuuacuggcaaaaugaagucauugaaaagaugcaaaaaaagcauuuugucauaaaacaaagggcaaacaaauuaauaacugggauaaggaucuaauucuauagaggaacacaagaaauuagaaaccauaugauggucaaaaaauauuaauaugaggaagccacaaaaucagucugaacagacuuuucaccaaauauaacaagcugaauuaaauacccauagcaugagauacaucccagaaggcagagaaggaaaaaggaggggaaugagggggggaaccccacagcaaaauagaagcuguuaaguguagucucaauggagacaacaauuacugaguggaagcuuauagccaaauacuuuucagaguauuaccucaucuuaaaagaugguuuccguuuuugaguaguuuucaauucaaaauagaccuuaucuagggaccaaaaugaaauuucuaaugauagaauaaaaugggaagaaacucugaucaagacuggucaggaaaaacauucuguuauuacuaucugaaguauuaaaacuugcacuucuaaauccuugccauccaguaugguagucacguguggcuaauuaaguuauacuaaaaacucagcuccuaaguaaaccuagcuguauuucaaauauccaaccaaauguggcuaguggcuaugguacugaauagcagauauagaacauuuccaucaucacagaaaguucuacuggacagugcuguuuuaaaugguuauagaaaagaggauacuuuacagaaaaaugauuuccaggucauuauuaacugaaccccugcaagcaagccuuuuaggggcuuacuacaguguuuaucacaaugguuucccccuacaguacuuuccacuaugaugaucaugacaugguaaggcaguucugcucagacucuaaugaggaauuauucuagaaauauuaaaaagaccugaugauaaugcuauuucuaacuccacucccaacuuccccaacccaaccaguucaacaaauaccccuccucccacugcccaagaagcaauauacaaaacauuggcacccaguguuuucuuuuccuaaaaaaggacugcuuaaguugguaaagguagucaaggcaucucucuuuggggcaaacagaaagcacuuuacagaguguaagaaaauaagaggucggugugccucuguugccucaucuucaauguauacucacaacauaugagcaaaucaaauggacagguggcaaaccacuggguuauuucucacuuaagggccugggagugggagaaacugcucccaaaacaucuuuuuuguauugacuggcacccugaagcccacaggccuggcuucuacguaucgaagaggggucuuguucauauugaaauuaacccagauaguuuguguguguuuaaaaauaacauacuacugcaauuuuauucuaaauguagaacuugaaaguauucaacucaucuuaauuacgcccagauaagcaguuccagaaucccaaauccggacccuauuuccguuaaguuuguuugcaguucugauaucccuaaaauaguaauaguuuuaacgggcagugggauaauaaagggagggaaugaauuuuuagacaggauacagauuugaguuuaguacucagucgguaaagcaaucucuaaucaaaacacccuugaaacuuuuuaaaaaucagguucagaauuuaaaggaagcucuuaaaagucauauauauuugcaaauuauauauggcauuuuucugaaucagucugguguccugaaacacaaaagguauuuacuaugauggcucuauguuugucuugaaaucccagugcagguuuucaaaaaaagguuucauuaucuacuaaacucuaccaugacaaagaucuccuuuucaccacauaguucaauuuccacaagugucaacaacuuuacuguaaaaccuagccuuaagucugaacaucuauguaacaauuauacaaagcacuugucucucuuuaggcauuuuugugguguguuuucaauacaaaauguaauccacuagcuuuggggaaaaaaaaaaggcacgcauuuucaaagaaucuugugguauuaaaaagaaucuuaagguucuauuuuucuccuucaaucuuuguuacuuuuugaacuaaauuucauuugccaggucuuaaaaacuaaaagcguuuuucauugugaaguuacauguaccucucgucuugaaaaucugacagacuuggaaauuucuaucaacuuuaguuuuuaaaaauuauguaagcacacaagauuuauauaacaaagaacaauauuucacucugauguacagaaaccugagaacuggggaagcaacccuacuucuacaagcaaugguaccuacagaauuuacauauauacauagggugggguguaaccccucaaaaggcgcuuuggguacuuagggauucaagcaauaauuugaaaaacagagaaaaaguacaauugucuacccauacuuacuuguaaaucuuucuucaauuuuagcaaaucuucauuuucuccauuuccagauaaugcagcuucaacuugcuggagcugagcuuuguagcuugccagcugcuuugcuaaauccucugacaucuagggaaaauaaaaaggguuagaccaugaaaacuaaaccaaaaaucaaggcauaaaaaacuaacuccccugucugccugaauuaccaguuuuugccucuaacuccuucuaacacugcagcuuaauuuaccaccauuaccuuuacucucaguuuagacuucagcuaaaccacaaacuuaaaggcaacagauucugaggauuauaaacuugagauacauuccauacuuuaaaaaagcauacagauacaaagaaauuucuaauuuucuuuuaacuccuauccacaggguaggugcugaauucggcucaauaaucaguguuaucuuuuuaaaaagcacuacucuguuggaaaagucgaaacuuucaaaaacaauccaaauacuuauuuuuaagcacuacaguaugcuuccaaagccaaacaagugcguuuuuaaauuaacuacacaaacuacgaucuuuacuugaacuauucaauuaagaguguauuuaaaagugccucuccaaaacaaaaaucuuucgcccagucgcuuaaauauuuaucggugcauuaucuucagcaaaaagaacagcacagguacucucccauuuaggcauucuaacgaaugugccuuucgccaaauccagcucagucauuuuccugaaaauaagauaccaauuaaccuuuuuugaugguuuauaagcaaauguaccacguuuccgaggacccuucuccuucguaaaauucccguccaaccaaaggcugggagccugcaaaggcccccuaagaguuacagcgacccaggcugcucuccuccccgccacgcagcaccucaaagcccgccacaacucgaucauucggacguggaaauccacacgccagcuccaagaccaccgccggagccccgccgcgcuccaacaggcaggcuccacagggagccgcgcggcgcccagccccacccgacccgguccccugcgggccguguuugccgccgccgcacggaggccagcgccggccgggccgccgaggcucagcucuggcugagagacggccguggcuccgggauccagggccagcgccugggcgucuccggcgaggcgggcuccucagccuugggccuccgcuucaccucgggagggacccgggcccggccaggccuuacucucucccucagggggguuguuaccuuguguggggcugggggcggggcggcgggaaggggucggggcaaaugagcccagugguaguggcgguggcagcagcagcaguagcaguagcaggaaaaucaccgcgacgacagcaaggcgacccggucugaaaaggaagaacucggucggcggcgagggggaagggaggaacgccgggcacuggaaggaggaaaagacagagacggugaagucucgcgagaaauacaaacucu

SEQ ID NO: 18874 - RNA, 2704 nt, Homo sapiens
ucauugucacacagccuccagcuucccaauucugacccuuaccugcaaagcccucccucuguccccuggggcucaccaacacuguuucccaucucccuuuuucuuucaucuucaccacagccugggacagaugucagggagggauaauuaucuacauuuuagagaggaacaaacugauccagagaaguagagugacucacuguucuugccuggcuggaucuagucaucuccuaacccagcuaccaucucucuaauccacccagcccugucaccugucaccaggguuaccuucuuaaagccaaugccccauucagacuucuggcuauuuuccagugagcacccaguaaagaguccccagcugcccucuccugcgucaucacucccgugucccuuucuacaccccaugcugugaccacaucagcccacucacucuuccuacuauauguucuccccaucucaguggcuccccucaugcugcauucucugccugguauucucucccuucccucccuuccuucucugaaugucaaaguugaauuccuccaccaggguccagcucaaauguuaccgccugcuuuggagccucccccgccaguccccaguaagcaugaaucucuucuuucucugcacucgcugagugcuuggcuuuuaccugcccuggugcaucgauuucauuccaccuggagcuagcgguguuuugcaccauuugccucccccagggucuguaagcaacuucagacccagaaccccaacuuagucauuguguucuaugaccuuggcaaguaacuugaccuuuucugggcuauaaaauggggaugacagcagcuuuaccaggguaggauaaggauugaacaaaucaccaaggucagugcuuggugaaugaugggggacgaugauugugaagccagucagagccagcuguggcugagucuucugagcccagaaacuuguuucuguucacuuccuuccuuccccaaaaaggcauuaaacccaccugaggaaauuagacugcugugauuuuguuuguuuauuuguuuuugagacagagucuugcuuugucacccaggcuggagugcaguggcgugaucuuggcucacugcaaccucugccuucuggguugaagcaguucuccuuccucagccuccugaguagcugggauuacaggugcuuaucacuacacucggcuaauuuuuauuuuuuuaguagagacaggguuuuaccauagugcccaggcugcuuuugaacuugugacuucaagugauccacccacuucggcuucccaaaguacuaggauuacaggcguaaaccaccacgcccagccuagacuauugugauucuuaaaggcagcuacacacuagaaucaucggcgagcuguugcaucagaaucccuugaggaacuggcugaaaauuuagauuacugggccuuacccuggaccuucuaaaucagauuuccaggguggagcccaggaaccugcauuuuuaacaagcuuccuaggggauucugcugcaacaguucuggccacacugggccauaggaaagacagaggguagcuggggugggacaugaugaucacaccuuccccuuugcuuaggugaucguggaaguggcuuugggggauaacagugcccacagccagccaccaguacucuucaucuagcuccucuuugagcccuaguccaaggcuaggguaacagggcuggucaguagccagacuugguuacuagauucgcaacuggcaaagcaccugacccagucugggugcucggcaaauauuuguggaaccaacugaauuccccuggggcuggcucuggcaggggaccugugaccuagccugcugggcuagacccuagccccugcuccuccuucugggccuggcugccuccccaaggagccagcagggagagguuugacugguuccauggggaggaaaccacugcggcucagcccagggagccgcacccugaggaaggagagcuggggcaggaguaaacaucuggagaccccguccucccaccagcaguagaggaggaccuccgucagcaaggaucuacugagcugagacccagugagcugagucuuagugcucacucagggcuucucaaucccagcugcacauagaauauuggaaaauauucagaaaguaccacucuugggcccaccuccaaccaauggaaucagaaucucugggaugaugccugagaauugauacaucuggaaagcagcacgagcgauucuguuguauggcuagaacugaaaaacugcccggccagcuggccuuucuuuuacucuccuuuugccccccaaugcuuuguagucugacguugcucagaaauuuaacaguaaaaaaucacagcucauaacuggugagcccuucugugugccagggccacacugguuacugcagauagagcagugaaugugccccugccuucacagaagccacucgcagagaagacuagcagagaaggcaggcuagcaaacaaagcaucagaauagaguguucuggggguguccaagaggagcccccacuucagagccugaggguugguagggaugaggggaggcuuucuggaggaaguggagccuagguggaggucugaggacagguagaacggguagagguaagccuggggaaggugaggugggaggagugaggaaggcagacggaacagccugugcuagcaagaagagccccaagcaaga

SEQ ID NO: 18875 - RNA, 4660 nt, Homo sapiens
cuuugccuuugggauggagggaggugauauuaucugagcuuugcauuaggagaaagccccuggguugacagucccucuguccauacccgguggaauccucuccugccaacaguggcaaacuccuuuguuuguuuguuuugagguggagucugucucugucacccaggcuggagugcaguggcgggaucucagcucacugcaaccuucgccuccuagguucaagagauucuccugccucagucuccugaauagcugggacuacaggcaugcaccaccacgcccagcuaauuuuuuuguauuuuuaguagagaugggguuucaccauguuggucaggcuggucucaaacuccuggccucaagugauccgcccaccuuggccuccuaaagugcugggauuacaggcaugagcuaccacacccggccagcaaacuuucuuaucucuuguucuccauucccaggacucccaugguaccaacucaguaccuugcucagcaucccaggguguuagaacugaauggcugcuuauggacucccugcaaugggcaccuccuucuuuuacagcacagaaaauugaagcauucaauucacucagggagaggaagugaaacacccaaagcaacacagcuaguuagggacagggucacuaccuugucuuaagaggcgaaaaauaggaacuaucucccacccucuccccugacaaaaccaaacacucuuugcgccccuccaaguaucucaauacugcuuaagccugaggaguacggggaagaugaaguauguaacguuuaucuacucacaaagcacagaguuucuguugccaccucugagcagcugucuuguucugggcaacugugaucucccuuccucuccuaagcucuuggaaugaaucuuucuuaagggaaauggaaguugcaauuccauuauucuguauagagugaguuaaggggaaggccucucuccuuuucugucaucuaauagcuaaauuaacauaagcccauaggcacagggauucagguaacagaaaccuaguuugugacaauuacaacgugaaaugaaaacauacauuguggcccagaagcccgggcagcccuaggcuucagauauuaccuacccuaaaguaguauaaugccuuuuaccaagaacacagcugaaucaacugugcuuuucauagaacaggcacacacuaaaauauuuguggauugauuugguaggcaaaaauucuuggcacuuggauacuucuccauuuucagcuuauucuuaaaaaaauuuuuuuuguuaaauguucagcugcaaaggcacaggugacuaaguguucaacacagcuggaaggaauguuggugacaguggcugucaucuauauuucccaaguugguuucuaaauaacacugcuucugggguaucuugagaaaaaaagguucuguguuuaaacaagguaggaaacauuacuaaucuuccuaccuuggucucccaagacacuaaaggcacauagcuuauuaaaaacacugagaaggcugggcacgguggcucaugccuguaaccccagcacuuugggaggccgaggagggcagaucacuugagaucagggguucgagaccagccuggccaacauggugaaaccucaacucuacuacaaauauaaauauuagccaggcgugguggcaggcgccuauaaucccaguuacuggggaggcugaggcaggagaaucacuugaauccaggaggcacagguugcagugagucaaaauagugccauuacacuccaaacugggcgacaagagcaaaacuucaucucaaaaaacaaacaaacaaacaaaaaaccacugagaagaguuguggguaaagaaacaguuuuauuuuuguuuaaacgaguuauuuccaagaccauuugaccauggaacaaucccucccacauuuuuuuuugcaugauaucuauuaaaguuccacaaaauucauguucuuuggaaaauaacuugggaauuacugauugagcccaauuucugaauuuuauugguaaagaaaaagguccugagaggggcugaaguucuuacaggaaguuagugggggagguaggacgacaacccuauuuccugagugucuggcccaaccuugucaaccacacgcaaauacggcagcauucucaaagguggguucugggaucccagccaucauggguacugcuugagaugauacgcaaaaaggacaugaacguuuuccucccuaauggguccuuugggggcaauuugcuaaaacauaacagguuguuuuagaugcuucuuaaaauugguaaucauaucccauucuuucuuuaucucauagaacucgggaugccuacccaacacagccugauuaugcuauaugugcuuaguaaguacauucaaugaaugacuaaaugaaagacagggaggaagaaggaaacaguccagaacugaaagggaugagaagagaaaaaauguggagaaagagaaggauggguaacaaaggagccagcagucacugaucaguagaguauaggugagagaggggaaaggagacagcugcagauaauggaaaauaacaaaacaaaacugaggucugggaagcuccgauuuuaaaaagugaacaugaguuaugagacuaauucagauacuggccacaccaggaggcccccgcccaggagaugaggaugaccaccaacugcugagaaucuuuguaaacucaaaucaagguguauuuauugcacaggcacaauaaaugaacaaggcaucuuaaguacuacaaugacaggugagugggucaggcacaguggcucacgccuguaaucccagcacuuugggaggccgaggcaggcagaucccuugagcucaggaguucaagagaagccugggcaacauggcaaaaccccaucucuacuaaaaauacaaaaaacuagcugggugugguggcacaggccuguagucucagcuacuuggaaagcugaggugggaggauggcuugaccccaacagguugaggcugcagugagccaagauugcaccacugcucuccagccugggcaacagggcaagacccugucucaaaacaacaacaacaacaaaaucacagaugaguaagacacaggucuuucccuaaacaagguuacagucuaaugggcagaagggcuaggacagggacucagaugaaauaaugccagguagaaugugaucagugccccuggagguguggcaagccaacacugugaggaaucagcggcaggaagaucauaucaaaucacgaggcuccagaaaaacuacgaggguccaggaaugguggcucacgcuuguaaucucaacgcuuugggaggcagaggugggcugauugcuugagcccaggaguucaagaccagccuggacaacaugaugaaacccuguguguacagaaaauacaaaaauuagcugggcauagugagcugugccuguagucccaguuacucaggaggcugaggugagaggaucguugagcuagggaggcugacggaggucgaggcagcagugagcugugaucaugccacugcauucuccugggcuaaagggcaagccccugccucaauuaaauaaaacaacaacaacaacaaaauaaaaaacuaccaggaagggccaugaggcacagaaggauugcaucaggcggagauaggagaugagaagagagacauuucaaggugauauauaaagaacuaccagggggugaggaagcauauggggagauguguggagacacagccugaaagucuugaagucacaucacggagccuugaaugaccgaccgaggcgcugacacucaagagaggcaaugggaagccagugaagguuugugugugugugugugcgugugugugcagagaaauaguagcauuagagaugauucccaggcagggugacugggcagccaagggaaagcgcuggccugugcgggaugaggcaguuggguucuggagagcacaagcaaucauucggugcugcccaucagacaacugaaaaaucugaucagaggcaguggcuaaguccccgccugggaacacaaaggaagccuaagguucugguuaucacccucaggggaccgugaccuugaaagaguaaggauaguaccagccaaaaccaaugcagccaagaggaaaagucacagagaacagcgaggggagguggaaguuucaauacagaaauuguagccauggcugagaaccccagcacuggaggccggaauuugugcguuugaacgccagaggcuuggcuagucaugauuagcaaaggaacuucaaagaguuuuggagccugcuuuauaucugugaaaugggaauuauuuccaucucaaagguuugaggggauucgcugagagaaacuucuuagcaugggaucuccagaaacuggaagccacagagaaagcagcggccagagggaggaggaaucggacaggcugaucacuuggaguguucgccuaagcaguuucuagaaauggaggcagggaccaucaggaagcucaaaaccuuugcuucagccgaguuugcagaacgcccugugaggagaaugggugagcugggucgaggaagcuucauccucguccccaucccccagcacugcccuuuucccaacgcucccaucccgccacgccucccaacauacccccaccccgacuucccgcucaacucccgcucc

SEQ ID NO: 18876 - RNA, 4660 nt, Homo sapiens
ggagcgggaguugagcgggaagucgggguggggguauguugggaggcguggcgggaugggagcguugggaaaagggcagugcugggggauggggacgaggaugaagcuuccucgacccagcucacccauucuccucacagggcguucugcaaacucggcugaagcaaagguuuugagcuuccugauggucccugccuccauuucuagaaacugcuuaggcgaacacuccaagugaucagccuguccgauuccuccucccucuggccgcugcuuucucuguggcuuccaguuucuggagaucccaugcuaagaaguuucucucagcgaauccccucaaaccuuugagauggaaauaauucccauuucacagauauaaagcaggcuccaaaacucuuugaaguuccuuugcuaaucaugacuagccaagccucuggcguucaaacgcacaaauuccggccuccagugcugggguucucagccauggcuacaauuucuguauugaaacuuccaccuccccucgcuguucucugugacuuuuccucuuggcugcauugguuuuggcugguacuauccuuacucuuucaaggucacgguccccugagggugauaaccagaaccuuaggcuuccuuuguguucccaggcggggacuuagccacugccucugaucagauuuuucaguugucugaugggcagcaccgaaugauugcuugugcucuccagaacccaacugccucaucccgcacaggccagcgcuuucccuuggcugcccagucacccugccugggaaucaucucuaaugcuacuauuucucugcacacacacgcacacacacacacacaaaccuucacuggcuucccauugccucucuugagugucagcgccucggucggucauucaaggcuccgugaugugacuucaagacuuucaggcugugucuccacacaucuccccauaugcuuccucacccccugguaguucuuuauauaucaccuugaaaugucucucuucucaucuccuaucuccgccugaugcaauccuucugugccucauggcccuuccugguaguuuuuuauuuuguuguuguuguuguuuuauuuaauugaggcaggggcuugcccuuuagcccaggagaaugcaguggcaugaucacagcucacugcugccucgaccuccgucagccucccuagcucaacgauccucucaccucagccuccugaguaacugggacuacaggcacagcucacuaugcccagcuaauuuuuguauuuucuguacacacaggguuucaucauguuguccaggcuggucuugaacuccugggcucaagcaaucagcccaccucugccucccaaagcguugagauuacaagcgugagccaccauuccuggacccucguaguuuuucuggagccucgugauuugauaugaucuuccugccgcugauuccucacaguguuggcuugccacaccuccaggggcacugaucacauucuaccuggcauuauuucaucugagucccuguccuagcccuucugcccauuagacuguaaccuuguuuagggaaagaccugugucuuacucaucugugauuuuguuguuguuguuguuuugagacagggucuugcccuguugcccaggcuggagagcaguggugcaaucuuggcucacugcagccucaaccuguuggggucaagccauccucccaccucagcuuuccaaguagcugagacuacaggccugugccaccacacccagcuaguuuuuuguauuuuuaguagagaugggguuuugccauguugcccaggcuucucuugaacuccugagcucaagggaucugccugccucggccucccaaagugcugggauuacaggcgugagccacugugccugacccacucaccugucauuguaguacuuaagaugccuuguucauuuauugugccugugcaauaaauacaccuugauuugaguuuacaaagauucucagcaguugguggucauccucaucuccugggcgggggccuccugguguggccaguaucugaauuagucucauaacucauguucacuuuuuaaaaucggagcuucccagaccucaguuuuguuuuguuauuuuccauuaucugcagcugucuccuuuccccucucucaccuauacucuacugaucagugacugcuggcuccuuuguuacccauccuucucuuucuccacauuuuuucucuucucaucccuuucaguucuggacuguuuccuucuuccucccugucuuucauuuagucauucauugaauguacuuacuaagcacauauagcauaaucaggcuguguuggguaggcaucccgaguucuaugagauaaagaaagaaugggauaugauuaccaauuuuaagaagcaucuaaaacaaccuguuauguuuuagcaaauugcccccaaaggacccauuagggaggaaaacguucauguccuuuuugcguaucaucucaagcaguacccaugauggcugggaucccagaacccaccuuugagaaugcugccguauuugcgugugguugacaagguugggccagacacucaggaaauaggguugucguccuaccucccccacuaacuuccuguaagaacuucagccccucucaggaccuuuuucuuuaccaauaaaauucagaaauugggcucaaucaguaauucccaaguuauuuuccaaagaacaugaauuuuguggaacuuuaauagauaucaugcaaaaaaaaaugugggagggauuguuccauggucaaauggucuuggaaauaacucguuuaaacaaaaauaaaacuguuucuuuacccacaacucuucucagugguuuuuuguuuguuuguuuguuuuuugagaugaaguuuugcucuugucgcccaguuuggaguguaauggcacuauuuugacucacugcaaccugugccuccuggauucaagugauucuccugccucagccuccccaguaacugggauuauaggcgccugccaccacgccuggcuaauauuuauauuuguaguagaguugagguuucaccauguuggccaggcuggucucgaaccccugaucucaagugaucugcccuccucggccucccaaagugcugggguuacaggcaugagccaccgugcccagccuucucaguguuuuuaauaagcuaugugccuuuagugucuugggagaccaagguaggaagauuaguaauguuuccuaccuuguuuaaacacagaaccuuuuuuucucaagauaccccagaagcaguguuauuuagaaaccaacuugggaaauauagaugacagccacugucaccaacauuccuuccagcuguguugaacacuuagucaccugugccuuugcagcugaacauuuaacaaaaaaaauuuuuuuaagaauaagcugaaaauggagaaguauccaagugccaagaauuuuugccuaccaaaucaauccacaaauauuuuagugugugccuguucuaugaaaagcacaguugauucagcuguguucuugguaaaaggcauuauacuacuuuaggguagguaauaucugaagccuagggcugcccgggcuucugggccacaauguauguuuucauuucacguuguaauugucacaaacuagguuucuguuaccugaaucccugugccuaugggcuuauguuaauuuagcuauuagaugacagaaaaggagagaggccuuccccuuaacucacucuauacagaauaauggaauugcaacuuccauuucccuuaagaaagauucauuccaagagcuuaggagaggaagggagaucacaguugcccagaacaagacagcugcucagagguggcaacagaaacucugugcuuugugaguagauaaacguuacauacuucaucuuccccguacuccucaggcuuaagcaguauugagauacuuggaggggcgcaaagaguguuugguuuugucaggggagagggugggagauaguuccuauuuuucgccucuuaagacaagguagugacccugucccuaacuagcuguguugcuuuggguguuucacuuccucucccugagugaauugaaugcuucaauuuucugugcuguaaaagaaggaggugcccauugcagggaguccauaagcagccauucaguucuaacacccugggaugcugagcaagguacugaguugguaccaugggaguccugggaauggagaacaagagauaagaaaguuugcuggccgggugugguagcucaugccuguaaucccagcacuuuaggaggccaaggugggcggaucacuugaggccaggaguuugagaccagccugaccaacauggugaaaccccaucucuacuaaaaauacaaaaaaauuagcugggcgugguggugcaugccuguagucccagcuauucaggagacugaggcaggagaaucucuugaaccuaggaggcgaagguugcagugagcugagaucccgccacugcacuccagccugggugacagagacagacuccaccucaaaacaaacaaacaaaggaguuugccacuguuggcaggagaggauuccaccggguauggacagagggacugucaacccaggggcuuucuccuaaugcaaagcucagauaauaucaccucccuccaucccaaaggcaaag

SEQ ID NO: 18877 - RNA, 2886 nt, Homo sapiens
ucaaaauucagucagaauaaaaagaaaucaugauucuauuuccuuuuaccucugaagaguuaaugauugaucacuaauuguacauuuguuucuaaaaguauaugaacaaugccucaggaauguaacaaaguuauagcuuaagagcuccacugacaaaaauuuacaggauauguuacuacuuuaccuuggcuccuccgcugcauuguauaugcuggcaaagugcuuauaaaaaaaauggcauaagccaggugugguggcucacacccguaaucccaacacuuugggagaccgaggcaggcagaucacuugaugccaggaguucgaaaccagccuggccaacauggugaaaccucaccucuacuaaaaaauacaaaaaaaauucgccaggugcaguagcuaauaaucccagcuacuugggaagcugaggcaugaaaaucacuucagccugggaggcgaaagguugcagcgagccgaggucacaucacugcacuccagccugggugacagagugagacuccaucucaaaaaaaaaaaaaaaagaaaaaggaaaagaaaagaaggaauggcauagaugauuaacacccauucuguuugacaaucucaaaucaaauaauuuccucucuccccgacacuaccuauauuugcccccauucacacacaugcgcgcgugcgcgcgcacacacacacacacgcacucagauuguuuccuucagaaagugaauuuuguuuauccuuccaguaugaguaugguuaacuuccuuaugcguggagcugcuaagaggucuuuuguaacuaaucuguaguauaaacaaagcagacaguauuaaaugcaguugaccuagccaggaccauucacacaauauuaucugauaugcauauuuuuguuagaguuacuuucgaguuagccuggggaaucauugccaccuaucauugcuaucauauuuuacauuuuaaauguagucuuugguagaaugacagguaaaacaucuggaaagcuuaaaugcacugucagaaugauuccuaagaguaaauagaccaggaaugccaaugcaagaucuguaagcuauagaaauguaauuuuuaaaauaaaaacagguuuauucuuacauaugccauggcuagauguuuaagcuuuuuuuaaaaacucauucuuuuuucuccuucauuuugcccaggaaacauucuguuauauucuaauuguucuuacuacaaugucugaaaauucaacaguauagaguuuucaagacuugugagaaaaauguccuugaaaauuugcuguaaauuuuuaggcacugaagaaaguaucuucucucauaguaccuugcauuuauauuuuuacuucucuaucucuuuuucuuuucucuguucucucauuccucuuucucagcacauuuuacuuacuggugauaaacucgggcccugaccugaaauuaguguagcaaaaucucaaugucuaaacuguucuucagcuuuuaaucaagugcuuauucuuucagaauaaagugauugaauuuccuauagauucuuuggacuuaacagauuuaggaucugagcuagaauaaugcuacaaagagaauuuuuaaaaaucuugguucuuuuugugugcauaaguuuauuucuguacaguugacucauugccuuuguccuacgaccucuucaaggccagcauggguaacguuuuuaccaaaccaaagaauagcuuuggaguugcuuauauguuucucuuuaauaacaugcuugugccuuuaaacauagauuuuugcucuagugucagacacuugaaugcaacaccuuaucugucaaugauaacucuaccagcugcauucuuugagccuuaagugcauaugugacccucaaucauguauuguacaucuuaucugauuuuauccuuaacaguucugugaaggaggcaucacuaucccccuuuuacaggugaggcaaacugugcuuagugaaguuaaguaaacuauccagauucacauauuguagaaaggaacagaauuaggaugugaacuuaguuugcucuuuugacacacuacacaagguucccaaaggccaguuugugaaucagaaccaguuuucacuagugguaaaaugagaagaguaagaacaaacaguugaguuuuuguuaugccaacuuuuauugugagacacuauuauaguuccauuucuucugugaaauaauugguggcaguaaauaauuuccuuaaacuagguucauuguuacaguaaauagaaaaauaaauacuuguaaguauuaaacauuggcaaucauaugucaguccucccacugucccaugccccccucucauuucacugaccaggaaauucaaaauccauacuaugcuaugccuuuuaauaaccaaaaaaacugcuacuuaugcacucucugauagguagguagcagccacaguccuagacauuuguuauacguuaucuucuuucacuuucuaugauaacucuauaagauggauacuguuacucccauuuuaagaaauaagggaaccacggguaaauaucaucagggucuacauaagucaucugccuccaggggcugguuuuccuacuguaccaacuauuuguccuucuaugaagacccaguuuccucacagauggucagacagcccuucugggugugcagacaguuguuccugaaagcaaugaacaaacccuaccagauuccaccauugagggugggcugaaggcgcucagcugcagcuacuguaugccacaggagucccaagugaguguguucuuaaggaguccuuucgaauuguuguauugcuaagcauagacuguguggcauuaaccagaaccgagaaauaacaacaccgugcagcagaagaaucuauaaucucccuuaccuccggaauuugacaaguguca

SEQ ID NO: 18878 - RNA, 2886 nt, Homo sapiens
ugacacuugucaaauuccggagguaagggagauuauagauucuucugcugcacgguguuguuauuucucgguucugguuaaugccacacagucuaugcuuagcaauacaacaauucgaaaggacuccuuaagaacacacucacuugggacuccuguggcauacaguagcugcagcugagcgccuucagcccacccucaaugguggaaucugguaggguuuguucauugcuuucaggaacaacugucugcacacccagaagggcugucugaccaucugugaggaaacugggucuucauagaaggacaaauaguugguacaguaggaaaaccagccccuggaggcagaugacuuauguagacccugaugauauuuacccgugguucccuuauuucuuaaaaugggaguaacaguauccaucuuauagaguuaucauagaaagugaaagaagauaacguauaacaaaugucuaggacuguggcugcuaccuaccuaucagagagugcauaaguagcaguuuuuuugguuauuaaaaggcauagcauaguauggauuuugaauuuccuggucagugaaaugagaggggggcaugggacagugggaggacugacauaugauugccaauguuuaauacuuacaaguauuuauuuuucuauuuacuguaacaaugaaccuaguuuaaggaaauuauuuacugccaccaauuauuucacagaagaaauggaacuauaauagugucucacaauaaaaguuggcauaacaaaaacucaacuguuuguucuuacucuucucauuuuaccacuagugaaaacugguucugauucacaaacuggccuuugggaaccuuguguagugugucaaaagagcaaacuaaguucacauccuaauucuguuccuuucuacaauaugugaaucuggauaguuuacuuaacuucacuaagcacaguuugccucaccuguaaaagggggauagugaugccuccuucacagaacuguuaaggauaaaaucagauaagauguacaauacaugauugagggucacauaugcacuuaaggcucaaagaaugcagcugguagaguuaucauugacagauaagguguugcauucaagugucugacacuagagcaaaaaucuauguuuaaaggcacaagcauguuauuaaagagaaacauauaagcaacuccaaagcuauucuuugguuugguaaaaacguuacccaugcuggccuugaagaggucguaggacaaaggcaaugagucaacuguacagaaauaaacuuaugcacacaaaaagaaccaagauuuuuaaaaauucucuuuguagcauuauucuagcucagauccuaaaucuguuaaguccaaagaaucuauaggaaauucaaucacuuuauucugaaagaauaagcacuugauuaaaagcugaagaacaguuuagacauugagauuuugcuacacuaauuucaggucagggcccgaguuuaucaccaguaaguaaaaugugcugagaaagaggaaugagagaacagagaaaagaaaaagagauagagaaguaaaaauauaaaugcaagguacuaugagagaagauacuuucuucagugccuaaaaauuuacagcaaauuuucaaggacauuuuucucacaagucuugaaaacucuauacuguugaauuuucagacauuguaguaagaacaauuagaauauaacagaauguuuccugggcaaaaugaaggagaaaaaagaaugaguuuuuaaaaaaagcuuaaacaucuagccauggcauauguaagaauaaaccuguuuuuauuuuaaaaauuacauuucuauagcuuacagaucuugcauuggcauuccuggucuauuuacucuuaggaaucauucugacagugcauuuaagcuuuccagauguuuuaccugucauucuaccaaagacuacauuuaaaauguaaaauaugauagcaaugauagguggcaaugauuccccaggcuaacucgaaaguaacucuaacaaaaauaugcauaucagauaauauugugugaaugguccuggcuaggucaacugcauuuaauacugucugcuuuguuuauacuacagauuaguuacaaaagaccucuuagcagcuccacgcauaaggaaguuaaccauacucauacuggaaggauaaacaaaauucacuuucugaaggaaacaaucugagugcgugugugugugugugcgcgcgcacgcgcgcaugugugugaaugggggcaaauauagguagugucggggagagaggaaauuauuugauuugagauugucaaacagaauggguguuaaucaucuaugccauuccuucuuuucuuuuccuuuuucuuuuuuuuuuuuuuuugagauggagucucacucugucacccaggcuggagugcagugaugugaccucggcucgcugcaaccuuucgccucccaggcugaagugauuuucaugccucagcuucccaaguagcugggauuauuagcuacugcaccuggcgaauuuuuuuuguauuuuuuaguagaggugagguuucaccauguuggccaggcugguuucgaacuccuggcaucaagugaucugccugccucggucucccaaaguguugggauuacgggugugagccaccacaccuggcuuaugccauuuuuuuuauaagcacuuugccagcauauacaaugcagcggaggagccaagguaaaguaguaacauauccuguaaauuuuugucaguggagcucuuaagcuauaacuuuguuacauuccugaggcauuguucauauacuuuuagaaacaaauguacaauuagugaucaaucauuaacucuucagagguaaaaggaaauagaaucaugauuucuuuuuauucugacugaauuuuga

SEQ ID NO: 18879 - RNA, 859 nt, Homo sapiens
ggugggugaaaaaaaaaugccgcagcugaacggcgguggaggggaugaccuaggcgccaacgacgaacugauuuccuucaaagacgagggcgaacaggaggagaagagcuccgaaaacuccucggcagagagggauuuagcugaugucaaaucgucucuagucaaugaaucagaaacgaaucaaaacagcuccuccgauuccgagguaggaaaagccccucgggcuggugggguuuuuuaucuguuuccugggcuuggcaaauguugcugaaaggggagaaaucggggcugggggcggcggcggggcccggcgggcggcgugugcguacggugccaccauugcaaaaacuuguaacccuguuuuuuucuaccccccccucgaccucgccgauucuuuuucucccccuucucccccuucugcguggcguuugccccucgcccuccccaccuccaccccucugggaaggcggaaagacggccuccgccucgcuccgaaaguuuccgagacaaaucccgggaaaguuuggaagaaggugaguacgccccgcgcgccccgcagccgcccggagccgccccccgggccggccgccccgcgcgccccggccccgcgcccggcucggccuggcccugcgccggcccggucggggcgcccggccccucggggcacuuucuaaaaaguuucuccucacucucucccgcuccgcgcggccgccgcuguccccucgccgccccgccauguuagcggccaagaggcaagauggagggcucuuuaaggggccaccguaucccggcuaccccuucaucaugauccccgaccugacgagccccuaccuccccaacggaucgcucucgcccaccg

SEQ ID NO: 18880 - RNA, 2450 nt, Homo sapiens
uacaugugguaaaugcagagcuuuuaacuguacaguuguaugaaucuugacauaugaauauacccacauaaccacccgcgagucaagauaccuuucauucuagaaaguucuuuugugcuccuuuccagucaauuccucuccagagacaaccuguucuaaaacuucauaacauugaauccuaaaguguguacucuuuugugucuggcuuccacucaucauaacguuuuggaaguucaucuguguuguggguccauucguaguuucuuccuuuaaacugcugagugcuauguuauugugugaauacaucacacguugcuuguugcuuauccauucacccaggggcauauguguuacuuccaguuuagucugaaauggcucccagugguccacuccugcagauguuuguauccuuguguaaucuccucccuuugugugugccacacccacugccuugcuucuaacaaggagaauacuggagaaagggaugagaugucagcucugagauuagguguuguagggcugugacuucugcucucucacuuauuuuuacuuucccacucaccuauugugaugaaaacagccacgguauuguaagccagaguugcguguggcagggaacugaggaagacacauaaccagcagccagggaagaacugaggcccucagacugacagccugcgaggaacggagcacuguuguagccacaugagugaguuuagaagcagaucccuuuccaguggagcuuugagaugacggcuucccugaccagcaugguaauugcagccuugugagaaacccugagcaagaggacccagcuaagcagaaacugugagacaauacauaugguuguucaagggacuaaguuuuggagaaauuuguuaugcagcaguggauaacuaauacaggguuauuuaaauaauacuguggaaauucuugaacagauguuuuuaugggcauuuguuacauauguuuaauaaauaucuuauaaucccuuuuaacuccaucguuaucaccacccaccugauccauucaaacugagcuaugaggcacucauugcccggggggaggguugucagaguggcacaaaggcauugcauuuuguacuuugaguuuuugugaguuuacaaagcugaggucagggagaguaagaagauccaagagacuagcuugucucaucuagaagagguacuaauucccuggguuagguaaagauggugagcaugaggggagaagcuagagccuguugggacuccaauaaguguccuuguccucugcugcucuuccccuguggagcuucagugauagacccucuggauacacuuggagaucuggaacagaggggacucauuccucccauccauccauuccuugcuggguccuaggagagcucugggucccagauuaucccugugcuuggguggguaccaugggcaguggcaaccauguuggugaggccuguugagucacagaaggcuugagacagcuccagugaauuuuccacagccccagggagaacaauuauagugaccaacauuuaccuuugcuggagacuuccugaaugggagcaggggcagauacuguugaccagggaccuacaggacugagacugcauagaagaugcugaagaagacagaugauugccaagaguuagaucccccucccuaccaucccuggaacuuggaugcaacccugaagaagauaggauaaaaaaaugcugaagucaaugaacucaccuacauuuaguaagauuaguuuccuucugucguuuuugccugaggagcuugacagaaauuaaacugaauuucauacaauuaaagaaaaugacuuuuucuuuuacauuugaguuuuuguggcacaugggugucguaucugcuacccuggcacuguucaagcuuauagcagcauugcugaaaucaacgugguaggagaaggcacuagaggcugggcgccauggcucacgccuguaaucccagcacuuugggaggcgaaggcagguggaucacgaggugaggaguucaagaccagccuggccaagauggugaaacccugucucuacuaaaaauacaaaaauuagccgggugugguggugcacaccuguaauuccagcuacucgggaggcugaggcagaagaaucgcuugaaccugggagguggagguugcagugagcugagauugcaccacuguacuccagccugggugacagagugagacuccaucucaaaaaaaaaaaaaaaaaaaaaaggcacuagaacggggaguuggagaggccauccagucaacugccuucucuucaugcuccagugauuuaucuuuggaaaacuugacccugucugaguuuaucagcaacuacuucuuggugcagccacuggagauucccaagucgucauccucacugagaggcauagcaaaauaucuuucguuuggaguaccuuguaugcccuuacaaucug

SEQ ID NO: 18881 - RNA, 2450 nt, Homo sapiens
cagauuguaagggcauacaagguacuccaaacgaaagauauuuugcuaugccucucagugaggaugacgacuugggaaucuccaguggcugcaccaagaaguaguugcugauaaacucagacagggucaaguuuuccaaagauaaaucacuggagcaugaagagaaggcaguugacuggauggccucuccaacuccccguucuagugccuuuuuuuuuuuuuuuuuuuuuugagauggagucucacucugucacccaggcuggaguacaguggugcaaucucagcucacugcaaccuccaccucccagguucaagcgauucuucugccucagccucccgaguagcuggaauuacaggugugcaccaccacacccggcuaauuuuuguauuuuuaguagagacaggguuucaccaucuuggccaggcuggucuugaacuccucaccucgugauccaccugccuucgccucccaaagugcugggauuacaggcgugagccauggcgcccagccucuagugccuucuccuaccacguugauuucagcaaugcugcuauaagcuugaacagugccaggguagcagauacgacacccaugugccacaaaaacucaaauguaaaagaaaaagucauuuucuuuaauuguaugaaauucaguuuaauuucugucaagcuccucaggcaaaaacgacagaaggaaacuaaucuuacuaaauguaggugaguucauugacuucagcauuuuuuuauccuaucuucuucaggguugcauccaaguuccagggaugguagggagggggaucuaacucuuggcaaucaucugucuucuucagcaucuucuaugcagucucaguccuguaggucccuggucaacaguaucugccccugcucccauucaggaagucuccagcaaagguaaauguuggucacuauaauuguucucccuggggcuguggaaaauucacuggagcugucucaagccuucugugacucaacaggccucaccaacaugguugccacugcccaugguacccacccaagcacagggauaaucugggacccagagcucuccuaggacccagcaaggaauggauggaugggaggaaugaguccccucuguuccagaucuccaaguguauccagagggucuaucacugaagcuccacaggggaagagcagcagaggacaaggacacuuauuggagucccaacaggcucuagcuucuccccucaugcucaccaucuuuaccuaacccagggaauuaguaccucuucuagaugagacaagcuagucucuuggaucuucuuacucucccugaccucagcuuuguaaacucacaaaaacucaaaguacaaaaugcaaugccuuugugccacucugacaacccuccccccgggcaaugagugccucauagcucaguuugaauggaucagguggguggugauaacgauggaguuaaaagggauuauaagauauuuauuaaacauauguaacaaaugcccauaaaaacaucuguucaagaauuuccacaguauuauuuaaauaacccuguauuaguuauccacugcugcauaacaaauuucuccaaaacuuagucccuugaacaaccauauguauugucucacaguuucugcuuagcuggguccucuugcucaggguuucucacaaggcugcaauuaccaugcuggucagggaagccgucaucucaaagcuccacuggaaagggaucugcuucuaaacucacucauguggcuacaacagugcuccguuccucgcaggcugucagucugagggccucaguucuucccuggcugcugguuaugugucuuccucaguucccugccacacgcaacucuggcuuacaauaccguggcuguuuucaucacaauaggugagugggaaaguaaaaauaagugagagagcagaagucacagcccuacaacaccuaaucucagagcugacaucucaucccuuucuccaguauucuccuuguuagaagcaaggcaguggguguggcacacacaaagggaggagauuacacaaggauacaaacaucugcaggaguggaccacugggagccauuucagacuaaacuggaaguaacacauaugccccugggugaauggauaagcaacaagcaacgugugauguauucacacaauaacauagcacucagcaguuuaaaggaagaaacuacgaauggacccacaacacagaugaacuuccaaaacguuaugaugaguggaagccagacacaaaagaguacacacuuuaggauucaauguuaugaaguuuuagaacagguugucucuggagaggaauugacuggaaaggagcacaaaagaacuuucuagaaugaaagguaucuugacucgcgggugguuauguggguauauucauaugucaagauucauacaacuguacaguuaaaagcucugcauuuaccacaugua

SEQ ID NO: 18882 - RNA, 62781 nt, Homo sapiens
uguucaaagagagagacuuuaaaaauaauuuuuaaaaauacauugcccuuuuaaguccuacggauuuauuguauuuuauuuguguucgaaaguccgcuaauucccaauguggaggguuggggauguuucccuuagcgccucugggacgcugucccuaaggccuuauuccauguugaaucugacgcucucaauguccaggcucggcugcggcguggggaccgaaaaggggcggggugggucggacggcaguuuaauuacguccccgggaacugcgccgauuuggacuuuuggcacuuggaccuaugcuuuaaaaagaaaaaagugucauuggcguggaguggggcuaguggagggugaggugaaugcgccguuuggaaaccacaggacagugaacguuucgucucucccagcgagacucucccgcgggcccggcggccgcaucgggagcccggcggaaacauggcggcgcccggaggccggggccgcagccucuccggccugcuccccgcgcagaccucgcuagaguacgcccugcucgacgccguuacccagcaggagaaggacagccuggucuaccaguaucugcagaagguggacggcugggagcaggacuugucaguacccgaguuuccggaaggugaggggcuggcgucggggugggggccccucccggcaccuccccuuccucggggacggcgcccucccgcgaagcggugggcuaggcggguuugugccgcuggcgccccggggaguggcccuucgccuaacuugggccgcuguucgcguguucugcaauucccagggguccccaagcggccaccgacggggguuucccuggcacggggauccacauacucgucuguguauccugaguuccgcccgcgccugauauuagccaaguggacacuccgugaauauuuaguguccccgguggcaaugauugcaacguccacaccauucuguccauucaaucugguuccccagugucuucuggucaucuuucugcaucaucuugacauuuauugaucacuuuuucauguaucacacacaggguuuuuuuuuguuuuuuuuugauacggagucucgcucugucucccaggcuggaguacaguggcgugaucuuggcucacugcaaccuccgccucccagguucaggcgauucaccugccucagccuccggaguagcugggacuacaggcccgcgccaccacgccuggcuaguuguuuuguuuuguuuuguuuuguuuuguuuuguuuguauuuuuaguagagacggcguuucacuauguuggccaggcuggucucgaccuccugauuucaagugauccucccgccuccguuucccaaagugcugggauuacaggcgugagccaccgcgcccggccugccacacacaguccuaaacacuugaggggauaccuaaacacuugaggagauauuaccuuauucaauuaccucuauaucccagugaggugcuccuaucauuccccuuucacaguugaggaaauggaagcacagagagguuaagucacaugcccagggccucacagcugauaacugccccaguuggauuauacaggcccuggauuugcugguuucuuagcuguacugugcuucuccguucaaagucgugaaacuaauacuuuuaaaaaucggaaucaauuauagccuauuuccaggguuuaaauccuggccaugugagcuuuuggagcaugaaggaacagauauucccggcagggauguuugugaagcauaucuugccaugauaaaugaaaacguauuuuaccuucuuuggaugggaguagcauugcuuugccugauggugcuggcauguguccuggcgugacacugaaaccacauguauaguuaauugguuggauguggcagaauucaguuaucucaugggagguauaucggaaccugccuccgacaacagaguauuggugucuuuccaagucuuuugcacuacucaccuugagaagugcuuauuuuuccugcuauuaaucuuauacuggauuugaaauauuguggaauucuuacaaaagaauuggguacaugaaugcuuaucccaucaaacuuuaaaagauuguuuacaucuauacaaauauaugauuuuaaaaaguuuuggugcagaagguaguuauauaguaaguacacuguuauaaacaagcaggccaucaacugggauuuggggaauguuuuuuauuuucuagucuuguuuguauuuacagggaguguauuuuauucccaugagauuugaccucugugacucauaacuaaaaaaacauauaauaaaauauucaggcuuuguguuuaacacaguaugauuuucuccuggacccgauuauugaggacagaaugcuagaaaugacuguuuucuugguuucuuuagcaguaaacuauaaucaggaagucauaaacauaacuuuauuugaaaaacuguaugcuuuguucauuucuuagaagacuuacauguuuauaggagacagugcaguguaauggauagauucacagagaccuggaauuagauccuuguuauuuccauuuuguugguugugugauuuugagcaaguuacuugaccucaaagccuuauauuucucacuugcaaaacugaacuauuauuuaccuuucaggauuauuauuuguauugaaaguaauauauguaaaauucuuaauucacagaaaagcuuacuaaauguuagcagcuuuuuauuguauucauuguaauuauuguuauuguaaaauaaauuuuauuaagccugguaaguaucuagcacggugacuaagauguagucauucuuucuauacccccugaucuaagccacucuugacuauuuacagaaaagucacagaagacagauuaauaaauauuuugcaaguaggauaugaaauauacauuaauuagucugaaguuuuguaugaucacuugaucugguauauaauuaauauuuuaacaaaauggauaauuaagaggucacuguacccugaaaccucauuaguuuggacuaauuggcccaaauacuaguuugaucugcagauuuuuuuuucuagaauuuuguuaugauugaguaacaacaguuauuguuguuaaucauuagcuguuacuguuuacuucuuccucccaaguuuggcuuucaguugcuaaaagcuauucuaaauaccugcuucaaggcauaauuaauaguuguaauagcugcauugaguuauuuauaagcaguaaacuuuguuuucuuaaauugguuaaauagggaugcuguacuuuauuauuaguuaacaaaaucuuucuucauaguacagagcuuucuuuuuuuggaggaaagggaacacguucuucauuaauauuaauguuaccucaaugaaaucugugacaauaauaaguguauuuugcuuaacuuuacauuuagcauauuuuauuuuguauuuacggucucauccaaauccagaauauuucaguuucuucuccuuuaggaaacuguuuuaggcauuuuguauguuuauccuuacacacauuucacuccuuuuugauguuuaguuauaucuuacuauucuuaagcuugaccuuuauucucaguagcccauuuguaucuaauuguuuauguaauuagguucauuuacuauuugauauuucuuccuuuuuuuuuuuuuuugccuaaguguguugccuuuacuccuuuucacagacuguuacccuauuucugaaagaauuuaguagcuuuuucuugcuuuauuugcagauggcaucauaauagcagcuuucccauccucuacuccuccugcucccccacccguacccccaucccuuccuuuucuuucuucccuuuuugggcuuuuaaucucugcuaauuugccuuuuugguauguucuuccaaacccaaauaccuguuuaguuacagucauaaagauauaucuuuuauuucuuuuguugauagaaaaugaugguucauaguaaacaacuauaaauacaugcaacugccacagccuuuauauggugcuacucucucaaaguguuuauuugcauuagucuuaaaaaaaaaggucacauuuuaauggaaaguuuuagguaaauuuuaucuuucucuuuaaucauuguaauuuauuuuauguaaauuucaggauuagaauggcugaacacagaagaaccuauuucugucuacaaggaucuauguggaaaaauagucguccuugauuucuucaccuacugcugcauaaacuguauucaccuauugccugaucuccaugcauuagaacacacauacucugauaaagguaucugcucuuuaauuaguuucuaacagacuguccuggcauagucacuggaagaguggcugacucauuagcucauaggagaaugaacauuuggcaaggcuucagggauucuaaaaguaaucucuuaucuaugaauuaaagacuucauguaccuuuucauaaaggauuaagcuuagugauagugguuugccuaucuaaagaaccagcauuuaguauaugguuuuucucugcggauaggggcauaauuugcuauuuuucaugaucagauauuuuaaaaggucuuuuuguauguugaggcugacuuaaauuuguucuauuaaaaaaauaaaauaucugaccuuaauuuuacacuguuuucacugugauacaaagguuuaaaguucuuauuaggaaaugugacuaggcuuucauuaauauugaaugacaugaacugcaguggaaugcaaaauauaacagauacucuuucuuugacccugcuucauuaaaaaaugauuuauuacagcuaauguuuuucaaagcacacuaggaaauccauuuuuaugguauuacaaauucuaaagauguaggagauuauacuuauuggcuuuagaaguuugaaaaauuaaucaaauuuuuuuugucuacuuucuaaaaaaagaacaugggaguaaaugaaauuaauuaaaaguaucauuuaauuagguucaagugaauugaagcacuaaucuuggaguggauaaaaaaaagagauagggucaccgauccuguguuaguaaagaugagaauagacuauauacgugugaaaguaaaggauauucugaaacuuaacuuuaaaggggaagugauagagaaaucuucagugcaacugaaacuucagaugcuuuugaauuguaauacauuguauguuaaaauuaccagucaaaugauuuaucaagaacucaaauauuucuacuagcuaaauccuguuauuaaaaauuuaucuguauggauuuaagaaauauggauaucuuaucuccuagguuuuagaugccaguguuucuuguucaagacaucacguuuauugaacauguuguuaugugcaggguacucugcuaacugcugaggaaauauguaacaaaauugaauaaaaaacauuauggaaccuaaggaaaggaauaagucacuuugccuagaaacauuggaaaagauuucucagagaaggagacaauugagcuagaacuugaaaaauaagcaggagugcagcugaaaaugaaaguggggcagaagggacacuccuggcugaggaagcuucagguaaacaagcauggaaucacagaggaguaggauucuugcuccaagaacagguaaauaauuuaguguggcaagauuguaagaguucaugguaaaaguaaaaggagacaaagguagguuagguuaggagcacauugugaaaugcauuguauagcguucuuaauaguuuagacuuuuccuucugugaggauacagagauugaaguuuguuuuugauuuguuuuuuuaguagacggaugacauuuguguuuuagaauggcauuacacauggaguuaagaaucucaaaguuuaccaguuccauaccuaagaucaccccugaaagacuauuuggugaacucaugguuaaccccauaccuuaagcagauucagugacuuccuagaauggauccuuauaaucuccuacuaguuuacuggaaacauuguuuuuauagcacauugugacaaaaaaauuaaaaauauuuuuauauacaaauaugcuucugaaaagcaaaauacuuuguaaguggagcaagaauucacugucaguuucaacaaagaaucacaaagcauacacaaagaacagggaaguacagcccauucaagaacagggaaguacagcccauucaaaggaaaaaaauaaaccgauagaaauugucucuaaaaaauaccugauacauaucuaugagacaaagacuuuaaaacacugucuuaaagaugcccaaauaacuaaagggaaauauggaaaaaguuuuaaaaaaacaauguaugaagaaaauggaaauacaauaaagagaaaaccuaaauagaagcuagaaagaaauucuggaacugaaaaguggacuaacagugaggagaaacucacuacagaggcuccuugacuuauagugcagcugauaaacccaugguaaguugaaaauaucaugaaguugagaaaguauguuuaaugcuugguagcacagcagauggucccugacuuaugaugauucgacuuaaaauauuuugacuugaugguggaaaggugauacucaguagaaaucauaacuuucuaaauccuaaggagcucuuugacuuacagugaauuauguccagauaaacucaucguaaaguugaaaaauuauaagucauacccucauaggucaggggccauguagagacucgaagacagauuugaguaggcagaaagaagaaucagugaaccugaagauaaggcaauggaaaugauuaaggaacaaacagaacagagauugaggaagagaaaacagagccuaaaggaccuuggaacaccaucaaucagaccagcaugugcauuuuggcagagaauauuugaagaaauaaugguugaaaacaucccaaauuugaugaaaaacaugaacacaaacaucuaagaaguuuaguaaacuccaaguaggaugaacucaaagagaaucaugccaagacacauuauuaucaaacugccuaaaaccaaagagagaauuuugaaagcaggagagaagcaacucaucacauacaaggaaucuucaauaaucagcugauuucucaucagaaacuuuggaggccagaaggcagugggccaauauauucaaaguacuaaaggaacaaaacugucaaccaagaauucuaugacuggcaaacuguccuucaaagugagagagaaaguaagacauuuccagauaaauaaaagcuaagggaguucauuaauagaccuguccugaaagaaaugcuaaaggaguccuucagguugaaaugaaaggacacuagacaauaauucaaagccagugaagaaauaaagaucucaguaaaaguaaauaauaggcaaguauaaaaacuaguguuacuguaacauugguauuuaacuccacuuuuuguuuucuacaugauuuaagagacuacuauauuuuuaaaauuauucuaaaagcuaauguuauuguaacaucacauuuuguuuucuauguauuuuuuuuuugagacagagucuugcucuauuccccaggcuagaguguaguggcgcaucucggccuacugcaaccucugccucccaggcucaagcaauuguccugccucagccucccaaguagcugggauuacaggugccugcgaccacgcccagcuacuuuuuguauuuuuuuuaguagagacagguuuuacuauguuggccaggcuagucuugaacuccugaccucacaugauucgcccaucucagccucucaaacugcuguaugggauuaacgccaugagccaccgagcccggccuauuuucuauguaauuuaagaaacuaaugcauuaaaguaauuauuaguuuauauauuuggagauauaauguacaaagauguaauuuggggccaucaacaacugaaagggaugggauggagguguuaaaggagcagaguuuuuguguguuauugaagcuggcauaaauucaaauuagagcguaauaacuuuaagauguuaaauguaauuccucugguuaccacaaaaaaaaagaaagaaagaauauacacaaaaugaaauaagaaaagaauuuaaauguuucacuacaaaauaaaaaucaacuaaacaaaaaaaaaaacaguaauguagaaaaugagggacaaaaaagcucuaaggcauguagaaaacaaauagccaaaugacagauaagucccucuuugucaauaauuacuuuaaauguaaauggauuaagucuucuaauugaaaggcagaaauuggcagaaugaauaaauaacauauuccaacuauauguugucuucaagagacucacuuuagauccaaagauacaaacagguuaaaauugaaaggauggaaaaggauauuguaugcaaauuguaacuaaaagagagcugggauggcuaugcuaguaucagacaaaauggacuuuagaucuaaaaagguuacaagagacaaagaaggacauuauauacuaauaaaaagcccaagcugagcacagauuucaccuguaaucccagcuacucaggaggcugaggcaggaagaucacuugaggccaggaguuggagaccagccugaguaacauagcaagaccucauuuauuaaaaaauaaauuaauacauagaugauaugauuauaaugauaaaaugauuauaaacaggcacuuaauaacagacaaaauauaugaacaaaaauugacagaauugaggggagaaauagacaauucuacaauaguaguuggagaauuauacccaauauauacaggacacucuccccaacaagauaacacuacccaacaacaacaggauugcguaugggacauuuuccaggauagaccauuaguuaugccacaaguuaauuucaauagauuuuuuuuaaagauaaauauuaaaguaucuuuucugaucacagaugaaguuagaaaacaauaaccaaaggaaaauuggaaaauucacaaauuuguggaaaucaaacagcacacucuuaaauaaccaguggaccaaagaagaaaacacauagguaauuauuagaaaauacuuagagacgaaugaaaacacaauguaacaaaacuuauggcacauggugaaaacagggcuaaggaagaaauuuaugguuauaaaugcuuauauuaaaaaacaagaaauaacuuaaaucuaagguguaauaucuuagaauuuuacaccuuaagaaucuagaaaaagaaaaacacaguaaacccaaagcuaaccgaaggaaggaaauaaagauucaagcagggagaaacaaaauagauaauagaaaagaucaauuuggguacaaccaaccaaaaguugguucucuaaaaguaccagaaaaauuccuagaccuuuagcuagcuagacuaagaaaaaagaagacucaaauuauuaaaaucaggaaugaaaaugggaacauuacuacugauucuacagaaauaaaaaggauuauaagaguacuaugagcaauuguacauuaacaaauuggauaaccuagaugaaguagacaaauuucugaaaacaaaaccuacuaagacuaaacuaugaagaaauagaaaaccugaauagaccuauaucugguagcauuauucucaauagccaagauuuagaaacaaccuaaguguccauugauggaucgugggugaggaaaauguggugugugcauacaguggaauguuauucaaccuuggaaggaaauucuaacauggaugaacuuugaggacauuauguuaggugaaaaaaaauucacaauuuaugccacuuacaaaaauucaaauacuacauaauuucacuuacacaggguacuuagaguaaucugaaucauagagacagaaaguaaaauggugguugcuagugacuagcaagaggggagaauguggagcuauuguuuaauggguacauuuucaguuuugcgagaugaaaugaguuccggagauggaggauggcaauggucgcacagcaauaggaauguccuaaauaccuugaacuguacacuuaacaaacgguuaaaauaguaaaucuuauggaagaaacuauaagaacacaaaaaugagccaggcguggugucucacgccuauaaucccagcacuuugggaggccaaggcaggcggaucaugaggucaagagauggagaccauccuggccaacauggugaaacccugucucuacuagaaauacaaaaauugcugggugugguggcgcgccccuguaaucccaacuacuagggaggcugaggcaagagaaucgcuugaacccacgaggcagagauugcagugagcugagauugcgccacugaacucuagccuuucgacagagcaagacuccgucuaaaaaaaaaaaaaaaccacacacacacacaaaaauggguuuuuaacaacuauuuuaaaaaugaaccuuacaaggucagaauugugcaccacugggaggguuacacucagugguuuguuggagcuggcuccuguaggcuggugagagccauuuguuaaauauguaagaaauuuuaugagccagugguaaucuugaaaucagccauagugggaguauuuagaccauggaaaucaacaaaugcuacaaaucagagguuuuuugguuuuuuuuuuuugagacagagucuugcucugucgcccaggcuggagugcaauggcgccaucucagcucacugcaagcuccgccucccggguucaagcgauucuccuaccucagccucccgaguagcugggacuacaggcgcuccucaccacgcccagcuaauuuuuuguauuuuuaguagagacaggguuucaccguguuagccaggauggucucgaucuucugaccucgugauacgccugccucggccucccaaagugcugggauuacaggugugagccaccgcgcccggccacaaaugagagguuuuuaaaaaucgcuuuucaucccccccccccguuccucucaccauauaauagagcugguuuauuagcauauuacuggguaugauuugcuggcccaauaacucacuuguuaaugugguggagaauacugacuaguguuuuucuguauuuggcuuagaauauuguuuguggaauauauuucuuuuuuagauuaccguagaacuuuuucuuuaauuugccacagguuugugaagaauauuggaaaaaaggaaaagcacgagaaauaguugagaaugccauugugauaaguguucacagaggcuuucuuuucuuuuuuuuuuuuuuaauauaacuucgacuuuuuuuuuuuuuuuuaguuuaaguucugggauacaugugcugaacaugcagguuuguuacauaguggaauaaauuuuuaaccauuaaaaaauauuuuguaaguagucucaacauuguauuucaaagaaacauugcuucuguaauaugcuacuaugugaaaauccugauaacuuaaaagauuuuuauauugauuagaagauaaguucaguucauauucauaaaagcagacauaaccagaaaugaucacauggcagcucaauaagcugucacuaagucacuaaauugaauuugcuuuuuuguaguuaaauaucuucucccauuacuauuugauguacuucugaauguaucugcagcagugcuauuuauguucucgaagugacauuuggcaguauauuuaaaauuccaugaaauguucugcucauuuuaccauaaagccaaaaaugcuccacugaauaaggaaguguuuauuaauucaaaaccuugaaagaggcccaauuucauaaucaacuugcuuccucuaaaucagcuuuuaaaugcagguuuguaauaggggccagugccacuuucacagucgcaaaugagaaaucgcaaaugccaagaaguuugaaagcaaaaagcaaaaccuacuuaauaggaaugaauuguucugauguuuaaacauuuuuaaagaagcaacuaugcccuaagauuguuauuaauuaauaauaacuuaguacauauuuauguuaaacugcaagugauauuuuaccauuuucuacuugagaacuucuaaguuuuuuauuuaugguguauacauuaaugguauguuauuauguaguacugaaauugaacauaauggcuauuaucuaaggaaaagcacuuuuguuuuauaagaaaacuucuauuaggaaagccuuguguauuuuaaugugauugcuagguguauguuaauguauaacuaagucagacuucuaaaaaucugaauuucuuauuacuauugaguaaaugcuaguauuaucauauaguauaugcuuuuuucuguuuuauacuuuauuaaaaauuagaagaaugcacuuuuaauuuuauaguaaaauaagccuuuaaauaagucuauauauaauuucacuuugugucauuguucucaaaccucgccugcccgccuccccgccuccacccccggcuccuucaccagguuugauaguuuucauuaggaguacucacaagauucagcauauaauuguacucaugacuauauuauagcaaaaagauaccaagcagaaucaggaaagggaaaagaugcauggggcugaguugaagggagaccagguacaagauucuagagucuucuuucaguggagucaacccaaggugcucuuaauuuccucagccauguguugugacagcacauuugggauguugccaaccagagaagcuuagaaauaaccaaggcuuuuauugggggcuggucauguaggcagcuucugccugcugucauguuucaaaaguucagauucucagaaggaaagcagguauucaguauaagcuguauuguuuguacaaacauuuuaggcaaagugagccacucaucaguucuaggaauggugaaaacccucccgaaaucuaagcucccagaagccaggcaagagccaaucuuguuugcacaccuuuuaaaggauagcagucagggcuacuauguuaacucuuucugcacacacuuuauauuuucuuuauucaguaguuugucuauuuauucuauguucuuaaauaaaguacuaugaaaacauugccaauuuauggcacauuuucagauguuuaguguggacaacagccugauaucaguguuugauuggcuuucaaauuugcuucucauuuauuucccaauuuaguguucagcgauuuugauccuuucauuuuuauguuuccauuguucuuaguauaaaaacgaaaauuuucccucuccagcaucuuuuccacacccuucucauccuuccucaaggcuguucuagccucccuggcuuuccuucaguuccuaaguaucauuguuccucuugcuuuaacaccuugacacaguguucccucugccuggaaucaucgucucauccuuuuugucuagugaagccaugguugucuucuggaucucagaaugucuccauuacagguuuuuguuuuuguuuuuguuuuuguuuuuuuagcaucuuucgaaaugccucaaauagucucaauccuugcauuuaacuagguuuuuacauugccugugauuaaacuacacguucuacuauaguauauacaauuguaauugagugcauuuagaaguauacgucucucaauaagacuuuugaagcuuuaaaaauauguauuuuaaaaagugguuuuauuacuaauauuuuagaagcaguuauauauuuaucauguuuuuuguugguuagucagagacaaggucucacucuguugccugggcuggauuucacuggugcgaucacagcucacggcagccacgaccuccugggcucaagugaucugcccgccucagccucucaaagugcugguauuacaaacagccugagccaccauguaugugugguuuuuuuauugguggugauggugguguuuuacuucacugagaagaaggaaguuacaauuuuugauauaguuucuccuucccucauucccuucuuccuugcccucuucucucccucuuuccugucucccucucuucuuuccuuucuucuguauuuucucuuaaauggaguaauuuugaucccuauguuggcaaaggauucauaaagggcagaaucuuuuacauccgcuuuucaguaugcaugauuaacagaaaaagcuaaauaauuuaagaaaaaucugcauauugagguucuuacagaaacaaaugggaguggauauuuggcaauuguguuuguacguagaucaauauagaucuccuauuuggacaauaugauaugguuuauuauacagauuuauaaauuccuucaguauuuauguccugugaaaucauuuguuuccuacuuacguacuaggcacuggagaauaauaaaacaugcaugggaccuauguaauuaguaggcauuauagucuaacaaaagaaggcauauaauuaaauaaucauacauauuuuuauaauuucugauuagugaucuauaggaaaaauuacaggcugcuaugaugacauuauagaguuuaaucuggaagaaaucuuucuuaugaaaguaaaaauugaacuucuguucuaaaagacaagcguggcuuuaguaggugagaacagaugagaacauuccagucagagggaacacuguaugccaacccuauaaagcaaaaggaauaauauuauugaggaaccaaaggaaguccuagaauauacugcaggaggaaaagaguguggagaagauacuggagagaugagauuuguuauacuaggaacaauugaaagccaaugaaggauuuucugcaacaaggugacaugaucagauuuguguuuuuaaaagaucagugacuucaggauggauaacuacuuggugggcaagaauggauaugggaaaucugugacaaggcuguugugcucucugugaauaggauaacaacuugaaacuagucauagcugauaagagcaauaggacuugauuguggauuaaguauggaugaugagagugggcugauugauuacuacagagauguccuagacugguuuuuugcuucuauaauuggauggaugauggugccaugcagugacaggaaacacugaaaaggucauauuuggaggagaagguuaugaguuuaguuugaaauaucuuugagacuugcccuucauucuccauauaacuucccauuuuucuuaggauaaagauauaaaucuuuaccaugacuuacaagacugaucccaucuguauguuuguucucauuuugucccacguucuccauuguucucugugccuagucacuuaccuucuucaguuucuucuauccuuccugcuuccucuuuguaggugcuguugucucucccuggaaucuccuucagcguucucugcaccuaacaccucaucauucacaucucacuucagucaucacuucuucaaggaaauguugggauauauuuaucaguaggaaaaugugugauacaugauaacauacuuuaugauaaauauuacauauauauaauguacauaaaauguauacagauuuaacucauggauucuuauuuaaaauucauuggguuauaaauaauuacugugauaauuuauuuugguauuccaaugguccaagauuugacuaauaggauccccuucaggcugucuucugugaucuuuugguauuucuuugucguuuuuugagcccuuccuuacuaaauacaccaaaauauuuccauauguaucuuguguuuuuccagcccaacccugagucagcuauuucuuuaaggagcuuugaucccuuuuaguagggaaugguauugagaaaccaaggucugggaacuagaugugcucauugcuacuaugguguuuuugcuucuaguuucucaaauaauucagaaauuacuuaggcuauuccuucccacuucucagcuucccccauuaaauuauguuauucaucuaaaguaucguuagauuuauuuuuuucuauuuguauuucauuuuaaguccccccaucuuuguugacuuaguuuuugaguguguaagacaacauggucuucaaagugaggaugaaacagauauucauucuauccacccaucccuucuaacuguucuugccuucccauuucuguccuauauuuuuuaaaauuuccuuuuuuuuaaaacaaaaggugacauacuguagacauuuuuauacacucgcuuuuuucauguaaaauuuuaucccaggagucacuucauaacaguucauagagaacuucuugacuuuuaaaaauaacugcauaguacuccgcuauaugugugccauaacucauucagccacucuccuauccuguguguuggcucuuagaucauuccauauuuagcaauuauaagcaauaaauaaucuuguagauaugcuuuugucuugcugguggaaucacuuaaggauaaauuccuaaaaguggcauugcugggucaaaguuaaguacauauguaguuucguuagguauugccuaguucuucaucaggaaaguuguaccaguuuguauuucugcuagcagugugugaguguaccucuuucucagaugcugcuucaauaaacugucuugacauacuuuuuaauuuuuaccaaucuaauagauaggaagugguaucuugguguaauuuuaagauguauuuuugaguuggguuaaucuuauguuuauauggcuauuuauuguauaugaaguuuugucugccauuauauccccuaacugguuauuguuugaguauauaaaggcuacugauuuccauguguuaauuauucuugcuuccugcaucuuuuuuuuuuuuuuuuuuuuuuuuuugagacggaguuuuguucuuauugcccaggcuagaguacaguggcgugaucucgguucaccgcaacguuugccucucagguucaagcaauucuccugccucagccucccaaguagcugggauuacguggaugugccaccacgcccggcuaauuuuguauuuuuaguagagacagaguuucuccauguuggucaggcuggucuuggccucccgaccucaggugaucagccagccucggccucccaaaguguugggauuacaggcgugagccacugcaccuggcccugaaucuuuuauuauuugacuuaguuuuauaauugagucucuggacuuuucuugauauacuguuauagcuccauauagaaauuuuucagucuuaugccucuaauugauuucacuugucuaauuauguuggcuaaucccccacgccccaccucaauuuauuguuaaacaauaguagagaugguaggcauuuuuuuccuuauucuuuaucguauuggaaguacuucuguuuuuauacuacuggaaauacuucuauuuuauacuguacuucuguuuuuauaccaguuucugguuuuauacuuaguuuauuuaaucaacuaacaaaguaugaaagauuaguguaaguaauuauaugucaauaaaccuaaugauuaaaaagaaucuaucugugcuacuucuggguuuggaggaggaugguggcuaccugaucuugaaucuccccacugucccuccccucuguuccaaacaauaaaaaaggggagaacaaguaaaaucucacuuggcccugcauuucacaauacuaggagacagagaauaucauggccuugacauuagauggaaguucagaaauaaacuaaauucccauaaagguucuauugcuguaagucuguggaugccaagaacaaguguaggggagacuuaaaagacuccaugagaacaagcagagugguucagaguauuuagacaacgcacaaacagaauagucuccuuacccccagaaagagaagcuccaauacaaaguauaaaauacugaacacagguuuggacauacuagaccauaucaccagcucuuacaagagugcaggacaaggaauugaagccucagagaagcauugcuccugggagauaaucagcuauauaagaaagaugugguuucccuuggagauaggccacugaagggaaaaaagcguauaugaaggaaaagguaagguucuaauggaaacaaaagagaaagaagauauaucaaccccuccuuacaccaaugcuauucaucaaugaaacugcccagaaaaagggaacugucagaagagggcacucucaaacuaggaacccuauucgcaaaaugaacaggaauagaaaaaagcagaucacaucuauauaaaaacuacugcaaaagaagcugaaaaugcaauucagaguuaaaaugcugauacaaaauugacaaaacuguaacaccuugcuucauacuggauuaaauauccuuagucagcauuuaggaauaaugaaaaaaaaacagcuugaaucagaaauuucaaaauaagaaauggacaaaaaagaaacagggaaaugaguguuaauugaauccagaaaagagaagacaaauucaaaauuguauuacaaaugaaaacuaaauuugaccaagggacaauaaauuuguauaaaaauuuauuaaggggcauuaaaagcagggagggaaaccccagagaaugaaaaugagcuaaaaaaaaaaaaaaaguuaaaagguuuagagaaaaaaaugauugaauuggaaaacaggcagaggagguccaacauaagacuacuuggagaccuucaagaaaaucagaacagcugacuggaacaaauaucuaaaauuagaauccaagaaaacuuucuggaaagaaaagaaaccuugaaucuacauauugaaagggccuaccagguaccgggggugauugacccagaacaguccaagaaguauccuaguaaaauuauuauacuuuaaacauugaaaaacaaagaacguaacuuacaaagacauguaaguuagacuggccaugcuuuucacaaauaacguacaaagcaaggcaacaguagagugacauuucaggaaucuuaaugaguguaaaccauaaaccaaagagauuauauccaaccauuuguccuucaagaaucaaucaagguuaaagaaaaacaguuugaaugucccaaaacucagagaauacugugcacaugugcccuuucuggugaaucuacuauagggagagcuagagaaccaugggugaguagggaaacugcuaauggauggauggagauuuuauacauguagagcuaacaccaaaacuaagauguagaguuuugguauauuagucauaguuugaucagagaagcacaacuggguauaauaaugagagaacuaauagagaauucauuauagguaguugaccuuauguuauuguggagcuacauggcuaacuaguauaugugaggcuguugcuuuugugugcuccugcaaccuaccuaaguuuacuaacuuuucacagucuucaagcagaggugugugugcguauguucuugugcuuugguuuggaauuaaaguuguaauuacuggcaaauuauaucuccugauggcaggucaggcaguugagaaggaaagauggauauaaaguagcagagaacaagggcaaaccagaaagaacgugcaaacaugaacuagaacuugcaaggauaaacugaaacccauguaagcuuuaguuuagaugaugaaguggagcaaaacacucaucuggcccagaaauuagagacgcggaaggaggagaucuacaacccuuauauucuuauugcuuucauuugccuugcauaucuuuuucuaccccuuuacuuuuagucuuucugauucacauuuucuuagauguaucuuuuauguaaagaacuuauccaaaucuuuuucuuuuaauaaugaguuaagcccauugguacuuauucauaugacugguaauguacaaguauuauguguauuugguuauauuuguuguguuuaucaacaugaugcacuuucuuugcuguuuuauuuucauaaucucuucugauauuuauaaauguuuacauuuaucuuuuauuaaucuuuguacuuacaacuuuaaaaaauaauuauagcaaaauuuguugaaauuuuacucuacacuagguacuaugcuaaaugccuuacacagauuaucucuuuuaauccaccugacuuauaaggcauuugcuguuauuuuccucguuuugcaaaugagaaaacagaugaacagguuaaguaacuugcccaagguaacaggugugcaguccuucccacuccuccccaccaccuuuacccacaucccccaggcaaccauuccucauugcaucuuuuuucccagcugcuuucaaggcauguguuuguguguguguguguguguguguguguguguguguguguguguguguguguguuuagccuuugauuuucagcaguuuguuuaugaugugucuagacaugguuuuaauguauuuuauuuuguguguguugagcuugaauucucuaaauuuauauauuuaaucaaauuuugaaaguugggacauuacucaguuauuuuuuucugccccaaucuuauuuauucacuuuuucugggauuccaguauacuuauuuagauauuuugaaacuguuccacaggucccugagguucuguuuauuuuuuuucaaucuucuuucucucuuuauguucuuuagauuggauuaauuucuguugagcugucuucagguucauuaaccuuuucuuugucauguccuuuuugccaaugagaucauccagugaacuugugguauuuuucaguucuaacauuuuuaguuacuuuuuauaauuuccauuucucuguuuuuauuuccugucuuuuuacuucauuuguguuuuucuuuaccucauggagcauaguuaucuaguugcuugaaagucuuugguaagucgaacaucugcuuuaucuuggcaucgguaucuguugcuuguuuuuuuugcccccuaccuugauaacugaccauauuuccuuguucuuuucuuugaauaucagguaauuuuuuauuguauccuggacguuggaaugugacgauaugugaacucuggguucuguuauaguccuguagggaacauugguagccuuauuuuaguaggcaucaacccucuuaauucaaauuauaacuucugucucaucuuccaucagcucucgcuccuucuguaaacccaguuauucaguuaucagcuccccaagcauuugcuacacuuuuuaaaaucuguucccuguacuguaguuuagggguuaaacaaagacuucugaguguucauacucagaaauaaggagccaccuuccccagcuguucuccucaggguuucucccacacuguccagguuaugugguuucuugggcuagaguugcagugggauuucuguuggaguuuuggcucuccauacagcuccaaaacuggaacccacucucaggacaaagcuaggaaaaggauuggaaaagaaaauaaaauuggcagcucacucuucugucauuugaucuucugucauuugcuuuucugaguuuuggcccugcuguacaaucuaucuggucggguuuacuuuucuccaucuucaagcagggugugucuucaagcaugcaugucuguguuuugauucggaauugauaguuauaauagaagcaugagcugcugggaaauuauaccuccugauuugugugguuuuauuuguucaucuugcagguuugaguaguuuuugguggauguguugggagauuugaauguuacuuagcuguuauuaucucuacuacuuugguagucaauauugaauuuuuucacugaauccagccaaacacuuuuuuuuuuuuuuugguacuaauuucuugaaauaauguauugauuagauaagagaaguauguuuucagcaguucugucuacagaaaggcuuguucuaagaaccauacaauaggaauuuuaaauaaaucaaaagccuuauauuauggaaacaucuugcuuauauuuauucuguuaaucuguaauguaaaguuagauuaaaaaaaaaaagacagugauacaacaauaaauaccucccaaaagcaggcauagucaacucugaauuucaaaggggcuuauuauagguggaaaaaauuucaacauuuauuaaaaaaauaaagauaauuuuuauagcauuaucuaaauaaaagaaaaaaaguuuuaauccugcaauagccauaugaauuugaucauguguguuuuuauguaguaaucaagauuguuaugagauuuaaauuuguuaguuuuuuauguguguuaaaaugcaguugaagaucccagcguaguucuacuuuucguuuuuuuuuaaucuauggacuuuuaauauuugugauccaaaaccuaauguguagaugaugauauucaaacuuaaauauuuaauaauguuuaacauauaauuuuuuccuuucagauggucuucuuauuauugguguucacucggcuaaguuuccaaaugaaaaaguccuggauaacauuaagagugcuguucuucgauacaacaucacccacccuaugguuaaugaugcagaugccagccuuuggcaagaacuagaaguuuccugcuggccaacucuagucauacuuggaccucguggaaacauguuguuuucuuugauuggagagggacacaaagauaaauuauuuuuauauacuucaauugcuuuaaaguauuacaaagacagggggcagaucagagauaauaaaauuggaauaaaacucuauaaagauucuuugccaccuucaccauugcuauuuccuggcaaaguaacaguagaccaaguuacugauagauugguaauagcagacacuggacaucauagaauuuuggucguuuggaagaauggacaaauucaauauagcauuggagguaaaacuugcuucugauuacgauagauaacguguuuuacaguaaaaaaauaguucaagguaaauauaaaaguugaaaugucuaaaugaaaacuaauuauagaaaagugauauacauugacuuaauuuccuaauaaaaauuuuuuguuaauuaauaugaugucugaauuaaccucuucucacucccucauaaaacaaacaaaaacacugaaaaagcuccaggucaaaaagaggaaauaguucagcuuuuagguauauuuguauauucuaucuuuuuuuuuuuuuuuaaacugcuguacuuacuguuucuuaugaaaacauacguuuuggauuucagauguuuuaaguagaaguauuauguuucacuuuccaacaaaauauagccguaucuuuuuaaagaucaugucagugccccaugaacuugagauguaguuuauaaaauaaauaagcuagaauuugugcauaguuuuacuuuucucuccuuucuuccauaagaacuugaacauguuucuggaucuauuuccagaauagaaauagguguagcagaguaugaguaucaugcaagcguagaucauuuuguucuauaucucccuggucuuagaucuaaaacuaccucuugguuacaucuacauaauuaauaaacucuacugaguacauucuuauuaaucuuucuuaucuaaacugagcugacauuugacagcauguuagucaaagacaaaaguaauucauuucuuugcaauccugcuuuaguaauauaugcagcauuaguacauaaaguagaaaugucuguguuccuaauauaaaaaagcuaguugugguccuaugcccugauguuauucuuaauauaccaagauacaguauguguuguguuuugugguguuuguuuuguuuuggcuacuugguauuuugauuuaugacaggcaguuacgagaauugaauuguuacucaaaaagugucuuuuguagcaguuugaauuuaagugguuuuaaaaguuaauagauucugugauuuucaaaauaguguaggugaauauucuuuguuaaaagagaaaccagcagcaagcuacacuacccaaacauaguucuagaaauacuguuaucuuuugauacaguuauucuuuaauuuuuaaaaaagaauucuuuggucagauacacucaggaaacacuuuuaauguuaucagauuuuuauuggugaugguaucauaauauuucccaaauuuuuuacucuccuaauuuuccuuauggggggguauaguacacaauauuuuccaaucucauguaaccacagaacucucccuuuuuuuucagggaacucuuaucaauaucaacacaauaauaguauuauuaacaauuguagguacaguagacacuauaugucuggcauuauucaaaacauuuuacuuguaugaacucauuuuugccugcacaaugcuaugaguuagguaauuaguuccauuuuacagaaguaaaacugagacacaaagaacuuucccaaaucaccagcuagaaagagacagacuugggauuuagacaaggucuauugggcucuugaguugguuuucuuuuuuuuaaagauggagucucacucuguugcccaggcuggagugcaguggcaugaucucagcucacugcagccuccaccuccuggguucaagcaauucuccugccucagccuuccaaguagcugggauuacaggugccuaccaccaugccuggcuaauuuuuuguauuuuuaauagagaugggguuucauuguuuuggcuaggcuggucuugaacccuugaccucaagugaucugccugccucggccucccaaagugcugagauuacagacgugagccacugugccaggccuuggguuuguuuucuagccacucuguuacacuaccuuuuuaugguugccuaggacaauggaguuccacaaagcaguuugaacugcugauuuagaggccuugaauggcuugucugcuggccauggaaauaauaguuacauuuuauuguguuauauucuccacccuugaaacucuacaugaauuguaaaaacugagagguggacuagaaucacucucucuuacaguguguaugauauaucgcaggacuuucugacaaagugaaauaguagauaagaaggauucuuaaucugggguccuuggacuccugagagucuucagugguccucaggaucugggauuguuuacaacaauuuggccauguguauuuuucuagggaaagggcucauaauuuucauuguauuauccaaggagcauaucuuucaaaauuguuaaaaauuauucaucuguugaacaauuggaguuauuuuuaaaucuuuguagucuagguaauggauaauuagaaugcuuuuaaaauuauuuucuucgcuauauacuacuaugcuuaagugcacuaguaauuguacuaugagcccugucauuagcaaaacucacucuuaagaaaaauguuccuuggggaacauuuuaguuuuuagauggacauaccauuuuuuuauauuaaaaucccagcauuaaauacaaguuuguuuuguuuuguuuuguuuuaccuugagaucacuucuuaaguggcaaauuuuaucuuauuuuaggacccaacccuggaagaaaagauggaauauuuucagaaucaacuuuuaauucuccacaggguguagccauaaugaauaauaucauauauguggcagacacugaaaaccaccuuauaagaaagguaauuuucauuuuaaauuuguuuuaauacuuacaaucagaaaaaggaaauguauuugcuacauuaaauauuugaaguuaaagcgugauucuuauguaugucaauguccuuguucugcuuuucuugagguacguacuuuaguuuuauucucaaguauccuguuucuauuugugucaguauguauuugucacaaaagaaaaccccauucaguucuuuuuuuaacccuuguuucaaggcugugucccuaaucacucaaaagcuccucauuuugaaguaucuuccuaaccacuaguuuacaaugauccuuuguccuuuuucaguugaauuuucucaaacuagaaaaaaaauccuaccauuccugcuucuauucaacuuuuaugcuuuggcuggaaauacugauuagccaauucgucuuaaaacuuguuugauuuuauuauguguccuuauuucuaaaaagucagcuaauacauaaagguaaaaaaaaguccccugaccaucaauuccaguuucccagagguaaccauccacuguuaaagugugugucuuuuuggaaauuuucuacucuuauaaaaauaaauugauauuaaaaagccuuuuuguagagaauuuuuuaaacaaauguaaugaugcuaugcauacauaauguuuugcagguuuuucuaacuuuuuuuuuuugcauguuagucaccugaaugauaugacuguaucacauuccauuguagauguacucgguuauuucagacauuuccuccugaugguuguuuuggcuaaaccauuggucuuuaaguugccauguguuuggaaaauaaguaaccaaguucaucauacucauccugucuaaauacauuguuucagauacugccuuguuuuucucacuguuucuuucaguauugacauuuauucucauuuauuugacaauauuuucacuuauauacacauaguagaaaaaaauacauauaauauauaauaauauccacuguacuguaagucuuccugagggcuagaaauauguuuugucuacuacugaauccuagcaccuagaaaagaccuggccuaugguagguguucaacagauauuuguuggaugaauuuaugagcaaauaauacuguuucaggaagcacuuuugaaaguguguauuccucaauauaaaaguguuacaugaaaaacagauuuuguggguuaauacauuaaagcagauguguuuuuuaaagucuugcagacuuucuuccagacuuaaauaugcuaauguauuguugagugcauuaauggggggauaucugugcagcauuucuaaacuuauuugaccagagagcccuuuauaggcagagcugcuuauaggacuguuuccaugguguauauuuuagggaaaagugguuuuuuaaauuacuaaauucuuaaugauuaauauuucuuuaucauuaucuuuuugggguuguaugugucuauaauucgucagaggggcuagaccucuaaugguguauugaauuaguaaaauagccagccugcaacauucagggaguacuuguccuucuuuuuuaauuguaugucauuucucuugcuuuacaacuuaauggguuuucgaguauugaccaugugcuccauuucaaauauuuaugcauuuaaguauaaucacaacaaauuuagguuaccugaaauuguuuuauauucugugacuuaauauggugucugcagaaauggaaaguggaauuuuuuccuuuuaaaaauacaagaauauuuauuguguuuuauuuuuguuuaagaccucauuugcagaggauugaauugauuauauucucauucauggcucacgaacauuguuucaugcagacccuucucauuuagaauaauuuauuuaaauuauaaauucuccuacuuccccauacccccaacucucacuccccuuacauuagcauaccuauaagcagccauugugauacguuuaaugcauguuuuuauuuguaugugaucuuguaaguguucuguguauauuuuuuaguuacuuuauugugcuauauuuuauguaucauaaaguuaacccauugcaaaucuauaauucacuaguuuuuaguaaauuuaacagguuuugcaacuguaaccauacguuguuuuuaaaacauuucaucccccaaguaagaacccacaugaccacuuacagauagucccuguccccucccaucccuaggcaacuguuaauuuacuuucugucucuauaaauuugccuuuuccaaacauuuuauuaaauagaauuauauauauuuucuuguauuuggcuucuuucauuucacauaaugaaaaguucaugugugaaguagcauuucaguaguucauuccuuuguauugcuggauaguauucuguugugugaauauaugacauuuuaucuaccaauucaccauugauauuuagauuguguuuuggcuauuuuguauauuuuguuauuuugggcuguuaugaauaaucuugcugugagcauugauacacagguuuuacauggacauacauuuuuauuuggcauggguagauaccuagaauugguauuguagaguuauauguuuuauguuuaauuuuuugagagcugcugaauuauuuuccauagcaauugcaccaucuuaccuucccacucgaaauauauguggguuccaauuuucuacauguucaccgucacuuguuauuuuucauuuuuuaaaaauucuagccauccuacuggauaugaaguggcaucucauugugguuuugauaugcauuucccuuaugacuaaugaugucaaccaccuuuuccugugcuuaugggccauuuuuauaucuuugagaagugucaguauucuuugccaaauuuuuaauuggguugucuuuucuauaauacaguuguaagaauccuuuguauauucuagguacaaguucuuuaucagauauaugauuuacaaaugauuuuucacauuuuucugcuugccuuuauacuuaguuaaucauguucuuugauacauugaaguuuuaaauuuugaugaugacugauuuguccauuuuuuccuuuuguugcuuauguuuuuguuguuguaagaauccauugcuaaauccaaggucauaauuauuuaccccuguguuuuauucuaaaagucuuuuaguuauggcucuuauaauuaggucuuugauccauuuugaguugauuuuuguauauggugugaaguagggguucaacuucauucuuuuacauguggauauacaguuaccccagaaacauuuguccaaaagacuguucuuucucccuugaauagcuguagcagccuuguuaaaaauuaguugaucauagauguauggacccauugaucucucugucugucuuuaugccaguaccuuacuguuuugauugcuguagcuuuuaauaauguuugaaauugggaaguauaaguccucccacuuucuucuuuuucaagauuauuuuggcuauccuaggucccuugcaauuugauaagaauuuuaggaccagcuuguccauuucugccaaaaucuuuugauuguuucuuauguaaacauauugucuccaaaaacaaauucccuuuugauuuuuaaacuuccuguuuccuuuuauuauauugcuggcuaguaccucucuugcuuuuaagcauuagcaaugaugguggguaucuugucaugcuuauaaucuuaaagggaauacauguacauuuucuccagaaguuuaauauuugcuguagcuuugaggaauaagauaucuaugaaguaaggaaaauuucugucuauugauagcuggauaaaaugugcaauaaagcaauuaagugaaauauugaauaucaucucagugguagguauauggauguuuguuacaaaaauuuuuuaacuuuccuguguguuugaaaauuuucccaauacauuguuggggagagggucucaggagaugaaagcagaacauauuuucccaguagaauacauuaguuuuucaguuuauaaaguaaaguccguaaagugucauggaacugccuggguucaggucccagauucuugacuuacuaacugugggacauugaaaaaguuacuuaaugaucuguguuuuaguuuucucuaaaauauuaaaaucgucacacaguuaugagcauggcuggauggcugguuggcuugcucacuauuggauuagugcuuggcacauguaaguuuuaaugugugucaauuacuagcugagcacaacugaaauaugugcauuuaauuuuuagaaacauguauuuugcuacauuguguuuuaaaauuucauuuuaaaauuuuuguuuaguuaagaugaggucaaugccagaucugcuggaggcaugaugggagauggggauaagaggggaaaaguagaggaauggacaggugggauaugaaagggacugauuaugugcauuugaauaagaaguucauucuauaauugauuggccuuuuuucauaauaaaacuuuguacugcacauacacucuaaauguucuauugacuauugaaaaucuuuacacagcaaaagacaaaagcaaaaguaacauucauugcauaaaaccauccuuugaauuucuauagauugaccuagaagcugagaaggugagcacuguagcugguauuggaauucaagguacagauaaagaagguggagcaaaaggagaacaacaacccauuaguuccccuugggauguaguuuuuggaacaucagguaugugaacuuuugauauuaaauguaaagguaaauuuuacuucauguaagauuuaaaaauauucuugagguggucauuuggauuccauuacuaguuauuuuauuuuauacuuuuauaccuaugccucagaguuuguuaauuguguaaaaacaaagcuagcaguaauauagauauauauauacuagaguauguauuauauauauuacauauuuuaucuauaagauagacuauguguuacucuaaagaauuauauauuagaugcacccuccaauuaauguaguucugaauuucuuauacugaaaggauuauaguaucagaacuucaaaagguuauucaugaacaguaaucaguaauaauaaaaauaaauuuauucauaaauaaggaacuuauagugucauuauauacucuaguuugaaaaagaaaucaaagaggcagcugcuuuugcuuuagauuuaaaaaauuuauauuaaaguaugauaacuucuuuaaacuuuuacccuagugaauuguguagacauugauaaugaaugaaacuuaauguuaucuuuauuaucuauauuaauugacuaaaagaaguccaggaguacucuuauuaguauuuuuauuuuuuauuggcucucagugauacugagauggucaucuacaugucuaaaauuggauugaugaguaaacaaaguuagaauaugucgaaaauguaauuuuggacuaaaugguugguguugucuucauauauuuaaagaguauauaaguaccagcuuaguugaaaagcuuuacauuugagguaacuuucuuuuaugaugccaauuuaauuaugauucaaacacccuacuuuuugguuguuauuaacuuuuaugaagcacuuaauacucauaaaauaaaugagugaacuucuaguacuacccgcacuuaacacuuaaguauuuuguguagguuauuuuugagaauucuacuuauggaauuguauguuguaaacauaauuuguuucauagcucaccgaaggggauaguauaguaggagcagugcauccaacuaaagggauacuucauauguagagaauuuugaaauauuaauacagugaacuaaaauucagucuccauuuuauuaccaugcauuagcaauucuaaauaauuucagggcuaaaucuucaccaguacuuuucacuuuuaccucccugccuuauuugcucuacuuuugauuauuuuugcuaaaucguauuuuaguaugauguuauuuauuacaugaguuguucuauagugcaaguaaacaaacuacagcuacaucuagcagcauggacaaauauagcaagggauauuuugagugauaaaagaaaguuacagaauauguacaauauaauuucuuuguauguagaaaucuacaauaugauuucuuuuauagcaaguacaauagcauuuaauacaagcauugggagauccauucagacauaauaaaguuaaaaaguaagaagaaugauaaauguacauuuuuauacuagugguuccuuaugggaagaggagcaauuagguaagaaaaagaaauaaaaggcauccauaugggaaaagaaaagugaaauugucucuauuugcugaugacaugauuuuauauguagaaaauccuuaugacucuaccaaaagacuauuagagcugauaaauuuuguaaaguugaagauuacaaaaucaacauacaaaaauuaauaguguuucuauauacuaacagugaacuauccaaaaaggaaauuauggaaacaauuucauugacagcagcauuuaaaaaaguaaauauuuaagaguaaauuuaaccaaggagguggaaagaucuguacacagaaaacuauaaaacauugaugaaauaauuugaagaagacaaauaaauggagagauauuccauguucauggaugggaagaauuaauauuguuaaaauguucauacuacccaaaccauuauacagauucaguguaauuucuaucaaaacuguguugugauuuuucuuagaaauagaaaaaaacuaucuuaaaauguguauggaacuagaaaagauccugaauagccaaaacagucuugagcagaaagaacaaagcuggaagcaucacacuuccugauuucaagcuaugaagcuauuguaaucaaaauggcaugguacuguuauaaaaacacacauaucaaccaauauaacaggauagaaaacccagaaauaaacccaaguauuuacagucaaaugauuuucaacaaaagugccaagaacacacaaugaggaaaggacaauucguuccauaaaugguguugggaaaacuggauauccacaugcagaugaaugaaauuggacuauaucauauacaaaaaccaacucaaaauagauuaaagacucacaaggccugaaaugguaaagcuacaagaagaaaacaggaaaagcuccacagcauugaucugggcaaugaaugauuucuuggauaggacuccaaaaacacaggcaacgaaagcaaaaauagaccagugggauugcaucaaacuaaaaagcucuauacagcaaagaaaacaguuaacagaaugaagagacaaccuauggguugggagaaaauaucugcaaaccauauaaccaauaaggggcuaauauccaaaauauguaaggaacucaacucaauaucaagaaaacaaccuaacuaaaauauagggaaaggguaucacaaacauuucucaaaagagauaugaaugguaagcagauauaugagaaaauauucaucaucucuaaucaucaaggaaaugagaauuaaagcaaugaugugauauuaccucacaccuguuagaaugacuuuaucaaaaagacaaaugauaaauguugaugaggaugcggaaaaaagagaaccuuuguacacuguugggauuguaaauuaauacagacauuuuggaaaauaguauggagguggcugaaaaaacuaaaaauagaauauuuauaugauccaucagucugacuuaacaaaggcauuuaaauugcugugucauagagauauuugcacucccauauuuauuucagcaguauucacaauugcuaagauauggaggcaacccaaguguccaucaguggaugaaugguuaaagaaaauguauaucuaaggcugggcaugguggcucaugccuguaaucccagcacuuugggaggcugaggcggccagaucaccugaggucaggaguucaagaccagccucgccaacguggugaagccccgucuauacaagaauacaaaaauuagcugggcgugauaguagaugccuguaaaaauccuagcuacuugggaggcugaggugggagaaucacuugaacccgggaggcggagguugcagugagccaagaucaugccacugcacugcagccugggcaacagagcaagacucugucucuaaaaaaacaaaaagaaaauguauaucuauacacuggaauacuauacagcuuuaaauacugucauucaugacaacauggauggaagcagaggacauuaugcuaagugaaauaagccaaacacagacagacagauacuguaugaucuuacuuguggaaucuaaaaaugucaaucuuaggccgggcaugauggcucaugccuauaaucccagcacuuugggaggcuaaggugagaggauuucuuaaggccaggaguuugagaccagucuggucaacauagcaagacacuauuucuacaaaagaaauuuuaaaauaaaaaguaaauuuaaaaaaauuguaagaaaaucucagaaaaagaacguaggaaggugguugcuagaggcuaggaauaagggaagguauggggaaagggaagagguugaucaaaggguacaaaguuucaauuggaggaauaaguuuuagagauaauugugcacugcauggugacugacuuguaguuauuaauguguauuucacagcugcuaaaagaauaaauauuuaacauuugcaccacacagaaaaaaauguugguauauucauagauauauuauuuagcuugauugaaucuuucuacaguauacacauagaucaaaacaugacauuguaccccacgaauguacacaauuauuauuggucaauuaaaaauuugaaaaagauguaggaaagggacuagaaauaucucauuauuuuaaaucuacauguaguauguaaaugcauguguuuauguauuuuaaaugguaucugaauauuuaaccugacuaugccguauaguuauaaaaauaauuaauauaaagugacuuuuacaaaauuacauuuuaucuguguucauuuuuuaauugucauucuuaauguggucagaacaucaugcaccaaaaauaauuacuacaguaaguucauuuuuucagcagauacauuguaauguuucuaaaauguguaucaggucuguguugacuccauuuguaccagacaacaaccugaaagacguuuagcauaaagguugaaacuccuaucaguaucuuuuuuuuuuuuuuuuuuugagacugaggcucgccauaucaccuaggcuggagugcagugacgugaucucggcucacugcaaccucugccugucggguucaagcaauucuccugccucagccucccaaguagcugagauuacaggugugcaccaccaugccuggcuaauuuuuguauuuuuaguagagaugggguuucaccauguuggccaggcuguucucuaacuccugaccucuagugauuugcccgccuuggccucccaaagugcugggauuacagguaugagccacugcgcccagccaaaaccccuaucaguaucuaaguacuuuaagacuuuaccugauuuugagucauuuauagaaaggauaacgugccagaaucccauuaaccuuucuuggcccuuuaaucaacauuuucccuagauagaaguuuagccauucuucuacaaccuuuaaugguugaaauccaacuauuuaguaugcuagucugauaaucuacaguguucguauuuaugugcuucaauaaaugcuucucugacucgcauuauuaauaugauauaaaauaccaugaaaauauuuuugcuuuaaaaaaaucagaugacacggaguuuugaaggaauaaauuugaugcaguaugacuaguacauuuuuauuuuguuaaaauaaguuauaucuuuaugucuaaaauuugagagaagauucuuauacugccuuaucacauugacuugguguugauuuuuuuuagguuaauuagguauaauuuauauacaguaaaauuuacccuuauuagguauauaauucuaugaaauuugacaaagaagugcagucuuguaacuuuuaccacagucaagauacagaauauuuucaucccaaaaaguuauuucauagccuguuguugagucuccccccgccaucaccacacucacugcagcaacuggcagcagugaucucuuuccuguucucugucaucuuucaugucuggcuucuuccauuuagcauaauguuuuugagauucaucccugugguuccauguaucaguaauuuguucucuuuuaucacugaguaguaguucguuguauggcucuaccacaguuuguuuauucauucaccaguuaauagacauuugaagguauuucuaguuuucaguggcuauagaaaaccuccauaaacguuugugcacaguuuuuguuuugugguaauaugcauucacuucucuugggcaaaugccuaagaaugagauuacugggucauaugguaagugaauguguacaagaaacugccagacuguuuuccacaguggcuguuuucuuaaagucccaaaugucuguugggagucauugcuucugccugaagaacuucuuaugacacaggucugcuggcagugauuuuucuugccuuuauucuggucugaaaaaguaucuagcuuucauuuuugaaaguuauuuuuauugcguaugugaaucuggauuaacauuuuuuucuuuuacuauuuuaaagauauuacuccauugucuuuugacuuacauaguuuuccacaagacaccuguuuuaauauuaucucuuguucuuuauauguaaaguguauuuuuuucucugguugcuuucaagauuuuaucuuugguuuucagcaguuugauauaucuaagaauuauccugcuuggaguucuugaaucugugguuugauguucauuauugucaagaaauucucacucauuaucucuucagauauuuuuuucugccccuuucugucuuucucuuucugggacuucaguuacucauguuagauuucuucuuaauauuauauucaauaacucuugcauauuguguucuuuuuauucauucuucuuauuuuuucuuuuuguacuaguaauuucuaccaauuuaucuucagucauuaauucuuucuucagcugugucuagucaacugaugagccuguuguauuaguccauucucauacugcuauaaagauacuaccugagacuagguaguuuauaaagaaaggagguuuaauuaacucacaguuccacauggcuggggaggccucaggaaacuugaaaucacagcagaagaugaggaggaaacaaggcacaucuuacuuagcaggcagccaagagagaguaccaagggggaagugccagacaguuacuaagcaaccagaucucguaagaacucauucacuaucaugagaacagcaagagggaaacuacccccaugauccaaucacuuuccaccaggucccucccucgacuuguggggauuacaauucagauuacaauucgagaugagauuugggugggaacacggccaaaccauaucauuuguagaaggaauuuuucaucucuaauauuaugccuuuuuaauauagcauuuguauuucuuacagauucaucucugcugaaauuccuuaucuauuuagguguguugaccaccuuuuucucuagguucuuuaacauacuaugcauaguuauuucaaagucuguauuagauaguuccaaaucuggggacuauccucgagucuguuucugaucauuccuuuguuacucggaagcggguaauguuuuugcuuuuaugugugucuucucauuauuuauuauaugucagucaucuuguauaaaacaauagaggcugagauaaauaguacuuauguuauaauuaugaaagauugagucaauuuggucaggagcugagcugggccuugguuuuauuauugcuaugucaaugcaccacauguuuuaaauuccucuagcugggcaguuguugccuucugauuuugccucaguacaugggccuagauuagcuggaggguuuucuuaguguuagugcucuacccucagcuuucagucgucccuguacaaugaagccacauggugguucccucucuccacucuugcagccgucccagggauagacugcuacucguuguuauucugccccaggcuuguguuguguauggggauguucucuguuguucagccucagccuugggaaggcccugagugccuaggccuugaggaaaggauguggggagcuuuuucauuguugcuguuccucucucuggcagccagaaucugucuugugucugugauugguuuggggagccuccuguuucuccccuagcagaaugagaacucugcuuggugucaguagagcauuuuuucaucuaccuuuuccacagcuguaaaugguauuuuccugugcucuguggaaagugacaggcuuugcugcccuucccuaguggcuuaagacuuugauucauaagagguuuagagacuuuguagaaacaaaucuguguagaagcacugauggagaauuucacggaugcucuuaggaggguucuagucauagguacuuaaaaugacagaauuuuuuuaaagcuggauuucagguaauuuucauguugauauuucuuuuguugauuuuauuuguuuucuaaaaauaugucuaaucucuacugauaauuaugagugaguuuugccuuuaaaaauauuuucagaaccuuuucagccucugucauugucguuuuaaaaaauuuuuaauuugugauuguugaaagucaguaauauuaagugcacucuuuuuuguaauuuuaccuucuauuugagauugggagguauguaugagguuuguuguguagguguaaguauacucuuaauuuaaaauggaaauguucaugauuaccacauucuuuuuagagggaacaaaucuaauacccauacucagugauggaacugugugcuuuggaggccacacuccaggaugaacaguuguaaauuguuaauaugacucuuguuacuuugauagacauuauaaaugccagcccucuuuuuuuuuuuuuaacuuucauuuuguuuacaaaaacaaacucuucagugcucaggguaaaaauuucuggagaaguggucuagcacgguggcugugagcaaggacucuggagccagaccagcuagguuugcagcuccacaucuuaguaguugugugacuuuggacaaguuucauagccucuuuauaccucaacuuccccaucuaaauugaugauacaaauagugccuaccugaaaggcuuaccaugaggauaagaauuaauauauguaaagcacuuagaacagugucuggugcauagaaagcauaauauaauauacauguuugcuauuaucacuguuuucuauaagauaagaauuuugucauaaagugucaugaacagaugcugaugaucugaaccaaaccaaaaaugggaaggcaagggacuagaaaauaacuuuaaagacauuauccaaccauagaccauucccagggguacagggagagaaaggcagagggguaaaccucacuaugcaucccggaguaggaggcuguggguacauuuaaucagaucccuguuucugaucacagacagaaaugcacuugaguacuuguuaccagagcuaagucugcaugggucagaggcagaaggagggugaaaaacgggcaaguagagaacugaaccaaauaguuccuucauucucaucagaacacucauaaucuagagucagauucacuaaugaagucguuuuccaaguuuagcugggugaauuucagcaaauuauuuagccucuuugaagcuggcuuuuuauaaaaugaagaugaugauaauaagacuuguuaagguuguuaaauugaaggaaauaauccacguaaaauuauuagcucggugccaucaacacagaaagugaccugggugaugauuaucauuauccucauaaguugguauguagaauuccaaacaccugaacccugaccugacacugcugcugcuucucuacuuuuucucuuuccucgggcaucugaaggaaauaaguacacagagaccaaaacuaaaccaaugcccauacuuuaucuaucacugggaagcuuuugccuuauuauaguaagccccagcugagcuagaccgaccuguuuggagaacuagauaacaaaguuaaauuugaucuuucacucagcuaugcaccaacauagcucuccuuugccaagacagaggcucuaaaagcaagcuaagaaaagcaaauguuuuuguuccuaaagcuuagagcuaaauuugccuaacucacccuuaugagauuuucuuagagugggacauugaugugaaagagaaagaaaaaugcaguuuucaaggugggaacaggaugacaaaccaguucagaaggaauucuugcaguaaucccugauaguggcuuaggucaagguggagguggugagaaguggucagauuuugaauauauuuugaauaaggagccuacauaauuugcugauggaucaugugugacaugugagaaaaaggaggaauuaaagaugacuccaaggcuuaugaccugagaagcuaaaaggauggaguccuuuuauuuucauuuacuuggucaaccuuccagucuuguuacccauaagguccuaacauuggcuggagcugacuuuucaaucaagauaaguuguauaaaaauaucugucuauauuucucucaauaaugauucuuaguguagaaggcuuauaaaucuuuuuuacccuuagguguuugauguuuuugaaugucguuauaaauuuucuuguauauuugcugcuguaaaccgauaaaagaauuuauccuugcuuauugacccuguacccaacaacauugcuaaauuccuguauaaaauugugaagauuuugugugcauaguuaugucaucugcuaauaacuacaguuuuauuucuaaucuuuuugugcuuugcuucuuuuuccuucuuuguugcacaaacuaggaccuccauaagguguuaaauagaaguguugauaguagguaucuuugucucauuuuuauucucggggauguuuguaggauuuuguucuuaaguaggauguuugcugugacuuucuuaaaaauguucuuuauaagauuaaauaaauugccuucugauccuaguuugcugaguuuuuaucaugaauggaagcuuguuggagauguugaaaggcuuuauuguuauguguggcuuuggaguucucagcccuaucagaucccagauccccuuccuauaauacauuuuaugaaaagccuccuuuaccauaccuaaagugaaauucauagguaguauaauccaccugugcuauauauugauauauacauaauauaaauauagagaagaaauaagcauaauuuauaauaaaauaguguagucauuauguaagugaucuggcaugacuauauuaucauaugauauauuacccaucaaauauccacagcauuuuuuagggugggcugccacucccauucagcaucauuguuugagaggauaauaguacagguucacaucuauagcagacuucugggauuagagaugaaucauuaguacuauuaggaaauaccaaccaucauuaggauagcuuuagggcuuuuuuucuuuuuuugugguuucuaggggaaaguuuacucauucaacaaauaccuacugagcauuuggcaugugccaggcacuauucuaugugcugcuaauaaaacugugaauaaaacaaagcugcuggccucuuagaccuuaugcucaguagaggagaaaggcaguaaauuaauaaauauguaacauguaagauagugauaaauucuacagugaaaaauaggcaagguaaggagcuaagaaugaugggugugugguauuagauaaggggaguagggaagaagcuugagcagagaucugaauguucauaucuggauguaagcuuucuaggaugagaaaggagggagcacacuaagguauagaaguugaaagacagcaaauuauuuagcaccuaacaugaugccuggcaccauguuaggugcuuugcuuacacuguuuuauuccuuccaguaaucuuauguagagagugaugaugugcucauuuuacagaugaggaaauggaggcacacacauuagaaagugauguagcuacuacaauucaaauccagacccaccugguuccaaagcuaaggaauuggugaaggaaugcuuucaggagcccucuucuuuuaguggucuaucacauuaccauaggaguaauuacauuucauugagaaaaaugggagaacuggguagaggacuugaaaacauaaucauuuacauuuuuucauguagcauuuuaaaaauauuugaaccuccacaaugagauaccaucucacaccaguuagaauggcgaucauuaaaaagucaggaaacagcaggugcuggagaggauguggagaaauaggaacacuuuuacacuguuggugggacuguaaacuaguucaaccauuguggaagucaguguggcgauuccucagggaucuagaacuagaaauaccauuugacccagcaauccuauuacuggguauauacccaaaggacuauaaaucaugcuacuauaaagacacaugcacguguauguuuauugcggcauuauucacaauagcaaagacuuggaaccaacucaaauguccaacaaugauagacuggauuaagaaaauguggcacauauacaccauggaauacuaugcagccauaaaaaaggaugaguucauguccuuuguagggacauggaugaaauuggaaaucaucauucucaguaaacuauggcaagaacaaaaaaccaaacaccgcauauucucacucauaggugggaauugaacaaugagaacacauggacacaggaaggggaacauaacacucuggggacuguugugggguggggggaggggggagggauagcauugggagauauaccaaaugcuagaugaugaguuagugggugcagcgcaccagcauggcacauguauacaaauguaacuaaccugcacguugugcacauguacccuaaaacuuaaaguguaauaauaauaaauaaauaaauaaaagaaaaaaaaguauuugaacuggcugggcaugguggcucaugagcgccuguaauccuagcacuuugggaggcugaggugggcagaucacgagguuaggagaucgagaccauccuggcuaacacagugaaaccccgucucuacuaaaaauacaaaaaauuagccgggcaugguggcgggugccuguagucccagcuacucgggaggcugaggcaggagaauggcaugaaccugggaggcggagcuugcagugagccgagauugcuccacugcacuccagccugggggacggagugagacuccgccucaaaaaaaaaaaaaaaaauuuugaaccaauaaaugcuuugaaauauugugaauggaaaacauuccaaauuaaguuagaaugaauaagauuauucauuuucgugggcuuuccauguuuuuauuucucuuaccuacugaaguuuuuguuuugcuuggucauuuccauaguugauaauaucauugacuaugcaggaacauaaaagucauuuucauuguuuaauacuaaaaguuuauuaucuuagauuuaugguagauuuaacagaaauaagcaauucuaaacugagugcuuucuuagguaccaaauaugaucuguugguaauacaugcauuauuaauacucacuguaaaauuaaugaacuucuuaaguggaagagguuguauuauacuuuuuacccucuauggugucuauugaagggcuguucaguuuguaaauguauuuauguuuuccuaguacaaauauguaaaauuaagguccagauucacuaaaugaucauggcuaacauuugagugauauugccuccaagcauuacucuaagugcaucgugugcuuugagccuuuuauuuggaugccaguauauguaacauaacagaauauuuuaugagcuuagguuuccuguucauuuucguagucccggguuguggcucuagaauaacugaaacauugugguaugcuaaaaauuaauuguggaaagcuuuugauguaguuuuaaggugauuaagcagagacaguccccagaauauaugugugccagugucacuuuuaauaguuuaugucauguaaaauaagaaaucagauguuuaaaacauuguuaaugcucguuguaaaauuaacaaacugcugaggcagaguucagaugcagagaugcagaggacuuacugcugguaagaauacuuuggauuccugugaaauuguuguggguaaaauuacaagucuaacaaaguaaaccuuucacaagaaaacaaaauuuucaaagauaacuugaaacauugcagauauuuuuauuuaucagaugauucacaaacauauuguuauccuccauaaauuuaacauuuuaaaaccauuggaguguuuguauuaaccagauauguauauaauaauaaugauuuauuuuuauaaagguucagagguccaaagaggugacauuuuauggauagccauggcagggacucaucagauaugggcacuccugcuggacucuggcaaacugccaaagaaaaaguaagugacagccucucucuuugaguagacuguacuacuugguguucauauaauuucuuuuuucaaaaucaccauccucacuguaccagucaggaugugcuagguuguacugccauagcacacaacgcagauucucagugacuuaaaacaaggcguguuuauugcucacucacauggguucacuggggagcacuccucuguugcccaggcugaugaaacagccuggagcuuucgggagcuucgccagucauccuggcacagugagagagaaagagguaguaagucacucacugacuguuaaaauuucuacucagaagugacacacgucacuucuacuuacauuuuaucagccagaguaagucuuagggccacacuucacuucauggaaccugcaaagaaucauucuccuuacugucuagaaagagaacuaagaauauucaguggacccuuaucuuuuaagacauaguugaacuaucucuaaucauucauucaaacaguugaauaccacauagcagagugcuuaauaacucaguuuuuguagucaggccugagguugaauccuggcucugccauuuacuaucugugugaguuuaggagagccacuuuaacuuucaaagccucaguuuccuuauuuauauuaccucauaggcuugcuuugagaauuaauaauauauguggagagcuuggcauaguaccuaacauguacaguaaacauagguagcuuugcugucacaaggauauaaggaugaaaggguagugucugcaaaguuucucauauuuuuuuuccuuagacccuuuccucuucccccaauaccccaggcagaacuggccauacucuucucugugaccucacuguaccugguguauaguuacaucacugcacuaaguuuuccugccccaacccgcugccccuuccucuuucucucucuucucuccuuuugauuguuuuuauuuuuagccauuuccuccuacuagucucuuaaaggaaaggauccucucccauucauuuuucugucccuuguaccuagcacaguauuugguaccuaagaggagcucaguaacgguuugaggauaaaugaauaaaagccguuaaccggaaaggcugucacguagccauggaaaaugaucauugcaaguuaccguuauuaauagaaagcugcuuuuauauagauccuucaaaauagcagauauuccaaauaguguguauguuugugcauguugcuuuggacacacuuauguaauguuuuaagacauuuaaucguuuagcaaauauuuaugcuaggcaauagggaugaaauaugcucacuauguuaaggauacaaugaaaagaugugguugucaucagugaacuuacagaggaagaaucagaucagcaaacaauuaaaaguuagugugugcaaaaggaaucgcugcaaauugaaauuguucggcugggugcggugggucacgccuguaaucccagcacuuuggggggccgaggcaggcagaucacaaggucaguaguucgagaccagaaugacaauauggugaaaccccgucucuacuaaaaauagaaaaaguuagcugggcgugguggcgcuugccuguaaucccagcuacucaggaggcuguggcaggagaaucgcuugaacccaggaggcggaagguugcagugagcugagauugugccacugcacuccagccaggacgacagagugagacuccguuuaaaaaaaaaaaaauugaaauuguuccuuauauaaguaagaggaagacgcaacaucaguaagauuugaguugucaaggagggcuucuuggaagaggcaacuaaacagugaccugauaagaguauaggaguuagggagaguggaaaguuuuccaggcaagaauuggcacuagugaugucaguagaagccagaucacacugugccuugugaguacuuuuagggaucugaauauucuacaagccuuuuuagaaagguuuaagcugggaagugacaugauuagauuuguguuuuugaaagaacauuggcagcacucagaguggaacaagacuagagacagagauaagagauaccacugaggagccuauugcuguuauccaggcaagagaugauaguagccugaacagugagauuaccaauaagauuuuacaugaggcauaauuauaaacagcagagaaguaacagaaguugccagaauaugcuguucugggugauggcuguuuuaggcauagaugauucagagcugccugaauuuccucauaaguagaguugucacucuccuucuuaauaggaaauuggcacuaggaccacacugaccuguguuuuaauuuuaaggauguauuaucuuuauuaccgaucuucagguaguaaugacccuuagcauuuuaaaaguuauuguuucucccuacucuuuucuuuauuuaauuaaggaaacuccuuuuuaaaguauuaagacuccuuguagacuccuuucaauuaauuuguucagcauauuaguuauuacauauauuguacuugcuauguuuauauguuucuugaauaaguggccauauuuuaugcgugcuaaaucccuuugccucuguccccugcucccuaccuaacuuauuaugggaacauauuagccaguaagugauggugaguucagacuuuugcauguuguaccauauucagaaaugauuuacacagacucucauuuugugucccgagucagcugcuucccuucccucaacacaacacacuaccaugucuuuuuuacagucucucuggaauaaacuuagaaaccaggaucuaaagcuuucucugcauuacaaaaggaaucauugcaauaguuccuuaaauagaaauuucccuaauguauauaagaaauugauuuguacaaucgauauaauuguacauaauuaucccauguaauuuuaagauaauuauguacaauuauauuauuuuucauauaauaguaaugucugaccuggccaacuuucaaaaacuauucuuuaauuccuuuugcuggucucuguuuauauauaagaacacaaaacauuuuuaaugaaaauugaagcuuuaaacuaucaagagcuagaugaucuuuuuaguucccuuuccgaaccucauauugcaugaaacuaagaaguuaagaauuuaagguaguaaaaacaaccuaucucaucaauaaucugaucauuauuuuuaucuuauaauucuaucagggauuugucguuuaacauuugaaagugauuucaguuuuguguguaucaaaguaaaguaagaaguucccuacacaguggguaaauaaguuaaugguuggaaaaaugauaaugaaagcugacuugaacaauuuaacuagaccaagaucacuaguuuguuuuuuuaggaggcuuaucacuuuugauuugauuauucacauucauuuauuuaagaacuaaauugcacacaauauaccacauguugacuccaccuaugaacuugucuuuuucagugaguuaacaaaaggaaccugccuuagguuugcuggaaguggaaaugaagagaaucgaaacaaugccuauccucacaaggcagguuuugcccaaccuucaggccuuuccuuggccucugaagaucccuggagcugcuuguuuguagcagauagugagagcaguacagugagaaccguuucacugaaagauggagcagugaagcaccucguaggaggagaaagagaccccaugguaaugacagucacucuugcacagugcgcucggacacugagcaagcugucaauuuugugaauuauggaaaguuaauaagauuuaagagagaccauccuuggccuaucugcgaaucaaaaugaaagucagaccaaaggaaaugugaauguaaagcaacgugaggaacacaccaucuaagaaaagugaacugacucuacuuuauuauguauaaauguuaagguuucagggagaaagaaaggaugaagcauugauuauuggagaaaagaaaaaaauguaaauuagauauugggcagugggguggaaagagcaccagacuaguggacuugaccuauuccugaccagauguaguauugugaguaaaacuacuaagcaccaccaauuaauacagguucaaaauacugucauuuuuuuucuaaucugaaugaaguauccaacccuauuuauaugaaaaucagcauuuucccuuuuaacuuaaauaccauuuguaacuguuugaauuuuccuucauauucuaacaaaacacuguaaaaauuauaauaacugcuguuucuuuucuuuuaaaaaaaauuaaagaauuuauuugcuuuuggugauguugauggaguaggaaucaaugcaaagcuucaacacccccuuggaguaacaugggacaaaaaaaggaauuuacuuuauguugcagacuccuacaaucacaaggugagucgugacagaauuauauaauaucuugcuuuuuguguguggcauuuaaaaugcugaaagaucugugagccuccuacaacugccacucuaaaauauagaaaggaguaacagucuuugacaacuauaacccagccuguucugcucuuuucuugguccuuucuuugccaagagguuaugaugguauucugaacuagggaaagcacagaaccaguuccaauggcaauagccaacaguugugaauugcaacccaucaaagcugcuuaguaacauauucaguauaucaagagaaggcaaguagcagggaaauuuauaugucaucuaacaaaugaacguuuuugagcuguugcauaguuacagugcuuguuaguaaauaauuuuguuuucagcauuuccauuuuugucuauuaaauugucuuaaguuuuauugcauuuuuacuuuuuacaaaaaucaguggauaauaaauguucaugcaguacuucaugaugugagaccauaaauuuaauauaauugagacauaacugucaaucauuaaguuuaacaaagguagcaaauucucaggcaaugcuagaugcucaggaagacaaagucaguucaguugugaaagugugucccauugugaagaaaaacaauucaauaaaaaaaaauuuuuuuuaauuccagaaauaacuucaucaaagauugcuuccagaagacaagauggagcuaaggauuuuacauagucuuuaguucuuagaauagaauaucuccccuuagacugcaauuugaauguuuggcuuuucaagaaaauauggaaauaacuauuccuuuugugagacuuauugagaauauuaauggcaaucagaaauuagcuugcuugauaccauacucuuccauacaacaaacaugagauugaucuucaguuauauaaguuuuuguucuuucuuuuuuagauuaaaguuguggauccaaaaacaaaaaacuguacaacauuagcaggaacuggagacacaaauaauguuaccaguuccaguuuuacagagucaacuuuuaaugaaccaggaggcuuguguauuggagagaauggagaauuauuauauguagcagacaccaauaaucaucaaauuaaagugauggauuuagaaacuaaaaugguaucugugguaaguaauuuuaaaauauaaguuaaagaaugugguuuuaagaaugauacuaagauccucacagcacugacagaggcauuuuugguuagaccaucuccaggagaguauuaaguggaugcuucuguuguauucuuugacaaagagaccagcaggacugcuuuaaggauauccuuuuauucuuaaaauaaaaguuccaucugugcugagaguuugagaaaaauacuggaaauuggagauaaucuaaugaaccuucaagaaaaaaaaaaggagaggacucagaucuguuuuuaaguguacagacauacugacauacacuacauacaccugcucuguggguuggguuauuuagcuuauuguuuuuguuuuuuuuuuuuuuucagugaucuuuagauuaacauguaaccuuuguuugccugugaugaauccauuaccaaauaaucuaacaaaagcuuuagaagccacuuucucaagacaucgaaaauaagauuguggaagaaacuuaaaugaguuauagucaguuuuuaaagauauggacgugguuucuuauagaauuuucaaggggaaaugucuauuauaaacuaacucuugauguaugacauuuaccugaaaaaaaugcaacaguuuuuuucugaaaaacugguaauuugcacgguauauuuuuaaaagaaacauagauuacuauugcaacauaaaugucauuucucuucacguagaucucugauauaagaugaauaacaucuucuuauaguugacaaugaaaauuauaagaaaauguauaucuagcauguuuaaauuuauaaacuuuugcuuuaauuuccugccgucuauauacauuggacaguuacuuuaauucugccucauucauaaguguuggguuuuguuguugucgcuaagauaaacuuucucugugucuacgaaaauaaucuugagggcaucuaacacauucuaauucaaacuagaauggcgauuaguuucauugacauagaacuucauuauucuacuaaagucuaaaaauaugcucucauucuauaauuaauauaaaguucuuguguuuuaauaacagauuuucuuauuuccuagcuccccaucuucagaucugaaaaugcugugguagauggcccguuccuaguagaaaaacagaagacauuacccaaacuaccuaaaucugcuccaagcauuaggcuuucccccgugacugcgugugcuggccagacucuucaguucaaacucagauuagaccucccaucaggaucaaagcuaacugaaggaguauccaguugcugguuucuaacagcugaagguaugaguauaagcuugcaaauacuaauacaucauauauucuugauguuuaaucuaguuauuuuuuauuuguuaggugauauuuuuacucuguauaggcaagauuugaagaucauaugaacaaaugaauccagauccaaccccacauuggccauuugcuuuacucaucaagagucuuucuucccuuuuauuaaagaacaguguaacucaccaaaaguuacaagucaguuguuagcaugauuucuuggaauguggguuuuccuauaccucaucccuuauucugauccuguucuucauucuauucuuguuccaaaaagaaucuuagaguuaaaaagucugaaauagagaaaguggagcccucguauuuaacaucuuuuucugugacucuuccuuucagucacucuugggcauuccucccuuucuucuauuugugaaucacaguaugagcuagcuccuuauuucauuaaucuaugguaaggaaucaguauacugcuugccuugcaguaugcauuccaacaucuguaaccugguggacaaaaauuuuaaagugaaauuuuagugguucagaacuucuaaauuacaacuugucucuaaugauauuccucuguccuggucucccacgcucuuucacacuuucucacucaauuuuccauuuccuucccaacuccuccuccuucauacccucucacacacuuuucuuuuguacauuacccaaauccuggguaauucauuccuucuuaccuucaacuuucucagggcagcagccacuggccugcaauuauaauaucaacuuagugucuaaaccaagaggauaacgguaucuugguagacuggcugggaggaacugcugguuaguguuugggaggcugguucuagggugauugagucuguagggaaaccaccccuugucacuucccacaagggggaaggcuaaccauguacuaggaccuuuggagcuugcuuuguagacagaagaauacucaaacccuggccacuccauagccuuuuguagguucagagcaaguucuagacugccaauuuaagucuggaaguauuacaucaguuggagaacauuaauuuuucucaguguaacuguaagagcagucacuguuagagcaguguauuaaauggugucacuguaggagcaguguacuaauuuuuaaaauaggauauugacagauuaacauuggucugcauugucagacacacuaauuaauauugagucauugggauauaaaauacagauaguauucaaauaaaguagucuauagagacuuuaucuaauuuguccaagauaugggccccauuuuuauuauauaguagcagauaauuuucaggcaauaauccuaauaauuuaagguuuuugaauauuauagaguacauuuguacacuuauguuuaaaggacauuuucucuuuuggcuuguuauuuagaaacacuuauuuuuagccaaauuuuggucuguauaaucuuaaagaaguuagaauauaugcaaguuuuaagccaaaaaaaaaaaggcagcauaaaagcaccacauguguuguaacuucacaaauugugugugugauauauaugacaaauaucuaaagaaacauuuucuguuuuauuucuagauuuggacauuaaaauagcucaguauuauuuucuuuguuugauuuaaaauauaagaaauuggccaggcgugguggcucacgccuguaaucccagcacuuugggagacagaggcaggcagaucaugaggucaggagaucgagaccauccuggcuaacacggugaaacccaucucuacuaaaaauacaaaaaauuagccgagugugguagugggguagucccagcuacucaggaggcugaggcaggagaauggcgugaacccgggagggaggcagagcucgcagugagccaagcucacgccacugcacucuagccugggugacagagcgagacuccgucucaaaaaauaauaaauaaaauauaagaaguucucuacuaaucucucuagcaaaaucaugcauuagauaaaagauacucucuaacccaggaauaaacaaagaaagccaaagaguuuuaaagagaauuuaaaaagaauucuuuaaaagcuucagcauagaaguuuuguacuuaucucucuagauucuuaucuuucaccuucguacucuuauuugacauauuuuucucaaauuugauuuuucaguaaacuaaagcaauaaacuaaaagagacaucaagaggacugauaaaggcaggcacucugagucgguuuacuuacccugagaacaaaagaaagagacagaaaagcuaaaaaguagacagcauuucaucacacucaguaggugguccaguuuuuguacagaugagucauuagaaaauguucaguguucuccauuuacauggugggaaagcauuucauauauuucccaaaugcuggcucuugagggcugccaccuuuuuaggcugaaugucuguaugugucugugcuuccccaguaugacauguguguuccuucuaagagaaagucgagaugaauaaagacauuuaaagaugauuuuaauucuugagggcuuaaaauuuguuagugguuuauucgauuuuuguuauagauagucuguuuauuucuaggaagaguuuuacguauuauaaugagauauacaaaaucucuugguuuuuacauuacuuaagcccacagagaauagauaugcaaugguaccuguuucuaaauaaaguguguguguauuuuuaaauuauuuuuagauauucaauaauucauuauuaaccagaaagucacuacagaguugcacauacauuuguauucccuagauaaaauuuuauuuuguaguuuuuauaucccuaaagacuuucaucucuuugguaaaaaugauccauuuucucaagugucguauguuuauuucuaaaauuuaauagguuuuauuuuuaacuuuagagacuaaggcuuuauagccauauuugcaauauucagcuugauuuuaauaagaguaaauguguaauuuauuuuauaguauccaaaggaagaacuauaauaauuagauguaauaaucaucagacugggaacuucuaaugaguggucaguauauguuauguauauuuauguccuucccacagaccgcaaugccuggcacuuagagauuuuuuaauaaauauuugucgaucgaguuuaucuagucuucauaagauguucccaguuuucuacuuaucuuauacagucuuaauaauuucauuuuugauuuuuaggcaaugaauggcuacuucaaggacagauagcagcuggagauauagagaacauuuccagucaaccaacaauuucacuacaaauuccugaugauugcuuaucacuugaagccauuguaucugucaguguguuucuuuauuacuguagugcagacagcagugcuuguaugaugaaggcaauuuuguucagucagccuuuacaaauaacggauacacagcaagguugcauagcuccaguagagcucagguauguauuuuagccagccagcuagcuagcaacccauugccaccaccuacugucucccauccugacuaucacuguaauuuaaggaaagaaaacuucaguucugccucuggauaccaagaugcccauugcucaguucagacaacugauauuaaaauaaagcuaugcuccuuacuuacuucuuuuauuauaaacaaauuccuuugcuuuggcugauacuagcugagucauugaucaucauugguaccaugauauuguaaucuaugcugcuauuuggcacaagacugaaguucacacuacaguagagaauacuauaagauaauuugcaauaaauacugauaauaauaauaccagauauuuuaacuaacuuuuucuaccuuuauuaauagcaaucagcacacuugaauguguaaauuucacaguaacuuuaggcagaacuuaagcuccaggccacauuuguauaagaacaccaaguauucaaggcauaaagucuguuguaagccaaaaaaaagucuuuucaucacuguagaagcuuaaggaguacaucagugguaaauacgaucuuuauucucuucugugguuuucucaguugagauauuuuuaaaagagaguuuugaucuauuuuuauuauaaauuauuuguuauuuaacauaccauuaugaaugccuuaaaacuuuguacagauaaaguuggacauagaaucucuaaggacugacuccuuuaacuguuuuugagugacuacauuaccagauaaugaaugaguccccagaaauauuaugacuuucaaggaaaaagggacuuuaggacacauuacuuagugucugugauaaauaauuuauugugacagcuaaaucugaugguuacauaucuuguuuuggaaauguacauuucacuuguaagcauuaaaugcagauuuguugaguuuagguuuugagguuuuuuucguucccauauucagaauuuaaauuaugaucauuuauugugauguuuuuaaaaaucacuuuuaagccuuaaaagugaaauuuucagugugaggugcuuucaugcuauuaauagauacaguauauccuaauauauuagucuucaaaauauuaaggccgaaacagugauuuaaugauacuauuuuuuaauuuuuguuguuuuuuaucccuaaaaaaagauauuggaaagguuuuuuuucuauugucauaauuuauaacuacuuaaaagccuaaucuuguuuuccuuaagaccuauucaacauguuugugauuuaaucagcuuacaaggguuuaaaaacaucaggugaaccauguuuauuuauucaguaaauauuuauagacaauauggcauaauaugcuucccuucccuguaaaaacagugcuaaauuugaaguguaaucuuuuuuaaacaucauugucuauuuuuaauuuuguuugaaauguaguauuaguuuguuuuauucauaagguuagcugaaucucugaaguaaggauguauaaaucaugacauugauuuaauuagucaucuacugaagcuacuuuuaaagagaaauauagauauaaaauuaaaaggaauccuguuuaaaauuauauguaauuaccucauaaaccuuuucucuccacaagcaaucaaaaaaaugaaauguucuguaauaaaaggguguauaacauacucucuuuuaugagaauaggccuuaguuauuuuauuuuauuuuugagacguagucuggcucuguagcccaggcugggagggcaguggcgcgaucuuggcucacugcaaccucuaccuccuggguucaagagauuuuccugccucagccucccaaguagcugggauuacaggcguacaccaccaugcccagcuaauuuuuuuguguuuuuaguagagacaggguuucaccaugucagucaggcuggucccaaacuccuggccucaggugauccgccugccucugucucccaaagugcugggauuacaggugugagccaccuugcccuacuggccuuaguuaauuuuuaaucucauuugacuuauuauguuucucauuucuagauggacaggaugagaauauuuuggcccaaucauuuucuguuuaaggacuuaaacaauuucacacucuaaaugaaguauauacaauuuuaauuuacuaauuuagaaauaucugaguuuauuuuucaauauaauauacaaacacaguguuuguuauacauguucauguacagugaaaaugcaaaggcauuuuuuagacucuauuccccuucauuugucuagacaguuuuagguuagccuuagcuuauacuuuucuugacuuucaaaauacaguuuuauugaacauucuuauucuuacccacugccagucugcauuguuuuuuacauuaaaaguauuauuuauaguagacuaauaugauuuugaauaaaaucacacuuaagcaauauagauagguuccuagaauuuaugacgaggauaaaccucucacauaagaggaagcacuagaaaguuuauuuuuaaaacuuguugauccauauucuauaaggacuaaugcauauuuuuuaucuuuugcuuuucuuguuggauaaauuauuauguccagugauaguuuaaaaagaacaagauuuuaguguaagucaccucacuugaaaugccaguaaugugguauuacacacauuuuauauaauaccuggaaucuuugcccuaaauuauucugcugguuugucgcuauuuuuuuccucuccucuuuauuauuucacaaaugguagaauuucuugauaugauucuuguaaagaguuuagcuuaucuugaacauucugucuuaagcaaauauuuaacaagagaaaacuuuguaguuuaaucacccauaaguguaacuuuagcaaaauucaaugacuaugaaaaauaauuuuuuucuuaacuguucuaauaauauuuaguuauaauauuaucaaaccuucagaaaguuauaaauccuaacagccagaaaaaaaaauuuacuauguguauauuuauauagguguguguauacacaaagauuaagaauuauucaugauucuuuuauggccaauauacuuuugagcuuguauaacugagauaaguuacucuuugcuuguuuuucuguaguuggaaaauuuaggaaguuauuaaaaauacauaucucuauaauguaauaguuuucugccugcacaaaguuuacuauuaauuuaugucuaccaguuaaaaauacgauaguuagauuuggcaucacguuuaaccacaaucaucaaaaucuacuuaaauucuauaguuaacaguuacauaagaauauaugcagagggaaaaugucaauaguucuugugaaugaaggaauuauggauguuuuuauuuuaauucuacuuugcuguuuuuuuuuucuuuucagugagcaaucuguuauuuuuaaaaucacgguggggggaaacccauaaaguuuaaagaguuaaaguuaacugaaucguaagcacuuauauaauaacuuuuuaaaagucauuuuuauuaccagagcucagaacauuguuuggaguccuuugaucuaccgguucucuuaaguacgugauuucgugaagauagcaaugguuauggcuuuuuuguucuguuauuuuuauuguguaacguaguguagugguuaagagcuuggauuuugcaguaacuuggauucuaauccuuuaaaauggggcugauauaccugccucauauucaaugaaauauuguguguacagcacuuaguaauuaaugaaacugguaauuauuagcuuaguuacuguaaugauaauuugggaccauaaacacauaucacccuacauuuucuuugcaacuacaauuugugaaggaaaaucucccacuaacuauugguuauguuaauauucuucauagaguuggguucaagaagagaaauguuuuauaaugaagcauauaacuauuuuauaaacaacauuguaguuauaaagaagcaugccuauaguguuauuaaaaauuuuuuguacgacuuucuggagcuacaaguaaugaacuugcuuugagaggguccagacauacucauccugaaccacauuccuacaacauaugcccaacaaccugcaccagaguacuuauaucuuaaccaaaaaguuucacuucaaugguggugcuucacaaaaucuucaaagugcuuucauguguauugccucauuugagcuucaaauaaccuuauaaaucgggcagguagauguuaguuuacagaggaggagacagcuuuggaauaguggugacguaucugaagaauagaaaaccggaauagugcucgaugccugaaguggugccuggcgccagcagauguucacuucugucaaacaaggggaaguagugguggagccuuuauucaggcacgggucuccucauuccuaacuccaagaugcagagggaaaacgaacugcucaauuaagaguucuuccauggacacuuucuuaagccuucacauaaaauaacaagaauaauagauauuuauugaguagauauuuauugaguucuuucuauuuuccagcacucaucuauuaagugcuuuuauguauuaacucauuuaauccacacaacaaccuuaugugagaaauaccauuuuuccuuauuugauuggugaagaagcacacagagaggguaagcauaaucaaauacaccagcauaaccaaaaucacacauuuagcgaguggcagggccuggaugggagucuguucaacucucugcuguauugccucuuaaaguagguuuucuuaaaacauaaaucuuucauaacuuuauauauuuauaguaacuuaauccaaagaaccccaaaaguacuagcaaugauuguuucugcaauuuaaauaaauccauuuaauuauacaacuuugcauuauauacuguuauucagaccuuggaacagucuauaauuguuugucaaaagauuuuauguacuacuuuuucuuaauuucagauauuauccagaguuuuucuuggcagauggauguauuaaaaaaauagcuuuccaguguuaguucucaacagugcuguuucaaaaguuguuuuaaaaguucuaacgguuggucuucaaaacguaauuaagaccuuaucauaaagagccuuuugcacaggacuaucucaaacccuaagaagcuauucauauuuaagaaaauuuuguuguauuaaauauuaguccaagugagcucuggaaauacagucuucugcuuucuuguuucauaaauaacacugguaugcagaccccuccccaugacucaaauauuaauauaugcaauucuguuacaguaaaguuuucaccauggucaaccuauuccagcauuagguacuuuuuguuguuguuguuuuguuuuuuuuuuuuuuuuuugagauggagucucacucugucacccaggcuggagugcaaggguacaaucucagcucacugcaggcuccaccuaccggguucaagugauccuccugccucagccucccaaguagcuggcgcucaccacuacuggugcccaccacaaugcccggcuaauuuuuguacuuuuaguagaaacaggguuucuguuggccagguuggucucgaacuccugaccucaugugaugcgccugccuuggccucccaaagugcugggauuacaggcgugagccaccguacccagccuagcauuagguacuuuguuuuguuuuguuuuguuuuuguuuuuuuugagauggaguuuugcucuuguugcccaggcuggagugccauggcaacacagccuccacuuccuguguucaagcaauucuccugccucagccuccugaguagcugggauuacaggcgucugccaccacgcuuagcugauuuuuuguauuuuuaguggagaugggguuucgccaugcuugccaggcuggucucgaacuccugaccucaggugaucugccugccuuggccuuccaaagugcugggauuacaggcgugagccgcugcgcccagcgcacuaaauacuauuaaaaggaauuaagcaaaaugcuacguaccaaugauuaugauucaugaucaccuaaacacagaaugcagacuuaacuuuucauucuuagugugcuaauuaaguaguaguauggugcaguaaggaauuuuguuaauuuuguuauaaacucccucuccugaaauccguaaggaaaugugauaauaagaaagugauaauagugucauauuuuaaaaguagaauccacuguuaagcaccaagauuaccuuuucuucccccuguggcacaguuuauuuaaaugaaguauuagcaauaaucaugucacuauuuuguccugaauaauuaagaguuugcuuuuuucccaugucuuugcaauaggauaauauaaagaauaguauuaaaagucagaggcuuuacuaaucuaccuauauguauuccauggcuaacaaacccuggccccuuuacauaugagcucuggagguucgccuggcugccucaggcuugcagaaggcugccccaaucacagagccuggguaagguggaacaggaggcagccccacucggcuuuucugauugcaucccaccuguuucugaguguguugguuugguuuaauucuuuucaaggguuggaguuggaaagugaaaacccuagacacuugcuguggaauguuugccugguuguauuggugugucccucuucuucacuggcaugucgcuuucaaguguaccaaaggacauuuuguucuguugaaagccacaggaccaaaaggaaaauauugcaacuauuugcaaacauacuucccuaccuguacaagcagccauauacuaaaaagcacuaaacaagcacaaaugaacacuaaauagccuuauaccaaaaagcauucuuguaacugucagggcaugguaugaauuccuuccucuuuaagcagcaacuuaccacaggcuugguggcuuuaaguaauauagcauuaagcaaauggucaguuauuuuuuaauguugaaaacuuccaagugugaauaauacggacauaguuuacuaccuuuugcuuuuaauauaccugguuaucuauuuccauuugaaauaaaaugaaaggagaccucaaacugaugcugagaaguagacaaaaucagcucucagacuuaacucuccccaauuaaaauaguuuuuuuuucccuucccauuuuuuuguuuuuaagagauagggucuugcuguguugcccaggcuagagugcagcagugacaugaucauagcucacugcagccuggaacuccugggcucaggauccuucugcuucggccuccugaguagcuaagaccacaggugugugccaccacaccuggcuaauuuuuuuaaaauuuuuuguagagauggggacuugcuauguugcccagacuggucucgaacuccuggccucaagccaccaaccucucaaauugcuagaauuacaagcaugagccaccacaccuggccuguuauuccuucuuuaucuaaugugugcuaagcuugugaaaaauauauguugagguaaauagggcaaaacauuaguugauaaauuaugcuaauuaaugggaaaaauagacauguuccucucugaacauuuagaaggacucugcccuacaacuaucuucuguuuuuagaauuuguagucacuguucuuagugccacuggaaauauauucauucuuugagcauguacagggugggcucccuguuguauuuauuacacuuuucaaaaugccagcaaguuuuuguuuguauagaguuggaauguauuguucgugcaugccugugauauucaucaucaaaauauaccuguaaaaaauaaacuacugcuuccucuccacagcuuaggccucccucuuacuaaaaacaauaguaguuucuguagaaguuucagugagaaauuaugguuauauaaauaacagauauggcagaacaauuuuguuguaguauuuuuuuccguagcauuucuuaauaauagcucaguuuuuaaaggaggggaacaauaccccaugaguucaaauuaauuuucucuacuuugagguauaccuuccuaauuauauuuuacauaggcuguuuuuuuuaaguuuaaauucucacuguuaaguugcauugagagacaauuagaaauguuguaauugucauaucuuuacauguggauuaugaacaaaugaaaguuugcugugugauugcaguuuuaaauuauaacauuucauaaauaugucaauuuuagaaacucaaacucuuucccaucuuuuguauggauaaaguuuaugguuucauuucugagaauagaguuggucugcugugcuaacuucauguuucuuauuccaaaggcuugauuauauuuuuuucuccagugauuaaaaaugcagcgaaaauccaaucuacaaguucauauauugguauuucuagacauagucuaguucuaaaagaauguacuuggugugcauuuuuaaguguuucauguagacagauuaauauauuuuuguacaacauuguauuucuacauuuauuucaagacuguacuuuucagugacuuuuucaagugcauguguuaacagaagauuguuuggaacgagagugcaguggcuucuuuacuagcaaagagaaguguaauacaagugaucauagaaggugagaauguguuuauacuguauauggaaaccuaaugccucuuuucuaaagcuuuguacauuuuuuucgugaaauagauuaaauauuuucucucuaaaa

SEQ ID NO: 18883 - RNA, 53352 nt, Homo sapiens
ugucgccgccaucuuuguugaugugucagcuccgcagggguuuggggaaacggccgcugagugaggcgucggcuguguuucucaccgcggucuuuuccucccacucuuggcugguuggaccccgcuauggaaaaguuggccccugagccagagcuccagcagccuuguuagggcguggccugaggcuuggauaagugggguaagugucugagggguacucggggcacaccggugagucgcgguggcggugcgguggggcugccagccuuccgcuccuuccugcacguuccguggcgggggcgagggcgagugcgagguggaggucgaggucgagcgggcuccccgccuggcuccuuugagggcgcggaggaaggggagggcuggggaacggguuucaagcccuuuccucucccugccuuccuccuucgguuccgggaccuuggagguggcaaagaggggucagcgggggucgugggggcugugccucgagagcgucugaauucgagcccauugccugggcugcgugugaacugcagccaagcccuaccugcucgagaaucuuuccuagacucaaucgccuauuucguuuuucgucucaaguugacuguauguggguguuuuauauuuacuguugugaagacuuguuacccucuuccaaacacuuccauuacugugauucuaaguuccuuagaagugauucuuuggagugguggauacuguucuuuauguugucuuucaaggacgucaaggcauuucauaaaccuugguugguaaggaagggguuucagauuuaugucuccaucaguaaugaaaaauggcaaaaacaaaacaaaaacccuucuacgugucccuaaguagcaaucuugggaaacagugcaggugugaguauugcuuagcuguuaacaguuuaacaacuucaccuaauauucccaucuugauuuuguuuagaggaaaaaguccuggauuucgagucagaacaucuggauuagaauccuacuucuuucacuugauaaucuuguuaccuguggaaaucagaagagagaauauaguaaaaauacgcaguacagucccagguacuuggccguuuucucugcaugugugucauguuccuuugaugcccagcuuuuuuuucuuccaaaacgauaggccggguguugucuucuaagguguucaguaaaucaggguuucaagaggugugcugguagucauucagaagaaauuaaucugcuauuaucuauuuagguaugcuaguuguggguguggcuuucccaacuaucaaguacaccuuaauauuuaccgaguguucaucucgugggaaggauucagguucaagagagauugauagugaaacugaacuaucucuguguguaauguacacuguucccuguguaacuucaauucuuuauccaacauuacacaaauaaaaaacaguaaugauuggcuagguucauuuuucucuuuuauuucuggucuuuucauguuauuuuuaaugcagugaagauauuagaucacgaaucuugcaguauuaagaauuaaaacuuuuuacagcauaauaggcaaacguaugauuacugaagauucucccuggaaaugcauggauuguguuuguuuuuuaaaggcccuguuaaauucagaauaacugcauauaaacuuaagguuucuuuaaacaguggagauuccauagugugucauuggcuuuugaguccuauuuauugcuaacggaaaggguuggcugguguguaucacagugaccacucuaaccuuuuaguucuuucacccauaaaguagaguuguccuuuaaugcuaugcagugacagcauagcuaaugauugcuuaguauguucaguuuagaaacaucuauuugcagcuuuaugcugacaucacagagugaagauaaaagcauugcaguauacugacuccaggaagagacaguagguugaagcacaaagcagcuuuauuuggagauuuagaaaauaaucuuucccuuugaagaaggacugguaaucugcacuaguuucucaaauucaugcaacaguuucguguuaaaguaagaauccuuacccugaaauuuuuuuucuuuuaguaaaacuuagguuuuucuuuuaucucuaccuuaaaauaacuaaagcugguuuuucaauuucucauaaacauaucacugaguuuacaguauugcaaauguuauacuuaguauucauuuuaggggcagcagugagaucauagauaauuuaaucuauuguuucaaacugcuuugaacuuucuuagcuacugagauuuaaaaaauguauuugggcuaaaaaguaagaaaaaggaaaaauacugagaugaagggacaguagacacaaaguggaaaucagcaccagcauaguuuugauuggauugugaguguauuucuuauuaacauuugucuaucauuaagacacuugaacugauaauugugggauuauguagacuauguaaugucuaccgcacuuacuacauaaucccacgguagacuaucaguucauguuuuuaauaaaguagagcauaccaaauuaaccaacucuggccaaaggugucuucaaaauuuaaacauuaacccaaacuuuuuaauguaaugcaggcuuauaacuugaaaaaaaauuuuuuuuaaagauacuaggcuucauuuuguuuaguuuuuugagacaagaucucaaucugucacccaggcuggaguauagugguaugaucauaauucacuguagccuugaacuccuggucucaagcaauccuccugccuuagccuccugaguagcuaggacaacaggcacaggccaccauacuaaucuuuuuaauuaaaaauuauauauuauuauuuuuuauagaccaggucuugcuauguuucccaggcuguucucuuaauuccuggccucauuugauccucccaucuaggccucccaaagugcugggauuacaggugugagccaccuguaaaggaaggccugagagccuuccuuuuugaaaaaggaacuauaggucagauuuuuuuuuaccuacuuuauuccuuuucagauuuggaggaaaauuagcugauaauacuuuucauguuuucuuagacucauuaaagugcaagugcaaucuucaaauuagauuucuguauuaguaggaagucauuucugauaacuuucugcuuuaguauuuuaaaguauuuauaggagacauguaaaauuaccgagcugauaugacauauaugguguaacuugauaaggugaacuaugauguggccacugacccucuuuuucauggaauuuugauggaccauaauuucucuuuguccuguuauccuaucacaggauuugguacuauuugggaguugguggagggugggggggucuugccgcaucuauugcucaagucuuuuuuuuuaaacaucuuugugugugugugugugauauaaugcacauaucauaaaguucuugcccugagucuggauuguaaagcuaaacauacccccacagggauaaauaaccuuggucucauaaaacaaacuuuucaaacuggugaacuaaaggaaacuuuuuuauucuaaugcuguuucacuuaaacucaguauauuacaguuaaauuugugccaaccaugguggcucacaucuguaaucacagcacuuuugggggguugaggugagaagauugcuugaugccaguaguuugagaucacccugggcaacauagcaagacuccaucucuacaaaacauuuuuaaaaauuagcuggguuuggcggcauguaccuguagucccagcuucuuaggaggcugaggugggaggaucaguugagcccaggaauuugaggcugcaagugaccucugacugcacuccaaccugggugacagaaaaagacccuguuucuaauaguuucuaauaauaaaaaguuagcuuuuacccaaaagcuuaauaggaugugacuacuuuaaaaauuauuucuuuuuguagaacuuauuuacaguuuuuuuuuugaaauagcccucucaguuuuuaucuuuuaaaagcagaauuugaucugcauaaauucaccuuguaugaaacuuaagugucagguauuuucaucaugugaaacaacauuuucauguuucauacacaaguucuuuuccauccuauuauucuguuuuuaaaaagcuaaguuaaaaauauuaucuggguaugguggcaugcaccuguagucuuaucuacuugggaggcuuaagugggaugauugcuugagcccagaaguuugaagcugcagugaccuaugauugagccacugcauuccagccugaaugacagaaugagacccuguuucuacacauaaauaaauaaguagguagcuagcuuuauccagaaaguaucuuuuaaaguuaauuauuuaucaaaagucaguuauuuggggguugugagcagguuacauugaacuguguggaugcguuuuugauuugauuuuacuucugacauuaauuacaauaucaaucuugauagaacuagucagaaagauguuauucuuuuguuuaugcugcuuucaagguguuuuuggagaauacaaacucuuuugauguagguacuuuuccuacaaaggacaauaaaccauuauauugaagaacaggaguggucucaaguucaguuugcuuaauggauauuacuugagaaguguacaacugguauuauuuaagaaugguaugggcugggcgcaggggcucaugccuguaaucccagcacuuugggaggcugaggcugguggauugcuugaggucaggaguuccagagagccuggccaacauggugaaaccccaucuuuacuaaaaauacaaaaauuagcugggugugauggcacaacccuguaaucccagcuacuugggaggcugagcgggagaaucgcuggaacccaggaggcagagguugcagugagcuaagauggcaccacugcauuccagccugggugacagagugagacuccauuuuuaagaaaaaaaaaaaaaaaaaaaaaaaagaaugguacuacaguuuauaauuuaaaaauuuauagucugugaaugaagccaaauuucucuuaauauacuuaaaacacuucugcauuucuuacuuagcuucugauggagcccuggcaaaccuuaaaguuaaaauacuguaacauuaaauacuguagaauucauaauacuguaguguuuauuggcaguaaaacacgaagaauaaaaugaggauuucuguuuuauucacugccauguucccaacaccuagaauacauauuaauagaugcucaauauguauuugguaaaaaugaacaucuaguuuggaaauguaucucuuaguaccuuugcaugagacuaguuuguuugauaaccuguuacugaauaucugugaguuuguaaucgccugacagguucuugccugcugcacagauagaggcaguuuacugagacagcaguauugcaauagagaaaguuuuaagaaaugcagaggcagccaaguaguaguaagaaguuaauuacucaaaccaaucucccugaaaauuaggagacuaggguuuuuuaaggauaauuuggugggcagggggcuagggaauggggaaugcugauugguugggucggggaugacucauaagggguugaggcugucuucuugugccaagucacaagaccagucgagccaguuuagugguccagguggcaggcaucagcugguccaucaaaaugcagggucugaaaaauaccuugaaccaaucuuagauuuuacaauagugauguuauauauaggggcaauauuugcaguuuaucaaaccuaaauuuuuuguuguuuauacugcuaauuagaaaaacaggaaauggaaccagaagacaguguuuucauuuacguggcucuuguauggaaauaauuuuguagaaaugugaguucuuucauuaaaaaauaaguuccagaguggguaaugguugacuuuaaggcaaguaaaaaauuguuucuugaccaguugccuacagcugaugagcuccaguaagagcgaaaccaguucucacccacugaaaugauuucgaagugugaauugguccuguaguacugugucagaaacagaaacaacucuaagggagaaaaaguauuugaguuaaaaggaauuuugugacuguacuguauuauaguauuucuccuaaugaguaagaguugcuaaaagguauuauaaucuauaauuguaauuacuauauauauauaugaguguaaauuugcuuuguacaagcauuucuuuuucuuagagaacgagucucacucuugcucaggcuggaguacaguggugccaucauagcucauugcagcuuugaacuccuggacucaagugauccucccaucucagcuuucugaguagcugggacuacaggugcaugccaccaugcccagcuaacuuuaacaauuuuuuuuuuuuuuuuuuuuuuuuuuuuacggagauuaggucuuguuauguugcccaggcuggucucaaacuccugggcgcaauaaauccuuccacaucagccuuccaaaguguugggauuacaugcugcacccccaguguaucagcacuucuuaaauuaaaauaaucuugccaacuaaugucuuguuuuacauccuuccccuuuagucuacuacuugccauucuauccuuaguagccucgaugacggcuccccuuuuaccccauaccucucucccccaaaaaagcuuggacagcaaccaaauuggcuuguaucaguauugucaacuggaggccuacaugaggacucagcuuacuguuuuucuucugguuaauuguggacauaaucaaguucauugcuuuuucuccccaucugcuaccacucuugugcagcuauuuauggugauggcuuuguuacguauauacacauagaccauuguuaauccccuccuuuuccuuuggcugccaaacaguauucauuugaacaucaucagaaggugugcaagcacuuugggaggccgaggcggguggaucacgagguccagagauugagaccauccuggccaacauggugaaaccccgucuacacugaaaauacaaaaauuagcugggcaugguggcucgugccuguaaucccagcuacuugggaggcugaggcaggagaauagcuugaaccagggagucagagguugcagugagccgagaucgcgccauugcacuccagcuuggcaacagagcgagacuccaucuuuaaaaaaaaaaaaaaaaaaaaaaaccagcuugcaagcuaaguaguuaucacaugccaauuuacaugauuuuucuuaaagucaugagcauauugcugacagaaguuacagaaaguacuugccuuuugagguuaaucugagucuuccuuaauuuacaggaggaggauauguaaaacauucuaagcuuagguaaccaaauaaacagcuuuuuaaaucuagaugaauauccagcaggaugacacguuuuuguuguucuauacugucuuccacauugucaucuuacaaccuguuuuccauccacugaaugcuguuugcucccuagaucacuguguaaacccaguugaccccaccuucauuuguauagccacugaagagcauuugcaaaaaugcguguaaauguaguagagaauauguuuguuagauuuauuauuacugucauauugcaugagacuuaagaguuugauucaguucagagggagguuccaucuucgugcaaguacaaagaucauuuaaaaggcuaaaugcugccucuucaaaaaggucacaagaaaggcucuaugugcuugaugaguguaaaugcaguguuuuuaaauuuacccugagagacuauuuuuguacuugugaugagagaaaauuuggaggaagaugugacauuagaauugguccuuuaaacauagacuucagauagaccuaagggaagaacauucuaguugagaacaaagccauugaaauguuaauacgcaaguugggggaaucuuugaguuagacugguugggcuaguaaaguaugauggagugccaggauuucaggaauguguugagagauaagaauggaaaaguaguacaacugguuuacugaggaaucuuaaaucuggguauaaacgugaaaugguuuuauuuuuuccuuacugggucuccagucauacaguguaaaacacuccuaaccucuguacuuuccucugcagugcaguccuuuaagaaucccuugguccgauguaacuuugccgccacuuuugguuacuacaaaaaacuuauuccagaaauuaagacagguucuagccauuaaaaaaaaaaugaagucacaaacucauuguuuucucugaagaaaaguugaagcuguucccagcugcuuggcaugaagagguauaauuugacucaaagaugugcucccucuccuuacuuuuuuuuuuuuugagacaaagugucucgcucuguugcccaggcuggagugcaauggcacgaucuuggcccacuacaaccuccgccuccuggguucaagcgauucuccugucucagccucccgaguagcugggauuacaggcacccaccauaaugcccggcuaauuuuuuuuugagacagagucucgcuccgucgcccaggcuggagugcaguggcgcaaucuuggcucacugcaaccucugccuuccggguucaagcaguucucugccucagcuccccgaguagcugggauuucaggcggcugccaccacgcccagcuaauuuuguauuuuuaguagagacaggguuucgucgucuuggccagguuggucuugaacuccugaccuugugaucugcccuccuuggccucccaaaguacugggauuacaggcgugagccaccacgcccagcccacaaguuauaucuuaaagugaguuacuuugggugagguaauguagguggcagugccucuguuugagaauuauuuuauuuuguccuagauuuuggaauacagaguacuuacgaggucuuuuauuuacuccguuuauuuguauugucuaaaccaagccuuuaauacuagugugugcuuuggcuugguuauaaaauaucugcagcaaaauaaugauaauuugguuguuuggaaacauauuuauacagagagguagaguauuuaggccaauggcugucuuaguugaugccccagagggcagucuagaaauuagcauauuuagcaaacaagcuggucuacuuuuccuuucuuacacuuauuccucccauuuucgacauuccuagaauaauguuucucaaauacuaguguuaccauuucugugcuuacaggcuuuaauuaaacaaauauuugagaacccacuaugugcuagaaacucugcacuguaauuaagucuacaagucacugugauuuacuaugauuuguucuuaacaaaauucacuccugcuuagccuucuauggaaucuaccugaccagucuucucucucucuuuucaucauccucugauaaccaccuuuaucccagccugauguaaccaugcauguuuuguuauuuaaaaauuuaguauaucucuccauuaguuuuccauuaguuuauaucucauguauaaacuagagcuauuuuccauuaguauaucucuuaucuggaauuauugcucuguuauuucugucaaaacuaugaucuguccucuuuuuaaucuaaccucacaugguuucaguaacucauuaccuuguacaugcuuuguugauaccugacaaaagaagucaacaauuuuuuuuaucaagauuguggaaauauuuuauaauuauguguugugggauaauauuugaagaugacuaauugucauaaaauggcuagaauaguaaccuccauaaacaauauaaaaaucuauccuaugccgggugcgguggcucaccccuguaauuccagcacuuugggaggccaaggcagguggaucaccugaggucaggaguuugagaccagccuggccaaccuggugaaacccuaucucuuccuaaaaauacaaaaaauuagccagguguagugaugggcaccuguagucucagcuacucgggaggcugaggcaggagaauugcuggaaccugggaggcagagguagcagugagccgagaucucaccauugcacuccagcccgggcaacgacagugagacucuaucccaaaaaaaaaaaaaaaaaaaaaaauauauauauauacacacacacacacacacacacacacacacacacacacucuaacuuggucaaauuaauaaaguugcuuuuauugaccuaggcagugcauaugggcuccauuuuauuuguacuggacauuguuuuuuuccugaugagaauguuugaaaaucaccaugguacuuccuggauuccugccuggaugaaaaacuaauuucuaccagggauucuuuacacccugacuucauuauggcucaaaucuagaucucugggcuauagauaguugugucuuguuauuuagguuuccuucuuaguaaauuuuuauuuucuuuaaugugcguuguuuuguuaucuugguuugugauuucuagugcuuuuauugguguauuauuucuccaguauuuucuuacagauuuaugagguagucuuuuuuucuuuacagagcugaaggaauucuaagcauucuuuggcacucgucuaguugcuagcguuacuccuuaccuaacaucuuauggggaugauuggagaaugccagacuacaacugaaauuaauuaaugaaguuguuugacugaaaugaaggaggaaagacagacuuugcaguggcccuacugcuuguagcuagccagcuuggguuagcuguccuaguccuuuuucuuuuuucucaaggacaggcuuuuaaaggaauuguuagugauaaaauuugugguguuaguuauuccacaucacagagugugugcaaguuuguaugggguuuugguuuaaagugguuuuuaauuuugauguuucaauuucuuagauguaaaacgaagaucaggagcagauuugaagaauuacaaagugaauuggugccagucagcaugucagagacagaccacauagccucuacuuccucugauaaaaauguugggaaaacaccugaauuaaaggaagacucaugcaacuuguuuucuggcaaugaaagcagcaaauuagaaaaugaguccaaacuauugucauuaaacacugauaaaacuuuaugucaaccuaaugagcauaauaaucgaauugaagcccaggaaaauuauauuccagaucaugguggaggugaggauucuugugccaaaacagacacaggcucagaaaauucugaacaaauagcuaauuuuccuaguggaaauuuugcuaaacauauuucaaaaacaaaugaaacagaacagaaaguaacacaaauauugguggaauuaaggucaucuacauuuccagaaucagcuaaugaaaagacuuauucagaaagccccuaugauacagacugcaccaagaaauuuauuucaaaaauaaagagcguuucagcaucagaggauuuguuggaagaaauagaaucugagcucuuaucuacggaguuugcagaacaucgaguaccaaauggaaugaauaagggagaacaugcauuaguucuguuugaaaagugugugcaagauaaauauuugcagcaggaacauaucauaaaaaaguaaguuuuuuauaccuuuagguuauuuuuuuucccucacaggcacagggauucgagauaaaauucuuuaaaggaaaauaccauuuuguucauuuuuacuugcacauuagaaucaugcacauaguaguugaacaauaaauguauaguugcugaaugugugagcaaaugucgaguuuuucagauaucugaguucaauauguuaaauaguguaaauguauuaacgugcuagaaauuuuuauagacaacucaaaauuuuucacuuuugaaagaauguagaaguauauugucaaaacuaagagaaacucaaaaggaaauaacaagucauaaaauuccacaacuuuuucuuaaaaucugcauucuaaauucauugguuuaaaacauuaaaauuuagagaacagaauaauugauuaucguucaguaaauaauaauacaguuuuggauaugugaaguucuguuuucaugauaguuuaaaauuuaccaucuuaaccauuuuuauguguacguuucaguaguguuauuauauauucacacuguuggacaaccaaucugcagaacuuuuucacuuugcaaaucugaaacacuguauucguuaaacaacacuauuuccacuugcccucagucccuggcaaccaccauucuacuuucuguugcugaguuugacuacucaugauaccucauguaggugaaaucauauacuuuucauuucaugacuggcuuauuucauuuagccuaauguccucauuuauccauguuguaacaugucagaauuucauuucuuuuuaaggcucaauaauauugcauuguauguauauaccacauuuuguuuauucauccauuaauggacaucuggguuccuucugcuuuuuggcuguuguuaauaaugcuacugugaacuuggguuugcaaguaucucuucaagacuccaaggcccuucuugauauuacccccaaacaaaugccugcuguugcuauucauauccuuacuguaauacuauauuaugugaauaaacuguaugcuuuuguacuugaaccaucagugcugcugcuauucuugcauuuuauaggguaacuuucucauuuuccuguagccuguaccuauucuuuuagaccuuccucuugagauuaucucugaugccucuucccacuuuacugagaucuagacucuuaccauuuucauaccucccuuauaaauuauaagauguuauacauuuaauaauaauagcaguaaacauguauaugcugauaauuaggugccugguauauuacauuuauuaguucauggauucuucacaagaacucucugugacaugugcuguuauccccauuguacagaugaguuaccugaagcgcagagagagaaaaaguaacuugcucaaggccacaugcuaacaaaugcaaaguuaaaaucugagcuuugugaguggagcuuuagagcuuuuucaaauacgguuauuagaaaugaaccaguuacaagguguuaaauuuaccuaaaaauaugaggaauaggguagaaaauugguuucucuuuuuugcuucauccugucagaacagugacagcacgggugaguggaauaaucauaauucugaugucugguauuuggaagauacccauuggcauuugccagcucuguugucuuggccaagucaaccucuuugagugaaagauuuuucaccuuagagugacaauacuuaccugauggaacuguuuguggacauuaggacauuacacaaaugucagauguuauuuuaaaucaagguuaauuuuugguuauacacaugauguuuuuaauuccaaauaaaauacuuugugagucagguuaacucuaaaacaacuaaauuuuuuucuuaacuuuuuucuucaucuaauuuucuaugaagaaaacuuccuuuuacuuucuuugaaauuuuaaugaaugcaucuauuuccaaaucuuuguuuauacauucccucauuuuucccccagcuuuauugaaauauaacugauaaaauuguauauauuuaaagagguacaaugugaugauuugauauacaucgugaaaugauuaccacaaucaaguuaguuaccacaucggucacaucacaguuaccuuuguguguguguggugagaacauuuaagaucuacugucuaaacaaauuucaaguguacaauaugauauuauuaacuguuaucaccauggaguauauuagauccccagaacuuacucauuuuauaacugaaaagucuguaggcuuuggccaauaucuccccuuuucccucacccccugugcccuggcaagcaccauucuucucuuuauuucuguucuuugauuuuugaacacaucaauauuacugucuaagguuccaaccaaauuuuuuuuuuuuuuuugagguggaguugugcugugucacacaggcuggagugcaguggcgcgaccucagcucacugcaaccucugccuccuggauucaagcaauucuccuacuucaggcucccaaguagcugggacuacaggugccuaccacuacacccggcuaauuuuuguauuuuuaguagagacaggguuuugccauguuggccaggcuggucuugaacuccugaccucaagugaucuaccugccucagccucccaaaguucugggauuacaggcgugagccacugcgccuggcccaaaaauucuuuauuuuauuuuuuugagauagggucuugcucucuugcccaagcuggaguguagugggugugaucucagcucacugcagcgucaaccuccugugcucaaguuguccucccaccucagcaucccaaguagcuuggacaacaggugcgcaccacuaggcucagcuaauacuuuugugguuuuuuuguuuuagagaugggguuucacgauguugcccaggcuagucuggaacuccagaacucaggcuauccacccacacuggccucccaaagugccaggauuacaggcaugcaccacugugccuagccuaaaauucuuuuuuuuuuuuuuuuuuuuuuuugagacggagucucgcucugucacugagcuagagugcaguggcggaucuuggcucacugccaccuccgcuucccagguucaagcgauuuuccugccucagccuccugaguagcugggacuacaggcacgcccuaccacacccagcuaauuuuuguauuuuuaguagagacgggguuucaccauguuugccaggguggucucggucucuugaccucaugauccacccgccuccaccucccaaagugcugggaccaaaauucuuaauuaagaacaguugucuguauauagaauaugcauuuggcacauaaguaacaaauugaguguuuacugcuuuucacuucccccucccuuuguuguucacuugugaacuauaggcaggacucuugugucucaaguaguuuucuguagcaauugaguaugccucacauaaaugaucuaaguuaaaccacugugucauaaaaggcuugaauaaacaugcauauauuugccuuuuuuccaaacauuuguaugauuguuuccucacugauuccuaggcucagcugucaccuucucagagaggccuaucuagacuacuuaucuaaaauagcagcucaagucacucucuggcuuuucgcucuccuuuauuuuucuuaauaggauuuaaucaccagcugacauuuuauuauauaucuaggguccauuuuuauuuuauccccuagaauguaaguuccacgagggcagggacuauuugcugacauauuucccacauaaaauagaugcugaguaaguacugguugaguuaaugagugaucuucaaaguagaagguggaaaggccuggggcuuuggaaguauaccuggauccaaaacaaaauugaaaguucaacugcuuacuagcugugugaccuggaacaagucuuaggcuucaguuuuguuuugcuguuaauauuuuuauuuuauuuuuagagacaaaggucuuauucuguugcccaggcaggagugcaguggagcucacugcagccuggaacuccugggaucaagugcuuuuccugggacuccuggcaugagccaucaugccuaacuaguuuuuuuuuuuuuuaauucguaaaacagaagugaugguaaugauaauaauuucauagacuuauuuugaauacuaaaugaaauaauacacuuuuuuaaauuaaaaaagcuaaauuuagccaauagcaagugugcaauaaauguuagguuacagcuauugcuaauuaguccuagaguacuugcuguuagcuuucuuaggcaucuuacauuucuaagcacuuugcaggcaguuuuugagacuuuauuucuguuuuucuaggggaauucaagaugauauuucugcuuagauuuuauuuugcuguuuuacauugacuguacauuauaacuauuagacuaucauuaaaauauuuuuaaaaucugaagcaagacuuuucaacuuuagcaguaucgccacuuggggccagauucuuuguuguuguuggaguugucuugugcauuguaggauguuuagcagcaucccuggccuccauccacuagaugccaguagcagccccuacccuuguuaggacaaccaaaaaugucuucagacaaaugccuggaagggcaaaauugcccguggcugagaaccacuuauuugaagagugccagugcugacaggauuggugcauaauugagauaccugaagguauaaaucuggaagggugugcuuuucauucauaugauucuauuuugauuugaaauauucauauuucuagggaaaaguuaauagccuaaugggccagagaaucuuuugcaaaguauuauguuucacuauaaaaugauuauuuaggaauguuaauuuauuaacauaaugaauaauuauagauaucuguacccugaucuguaaagaaauuauauuccacauauuauuuuaucuccauuuuaaauuauguuuuacauacacugcccuuuuuauauuuagguuaauuaaagaaaauaagaagcaucaggagcucuucguagacauuuguucagaaaaagacaauuuaagagaagaacuaaagaaaagaacagaaacugagaagcagcauaugaacacaauuaaacagguaaaaaagacaaaaaucuucgaagacuauacuucaauuaauaaaauaaauacauuccuggcagccgauuguggcagcucaugccuguaaucguagcacuuugggaggccaaggugggcggauuacuugagcccaggaguuugagaccagccugggcaacauggugaaacccugucucuacaaaaaaaaaaaaaaauagaaaauuagcugcauaugguagcaugcgccuguaaucucagcuacuaaggaggcugagguggguggaucacuggagccggggagauugaggcagcagugagcugagaucgugccacuguacuccagccugggugagagagugagaccuugucucaaaaaaaaaaaaaaaaaaaaaaauucugaaaacuugcauguagguuggaguucuauaagguaaaucauauuuuaaaugcagagaauugcauggcauuuaaaccauucuccuuuacaaaguaggacucauagccugauguauuuccuuuuauguaaguuuauucuuaugcaugugacuccuguacugcauguaguagaacauacucuguuauguucaaaauaagcaaaaagacgauuugaguugacagucaacuagacuguuguugccaacagggaggaagcaauggaaauauaaaaguuuaugucuggcauuaggauguuuuuaaguuuauauuuugguaugguuccauucucaguauuuuuaaaaacuauauugugaaggcuggcugucauacuuuagauuguaucuggcuuacuggcuuuccuagccuguccuuuuccuucuuuuuuuuaauuuauuuuuuguuuuuucuuugagacagaguuuugcucuugucacccaggguggaauucaguggcacaaucucagcucacugcaaucuuugccuccuggguucaagugauucuucugccucagccucgggaguaccugggauuauaggcggccaccaaccacacccagccaauuuuuguauuuuuauuagagacaggguuucaccguguuggcuaggcuggucuugaacuccugaccucaggugauccacuugccuuggccuggccucccaguucugggauuacaggcaugaaccacugccccuggccucuuucuaguuuuuaaaugaacuccucugaugcaugaaucaacaaagugaguauucagacuaauaggaaagcugaguugcucuuuauuuuugaggugcuuuuucuucugugaacaggauuagaagcauucuagccuuaaaaguauuuugucucaucuuucaaagaaaguuauauaaugaaaauaacaguaaacaauugguaaaacaauuuuucacuugaugcaugauuggaaggugacuguauuuguaaaauuguauguauuuaauccugauuuuuaugugcucuaggguccccacauauaaaccagaguuagaaugguaaagugugagggagucuuaacaggcuaaauccauauuucgguagucaggucacucaaugaccagaaacuucagaccgaacagguacaauggaaccagagcccuuccuuucaugagcuuauuagugggcuuuuuuuguuguuguuguuguuuuuaaagagaaaagcuuuuccuucuuuauuuuauuucuagaucugcacuaucuaauguggcauccaccagcugcauauagcuauugagcacuucaaagguagcuagucuaaauugagaggugcuguaaguguaaaauacacauguaacuuagaagaguuaguauaaaaauaaaacagcucauuuuuuucauguggauugauaauauuggaaugauaauauuuggauauauuggguuuaauaaacucacuuguuuguaauuuuuauuuuuuauuuuauuuuauuuuauuuuaucuuugagaugggguuucgcucuuguugcccaggcuggggugcaauggcgcgaucucggcucauagcaaccacuaccucccagguucaagcgauucuucugccucagccuccugagaagcugggauuacaggggcccgccaccaagccuggcuaguuuuuauauuuuugguagagacaggguuucaccauguuagccaggccagucuugaacuccugaccucaggugaucugcccaucuuggccucucaaagugcugggauuacaggcgugagccacugcgcccagcuucuuuuuacuuuuuaaagugugacuacuagaaaguuuaaauuccacauguggcuuguacuucuauugcucaguguugcucuagauaauuuuguaauaaggaaaauuaguauauguguacuauaagauuuaggucuuuuucaacagguuuauugagauauaauuaacuuuccacacaguucacuuauuuuaaguguacaauucagugacuuuuaccugugcaaccuuuaccacaauuuuagaacaugucaucaccccaaaaagaaaugcaacacacauuaguagucacuucucauuugccuccaacaguacucccucaacccugcccuagggaacaaguaaucuuucggucucuauauauuugccuguucuggacguuucauauaaauggaauuauauaauagguaccccuuuuuaucuagcuucuuuuauuuaacauaguguuuuuaagauuucauucaaguuguagcauguaucaguacuucauuguuuuuaaugauugaauaguaguucauuauauagauauuugauguuuuaauauuuuguuuaccccuucaucaguugauggacaugggaaaauggguuguuucugccauuugacuauuaugaauaauaccacugugaacauucacgugcuaguuuuuauguguacauaugcuuucauuucucuuggguguauaccuaggaauuaauagagugaguugggaaguguuacuuuuugggggaagagcaaaaauuugugaagaauugguauucuucuuuaauuguuuuaaagaauuuuaccuguguagccaccugggacugaauuuuucuuuguggguagguuuuuguuguuguuguucuuuuuuauuaugcuaauucagucucuacuuguuauaggucuauucagaucuucuauuucuucuugagacaguuuugguaguuugugucuuucuaggaauuguucauuuugucucuaaguuaaauuguucauacuauuuauuuauucaauuauuuuuauuucuauaaggucaguaguaaugucccucuuucauuuugauucuaguaauuucagucaucuuucuuuuuucuucagucauuccagcuaaagguuugucaguuuucuucaucuuuucagagaaccaguuuuugguuuuguuuguugucucuguuuuucuuuuucuuuucuuuuuuuuuuuuuuuuugagacaaggucuggcuguuucacccaggcuggagugcgauguugcgaucucgguucacugcaaccucuaccuaugaggcucaagugauccucccaccucaaccucccgaguagcugcuacuacaggcgugcaucaccacauccagcuaauuuuuguauuuuuuuguggagauggguuuucacuauguuucccaggcucgucucgaacuugugagcucaagcgauccaccugccucagccucccaaagugcugagauuacaggcaugagccacuucaccuggccuugucucuguuuuuccauucuaguuuuuauuuuuuucuuccuccucuuuguguuugguuuaguuugcuguuuuucuggugucuuaagaugcaaguauagguuauuaauuugauacccugucuucuuuuuuuuuuuuuuuuugagacgucauuucgcucuugucacccagaccggagugcaguggcgugaucuuggcuuacugcaacuuccaccuccugaguucaagcgauucuccugccucagccucccaaguagcugggauuacaggcacccgccaccaugcccagcuaauuuuuguauuuuugguagagacgggguuucacaguguuggccaggcuggucucgaacuccugaccucaagugagccuccugccucugccucccaaagugcugagauuacaggcuugagccaccccgccuggcccccuuucuucuuuuuuaauauagguauuuguaguuauaaauuuuccucuaagcauuccuuuagaugugucuccugaguugugguauauuauguuugcauuuuuauuagucaucuaguacuuucuaauuucccuugcaauuucuucuguguuucuuuagcaguaugugguuuaauuuucacaaauuugugaauuucccauauuucuuucuguuacugaggucucauuccauuaugguuggagaauaugcuucauaugauuuuaaucuuuuaaauuuauggaaguuuguuuguaaccuagcauauccucugucauggaauauuccaugugcacuagaugaaaacguauacacugcuguuccuggguggaguguuguauagauguauuagauuccauuguuuuguaguguuuaagucuccuauuucuguguuaauuuucugccuaauucuauuuauuauugaaaguaggauagugaagucuccaacuauuguugacuuauuuucccuuuuauuucuguuaguuuuugccucauauauuuugaugcuacauucuuagaugcauauacauuuaucuguuagaucuuucugauggcuugaucuguuuuauuuuugugagcuauucuuuaucucugguaacauucuuaauuuuagucuguuuuuuauguaaauauagccacucuuccuuaugauugcuguuugcauuauauauuuuuuuccacucuuuucaguuuacuugcauuuugaaccuaaaaugccuucuauagacaacauauaguugaaucuuguuucuuuaauuaagucuguuaguuucugccuuuugauaggauuauuaaauccacuuucauuuaauauuauugauggugggauuuaugucugccauaucuuucguuuuccauguuucaugucuuuuuucuuccccuauuccuccuucacugccuucuuuugcauuaagugaauguuguccaauauaacauuuaaauuucuuucaugauauuuucacuauacaguacagaguucccccuuaucugaggggaauuuauuccaagauccuaaguagaugcaugaaauugucaauagcacugaacucgauugccaucaaucagaauauguuucuguuuaugucugccccugacaagugaaugcccuuuucauccuuuuuuuuuuuuuucagagacagggucucaucacucuggcuggcguaccauggugggaucacagcucacuguagccucaaacuccuuggcucuagcaaucuuccugccucagccuccugaguagaugggacuauaggcaugcaccaccaugcccagcuaauuuuuaaaauuuuuuguagagauugggucuugcuguguugaccaugcuggucuugaacuccugaccucaggcaauucccucuccucagcuuuccaaagugcugggauuacaggcauaagccacuaccuggcuccuuucccgucuuaacaaaguacuuaugcaguguggccauaacuuuugaaguuugaggugugacagcaaaacuagcaugaauuucuuuuuucuucuucacaguuucauggauagaagauucauucuuacuguagaucuuagcaaccucaguauaugauuuuuuucuuucaagucaccauuucacuuaaaauaagcacuuuaaagccucucuuuggcacaugugaauugccagcaucacuauucuuauacucuggggccacuaauaaguaaacucacuuauuaauuaagggcuaaguguugcugcacacaagcacugucguccugccauagucagucugguaacugagauggcuacuaagcgacuaacuggcagguaguguguacaaugcagacaugcuggacaaagggaugacucacagucucagugagacauagugagacaacacaaguuuucaucacacuacucagaauggcaugcaauugaaaacuugugaauuauuucuggaaguuuuuauuuaauauuuuugaacugugggugacugaagguugcugaaaccauagaaagugaagccacagauaaggcgggacucuacuguauuucuuuguguuauuccuuuguggauguucuagggguugccagauaccuuaacuuaauggaaucuccagauuuuuacuaaaugacagugagauauagaaacauugcuaaaaguuuuuauuucaauagcugaaguauauucauuguauucuuuauguuuauuuacuuuguuuauauuuauuugcaguauuggugguguauuugguauagcuauaaaaauaauuuggaaauaauuuucuuuacaguuagaaucaagaauagaagaacuuaauaaagaaguuaaagcuuccagagaucaacuaauagcucaagacguuacagcuaaaaaugcaguucagcaguuacacaaagagauggcccaacggauggaacagguauuucucacaucguugucauuauuaacuugauauucuggugacucuuguuuguuaaaauaagcuaacacuguuagacuauuuuggaccucacuauuguauuaauacuaggugauucuuuuauauaaaaguaagccauuaggccagacguggugacucacaucuguaaucccagcacuuucagaggcugaggcaggcagauugccugaggucaggaguuugagaccagccuggcuaacauggugaaaccccaucucuacuaaaaauacgaaaaguuuagccagacgugguggcgcaucccuguagucccagcuacuugggaggcugaggcaggagaaucacuugaacccgggaggcggagguugcagugagccgagauugcacugcugcacuccagccugggugacaaagcaagacucugucuaaaaaaaaauaguaagucauuaaaaauucuaaagcaauauauaaauacauacagaugaauaaaaaaguguauggaauaaaaauuuuuuuuuuaaucuguacauauucuuccccugccuacaauccuuuuauaucccauuccuuguuccauagcuaauuauugguauuuugauuauguaucuuacuacauauacauguacaagucacacauguuuauuuguacauggucauauacuuuuuucccccauuugauuggaaugauacuauacaucuuuuuuguaaccuuuuuucccauacuuaauauaccuugguaaucuuuuuaaguugguauauaugaucucagaagagguaauuuuaagcagugcuuuuuuauuacuugccugaacucuuuauggaugacgucuuugucaucuucauuucuguauccacaaaaccuagcacaguaucugacuaacaauuagucuucacaaugaauugaaucugaaaggguuaacucacaccuucauuauuugaaugugauggaucccacccuuucuaccccgaagcugcuacuguagauggcauucuggaaggacuuuaggaaacagauuauccucagccuuuauuuggaugauucuuuaaaacaugcugacuccuugcauuagaaauguuauguuuaacucuccugcuaucaguucugaacccuuuuguaccaauugaagggaaauacagagccuaagagcuuaagaaguaacugguuuuagcgggcccaaacauagccagccagucauuagaaucaccuggugagccaaccugccugccugccugccuuccugccugccugccugccuuccugccuuccugccuuccugccuuccuuccuuccuuccuuccuuccuuccugccuuccugccuuccuuccuuccuuccuuccugccuuccugccuuccuuccuucgucccuuccucccuuccucccuuuccuuccauuccauucuuuucuuuccucccuccuucccuccuuuccuuccuuccuuccuucgcauucccuccccuccccucccuuuccuucccuucccuucccuucccuucccuucccuucccuucccuucccuucccuucccuuuccuuuccuucccuucccuucccuucccuuuccuuccuuccuuccuaaaacucuucgaagcuuaauauuuaaaauaaaauaguaguugguguacaugguagcaguucaaacauuugaaaaagucuucuuccaaacauuuuacccccuuccuaaagguaaccacugaugccaguuuccuguguauccuuccaaaaauauuuguugcauagauucuuguguuuuuuucuuuuuuccuccccuggcuuuuaaaaaacaaauggcaauguacugcacucacugcuauguauguuuucuccuuaaugaugaagaguguagaugaugcuaauaauaguagcugauguacugacuuuuagcugugugcaaagccauguucaaaauacuuuacaaguguuaacuuguuugaucuucacaacaacccuaagaaguggauauuauuaaaguagauuuuggaagacugaucuauuuaauuauuaauagaucugucucauuccuuuuuucccccuaacuuuuccucccaacuuuuugagaauuuucaagcauauagaaaagaugaaagauuaguaaaaugaacacuuguuuaucuuucaucuauugucacuaagccuaguaaguuuuguuuaaaaauagguucccauauguguuuacccauguucaugugcacacgcacauucaccugcuuuuuaauuuccagauugagguuuccucauuucauagaccagauagauagaaugaauuugaacccuacuuacaagagaguguagcuguauuauaaauuuucagggacuugauaacauuucccccacccacaucucccauggccugauauuaauaaguaucacagagcaguaaagguuuuagcccuaguauaccauucuggauuucuacuuugucuuagaucuuuuagcccuggaaauuucccauacuuucuugugagcucaacuauauauuaaaagauguuuguuauuuuucaucuaaaauuuuugguguauugaaugaggaggguuuaucugccauacuuguagaagcuacacuucauauacuuuguguuaauuuuaucuguugaguccuauugauuaucuuauucauguuuuacuuaucuuuauccaagucaaugauaaucaucuuacuuacaguggauaaauccaaagaccuuaauuggccugucuuccuuuaucugugccauaaauggaccuucuauaauagcuuaaauaacaguuauuguauugucuuguuuaauacucccaaugaugcugugagguaggugcugccauuagcaggauggggcaggauccaggagugugaacuuuuaacaagcaccccagguuauuccuuugcaguugaucuauggaugaccccaugaguaacagagccguuaucuggugcgccauucccugcuauagugaagacucucauaauauuuuccguuuauuuuuuuugagacagggucuguugcccaggcuggagugcaauggugcaaucauggcuaacugcagccucaaccuccugggcucaagagaccucccaccuuagcccucccaaauagcugggacuacaggugcacaccaccaugcccagcuaauuuuguuuuuuguuuuuuuuguagauaggggauuuugccauguuguccaggcuggucucaaacuccugggcucaggcgaucugcucaccucagucucccaaagugcugggauuacaggcaugacuccuugcauccagccaagacccucauaauauuucaccuugucuauuacaacugucuuuuuuugauuauuuucuacccccuaucucucaacuucagugaagcucccaugcugcuaccaguuaucuuacuaaaacacacauuuuaauaagagcuucugauuuauaaauucuucuuuggcuuuauguugacuauggaauaaaaccucaacuuauuaccaugacagaaauucuucuuccuuugaggaucuaaucuauaccucuuuuuguuuuuauaacuacuuucuucccacuccagccaacacaccaaauuuaagcccaauaaaauaacuugauaucuccuaaaugugucaugcuguuuuauacuuuuagguguuugcacaugauauucacucuauuuuuaauuccuuuccuugauucaccccuuacauucuauagaauucugcuuagccuuuaauaccuagcucaaguauagcaucuuuuacccuuccugccaacuccucccaggggauguaaguauuuucauguuuugaaggacuuuguacauucauuuacuauaauuuuucauauuauaauguuuguuuauaugccuuucucacuagauggugagcucuuucagaggccacaacugcuacuuuguuuccaauagaugauacauuaucugaauauuaaauuauuaugaaaccagacuucucuuaaaguugacauugagcuauugacuuuuucuaaguacagauauucaguugucuaaaaaucuaauucuguuggccaaguccagcauaacuuucucagucuuugucuacaagcacauuguuacaaccucggggccuaucauaucccuaaugcaaugucuuucuuaauuugaaaauuaguaugacuauuucaauggaaacaaaucccaauugggagauuuuuaaaauuacuuauauguguauguauagcauucucaguguugacuagaugugcuuaucagcagugccagaauuuuaugaaacauuuuugcagccauuuuucaucaaagcauagaagcuuucccuacauucugcucacuuuauuuuaauaguuaccuucuucaauucaguugcaucaucaguguuuauuuaccacuaaaagauauugaaaauuccuaaaguuugaaguucuaucuuuuguaaauuaaaugugugcuucaccauauuugcaaaccaugaguuacuucaaagaaggacuauuuguagaaguuuucauucugugaaauuucagaauauggaguaccaguucauacuaauagaaaauuuuuaaaugaguauauaguuuucauacuuaauccaguuagguauuucuuauuaaguguaaaaugcuucagaaagcuuuacauaaauaggaaauuaaauggucauuuguuagcauauggcuacuuaauuuucgaaagggaguuaagauuuuagaaauugucggcuauacagucaggguccuggcagaaaacagauggcacacuuaaaccggugaugaagauaauuuaauaaaaagauucuuugucaagguguggacaagauguagggaucccaaaaagggaagaugcagaauuucagggcugcuggacaaggagcagguauuacaccccagaggguaguuguauagagagggcaccugacaaggggaguggccaucagccaaccugugggaacucuggaggagccagaucucacucugccuacguucccaagcuucugccuacugccuucuguugggugaacccaacuggaaguuugagggcaagagagcuuauugauaggguucaugaugucaucauguuccugggacaccaguugggauuuaaaaaaagugggaaaggggaucuggaggaguacguggaaaauagcaaccauauuagccgaaguaaaaggaacaggaaaggguaaaggcaaaugcuagggauauuguaccauuuuucuauaauuuuaaauuuuuucuuucauuuuaaaauuucauggcacaaguccugggaauguugugcaaaaaccaaacaaugcauugguaauauaagagacaaauaccauguauuucaauacauuuccauuugaaacauuauuuuucauuaaugcuaaguaauauuuuuuuugaaggccaacaagaaaugugaagaggcacgccaagaaaaagaagcaaugguaaugaaauauguaagaggugagaaggaaucuuuagaucuucgaaaggaaaaagagacacuugagaaaaaacuuagagaugcaaauaaggaacuugagaaaaacacuaacaaaauuaagcagcuuucucaggagaaaggacgguugcaccagcuguaugaaacuaagguauaacuugugccauuugaaauauguugaccuuauuugaaauuuguucucuuugcuuuuccauauuuaaucaaauaaucauaauuuaacaugguuaacacucaaacguaaaguuguuuuuauuaguuuaccuucuaaaaccaugaauuuuuuaguaauucaaguguucuauuacuugucugcagagaaaagguuugcuagggaaaaaauaaguguuggcacauguuguuuauuagauaacuuuuucuugagcuuucuaaaaacuuucuuuuaaaaucuguauguuggagaaauuugcaucucaagggaagauuauauuuugguaaaauauguauauaguaguguaaaaugaauaguuuuagaaccagaaguauaauuugauauaaucuuaauauaacacaucaccauagaagaaaauuuauguuuuucuuacagaaaaacaugucuuucuuagauacuaucuaaagagauuuaguuacugagccagcuauucagaacccuuccuguuaacuagcagccucucaauggucauauuuccagggcauuaucauuuuucaaugauaaauuuuuuuuuaauucauuagcuuuuaguucaggaauauugucauuguucucaggaauucugacaaaaccaauuuaguucauauuucaccuuaaugccagccaguuaagaaucauaaagauauguuguguugacaauacauccaauugguuaaaauguaaauguaaaucaucuuugugucuauuaauuggauuuaggauuuuacuacccucuucucauuuggacuuuaaauaaguuuuauagucugugggcuauagugugccagcccuugauuauaguguuacuggacugauuacuuuguggggaauauaaaagauauaauuaauugauucuauaaaugaaaauauaugaccuagugauauuauuuuaggaaggcgaaacgacuagacucaucagagaaauagacaaauuaaaggaagacauuaacucucacgucaucaaaguaaagugggcacaaaacaaauuaaaagcugaaauggauucacacaagguacguacuguaauacaauggaauaaugauuagaaugaguuuuuuuguuuuuguuuuuguuuuuguuuuuuuuuugagacggagucucgcucuuucagauuagaaugaguuuuaagagcaaaugcaauaacaguuaaugaggcaugaagcuuaguuuagugaccugcaaguuaguuuggaccugaauauuuggugauuaugaaaaagaaauguccucacauuauuuacauauuaaauggggugggauguuaaauuuuacuauucauaguuugcaacacccaaauuugcccuguucuuuaagcauuuuuugauaugcaaaauuuaaauaacacugagaaauuggacgggggagaauguguaaguuuccaaauuugaauguaaacucuagaaauuuuaaaaaaucaaugaugcuaagauuuuauacucaaaaaauauacauucuuauuuaaauauaauauaaagauuuuaagaauaaguugccuuaacuuuuuuauaaauaugacuccauugguauugugccuagugaauauaauuuuauuaaaaagcuaauauaaguaauuauaaaggcugauaccugaugccguaauuuuaagcacuaacugagcugauauuagagguaauaaaaaucugaagaugauagaaugugaaguaaaagaacaacucugaauugugacuuaagaaguguaaguuuaugaaaauaucaguuuccagguuuucacaaacagucuuaaugauauugguuaaaaucauaaucguggauuaccgcauuaaauaguucuaaaucaguagaacugcuaauaacccuugguuauauuguauucucugauauagcauuaucagagaaaacuguaggaggaauagucucuguugacaguggucaaagguagauuagagaauaguggguuucccucaagucugaagcugaccuacuaaucagcacaugugugagggaacugccaaggcagagaaagaauuuucagaaaggaggaggaugacagucucuggagcucaacacggcuaagccaucuaaauuuucucuuuacuuugaguuacagaaugaggaauugaaauuccaaauucauaaaaacaguaaugauucucaacuaccugaguugcuucaagaucagaacaucauacuuggucaugucugauaucugugguacuuuccucaucuucauccagagugcuaagagacaggcuccugaaaccuguuagaauacuagcacuuaggaacaaaagaacuguuacagaucuguguaagagaucuuaauggcagcuuugagcucagaugaaaccagguagucuguaaauagguuagagaggugauuuaaggcugacuucuguaagguuacauggugcagauugcuagaaaaugaacaagcauauugacuugguauguagaaauucacuaguucuuuuuaacuaaaggcauuuauuaaccagcaagcuuugugcauaacacuguauuagauaacuuggaggcuauaaaagccuuaggagacacagucguuacuuucaaagaguguccaagaugggcucccgguuacuuguuuuauguauuuaccuauuggauguuggaaggagucccuggaucaaaggauacaagauuuaauaaucaugugguuauuauagucuaccucuugagaugugggcaagagacacgagacacuuaguaaauuuuucuugaggcacccuuucugguuucugguuccugcccaccaagucuuagguacuaauaauacugcaguccuguagcuuacuggauccauugugaucaguagcuucuggucagacccccagugcauauuaccagaacuuaagaguaggugggcuggcuacccagaucaucagacuacccaagagaaacaauuuguuuccuucccuaaacuccuuugggauuuaacugaaaauguguuuuaaacaccuagccuguaaaaacagaagccuuuuauuuggaguacaguaaauaaagaugaauuucccccaguguaccucaucuacuuguuugccuaccugguugcuacuuauucaccuaccugauaucaggaugagauaaucucacugaacguauauacggcuagcaauagauguggcugugguucuuuggcugccaugguuugacuaugcugggugcuugccagacauaacugcuucagagaaagcuagaagaauauucuuggacccagaagcuagaccagcaggagguuguagaugguaauauaguacaggccuaaugugugacaagggcuugguguauuuuaugauauguucuguacacuaggucacccgagguaagacuguugcuuaauaagcucuucucccgaggcugucguguugucagugauagugucauucuuaaaugguuuguuuacucagaaggcccagucauuagaagccagaaugggcuucuuauuugcuuugccauuuuaucucacuuaauaaaacuauauucuauguucuauaacuguaguguucuauaacuguauucuauugacuauauuguauuauggaauaacaagguccaaauuuacccuucuaccuuaaaaaacaaaagacaaaauauaugaaaugaaggcuuucagacuugagacaacaggcagcauaggacagugaucucugagugaagggaaacaaaugagguauuccuggagaguuccagucugcagaacaagaagaaccuggacagcccagcagucuaccugaauugaggagauagaguucaaaauauggggaaccaaggcagagucccagaaaagagaaaaauacaacaaugugcagugaguucccuucaagucuucagcugacuacugaucaguacaugugugcgugcgugcguguaugugugugcgugcguguguguguguguguuaagagaggaaacuacagaggagggggaagaaauaggggcaacaaucccuagagcucccacaaggcuaggaaauuguucauguuuccaucagucaaagagaaaugaccucucaacacacaucaggcagggcugcaucaagcagcccccagaagguuauugcuuuaguugugaggaugaauuugccuuagauuaagucuguuauaaaucugccuuaacaaaacuuuaaaagcaagcuucaaauaauuuguuucaaguaaauuuacuaugucccaaaacaaaggcccaaaauauuuaaaugacuacgaagaacucuggcaccuaaaagcauaaauuuacuguguuuggcauccagucaaaaauuaccaggcaugcaaagaggcaggaaaauggagcccaucaugagaaggaaggaacacuagaucaguaggaacagauccaggcacggugucucacaccuguaauucuagcacuuggggaggcugaggugggaggauugcuugaggucaggaguuugagaccagccugggcaacauagcgagguccccaucucuacacaaagaacuuuaaaaauuagccagguguggugguguaugccuguaguccuagccacuugggaggcugagaugggaggaucacuugagcccaggaguugaagcuaugaucaugccacugcacuccagccugggcaacacagcaagauccuguccugugucuuaaaaaaaaaaaagauucagaaaugacauaaauaauagaauuaguagacaaugaggcaaugauguuaaagcagcucuuauaaauacauuccauauguccaaggagauagacaaaagcaugaguaugauaaggagagacaugaaagagaaaaaaaacagauugacauaaugucugaacugaaaaauacauuggauggaauuaauagcagauuaaaaacugcagaggacaagauuaguguacuugaaaacauaggaguagaaaacuauaugcuagugacucccagauuuacaacuucuacccagaacuccagauucauauauuuagcugcuuauuugacauccaacaucuugaacgacuuaaggcaacuccagauucauauauuuagcugcuuauuugacauacgacaucuuggaugacuuaaggcaucuuaaacuuaacaugucuaaaauugaacuaaaaauguacccuuuccuccauugcuuuccuaugucaauaaaugacaauccauccaucucauuccaucucauugcucaggccaaaagccuuggauuuauccuuaauuucucaguuagcauauccaguccuucagcagaucuucuugcucaugucuuuuuagucuguacucaccuagcaccuucucaaugagacuuuccccagguauucuaucuaaacuuucaucucuccaaacuuucauucuauccggacuuucucauguccuugcuuuauuuuuauuccuuagcacuugcuacuaguauguuuuacuuauguauuguauuuagugucuccauuacuagaauaugagcuucaugaaggugagauuauguuuguuuucuuauacaguaugucccuggagcauagaacaaugccuggugcauagaugcccagugaauacugaaugaaugaauaagugaaacacagucaauaccuuaaccaaaacauuuaaugugauucucacuuuucccuuacucauuuauuuaauaaauauuuauuuggcauaugggaaucucucaauugcuauuuuuugagcgaaugaagugcuuacuaugugccaggcucuuuuuaguuauuaaugauauaguaguagaaaaacauauauaaaguuccuucucucugucucuuuuucucccucccuguccauugagucuaguauuuuaaaaagucaauauuugaaaaaauaaauaauugcuuauauuuuaaaagugguacuaaguuuuaauacaagucaaauuauuauuaaaaacuagcaacugaaaauauauaacuuucaguacuuacaugguagauuuauuuuuuuuaaugacauguaagaaacaguuuauuuuuguuuuuuuuucuuuucuuuuuuuuuuuugagauggagucuugcucuguugccuaggcuggagugcaguggugcgaucuuggcucacugcaaccucugccucccagggucaagcgauucuucugccucagccuccugaguagcugggauuagaggcaugcaccaccacacccggcuaauuuuuguauuuuuaguagagacuggguuuugccauguuggcaggguuggucuucaacuccugaccucaggugauccaucugccucggccucccaaaaugcugggauuacaagcaugagccacugcaccuggccuauuaaugcaauuuagaugguucaagagaugcagggaaaggcauucccauguggaggaacagcaaaaaaaaaaaaaaggaacaaagggagaugaguauuggguauuuggggaacccaaccuaacuagaggcuuauauuagauauuccuguauuaauucaacagauaguagucgaacaauuaauauguggcaaguauugaguuagucgcuaucgagaagcuauaugcuguauuaggggaacauauaagcuauaguauaauguauugaucauuagaauccagggcaugccuaaauuauaucuauggaaaagcagaguaggcggcaucugaucugccuuuuuucugaagggaagcuacugagaggagaugauaccaaaagucccauuugaaauccacaugauaagcaaaaccauggaucaguuugcuuagggagaauuaugaagaaagagcuccauggccaggcuguaucuuggaaaaucaccacaggaaguaaaagccagucagggaacaaugaagagggcagaaagagaaggagaauauuguccuguaauggaaacaggaaggauauugaaagagucaggggugaucagaaccggagcaaguaaguaaagaauaagaagaagaagaaguaauuggauuuaauacggguagccccugaaaacuuucagaguugccaucuuaggagaaugguuaggaacagaaaccaaauugcagcaucagucuauaaaaagacaguuugggaggcugagacagguggaucaccugaggucaggaguuugagaccagccuggccaaaaccuaucucuacuaaaaauacaaaaauuagcugaaugugguggcacauacuuguaaucccagcuacucaggaggcugaggcaggagaaucacuugaacccaggaggcggagguugcaaugagccgacaucacaccacuguacucaagccugagugacagaaugagacgcugucuccaaaaaaaaaaaaaaaaaaaaguuuuuauguuuuguuuuguuuuguuuuguuuuguuuuguuuuguuuuuuugugacaaagucucacucuguuucccaggcuggagugcaguggugcagucucggcucacugcaacugcugccuccuggguucaaacaauucuccugccucagccucccgaguagcugggauuacaggugcccaccaccaugccuggcuaauuuguguauuuuuuuuauuuuuuuuuuuuuuuuuuuuuuuuuuuuuuuuuuuugagaccgaguuucacucuuguugcccaggcuggaguacaguggcgcaauuucggcucaccgcaaccuccgccuccuggguucaagugauucuccugcuucagccuuccugaguaucugagguuacaggcaugcgccaccacacccggcuaauuuuguauuuuuaauagagacgggguuucuccauguuggucaggcuggucucaaacucccgaccucugaugaucugcccaccucagccccccaaagugcugggauuacaggcaugagccaccaugccuggccaauuuuuuuauuuuaguagagacgggguuucaccaugcuggucaggcuggucucaaguuccugaucuuagguuauccacccgccuccaccucccaaagugcuggaauuacaggcgugagccaccacguccggccaaaagacgguuuuaaauagauaccacagccguaaaccaaagaauugucuuugauguguguguacaaagaacuuaacacuuugcucaucuuaucagguuaguaacuucuaguaauuugcugaaaacugucaaauuuaacuguauuuaauggcuauuaguuaacucuacagaucauuuuaauuuuuugucagaaacauaaaauauuauugcuagaauaauaaucggccccucagugacagugcuaggacaagaaccuuccuacuugccggucacuucuuaccauucaucacguugcuguacccaacugugucucugucuuuugucaaugcaggaaaccaaagauaaacucaaagaaacaacaacaaaauuaacacaagcaaaggaagaagcagaucagauacgaaaaaacugucaggauaugauaaaaacauaucagguaugcauaacuuuuaaaauagauuaguaucaaauuuuagcaaauaucaguucucucuuuuucuuuuuuuagauggagucucgcucugucgcccgggcuggaguucaauggcacagucucggcucacugcaaccucugccucccggguacaagcgauucuccugccccagccucccaaguagcugggauuacaagugccugccaccacaccuggcuaaauuuuguauuuuuaguagagaggggguuucacuauguuggcugggcuggucucgaacuccugacuucgggagccacccgccucagucucccaaagugcuaggauuacaggcaugaaccacugugccuagccaguucucuuguuucauuaaauuucuauaugugcaauauucuacaucugcauauggaauguacuuuguugggcaggcaguuaaaugaaaugcagguuauuuccaauguuaaaguaccugcaacuuaaauggauuuuauaagagaacuuuuccaacaaauaaaaacccuagaaaaugucagaagaaugaagagugcaaggaaauguauaacuuuagguuaauaaccuaauaacuuagguuaauaauuuuagguauacuauguauuucacaauuaauaaacuuaauugcaaugcuuucuuuucaaaguauaaaacuuuaacccauuuccuauuuagaaaaaaagugcagcuugcugccagcgcucauuuaauuuuacauaaacacacucgaggaugaaacaaaucugacugauuuucaguggaagauaaaauaaaaaaacuguucuuggaguuauuucuaaacagaacuugucucuuauccuaacguaacagaaauguauaugaugcuacauuaggauuagagacgaguauucucagggcaaacgggaaauggguuaaaaauugucacacuuuuuuuguuuucuuuccacuaggagucagaagaaauuaaaucaaaugagcuugaugcaaagcuuagagucacaaaaggagaacuugaaaaacaaaugcaagaaaaaucugaccagcuagaggugaguaguuuugcucuuuauauauccuaaguugcauaauaaauacagaaagagaaauagugagaacuuauugcuaucuacuuuuaaggccuuuuggaaggaacaggcaauaaaucuuagauauaguuuagcacauuaugauuuguuguuucuuuuaaacuuuuuuaaagaugcaucaugccaaaauaaaggaacuagaagaucugaagagaacauuuaaggaggguauggaugaguuaagaacacugagaacaaagguaauucagucuuuagucaugaauccagaggaaggguaaauaucuuaaauuuugaauucauucugauuuuuaaagugguggggaaaggacauuaauauagaaauguuccauaauaaaggaacucaguagaguagaggagcaauuuccuagcaacuucuuuuguugaaaggaaaaugucuuccauguuagucccuuugaaguguuugccaaacauuacuauuucacagcacauuugcugugucuauagcuuauccuugggcuucucaucuaaaggcagucucaucaacgaaucaauuggaaagauaguuggaccuuagaacugugucagaaaauaacaggaaggcuauauuuuuccuggauauauuuaauagauggauaguuuuaauggccaauaaucuguuaaguccucuucguguuuauagucuuuauuguaagauuaguaugucuucuaauaugaauaugaauguguaucauucauuuauuuagaaguaguccuuuaaccacccugaauuugaggucacuuaauaauuuuaaauuguuuuucauacaccuucuuauuuguucuucuugccaguuuuuugagguagaggagauauauucuuuuucaggugaggagauggugauucaguaaaaagugaaaugacaugcuaaaacucccaugacugaaucauaagaaaucugagacuaaaagcuaggauuguaaacuucgcauuauauuuucuucacguuaauggugcuuuagaauuuuuagauuauucauauguaaccacuauacaaaauaguuuauaaagaacaagaauacaugguuuguaacuugguugugaucauuugauaggugaaaugucuagaagaugaacgauuaagaacagaagaugaauuaucaaaauauaaggaaauuauuaaucgccaaaaagcugaaauucagaauuuauuggacaaggugaaaacugcagaucagcuacaggagcagcuucaaagguacaaaaugagcaacuucuguuuguauuaauaagcaagcuuuuaaauuuuauuucaagauuuucuaaaugcaguuauugcauuaaacaaaaaauuuuacaauuuuacuagcugaaauuuuuaaauauuuucucuuuaucugaacuucuuuggauuaucuuuugaguucugucauggcuucuaaaaaucaaaguuuauauuccuuaaacauugguaguggcaauuuauaagacagaauagguugagucucuuauccauuccuuagcuuucaaauucuguuacuuaugcacaguguuuacuuuuucuucuaaaagguaaaucuugcucuagaucuucgcacguguguagcuuaagauccggagcugacauuauuccuuggcuccuuauaaaaccauuuaaguaaacucuacuugugacauuaccagacagaaccuggauucaguuugaagccagauagcuucuuuuccacaccuugcugauaacuaagcugcugaguguugcuaaaaaaauccuuaccaucauuuagauugauucugcuaauaaauucauggucacuaaccugaacuggaaauauuaaugcaccuaaucuuaccaugugucuuuggucagagguucuccaccaucuucuagcaucuuuucuaaacccuaccauuuucuucacacuucaguuuuuccucuuaccuuucuauuuacucuuggcaaguguuuacuucuucacagaaaaaaugggagcugucaggugacaguugucucaacguuuugccaucagucccaugaacugccugcaucugcagccauauuuucugcuguuaucauggaagaaacaaucuuguuaucauggaagaaacuccucugaaucaaauuagucuuucuacuuccgcuauggauuucaucucuucugacuuuuuggguucugucuugauuauucuucuuuauccuuuaugucuuaccuuucuccacuuucuuuuucuuucuacauuuaaacauaauugucuuuuaaaaauaucaaaacuccuguggcuuugcccugccagcuuuucuccuuuccuuugcagccaaacuuuauauaaucuucuguauucauucuccguuuccucacuuccuauguucuguaccucuccacuucauucuagcuuuuaccccaacauuuuauuaaaaauuacugauguaucccugcauaugguagacacauuucagacccacccuugcuugaauucuuaucaucuuuuaacacugucgaauucaguugucuuucuugauaggcuuguuccuuuggcuucauuuccaucacaugcugauguuccucucaccuuuuuggcaacucucucucaaucuccuuggcaggcuucucuuucucucauaaugcccucuuguucuaauuuuauuguaacuuugggugaucccaacuauuuuuauaguaugcugcaggacuuuugagucauuaucuuuagcccuuuucacuaagcuccaggcacaaguauuaaagauaccucaaacuuuagcauuuccaaaaucgguuucucugucccaugcuucuccucacauguuccuaggaugaaugaugagugcagcauccaugugacuguccagcuuagcaggcugggggccauccucagcucuucuuuccuuccccucacacaucuaaccagucacaaaguauuagugaugcuaagucuguaacaucugucaaguccauucacuuuuuacuucccugcugcuacuaccauaguccaagcuauuagcagcucucaccuggaaaacugccacaguuuguauuuuuucugcuuauauccucucuaaucuguuuuccacacuaugguuaguauaauccuuuuuaaaaggaaauuucaaaacucuucauugauuucccacugccucagagauugucuagugaguuccauugccuuagcauggcuuguaagauuagugaccugucccuugcugcuuccaugccuucccuuuuuucacccuuguauuucagcuguaguugauuaacagauguuuauggauuguuuccuauuucccaaacccuguguuaagugcuagggauauaguacagucuuucucuucaucaauauugaacaucuguuaggaccaacaagaagccucuuauucccuucccaguuuuuagcacauacuguuuguucccuuuaccuggagcauauuuuguucuccaguaacuccugcuuugccuuuaggucagggaucaaccauggcuuacaaaacaaauccagcccacuaccucuuuuaguaagugaaguuuuuuuggaacacauccacacucauucauguaauaucuguggcaguuuucauaguacaauggcagaguggaacaauugcagcaaaaccauaugacccagaagccuaacuuauuuacuaucugaucuuuuacaggaaaagguugcugacuccugcuucaaguauuaguuugagcaucacuuacacuaguuuaggcaaacccacucugugcuuuuaucauaaaaaauguuuuuuuacacauauaauuuccacacuugacuaaaagcucuuugaaagcagaggccauguuggucuugcucacuuuucuuuccagcucuuauuuccuggcauauauuaggcauuuauaaauauuuggaugaaugaauagaaguaccuuuauuaagcauuugacuagaugaaaauucccaaaccauuaauuuaaugucuuuuaaugguuuauuuuuucuuaaauauaaauuuuguguuuuagagguaagcaagaaauugaaaauuugaaagaagaaguggaaagucuuaauucuuugauuaaugaccuacaaaaagacaucgaaggcaguaggaaaagagaaucugagcugcugcuguuuacagaaaggcucacuaguaagaaugcacagcuucagucugaauccaauucuuugcagucacaauuugauaaaguuuccuguagugaaagucaguuacaaagccagugugaacaaaugaaacagacaaauauuaauuugguaaguauaaauuuacauuuuuuuuaaaacaacguaacaagcacaaauuaaauuucccuaacaguauaaaaguaauaguaguugaauuaaguucuuuccuggacacugacuuucugacaauuucaacugcuguaagaaaugucaguuuuuccucaacuguuauaauuuauaauaaaauuucuuccuaaaaugauuaugaauaauauuuuacuuuugaaaaugagaaaacugguuuguguccuuccugacuagaaucacuguauauuuuuaaaagguacuuuaaauuucuauuuuuauaauuuaugagagugucuucaaguuacucauaaaaaugauuugagacuuuaguccaaaaauucaacaaccuguaucacauguugcuugguauguauagaaugacauucuccuuaauguaucccccugcuuuucuauaugagaacugugagaagcucaaguaaacaaaagcugauaaggaauaauaauagaagaaucuccacugucaagaaccuuagauuguuaagguuauauaaacugagcauuaauggaaacaaacauacuaaaauuggugguuuuuguuuuacuuacuauucaggaaaguagguuguugaaagaggaagaacugcgaaaagaggaaguccaaacucugcaagcugaacucgcuuguagacaaacagaaguuaaagcauugaguacccagguagaagaauuaaaagaugaguuaguaacucagagacguaaacaugccucuaguaucaaggaucucaccaaacaacuucagcaagguauaaaauucuuccacacuuagaccaugaauguguuuguuucuuuuaaucauuaggauuuuauuuuuugugauucugccacauugauugaagcuguauguuuucuuuguuaauauuaguaaaccaaauuguuaaacuucuuggaauuucaugaccgaucuuuuauccuaaaggauaucuuguaugcuaaaggacauuuacucacagaaucacaaaacaugagaauugggaaagcaauguuagggcauuaguaucuaaacuuuugaucacauacuccugucaauaaaaagugcuuaggcauuuguuauccaauuuagauauguuuauuuauacauuuuaaacauguguuagucuuuuauauauauuagaacauaugaaaaauagaaauuuaaaauaaucuauuuuuaaauaucaguauaaauagcaguucugauaucuucuuuuacauuccugugauuucuuuugugcugcaucuaggcuaccggcaucuagggugcagauacccgagaugcguccucugacuuggaaaucguugcgacuuaacucuucaccuggguuucaagaaacagaccccagaaaguuauaaauuacccagacauaacaauugacugcugaacuggauuccagauuucuuucuuuuaaaaagucauacagucauugggugucugugcuauaugcuugggauacaaaaauaaauaagacacguauuucaaccuccuauucucuacuauuucucacggcuuuauuuguguuaaaauagggugaaauauaguaauaagcuaaaagggacuuagcauuuacuuaauacaaauauauucagauauuugccauagaguuuaguuuguuuuuauagauguaauugaagggaaauuuggaagaaauuucugguacuguaaggaacuucuaaaucuuucaauacuuuaaaaaguuaacuccacuguaauuaagugaugccagugucaguuauaauguuguuucuguauauuuuguacuugacuuuuacauuuccaaaugacauuuuauaugaaugacauagcccucugccuaaaguauguauucaagaacuuucucuugucuaugccauuuuugccucagugauuuuagcaauuaaagucagagaugguaggagcaaaugguccugauaauugugacgaauaaucuucuuuuuccuauagcacgaagaaaauuagaucagguugagaguggaagcuaugacaaagaagucagcagcaugggaagucguucuaguucaucagguaaaaaacuaguggcucuaguuguuauuucaugauugauauaaaaauaaauagcauuuuuggccaggugugauggcucacaccuguaaucccagcacuuugggaggacgagaugaguggaucaccugaggucagaaguucaagaccagucuggccaacauggagaaaccccgucucuacuaaaaauacaaaaaucagcugagugugguagcucacgccugcaaucccagcuacucgggaggcugaggcacgagaaucacuuggagguggaaguugcagugagcugagaucgcaucacugcacuccagccugggcaacagagcaagacucugucucaaaaaauaaauaaauaaauagcauuuuuuauuuuaaaaaguauugauaugcuuuguuucauuuugaaguaugaaaaauugugguuauauauaauuauauuguaaaaaauguuucugguuaaauauuuaaguucuacucaugaccugggguuucagauuugucaugggguucuaugugaugaucugucucccuaccuucuuuuuuauucguuguguuuucuuuuucuuucuuuuuuuuuuugagacaggucuuaacucagucacccaggcuggagugcaguggugugacuuuggcucccugcagccucaaucacaaucuucccaccucagccucucaaguaaccggaacuauaggcacuugccaccacgccuagcuaauguuuauuuuuuguuuuuauguuuuuguuuuguuuuuuguauagacaagaucucacuauguugcccaggcugaucuugaacuccuggcuucaagugauccucccaccuuggccucccagaguucugggaugacaggcuugagccuccgcgcccagccccuucuuuuuucuagccugcugcugcuuuauucugugcaacagcuuccucuuccguuuuuuaaaauugaaauuuacguuaauucauacaaagagauuugguguacaguggucucucucuuuuucuuuuaacacccaagaacaaaugaagaugucaucauuguguaucagauuuuuacauauaugugcacauguauauauuuuuacaucuuuuaguuuuucucaugauauaccuauguccuaaaguaaaaauggguagagucuauaaaauuaugauugaacccauugugaaaaugauaauuagcaaaauaucaguguuugugucuuuuuuuggaaugccaagaaccaugcuaagcacuugaaacauaccauuuacccugcaaaaaauucaugugagguagguauuauaauucccauuuuacagauaaggaaaccaagauucagagaggcugcaugauucacccaaaauccacagugagaacucuuugacuccacaguccuugcuuggcaguacacuauauugccucccagagguugcacauuaggagaaaaccaucaucaguuguuacaauagugggaaaaaauguguaguagaaagaacauggauuugaaauuauagacauguauuuagaucccagcucugccauuuauucauuauauaacuuuggauaagauauauuacuuaaagcuauaaaaucggauuggaaaaaacuaaucuuuguaggguaaagaggaucagauucuucucauugauguugguaaaaguaauaccuaacacuacauaaugcuuacuauaugccuuuuucuaagcauuucacauguauucauuuaaaugaggauaacaauccugugagguaaauaauaucauuuaugccauuuuaagaugacauaaccaaggcacagaaaauuaaauaccuuguccaaagucacacaguuaguaaguagaggaguaguauuugaaccuagacaggcuguccucagagcuuaacccacuauauucuaaccucucuuuuucugucuccucucauaccucuguuccucuccucccuuccuccuccucucugcuuuguucuguuauaguuuaauuuuggucucacuuuagacuuguuauucuuuuugagauccuuguugcucuauuaccacuuccugagagauacaguauagacccuguugguacuucugucaccaguauauucagaaaccagaaccucagccacguugaccuguguugucuucuguguccaacucuguuagagugaauauuugaaaugaugcuggaauaaguaauauaugagaugagaggugauguuagauuaagcacaguaucuaaaccaauuuuuuuugucuucagggucccugaaugcucgaagcagugcagaagaucgaucuccagaaaauacuggguccucaguagcuguggauaacuuuccacaaguagauaaggccauguugauugagagaauaguuaggcugcaaaaagcacaugcccggaaaaaugaaaagauagaauuuauggaggaccacaucaaacaacugguggaagaaauuaggaaaaaaacaaaguauguauuauuacgguagcaugaucggucuucaaaauaccguuacucauauagcaaaguuacuguuuuuaaaauuagucauaucaagaaccuaucuuucaaaaaauaauuauaguuauucaguucccagucuuuuauggucaccuauuauguucuagguuuugugaauacuaagaugaaauaaaacacgucuuuccuuuaaggugauagagaguucagucaguguuaauauuuuuaagauacuuaaacaacuuuagauuuuaaaaagauaaugcuuuacuuagcuuuuuauuuucaugacuguggcucuaagagguauauaugggguuguggauuuuuuuuccuguuggguaggauguagugggauaauuuauugaguaccuaguaguacaaggcgcugugccuguggcuuggcgguaucucauugauugcuuacaaccacucagugcgugaguucucuaauuuugcagauaaguggggcucaggucacaucacuaaauguuccagggucaccguucauccccugugugacagaccuagagcuggagauccaaacccagcucugaguaacucaggagugcugcgccaaauuccucucacaaauucuguuuuauguaaauaaaaguuuuuuuauauugugggccuuuuccaaugacuuuuuaauuuuuauuuugaaauaauuuuagacuuauaggaaaguuugccugugacuuuuaaaagaaagagcauaaaguacagcaaguuguaagucuaauaagaggaaaacagaaaauauuaacagaaauugagcaauaaagaaauugcucagcuagguauggugucucacaccuguaaucccagcacuuugggaggccggaggccgaggcaggaggauugcuugaggcuaggaggucaaccagccugagcaacauagcaagaccccaucucaaaaaaaaaauuauucaggcauggugguacaugucugugguccuagcugcucagaaggcugaggcaggaggaucgcuugagccgaugcaguggaggcugcagcgagcuauguuugugucacugcacuccagccugggugacaaaaugagaccuuaucucuuuaaaaacaaacaaaaaagcucaacuuuugauuaauaaggaaagaaauagaaaagcaauguuuauaugucuuuacuccgaaugcuacaauagaacaaaaaugagauaguuuaagaaaccaucugaauaaggagaauucuuuucuaauauaguuagguuauuaaccuaauauuuauuuuaugcuuaucuuuaugauuaguugacuuuugcagauuccauuuuuuuuaauucuacaaguacacaacugauacuaucauuuuguuuugcagaauaauucaaaguuauauuuuacgagaagaaucaggcacacuuucuucagaggcaucugauuuuaacaaaguucauuuaaguagacgggguggcaucauggcaucuuuauauacaucccauccagcugacaauggauuaacauuggagcucucuuuggaaaucaaccgaaaauuacaggcuguuuuggaggauacguuacuaaaaaauauuacuuugaagguauuuguguuucucauucacacaccaaccaguaaacauggcaaaaugaugccuguuucacagucugaucuagcaaucagcugggcuguuucuguaaugcaaggcagucauuuuacccaaagaugaaguuucgugauuuucucuuuuuaaaaaguauaguuuuuuauauuaggaaagaugaaaaauagcaaaaauuaauuuuguauuugacagacacuaagaugucauuaaauuugcauuggaugggcuuugacauauaauuaguuuugauugcuaaaauaauuuuuuaagauuaugacauuucugauuuauuuuucagcuuuauuuuauuuuuugcaguuaauauuuuauuuuugcugugggugggccuugaaaauuaguaguuaguuuaaaaauaauuuuaaaaucaguaauaguaaguaaucauuuuaugcauuaaaaauugcuguagcuucaguagaaaguuugaguguuacuuugaaauggacaggaguacuuuacugaaaacagcugugugucacuaguuuaucugacauagcauuuaggacuaaccacucuuucauuuccaaaauuuaggcaaaaaauaguucaaacugaauuguuuuauuuauuauacuuuuguuuuucucuucccuuuccccucaccccaauuauuaaaggaaaaucuacaaacacuuggaacagaaauagaacgucuuauuaaacaccagcaugaacuagaacagaggacaaagaaaaccuaaaacaagccucuugcucaguaaagagacaaaagccacacaggaguaggugccacugaccucuauuguuggagacuuuguuccacuuuuuguuucagccaguaaaaauauuguuuugcuucaucuguacacaaaaaaauacccuuuuacaauaugaaugcauugcuguauauacuguaagacugaaagcuuugaugaaauuuguuuuuguauggugcaauaugacagccugucauugaaucuaaacaacuuaauuugcuuguauucauaagaaguguugaacauuacaagggcuuuuauaaaaaacccuuuguucauauuucuucccuuuaaaauauguaaugucaaaaaugacucaccuuuuaaaaauuaugcaugaaaacaggugguaaacauucaguaauacgcuauuucuccaacaucaagacaacuaaaacaaaugauaaaaauguuuauuuuuacacuccagcauaucgggugaguuuuagggauguguaugaauauuuaaaucuuuuaauuucaguuuuaaugaaagcugaacuuaauaggaaagcuagcucuugguaacuagcaaugaucaggcauuguuugccucugucagguuuucuuaucuguuuuagguacauuuuuucagauucugauuguuugaguuaaugguugaauuuuuaaaguuuuuaguuacuuaaaauaugauuuuaaauuacauauuaauuuagaaaauuccuguguuuacuuauauuuuaaauugugaaauggauccaaucauuagaacagagagaauaguucuuugaaacugaaauacuuuaguuuuacugaccuuguguaaagauaauaugaagaaccagcuuccaaaagaaaccagcauauggcacuauaaacuauuucauuugagcaccauucuuuaccauggauauauuaauuauguauuauaguggagugaucauacaguucccccaaaugugauguuucaguguauuuauuuaaaacauaaaguagaccaggugcaguagcucacgccuguaaucccagcacuuugggaagccaaggcaggaggauuaccugaggccaggaguuuaagaccagccuuggcaacauagcgagacccccaucucuacaaagaaauuuuaaaagauuauccaggcaugguggugcaugccuaugguuccagcuacucgggaggcugaagcgguagaaucacuugagcacaggaggucaaggcugcaggugagccaugaucgugucacugcacuccagccuaggcaacagagcaagacccugucucuuaaaacaaaaaaccucacacauaccuaaaauaaguauauaucuguaaccaaaggaacuuaauuuuagagccaaauuuuucuaucuuguuggauuuuuuacaguguuuaagauagacacuuaaguguugccguaguaucaauauuucugucauugaauuuuuucucaccccuuauuauuucucacuuacaauuucugagcaugauuuuucauaauucauuaucuucagaucauuacuauaauaagauaccguggcucuuaugcagauauugcagcaagccuuguuugguuuggauuuuugcaucccuuuuucucccauuaagggaauuaaguuuugggaugauggauuaaaagccuguaaagaauuguuugggcucuaaaaguugggcucaugguggcaauauccuuuuaauguguuuuaacauuuuuuaaucaacaucguuuaaaaauaauuuacuaaggauuagauuauuuaaugaaugucuuuuuuucuauauauugaauuagauguuaucccaaaaaaaauaucuuuucacuucaaaaugaaaauauauguucaaagauguuuuauuuuuagaauaguuauaaaaaguauuagucuuaacauaaugugucuuguucuuuuuaccaauaauaauuuaucaaaauaagagggaaagugcaaucaaaucugaauuauuuuacuauuuguuucuagacacacuacuuaacacuccuaaagacuacuuugaguaggcaacauaacuaaauuuuucuaguuucuuaugauacagguucauaaacuacaauauuuggauuuuuuuccccaaggcacaaaauguauaauggagaccaaauagugaucugauccauaguauccuaugccuauacacuuuaaaauguauauacauuuuagacaaaaaugcacacuccaguauuaauauuugugcuaccaucuacuuggagaaguuuaaugagaaaauuuuagaagaaaaguauuacaaacaauauuuugacucuauuaccuguuuugccuuauacauuuuagaaacuggaaauuuuuuaaagaaaaugcuuuaguuuucuucuguucuucacugucuacagugugcuuuuguauauggaucaggacugagcaaaguaauuacauguaucagagauacuuaucucuauacuaauucacagacagcuccugauguaaggauuuagagggccuucugcccucugaauauauggugaggagaaugggguaucuggaaaaggaaaaugaucuggauaaaucugagaccuggggggaaguuuguuuuauauguucauuauugguuguuacauaucaaggcuguuuugguuauguaucaauauugugguuuauuugagcuggaagugauuuuuucuguguauguauauguauacacuucaauagguuuuaauuuugaagugaauauuugccaugacuccauuuuccccauaccacuucagacuuuagccuguuuaguuuuaaggacugaaaaugguagguuugggcagaagaaugaauuugaacuuugaugggguuuuuuuguuuuuacuuucuaucuucauaaccauuuaaagcgauuuagcuugaaauuaaauuuuaucaggcuaccaacauguuauuuauuuauuuaauaaacacauuuauugaaaaccuauacuauuguauuggcaccauacaggguauuguauuuauacuagugagcagaccagggcauuuccauccucauggaguucauggucuaaugaaaauagcuggggccgggugugguggcucaccccuguaaucccagcacuuugggaggcugaggugggaggauuguuugagcccaggaguuugagaccagccagggcaacauggcaaaaccccauguguacaaaagauuaaaaaauuagccagaugcaguggcacauggcuggggucccagcuacccaggaggcugaguugggaggaucaucugagccugggagguugaagcuugcagugagcuaugauugccacuguacucuauacuccagccugggugacagagugaaacccugucucaaaaaaaaaagaggaaagaaaauagcuaggagacaaucagagcagaucuugggcuucuguggcucaucucagcccuuuauaacuggccugagaagaggguuuaucuacuugugcaaguggcccagaaaucucacucguacaugaggcuuuggaacauccuugcaaagguacgcugaaagcaaauugcuguuuuccuggugguucugcacguuuccuaacuuuuaucauaguuugauuuucauuauuuaagaaaaaauaaaaaauccaaagaccauaagauggcauuagauuuuuuaccauuaaauuauuaaugccuauuuggugcucauaaagauuaaucaugucacgcauguuuccaaucuuucuuuugcaguauauuauuuucuaaaaauuguuacaugcaaauuuaaaccaagauuuaucaguaaaagaaaaaaauagaauccuuaauaauguaaauguuguuauauaugcuacccuggugaaaauauuuuuauaaaucauguugucauuuaugcuuuauguagccuauuuuucaauaaccuuuuuuuaaaagcaauuuuuuuugacaccaagauuguugauuuuuaauuaacaccaguugguggcacuagaaaccugaaauuuuucaaagaugaacaaagaaaaauugaaaagguaaucuaaacauggagaauuuuuaggaaaauaaaugaaaaauauaauuguauauuagagauguauuuuucuucuggaauggaauucuuuuucuaaaaugcaaaucgcuauccauuuugacugcaaugaugaaacuuguuuaucuuccagaggacauauauauauguguguguguguguauuguacagauaccuuuaauuugauuacacuguuucuuguaaauauguuucuguauaaaaugaaacuuuucaagaggauucuauguauauauuguacuuauuaaauagguaaugccuauuuaccaa

SEQ ID NO: 18884 - RNA, 1416 nt, Homo sapiens
uuuuuucaauguucaguuuccuuuaaugacccccaucucccugaagggcaggugcaggcagcuaggugauggcaagagauguucacuugaagaucuugccgugauugaaggcuuugcccacaugcuggaaggcccccucccaggaaaaguacucucgaaccagcgucugggucuccucucugccaggauccaguuuccgccauguguaugacucguaguccaccugccaaucuggacucagcggaaaggcaagcuccuggccucggaagacccagacuccagaaauggagcugcuauuguugguuccaaaaaggaugacacuggcgaaggcauucuuccucagcuuguccagucgcuggaacauuccagugaugagauugcagcucaugaaggucugagugaguucuucagggaagcgauacucugaguaccacagggaccagccguccuuaucaaagugcucccagaaauauggcagugccacagagaguguguccucauuggaguacuugcgcuuaaauucauccaacacaaagguacucuugggcaggugagcgaagggguccuuggccuugggcucagcagccagcgccugcucacauucauccaucuccuccucaggagcaggggcagccgccuuuuucuccuccuuccgcucagccuggggcuucugcuucucuucccgugaacccuucucuuuccgugguguguccuuuuuaggcugggucucugcaaacuuuuuagcaucaaacugggccaucuucucacacaguuucaguucccccaagacagcccggaacuggggcugguuaaugcaggugaggaaccagcgguugguauugcgaaaggcccggcggaaagaaggcucuagaaccugcuuauagagccacaacagggugcagacaacugugaugucagccaaugucacucguucgcccaccagaaaaguccucgucuucaaguaagcauccagcagccccagaauucgccucacuuccuccuuugcauucucaguggccuguuuguuguggugcaugaugcccaagguggggaacacccagguacuggcugggggcacuauaucggaaucagcaaagcucacccacugcaccaccugggcugcugccucuggaguacuuccccgcagcuccucauugcucacauaguaggcaauggcguugcucucaaacacacagaauccaucaucacccucaaaugcugggaccuugccggcaggaaauuugcgaagaaauucagaggugcgguugguuuggccaaaauggaagugggguggugcggagagcacgcggaucugagccccgcuguacugagcagcgaugagagccuugaaggcccuccaguuuucaggauacguguacagggucccagccgccauggugauuccgcaaagaaagg

SEQ ID NO: 18885 - RNA, 99764 nt, Homo sapiens
acaacugaagcaguuucuguguuagggcagagaguagugaucaagacauuaggguuuaguguuagauaaaccaggcuccacucugcggccccacgcaaccuccccacgcucucugcaccaguguuggcaucugucaagugggugggggcuaacagugaauaacugccucauagauggacuaccggcuuaaccagagacugacagcgggucgcauauuaaucuuccaaucacuuggcaaacucguuucacuaugcaucucuccuccuggcuguucuuucaacuuccuccucccugaaauuucgaagauccaccucggugggaaagucauuccgcguggcgcgcccuuucccugcgucccuccuucccagggcccacccuccgcggacgcagagcgucugccggggggacggcagguccgcgauggcugccucugaggcagucgguccccucucgccgugggcuugggaagcguccgaaaggcccgcucggaucgucugcggugcugcccgcagggaaagcgccgcugccagccgggcugucacgggugcgaguggaagaagcacaccgcaggaugagcgacgccgcugcagagguaaccgcggggacugcggccagagacgggggaugggcgcagccgaggauaacgggauggccggcauccggaacgcgucaggcccgcuccgccggaccgccuuauccuccagcccgcguccccagccguccucccagaucccgaccgcagcuccagaagugacggccacguggguggcggcgcgcgccgcggggauuggaauguuggcguggggggacgagguuggaagggccgcagagaaguaaaggaggacccgcguccgcgugcccgggcgccgacugcugggcgacgccgccgggagcgagcacgccucugacgucacgcgcugcucguccaaugaguggaggccugagggaggcgccggucccggccccgcugccgccgccgccacaccggcccuucgggagcgucugaggaggcgcgggccgcugcgggcucgggcgccgcagcgcgccggcccgagccccuggacgaggcccacggagccgcucgccccgacccagccgcccgauguccucaaaauggaggcagcgggggcggcggcgugaagaaagcggcgcugugggcgcgggaguaggggcccgggcggaggcgguggcgggauggggcugcugcucaugauccuggcgucggccgugcuggguuccuuccucacgcuccucgcccaguucuuccugcuguaccgcagacagcccgagccgccggcggacgaggccgcccgcgcgggcgagggcuuccgcuacaucaagccagugccgggccugcuccuaagggaguaccuuuauggcggcggccgggaugaggagcccuccggagcggccccugagggcggcgcgacccccaccgcggcccccgagacccccgccccgccgacgcgggagacuugcuacuuccucaacgccaccauccuauuccuguuccgggaguugcgggacaccgcgcugacccgccgcugggucaccaagaagaucaagguggaguucgaggagcugcugcagaccaagacggccgggcgccugcuggaggggcugagccugcgggacguguuccugggcgagacggugcccuucaucaagaccauccggcucgugcggccagucgugcccucggccaccggggagcccgauggcccugaaggggaggcgcugcccgccgccugccccgaggagcuggccuucgaggcggagguggaguacaacgggggcuuccaccuggccaucgacguggaccuggucuucggcaaguccgccuacuuguuugucaagcugucccgcguggugggaaggcugcgcuuggucuuuacgcgcgugcccuucacccacugguucuucuccuucguggaagacccgcugaucgacuucgaggugcgcucccaguuugaagggcggcccaugccccagcucaccuccaucaucgucaaccagcucaagaagaucaucaagcgcaagcacacccuaccgaauuacaagaucaggugagcuggaggucggggagggggccuggcugccgggaacccgggccugggcgggacgcugcguggauugggaagggcaaaggcucauuucuguccuggcgccugcuucuggggccuucccacccuggacagggccccagaucaaggcgagucgugaacacuugcuuugcuuccgaacggcauugauaggagcuagaaaccuuuucgcguguucauggggacucagggugcugucaacgcgggcagaaucgucuccuuuuauaagcagcauauuggaaauggaagggaagccuacccuaauccccaggagucgcuucugggacuguugagaaacucucccucuaugugguugcugcauugagggcagccgcgucacuggcuuugcagcauccccuuggccgcuuugagaaauuguuccuggacacaguacacgcgugaagagugugcuuauagcccaggucugugcuaauuugacauugcaagccacuuuugcuuugaugguuugacaccuuucaaggcagaggugguaacucuugcaaaggaauacuuuuguggguuuuuuuuguuuuuguuuuugagacagagucuugcugugucgcccaggcuggaguacaguggcgcgaucucggcuuacugcaaccucugccucccagguucgagcgauucuccugccucagccucccagguagcugggguuacaggcguauggcaccacgccuugcugauuuuuuuuuuuuuuuuuuuuuuuuuuguauuuuuuaguagagacggaguuucaccguauuggccaggcugguuucgaacuccugaccucaaguaauccgccugccucggccucccaaaguguuaggauuacaggagugaaccaccgcgcccggcccgggaauacuuuccacagcagaugggaaaggaguugggagccuguacauaguguacuuuacauuuuguauuaaugucauuugcccauuuuggguagauuguagaacacagauccagacucugcccaucaagcauuuacucucugugacuguaaguucuucucucaagggaccugaagucacuguacaaauuguauuuuaaugcuagguagugauuuuaauuuuguuuaagccuuccagcaucugauggcuuaaauuuugugguauacaguuuugaguaguauauaaauuuuguuuuaauauuguaggaguggaaggggaaagacuuuuuuagggcuagagguggaguggaaggugcuuuuucuuuuguaaaaagcugaauuuuuaacuucucuuucgguccuccuuuaauuuuguauucacuaagacauuugagccuuuaaaauuuugcccuuuauuauaaaauuaugucagucuuguauuuuacuuaccuaauuuuacuugccuuuuaguggaaguugccuauuucuggaucacuaauuuucuaccagugucaauuuucaggagcaagauaauccagaaauauuuuggguuuggaauggauuauugacuucuguauguggcagauguaccuuaccaauuauguuuuguuuaggcuaacagcgcagagugacaguuuaaaacuugcguggcaggagaaauuuacuuuguaauggaaauauuuccauagauuugcggaggguggugaacugguuguucacuguguucgauuucugguucugugaaguagaacauacuuuaugaaaccuacuuuuaaccucuggaauaucagugauuaaauuauaacucgguucuaguguuuaagcagugagagauguuuauuuauagcaguguguugccaaaaaagucaugagaaaaaguugcuagaaauuuugguauucuaucacaacuucaauuaugauguuuucugauagcuuucaguuaauacaauuugacuagauuauuauuuugaaauuuguagacuagccaaugacagugagauuacauaucauuuugagauuuuuuuuuuaauguagacuuggaauuuagguaaaucugaaguaaguuaugaauaaguuauggaggcauugagaaguuuauuacuuugaaaaacuauuaucuguaucauugaauaacaaccauuuaaaaguauggcaaaauugcuuuucacuuugaagggauuuuuuuaaaaacagcaugaauuugguuaugauauuucaacuucuaaaugugaagcauuaaaugaucauuuccagaaguaugcacaucugugcuauuuauacuggauggcaucucaaugcucagucagcugcacagagcauaucacucaaucuguaaauguuuauuguacaccugcuauaugcuuauccuuguuguagaugcugggauuucaguacugaacaauacuugaacucagcccucaggaagcuuagagucuagugagaauugaauuagcuauacuuaguaauuuuuuuguguuuuucguuuguuuguugagacaggauuuuguucgguugcccagagcuggaguacagugucaggaucauggcucacggcagcuucgaccuccugggcucaagcaauccucccaucucaaccuuccaaguaguuaggaccacaggugugugccaccacuccuggcuaauuaaaaaaaaauuuuuuuuguagagauaggucuugcuuuguugcccaggcuagucuggaacuccuggguucauucaagugauccucccaccucagccucccaaagugcugggauuacaggugugagccaccuugcccggcgcuuuguaagauuuaaacuagaaugggauugaugggguugaaguagccaggaagccgguuuuagcuuaguagaagaaaauagcaaguaugacgaugaaaagggcugccucagcaagugaugacuucuugucuguguagcuguucuguccaguguuuuaaacuggugaugggccaggugcagugguucacgccugugaucccagcacuuuguaaggcugagacaggcggauuacuuaaggucaggagugugagaccagccuggccaaccugaugaaaccccgucucuaguaaaaaugcaaaaauuagcugggcgugguggcgggcgccuguaaucccagcuacucuggaggcugaggcaggaaaauggcuuguaccugggaggcagagguugcagccagccgauaucgcaccacugcacuccagccugggcgacagggugagacuccgucuccaaaauaaauaaguaaauaaauaaauaaacaaacuggugaugaugugggacugauucaaguuucagauaagaaugaauuacaauacaucuaagauauagcauacuucucacagggaaaauuaaacuagcuaguguucaucuuuuuuuacagaugaggaaauggagcucggaguaguuaaauaacuugcuuaaagucacacagcuuucaaguguugaaacgcagcucugauaaggccaggccaccuuuaaacacacacacacacacacacacacacacacacacaaacuauguuguucuuaagugauuuauuuuuuaaaagcaugccaucgauauaguaaauaugugggauaucuuuccaaacuaaccuagaacucuugagaagaguaugacuauaaagcugauuuuuuuuucuuaaauuggucauuuuagaggauccuuuuaaaaguaaaucaugaggcuaaaucuuuggguacugucccacguggcauuucuuuuuuaauugagcagaauuguguuuccaaauagaagagacagguuucaccauguuggccaggcugguuucgaacuccugacuucaggcagucuacccaccucggccucccaaagugcugggguuacaugugugagccgcugugcccggccuaguuuauucuuuuuuagcuaucuaaucuucuuaguagagcuaaagcaguaaagagaauuguauggagucuuacgauccuuuggcauuuguaaucauuacauaacaaauaucuugccaguuaacguuguuauuacuucuuucccccuucauuuauuuugccuuuuucguguugcuaaagugaaucagccucucuggacugccaguuccugauguuucaccuagagaugcuaaguugcucaagugguugcuuucuaaggacccagcugacugacauuucauuuuacccaaguuaacaaacuuacaauguuuguaaaacauuuuauuuuacaaaaugaauuauaauauguagacaauauguuuacagauuuauucaaguuaggaauuucauucauccaccucaauguuaauugguuugauuuuuuaauuaaaauaguauauuauaauagcaauauauuuuuuuaaaugaaccucagaauccauccucaagggagaaagauuaccacuaauguucuuuuacuacguggauaauucaucuuaaacauggagucugaguaauagugucuggguggggagcucuguuuaggguuuaggagucaaauauuugagauucuuacggaugcuuguguuccuggaguauuauuguauauagacaagcagauucaguuugcagguacuuuuaauuuggccugcacuguuuaaaaaauggaaaauucuguguguuuuggauuuguggcuucuguuaggaaaaauuggaauaucuuguagcgccagugcugcauuucucagagcaacaacaggauggagagauggacuguaguagcagcuuugggguugaaacucgguguguaagcuccuagguggaguuuauaguccccccuuauuugcugugcuuaauugaugguacuugccuggcuuggaguuauaugaauuugagacccguacuggaggaguaaauagggagcauuacuguugcugauuagugaaaaugagaagacuuaauagcuggaguggagagggagagugaucauuuuuauccuucuuuuaauuacauuuuugaagggacugucauagagcaauuuuauuuuuuaaaagacauuguuggccaggugcgguggcucacuccuguaaucccagcacuuugggagggcaaggcaggcggaucacuugaggucaggaguucgagaccagccuggucaacauggcgaaaccccaucuuuacuaaaaauacaaaaauuagcugggcaugguggcacaugccuguaauuccaguuacucaggaggcugaggcaggagaaucgcuugaacccgagaggcagagauugcugcaagccgagaucauaccacugcacuccagccugggcaacagagcaagacucuaucucaaaaaguaaaaauaaauaaauaaauaaauaaaagacauugucaggccuggcgugguggcugaugccuguaaucucagcacuuugggaggccaagguggguggaucacuugaggucaggaguucgagaccagccuggccaacauggugaaaccccgcuucuacuaaaaauggcacgcaccugcagucccagcugcuggggaugcugaggcaugagaauugcuugaacccaggaggcggagguugcagugagccaagauugcgccacuguauuccagucugggcaacagagugagacugucucaaaaaaaaaaaaaaaaaaaaaaaacauugucaauauaauguugaauuuuaaaaagucacucugccagaaaaaaaaaaaugccuugaaaugcaauccauuuuucuaccauguagugaugguaaguagauagugucuccuuuuuguucgaguuugguggauaguuugcuuuaguggaaugggucauuaauaacuauguaagcauuuacuucacugaucuccaaaaaggggggcaucaacuuauugacaguauauuugaauuuaaugaauugagugauccguaucucaaaaucuuucaaaguaaauucacagaaaacugacaaaaucauuuguaaagucaaguguaauauguuguauuuauuuacuuuuucauacuuuuuuccuuucuauuacauuggaaaauauuuuaaaauagcuacuaaaauuccuugaugguuauaauagugacaguuuuacuuacuaauguugauaggaaaucuaaccuuuaauauuuggggagaauagacaauggcauugugcauuacucuagcuaugcuggaauaaucuuguaauagcuaauuuuuaaccuguugugcuuuuucuuguacuguugcucauaucucuauaucucgucauaucucuguauaaguugaauugcaagaucauugucuuagagaugaauaauuaugucauuuaaaaaauagucauuuaucuucaguaagugcuuagugcauacuaccuaguguugcgguggguauaguaaacgugauaaaaaugguuauaaacuaguucaugcuauuauaggguuagucuuucuagggaaaacaaagaacacauaaagcuuauuuuaguggcauuggaaauauuuaagcccuucaguuuugugagaaacuggaacaggagagaucaauaucucugcucugcuaaggcaaacaccugauuacugugguaccguauguaaugcauugugaccuuagcuuuuuuuuuuuuccucucucguugcccaggcuggagugcaggugcaugaucucggcucacugcaaccuccgccucccagguucaagcaguucuccugccucagccucccacaggcgugugccacaaugcccagcuaauuuuuuuauuuuuaguagagaugggguuuugccauguugggcaggcuggucuugaacuucugacuucaggugcucugucugccucggccucccaaagugcugggauuacaggcaugagccaccacauuagcuuucuuagcacaccuaaguguacuccaccuaaauacccaguuuagugcugauuuuacuucuugcacauuggauuuccuccagcugcuuugaauuauuuuaauuucagcuuuuaaaacacuuuagauggagaauaauguauugauacauuacaucuuugcucuagaaauuugauuuauucauugaggggagaauagucauuuugaggaggcuauaauuuuuguuuguuuguuuguuuguuuguuuugagacggagucucacucuugcccaggcuggagugcgguggcgcuauauuggcucacugcaaccuccaccucccggguucaagcaguucuccugccucagccucccaaguagcuaagauuguaggcguaugccaccacacccggcuaauuuucacauauuuaguacagacaggguuucaccauguuggccaggcuggucuccaacuccuggauucuagugauccccccgccucagccucccaaaaugcugggauuacaggugugauucacacccugccgggaggcuauaaauucaaaucaguaauguacaaguauauuggcuaucccaaaaagccacaguuucuuccuggaaauagccaaagcagaucauuauaaaguagauuguguugaaggagcaugccugaucaaauacuaaacguugacuuacaaguauuacuaacaaucuaucauaugagcaggguggggcuaauaaaacacuguuugcuaaguauucauuaggcacugugugggcauuuccaugcaguugcaaucucaauaguuaaaacuccuaugugggagagguugguaucucaguuuuacagauguggaaauaugcgauuuacggaggauuagugauauaaaguccuaaauguaaaagguccuggacuuccagagcucaugcucuauuauuucuucagagauaaaccaacuguuacucuaaaucaggggucugcaaacuagcugcuguuaggccccugcauuaagaaugguuuuuacauucuuaaacuuuauauuugacguuguuaaaagaaguacugguggugguggugguggugguaaugguggugacaguggugguggugguagugguggugguagugacagaccuuauguacccacaaauacuaucuggccuuuuacagaaaagauucacugaucccugcucuaaacuuuaaaaaaaaacccuaaaaauacaccccccucaacaguuacaauguuuaccaaaaaagaagcuauauauguguacauugaaaguacuuuuaagucuuugaggguccuguccuuuggaaaccugcagaaaauuucugcagaaaacaaauuuucugcauaaaaauauuucauuuaaguucauaguucccuugaagcuuuuuuaggguccuuagacuuuagguugaaaaauaaacacaaacagaaguauacaacuuuguuaccguaaacauaacuaaaacuaacaugcugaaaucaauauuaaccacuucauuauuuugcuuaccuucuuaaaauguauauaggauucauauggcucaggcguuucuaaaaaugcuggaggaggggguaaucccucucucuauccuaugaaguguaugucuuuuugauucuuuuuuuuuuccucuuaagauuucauauagcaggcugagggacucuagaucaauaguucaguaagaauauaugaaauuucaaguuagaguucuuauuacuaaauaccuuguuuaaaaguuaaauacugacucaacauuucuucccaugauauucucuguuuucucagaacagugucaccaggaaacaaguauuauuaaaugacuuuguucuuaccucagagucauaggacguacugacacuuuuuuggcauggcaucagagcacaucacacuuaauuggaaaguuuuaaagccaacuaccuggucauuagcagguguuuuacagaguaguuucaaaaucucucuugccaaauugcuaagacuggcauaaaacuguacacuuccuguauuuguacuagggaaaaaugugauaugcacguuaauuauuuaccuuuagaugagcaguacuaauuuuacuagauauauaucagauauuuucuaggugacacauuauauucuuuucccuuucaaaugagcgacaaacucacuuuaaaaauucaagcuguuagaaaauauguaguaucaaagugaaaaucuucuguaauaucuuuucuuaaaacuauuguuaaauucgggaacuauucuuccauauuuuucuaaauguauuauaauuugcuauuaauuuauaaaggcaggaucauacucaauacuucauuguuagcaucuuuuuuuaaaaaacuuacuguaucuugaguuuucuauauauaccuacuucauuuguucuaacagaugcuuauaauuacauugaccauuaguaccauaaguuaaccaauuccuuguuaauuuuucaguuucucacuaauguaaauaauggcaccauaaacauccuucuaccuguaucucuguguagaugguagauuuuguugguuauuuuuggccauuuuuuuuuuggcauauauuuguauaguauugaggagcauaaagaaguuaaaaaucuccucuccauuuugauuucauccccugauauacccauguuaaguuugaggucuaaaccuaacuguaugcucaagcauacauauacaagccucuuauauauauugaggaggugccucucucucuuccucuucuuaccuucuucccucucccucccuccugcccccacuuucacucccuccuuccuucugcccuuaguaaaaugagacuauaauaugaaugugacccuccaaauuauucugugaaguguaacauggaugucccuucagauaauauguauaaauccaucucauuuacugcuuuucucuacucucagccauucucucugccucugaccuuaucuuucgucaccacuucucacuuaaucuguucaugccucuuugcuguucucagguaugcucccaccacagggccuuugcuauuccuucuucuggaguguuuuucccacagauagccaaagagcucacuccaacauuuuuuaggucccucuuaaauaucaccuuucaacauauuauguuaaaaaaaauagugguuuagcccuuuaaaugcuggaauuuuuuuuugcucagacuuccuacggaaauaugcgugugugugugugcgugugugucugucugugugcguauagaaacugucccacuccuaaauguacagugaugaauuuucacaaagugaacugaaacauguaucugagugcugugauuuugguuucuuaaacauaauuuauggaacauauuuuaacauuuuuuaugguuaaacguugucauuauaaacacaggcugaugacauguaacccauacuauugugaaaucaguauugaaggagaguggcuucuuuuuagacagacagacacacagacacacacacacucucacacacacacacacacacacacacacccauaaauuauguugauuguggucuccagcaguuaaccauguugaauucaaggucuguccaggcaccauacuggcacaguauccuucucccauucccacacacaaacaaaauacuaaacacauauguguuugcaaccuucucugacacuccagaagacuugauuuuuaauuucacauuuuuagaaaggucaauauugauaaacuguagauuauacuuuucuuggauugauauagaauaacaaacuugcuuuuacuagucugguauauaauugccaauuuucaugaaaucacaaugcuuuagaacacauuucucuuuauucuguaaucagcacauugaguauuuacgccugugaauucuucauguauuguagggagaauggagcugaugauauggugggugggguacugaaugucugggcuuugauuugcauaacuuugauagaaaagcuagaaaauuuuucacuucucagcauuaauaguucuuguugguauguacuuaaaaacaaaaacgcuugaauagcauaguaaaaauauccucauuggguuuauucuucuguauuaaguaucuauuauguauacuugggucauugauaaguuaccaguuaaacagaaacuugcaaccuaacuacuuuuuagaaaugguguuucuccuaggaugaacucuauaauauccuaccuguauaaucuacaguuauaaauaacuauuguuuuuugcugugaaaucuuaaguaguagugauggggagauacaauuucuauuuaguagcuggcuacaagaaucucuauuuugaaaaaugacuauguucuguucucagauacaacuuucauggagacaucaauaucuucugaauagugcaucugguguuuguguuguaugcuaauuuuuuguccuuuuuacacaauagucuuucauacauacgggauuauacuaacacuuauuacuaaggaugugguugcugacuauacggucuuacuaccuuagucauuuggucaugcaaauaaauaauucaaagcuuuuuguucucugaaaccugcuguggcugaaauaaaagccauucuguuauagcaaauuucauuuguaugguaauuauuuuuauaaugcacugaaaaucuuauuuuguucucaccauuacuaaguauaauauuauuuucuguaaaauuuaggacaggugauaucugauguauuucaguguuuggaaaucuuguuaguucuuaauguuuaauucuuuggauuuuaaucgagaccagaauggcaaacucuugccaugggaagaauuuaacuaaauauuuguaguaaaauauguguccuuuuguuuacuaaugcuggagugguagguaguacaaacugaauuuacuucagauauuuugagauuaaugaaauguaaagagaaaauucuugacagucuguaaaauaaagucagugaauacaguguaucuaaauuauagcccauuuuagguaaauugcuuacuuaaagugaguaaauuaucuacuuaaaauauuugaguaaguugcuuacucaaaauauuugaacuuuuuaauacuacagaguuagaauuuggacucaguaauucugagaaucaugccacucaacaagcauuuauugaaccagacucuuaguaauuauucuuagagucuagaggauaucugugcucuuaugauuucucuugaaaguaacuuggccucuugcccugaaagaguaggauuagaagaugaggaauuccuguuuuauuucuggaauuacuacugauuuguugguuuaguauauccuuggacaagucaugcaacuuguuauuuugagacuaaaugaaaugaaaaaucuaaaguuuuaaaaguucuuagagaaaagaauuauguaaauguaagauggcauuauuuauucacuuugcuguuauuucugcaggcugcaucuuauccuggcauagguuuaauguagggauuucucucaaauaaggauauacaaacuuuacccaauaaauauuuuccuuuaauaaguucuaacuugaguuagguacuuauaaacuagcagaugcagagauacagauaguauuaaaaucauuuauguacuuuagaagauguuuuacuuuuauuuggauagggaaaaauuaggagaaagcuggacaguuauaaccuuaaaacauaaucaucccucaguauccaagggggauuggucccaggacccuccccauuccaccaggauaccaaaauccacagaugcucaagucccugauauaaaauggcauaguauuugcauauaaccuaagcauauccaccuguauacuuuaaaucaucucuaguuuacuuauaaugccuaauacaauguaaaugcuauauaaauaguucuuauacuauauuguuuagugaauaaugauaaaaacaaaagaucuguacaucaaguucuguacagucgcaacagucuuuuuuuuaaaucugggguuaguugaauccaaggaugcagaacccauagacguggagggcuauguuaacuucuccuuauuugucuuauucagauuuuuuguugucccuucauauuuggaaaggaauuuuugucuguuugauaacaccugacuagcuaaagaagaccagauuucuguuucauaaacuucaguguucaugucuuuaccauaguagggaggugguaauuuugcuuuaaaguauuuucucuuucaguccacaagacuucagaagagauucaguuuauuuaguaaauguuuaacaccaacuuuguccagaguacacaagacuucagaagagauucaauuuauucaguaaauguuuaacaccaucuuuguccagagagcaacacacugcagagacaguuagugcuaacagggaguaaauuaacacaguccuuucaagguauuuuuaaaaaucuaguaguaagaaaauauacuuaaaguaagguaauggguuacagcuuagaauuuaaaaaaaaauugccccgacucagucguuacagucugacucagugguuuucacagugugauuuggauguuccagaccuuugagggguuggcagucuaccaagucaagucaauuauuuucauaauaauacaaaaauguuaucugccuuucucacccuuguucucucgcaaauauauggugaaauuuuacagaaauuaaauauguggugacaucaucacccucacagcuaauggaaugugagcuuuauauauucuuauguuuaaaauuuuuaucauuuguaauuucugauaugcaaaauguuaauagacauaaucuacaugaacagcagcucuuugggauccucaauaauuuuuaaaaguuuauaggaguccuaagaacaaaauguauaagaacugcuagucugaccugaaguuuauuuauuuuuaccauauguaaaggagccaccucuguugccucacuuucucagugagcuuuaauaaauauuaaauauauacguuauuuucaguugcuaucuaguauugcuuguacaccuugguauuguaagacacaagguugaguggauuuguuacaguuuugacugcaccauuuacuugaguggauuuguuaguuuugacugcaccauuuacuaugugaucacagacaagcugcuuuagcuuucucuuuugucaaauaauguuuauuauacuguaccuuguuaugaguugugagaaucaaggacauauaucagaguugcauaauuuacagaagugcuagaaacauucaaaguagucauuuuuauauucucauucaaugguguguguuggggggcugguagagaagaacaggaaagaauaagaguuuggauuugcccauuuuuuuagcuaugugaaagcugggaauuuugauuuaauugaucauaggccaugguaagggacccuuacauuguggguugugaugaacauaagaagauaugagauuugccagacauagucaagagaauuacuuugguucccugagcaacucgucucauuugauaccuuaccucuguggugcauaggcuaucaguuaacauugacucaucuuuuagucaccagcucuuugaauucuauuaugagggaccugcagccuugauuaucacucuuuuguucagcauauauauaaaaacugcuuuagaaaauugugaggcauuuuggaccuugaucauucuaugcagaaauaggagcuuggauaaaagugagcauuuuauauuagguagaggguauauggaugagcaggagaaauuuuuuuuuuguaacaguauuuguuauccuuguucuuauuaauuucauaacuauucaggaauacuuuuuuuucucuguaggaauacagaaauuaaaauaauuuccccaagaauaguacacuucaaggaauuucauaaauagaacaauuuucuguggguuuccugaagucaguuuuuuaauauauucaguuuaauauaagcuuaguuauaaaacuugaugcagaaauacaaaggugauaacuaagguaggguggcaugcugacuuuuuguuuguuuguuguuuuuguuuuugagacggagucucacucugucacccagguuggaguguaguggugcgaccucggcuuacugcaaccucugccuccugggcucaagcaauucucccaccucagccucucgagcaguugggacuauaggcgcgcaccaccaugcccagcugauguuuuguauuuuuaguagagacgggauuuuaccauguuggccaggcuggucucaaacuccugaccucaagugaucgcccgccucggccucccaaagugcugggauuacagacaugagccaccgugccuagccuguuguuguuuuugaaacagggucucgcucugucacccaggcuggaguguaguggcacacucauggcucaguguaaccucaacugccugggcucaagugauccuaccaucccagccuccccaguagcugggacuacaggcaugcuccaccaugcccagcuaauuuuuguauuuuuuuguagagaugggguuuugccauguugcccaggcuggucucgaacuccugggcucaauccauccacuuaccucggccucccaaggugcugggauuacaggcaucagccaccacgccuggcccugacuauuguuaauuuguucucuugcacuuaacaaaugauaucgucacaaaggacgcaauuaaaaaaaaucaacuagcaugggacugaaaucaucaccacauggaaucugaagcccaaggaagacaaacagccaugaacugggaccaucauacauggugaaugcugaguccugaagugguuccuuguggaagggaagaaguuugcuaccugacaugucuguaggaauucauccuuaauauagauaaauagaagguuugauaggaaauauuucuagagcaccucacugggccagaugccuuaugagaaauuucuuaccuuguccuuacauagcucuauaaaauaagugcuauuauuauuaguauucuuucauaggugaagaaacuggggcucucagaguuccaaguaacuugccaaaggugucaaggcuaguaaguauuagagccaaaauucaagaccaaguauugauuuaauacuacuuuaaacugccuugucaaaaagaagcugaaagugaggaauaaauaaaugaaaacccaggagaagaaaaucagagggaagagaaagauaagggaugguggguauuaaaaauagguguggaaugcagcagugaggacuaaggguuagcaaucaguaaaaaagacuauuuuauaguccgugaaagaagagaggggagaugagggggaaagaaagaugacuauagguuggugcaaaaguaauugugguuuugccauuacuuuuacauggcaaaacccgcaauuacguuugcaccacccuaauaaauuuagugaacuacugcuuuggucugggacaauacuauacuuuuauaugcauauuauccauugaauccccacaguaaaaccauaauagugauauuucacuuauaaaugaauaaauacagauucaaaagguuaaacgaguuacucaaauugaaacucaggucucuaagauuacagaacucaugcuuuuauaucauauccaguguacaguuuaagaaacagggaacuuuuuuauuugacuuuuuauuaugaaaaaugucaaacauaguucuaagguaaaaagaauaguaagaugaacagucaugaucugucacucaucuuuaacaguugucaacucacggccaauccuguuuaucucuaacuccccuuccuccuuaaucccauagauuauuuugaagcaaaucccacguauuuuauccguaaauacuaaguauguagcgcucauauuuuuaucagauauaaaauaaauuuuaacaguaauaccuaaugucauuaaguauccaaauaguguucacauuuuccugaucguguaggccuuuuuuuuuuuuuuuuuuuuuuuuuuuuuuuuuuuuuuuuuuuuuuuuuuuuuuuggagaugaagucuugcucuguugcccagacuggagugcuguggcaugaucggggcucacugcaaccucugccuucuggguucaagugauucuccugccucagccucccgaguagcugggauuacaggcaugugccaccaugcccggcuaauuuuuguauuuuuaauagagacaggguuucaccauguuggccaggcuguucucaaacuccugaccucaagugaucugcccaccucggccucccaaaauguugggauuacaggcgugagccacugcgccuggccccuguaggcuuuuuuaaucacagacuuuugguuuguuuuacauagcagugaucaugcucuguucaacaauguauccugauuuucuuuuuuugagagagggucucauugucacccaggcuggagugcaguggugcaaucuuggcucacugcaaccuccaccucccaaguucaagugauucucgugcuucagccucccaaguagcugagacuacaggugcaugccaccacgccugucuaauuuuuguauuuuuugguagagauggggguuucacuguguuggccaggcuggucucgaacuccuggccuuaagugauccaccuucuguggccuuccaaagugcugggauuacaggcguaagccaccgugcccagaccugauuuucuaaauagcaguuuaacauaagcauuaucuuguauuuuauuucaacuuuguaaauuaauuuagacuugaaugcauucuuuucuuaucuuuaaacauuuuacugcuuuauugcuuuuacugggaaaaaaaguuugucuguaugaaaaguuguaaguuuaauaacaugcuauauuuuaaaauaccuuaguuuuuuugaaagauaaaagauucuauaucauggaaagggggagcaggguguacuccaaagccuuugaggaggccaacaugaacucauuuuccaaauagacaguaaucucaguaauuaccccggacuuauaagcuaucuggguuauuuuuaauuuuucuuuuucucauuuguuuuucauugauuacuucccucuccccaaccccagauuaggaugccuaccuuaaugauagauuaauaguaaaguacauauuauucucuuaucacaccagccuaauuuagcuuuuguaaaugcggucaggaauaacaauaacauaacuucugccaaauaugguuaacuuguuaguugggaacacuuaaauauaacuuuauuccuaaaagagcaugggccuggaugugaguguaccuguguuuuuagacucaggucuaauuagacuauuucucaucaguaaaaugaaacgauuuaaauauuuggauaucuguggaauuaccuuucacaucuaacauucuguggaauaaauuauuauucgugugucuugcuuuaguuauuuucaaauuuuaaugauaaccuucaaauugaguuuuaccuuuuuaaauuuuucuuauuuuucuuuuuuuaugucacaaaugucucagcaucuuuuuuuuaacuuauuaaaugauguuaagaaaauuauguuaaauauuaggcaauuuuagauuuaacacaguugucucuaaaaauagaaucuguaggaaacucucaguucacagaagaaaaaaaggauugaagauggaaucaaccaguugauaguuuacaaauaagacugagaucuggaucuauucauuauaaugacuuaaagaugaaugagauccagauacuaucuuuucuaagacuuaaggcuccuauggucuuagaaaagagaaaaacgagcauauaauaacuuaagaguuuuaaaaaauagaacaugauauaccuuaaugguauuaacaugauauaccuuaaugguaauaacaacaccuuaaugguauuucuucuagaaacuucugaaaauuuucagaaaaauguaaguauuguaguauaauuaaaaguaugccauuuuaagguauaugucauaucauuaaauagcuucuuuauuucaguggagguauacuaagugccaggcauuuuguuaaauaccaggaauuuaagcugaacaguaauaauaacuaaugucuauugaguguuugcuggcaugguacuaagugcuuuucauuauucaaugcaauucuuguaacagcacugugagguagguguaauuguuauccuccuuuugccucugaggaaaccgagucucagauuuuggucaaggucagaaguuugcucaagguuauauugcugggaagugacacaauaggauuccaagccaagcuguguggcuccagagucuguucuuaaccucuauuuuauauugucuauaaauguaagcuuucuuuucucaagcaacucacaauuuaguugggaggaggggaucuugcaggaaagcuagaaagauggagacagauacauaaauaguauggcuaguaguaaaacagagcauauauaaaguguuuuuagaacacaggagaggaaacaauuaccagaugguagaggagagggacggguuacagacaggaggcgacugaaguagaacuucagcagugaaaagcuuaccacauaggacuaggcuacguauggcaucagaguguuuagcagguacaguuucucaggagaaauaauacagcaguacuaaccuuggugaauauagaggagccuuguguaugaauuguccuuuuaauauaucaauugaaguaucuaaguaaaauugaaaauuugaaauuuagauucauaauuuaccaacacagaaaaugaggaguauuuggaaccauuguacuuuguuuucuuucuggcuuacacuuaguuuuguauuagcgugccauaguuugcaugauaauguaugccauaaaaguuacaacuaauagagguuuugaaaauuacacuuuuaaugcagcagggggaacucauuauuugaaggaguacuggcucugaagcauaauaaaugaagaaacauuuuuaaaaugaucacucacugaguuaucuaguuuauauauuugguguaggagaauuugaagagaacauuuauguuugcuaguuccuaaugugauagagccaaaacuuuccgacugaaagcauaaaccauauaggacuuucaauugccuguuuauagcugcucguucuacucucucccuuagaaaggauauaguguuguguguauuccugagccugaaauaugacugcaguaucugaguaucuaacuuugacuggucucucuauucucaaauaagccuauuuguuaaacaggugagaugguauuugagguaacuuacagaauaguuuagcuuuagacauagggagaugggguaggagcauauuguggguaggagaaaucacaaaggaacagaaugagggccuuguaggaucuucagagauucagugagacagcuaguuugaaauaguaauacuuuggcauaaagaagagaagaaaaccagaauuugugugcuuauaacaagccacgaacuugauuagguguaucacaugugugaacucuaaaucuuaguaauaguccugugagguagcuuuuuauuuacaacaacaaaagguagaggcuuuguuuuugguuuaagaaaguacucuuuuuaagaaaaggaaacaauuucagaaaucccaacauucuccgcaaucaaugaaaaccuaaaucaggccaaugaggaacacagaacaacagaagagacauuuuaacaguaaaugaauggagggaauggggauagaacuaauugguugugagaagaggaggaauaaaagguuaccuccagguuuccaggugucuuugaaauugguggugccaguaagagaaagcaggagagaagggcgcaaguuugaagaaaggguguuuaacucauuuuuagguaccaauguaugaacugugauaaaagcagugacagcaagugauguugcucagggaaguuagagaaaggaaacaggaagacagaaaccacauuguuuuaguauacagaacaauuuuucuaauucuccauuuuggaauacuucacuuaaaagucaagaaaauaguucaguaaaugccacuccccgcccccucaccccccucccucaucuugcuuugucuguagccaguaauuaacuuagggccacucuuguucaucuugccacacaccccucccccgauuauuuugaacaaaauuuauguauaacaucaauaugucuuuuuuuaaaaaaguauaaucccacuaucaaaccuuuaaaaaguaauaauucuuuagcaucuagcuuaggaucauuuuuuuauauccccaaauuagaaaacaucaagguguagauucucagaaaugacuuucauaguguuccuuauaauaaacuagcauggauuuuuauuagaacagagagagauucguugaucuuuuaaucacguggacuuguuuaccccuuccuucugaaauauugugacuaauaugggucuuucuuggaggacuggaauaauucgagaaaguuugagagccaucaaacugcacugggaaggucauuaccauuauuauugauuuccacucccucuaggacuccaagucaguauuaauagaauugcugaacaauuuuauugaguucuuuauauuuuacucagcaucauaaccuagacaaaauaguuuggaagacaagagguacuguuuuagauaucuaaaguaaauuuaauagagagcccaugauugacacuagaauuuacuuucuguaaaccauuaaaagugagauacugugacuuuauagaaauuauacagcuuuauaaugcagauuaggaaauguguuuuaguaaaaguggcauuguauuaggacuuauuacaaccccacuccuguggcuccacccagaagcaauuuggcgcacaggaggacagcuucagcccccuaugaguucaucucugccccaaccaaucagcagcaagccccuguuagcuggccaccccacuccuuuccccaaacugccuuugaaaaacccuuccccuacgagcuuugaaugaagugauuugaguacaaauuuuaucuccccugugguguggccagccuugugucuauuaaacucuuccucuaugacaaugccaccauggucugucuuuaugcugugggcaggaagaaccccucaggugguuacaauaccuuguaguuuaagagaugcuggcauaugaauuaguuuuacuucacccucucauagguaacaaaaagcauggauuauuccccuccucccuuuuugaacaagaaauugaaguuuaaggagauaaaaggcuuuuccaauaucaccugcuuuaucagugaugaaguugggacaacaaucuauauguauauaugauucuaaguuuuguguuccuuugucuucuuuuuuguguucuuuuuugucuccuugacaaauccucaucuaaccuuugccuaaauauuucuagagauagaggcuugcuacuacauacugagaaagccauguccuuuuuucacuagcucuaauugucacaaaguuuucucguauugaucugaaaacucuagcagauuuaucacuugagcaagaacaugaacgcucaacugcaguuaacaguagaucuagaccucugcauauuuuuacauuggguuguaguaaaaccuuucucucuaaagaucccaguguuugcaaacaguuuuacugcugccaugugauggagaugucaccagcugguauucagcaugcuuauagggcaaacuugaagagacaucuuaaaguaagacauauuuuagauguuacaaaagguucugucagaucuacacaggagaagaaggcuuggcuucucuuguaaguauaaauuuaaauauguauuuuaaguguuaguaaaauaaugcacauuuaaaaauuaaacacgccaaguauaguggcucacuccuagaaucccaacacuuugggaggccgaagcaggaggauugcuuggacccaggaauucaagaccagccugagcaauauagcaagaccucaccucuacaaaaaauaacugggugugguagccugcaucuguagugccagcuacuugggaugcugaggcagaaggauugcuugaguccaggaggucaaggcuguagugagccaugaucacaccacugcauuccagccugggcaacagaguaagacccugucuucaaaaaaagaaaaaaacauguuuuuucuuuaaauuuuuauuaaaauauaacucaccaccugaaaaguguacuaaucagaaaauucagcuccaugaaugucuacaaagugaacaaacucaugaaaucagcauucaaaacaagcaacagaguguuaccagcaaccaagaagcuccucauaugcuaccuagucacuaccuuccucuccucugccuuaaaguaacuacuauccugacuucuaacacuauuuuuagauuuuuuuguguuuguuuuuugccugauuuugaacuuuguauaaauugaaucauacuguauguacucauuuuuguugucuuuagcucaagaguaguuugugagauuaauccauguuguugcauauagauguaguuuguucauuauauuugcuguggaguauuccacugugugaauguacuucagucuguccauuuuuguugauggguaguguuguuaugaauauucuuauauaugccuuuuggugaacauuugugcacauuucucuuggguauaucgaggaguaggauugcagagucauaggguggaucucuacuggcuucguagauauuacuacaauuuucaaaguaguuuuaauagucgaaaccagcaguuucacauccucuccaacauuuggcauuguuuguucuuucauuuuacuuaaugcauguaacuuaaaaaucaaaacagaagaacuuaugaugaaaaucagcaauugccucccuaaacccuuuacuuuccugcccuaagcuagacuguucagaagcaaucauuuguaacuauauauuucuuuuuuuuuuuuuuucacuuugucacccaggcuggagugcaguggugcaaucucugcuuacugcaagcucugccucccagguucaugccauucuccugccucagccuccugaguagcagggacuccaggcaccugccaccacacccagcuaauuuuuuuguauuuuuaguagagacgggguuucaccauguuagccaggauggucucgaucuccugacuuugugauccgccugccucggccucccaaagugcugggauuacaggcgugagccaccgcgcccggccuauguauuucuauuuuuaacaacuuuuaagaggcauugaugaagagcacagauucuggggccaagcgugguggcucccaccuguaauccuagcacuuugggaggccgaagcagguggaucaugaggucaggaguucgagaccagccuggccuacacagugaaaccucgucucuacuaaaaauacaaaaauuaaccgaacgugguagugggcacccuguaaucccagcuacuugggaggcugaggcaggagaauagcuugaauccgggaggcagaaguugcagugagcuaagaucaugccauugcacuccagccugggacagagcaagacuccgucucaaaaaaaaaaaaaaaagaaacaaacaaacaaaaaaaacagauucuggagcuagacuaccuagauucuuauuuugguucuaccacuuacuagcuguguaucccugagcaaguuacuuaaccucucugugucuuaguucccucaucugcaaaauggggcugauuauaguaccuaucucaaagaauuguuuugggaauuaaguuaauuaauauaaugccuuucacaugcuaaguauguaauaaguguuagcuauacuaauaauagugguguuaccucuguauuacuaaacagugucauauagcuauccuugagucagaagcuuuagacagugacuauuaauuggcuucagaagauaaaagauuucacuaaguaauauccucucaccuucucuuuugccuuuuuugauauaguuauauuaacuauuuuccauucauucacugaacuacaucuuuauuuauuuuuauuuuuuuauuuuuuuauuuuugagagugggucuuacucugucacccaggcugaagugcgguguugugaucucagcucacugcagccucgaucucccaggcucaaaugauccuccugccccagccuccaguguagcuggaacuacaggagcgcaccaccaugcccagcugguuuuuguauuuuuuguagaaaugggguguggcuauguugcccaggcuggucacgagcuccugagcucaagcaggucgccugccucagccucccaaaguguugggauuacaggcaugagccaccacaccuggccauccuuauuuuuauauaauugauaacauguucuguucauaguuagucuuccuuggucuguguuuuuacauuauuaugucuauguaaguacuguuuauuacagaacugucuaauaugcagauuuauguuuccuucucuauauuccaguuucguuaccuuggugccauucaaagcaauauuuuuuucucuuaucaaauugccuuacucagauuuucagaguauuccuuucccuucucauuccuucugccucuccuauuuauuuccucuuauuucuuggagauuuccuuccuggagcuuucaucaccugccccaaauggguuuucucuuggcuugccacacaccagucaucuggguuuaggacaucguugcccucuugacuuagauccacuguuuuuggaucacuuucuucagucuugcuuuaugcccuuauuuugugggcauguaucuucauguaacuuuuuaauaaaaggauguagucuucagcaagcuuuuuguucucccuggacugugugaaaugagaaaaugauuugcgauucuugccauaccauguuauugugaggaucaaauauaguaauguauguaaaaccaugagccuccuuugucaggcuccuucagacuugguuuagaacuuguauuccagcagaaaacagggugguaaucaagucaguuaagggacuguagaucaggcucuggaguuacauaugaguuuuguuauggacugaauugugcuccccucaaaaauugauaaaauauguugaagcugcaacccucgguguaacucuguuugggauagggcuuuuaccaagguaaucagguuaauuaaaugagaucauaaagaugagcaguaaucugauaaaacugguuuccuuauaagaagagggagagagaacaggaauaugcacauggagaaaagucugugagaggacacagugagaaggcagccaucgccaagccaaggagaaaggccucaccaaaacccaacccugucuguacccugaucuucgacuuccagccuccagagccacucagaguucuguuauggaagccaucgcggauuaacacaaguuccaguuuuggcucuagcauuuacuagaucucuuacugagaucucuuaagacuguuuccuuauguacagugugcugaugccuaguuuggagguuguaaggauuaagugagcaaauaaagugcuuuauacagucagcaucugguuugguagccauucaauaaauguuuguuuuucauaagcauuaaaagggacuauaauuuguuuuaacgaagcugugccauuuuaugauuuuauuauuuuaucagacaauucuaaccaaacaguuauacaucaaagcagugacaagaaaaauuauuucuggguagcaggguuauugguuuucauuuuaacagcuauauugaaauauaauucauaugcuauacaguucaccuguuuaaaacuuacaauuuaauuggcuuuuacuguauucacauauaugugcaaccgucaccacagucaguuuuagaacauuuuuaucaucucaaaaagaaaacccauaaccuuuagcuaucacccuccuaaucccuuaccuacccccaggccuaaauaaccccucauguacuuuucugucuuuauaaauuucucuauucuggguuuucauaugaauggagucauauaauaucugauccuuguggcuucaggacguacuggcuguguguuuuauuucuuggaguauuuuuuucuacucccuugucucuuuucucuccuucugguucucccauuauguguuucacuaauucuuauuccaguucauaucuacuguuaugaguuccucuguaauuuuuaaauuucacuuauuguacuuuuugacuacagaauuuccauuuuuuuuuguccacaaaaagagucaaacucuguaaaauauuugaagagacuuauucugagccaaauaugagugacauggccugugacacagcccucaggagguccuuugaacauaugcccaaggugaucagggguacagcuugguuuuauacauuucagggagacaugagacuucaaucaaauacauuuaagaaauacauugauuugguccagaaaggcaggacaacucuagggggcaucuuccagcuuauagguagauuuuaaaauuuucugguugaugguugaguuuaucuaaaaccugggaucaauagaaaggaaugucugaauuaagauaaagaauuguggagaccagcguucuuauuuauuacagaggaagccuucagguaguaggcuucagagagaauagguuguaaaacguuucuuaucagacuuaaagucuguguccauguuaaugcuggcgggguauaaugaggccugucccgcaucuguguugauguuaaugaaacgguuccauugucugggguauauacccugguucuuggucuugguggagaaagaauucaggacagggacacacaggagggguggguuuaggagaggaaaguuuaauagaaaaagaaaagagagagaaaaagcuuccucaugcuaagaaaguggguagcucaaaagagggucucugauuuacugugaaaagccauagguuuuguacagaggcuugagggggcagugauugauauacauagggcucaggggauuggguugaccaggugugcuacuuacauagccccaaaaagacuggcccucccacccuagccuuuuauuauacaaaugaggccuccaccuggcggcggccaugaugccuguacgugguuuuaccaggaggcugccaggaaacccuaaaaguggugacaaggaaaagagggcaggagacaaggaaaagaggggaggagacaccauacugaauguaccuggcuuccagguacagcugcuggcauuuacauauaaaagcuccuaguuugcauauuaugccugacuucuguggcugcuuucuguuagagaagaaaugauuugggggcugcuuuuuauuaaaggaaaauuccaccgagaacuuucacccuuucuugcugccuaaaaauuacuuauuaauaacuccuguauuauuaaugcuggagggguauaaugaggcaucucuggcauguccgacccccauuugccaucauggcuugaaccauucuuucagauuaaauuuuaagagugcccuggcugaggaggaaauucaaucaggugguuggggggaucuuagaauuuuauuuuugguucauaguuucuuuuuuuacaauuccugucucuuuauugguaugcucuauuuaguguaacauugucauaauaccucccuauaguuuuuuuuuuuuuuuuuuuggacggaguuucgcucuuguugccuaggcuggagugcaaucucggcucacugcaaccuccgccucccagguucaagcgauucuccugucucagccuccugaguagcugggauuacaggugcaugccaccacgcccggcuaauuuuuauauuuuuaguagagacgggauuucaucauauuggucaggcuggucucgaacuccugaccucaggugaucugcccgccucagccucccaaagugcugggauuacaggcuugagccaccgcgccuggcugaaccccuauagcugaaccccuauaguucuuuaaucaugucuuuuuccaugaacauauuuauggagacauauuuaacauggacacagacuuuaagucugauaagaaacguuuuacagccuauucucuccaaagccuacuaccugaaggcuuccucuguaaauaagaacuuuggucuccacaaauuuugaaucuuuuucuguuaaaucuaacaucugguccuucucacaggcaguguguguuuuuuuguuuguuuguuuuguuuuguuuuuucuuuguuuuuugcuguaugggucauacuuuucuguuucuuuuuaugucucauaacuuuuucuuggaaaccagacacuuuagauaauauauuguagcaaccuuagauacuggucuccccuuacccagagcuugauauuugcuugucuguuuuuagguugacugccuggauuauuuuaguacaguacacccaccccacuuacccccccacuaguguuaacucucuuauugcuuuuaacagcacccaggggcauaacuuguucuacaaacuauuccagucaaauugugccuccuucaggaauaguuucuuggguaaguguuugauauuugcucucaccccaggagggcuccucccagcugucuuauuuccuguuucucuacuaggggcacagcagccugcagccuaggauaugucuuccuuaaauccaugaaggaagacaugugcuuuucaccacaaccuccauuguucuugguagugccuuuagguuugagcuucuucacagacuauuguaaaugaaauuaauuccuuugggaagagauugggagaaucuguuuucugacuugccucucccucuucuuuuccccuuagcaaaauaaucagaaccaggucucuggagcuaggggugaagacuacugcaggcuucucucugggugauaccacaacucuaggagcugagugcuagauuggggauagaguagccagagguccucuuggcuugccuuucccacuauggaaccacuuccucaugagccagggcaagacagucaggguuccaguauucucaguguucugugcccaagguagacccuccauuccaugagugggggcugggucaaugaaggaaucccccuccucuugacugaacuugccuggaaguaacaggugacuggaggcuagaugagaaauguuccuauccuccucuucccagggagaaagcccaccaaaugagagcugugggaugagggagcccuguguuccuggcaauagaagucuagcauggaguggccgggcgugguggcucacgccuguaaucccagcacuuugggaggccgaggugggcagaucacgaggucaggagauagagaccauccuggcuaacacggugaaaccccaucucuacuaaaaauacaaaaaaauagccgggugugguggugggcgccuguagucccagcuacucgggaggcugaggcaggagaauggcgugaacccaggcgguagagcuugcagugagccgagauugugccacugcacuccagccugggcgacaaauugagacuccgucucaaaaaaauaaaaaauaaaaaguaaagaagucuacuguggaaucugccacccugagcuuguuggggaaacaggguucaaacaccacagacuuggcuuucuuaucaaauugucaucgauuuucuuaaguagauuuuuaaaauuugcuguuugcucuuaagaucauuuccagaggcuguaaauguuuugguuuaaaauaauuuucacgaauuucacuggggagcagaucagcagggcucuucauacugucauccuuaaagucgaucuuccuaguuuggguuuuuaaguuuucuacaggaggaaguacagguaguuuguuaagacuauuuugcggggaagccugagugagaaaacugacauuuuugaguuaauagguuaauuaggaaauaaagacuaauggauuuugaagaaagaugauaugauggaauaggaagauaaaagaaagugauagagguagcccgcuucauuguuuggauucuuuauggguuugggauacuuaaagacuuggacuuaaaaauucugaaaaccaaagguucuuagagaauguuaauguguggauucuauuuauuggcuugccgaacauguucaugcuuuaucccaccguuuaguauauucauuuaaaauggaauacguuguucugauuuuagauuauuuuugugcauaaacacucuuagcaaaacccccugagcauuaguaaauccaaauuagacuuuaauccauauaacauucaacucauacuccugugagaaauuuuauugaauuuugacuuuauauuugacaaggaaagcugguucuuagagcaguugugauuuagcuaacuuggauuauuaaauucaaaguuucuaguguauaugguuauuauaauuuuuuuacaaacuaacaguuauauguuuuucaggagucauaaggacuguguguuaaaagcacccagcuacaacauuauauugauauaaauuuaguuacuaguuuuuuucccucuaaaaauuuggugccagucugucugaaucaaaugacuucaaaugcaaauuagcguuuuaguugggagaaacucggggggcuuucugcuuuccauacuaguuuagaaacaggagaaaaccacugagcaucgccugugucccuacuuaacauuuccuuaaaauuuuuuucuuuaaucuuacuuacugggaaaacauaaaacagcauuuaacccccucuauuagugucuuucaguauaaacuauaguaggccauugauauuuucuaaguguuuauuucaguuuuaguguuaacucuuuguaaaucagcgcaacacauacucaaauccugauagugugugaaacaucccgucagguauggaugauggaugcagagaauugugagacuaagucauauuugacauuuuaaggcauaaaugcacgcaauuuagaggacugcaagauagagaagagugaaagcagcauguauggccgagugcgaaagaggggaggauuuggacaggcuuugaggaaucugggaaaacuuccaguugguaugaaaggccugaaggcaggaauauucauagugucuucugggcauaugaggugacuuucuagauuggaauguuuauauuaagagaauauaugauuagaaagauuaauugugggcugggugugguggcucaggccuguaaucccagcacuuugggaggccaugugggaggccgaggcaggcagaucacuugaggucaggaguucaagacugaucuggccagcguggcaaaaccccaucucugcuaaaaauacaaaaaucauccagguauaguggugcaugccuguaaucccagccacuugggaggcugaggcaagagaauagcuugaaucaaggaggcagagguugcagugagccaagaucgugccacugcacuccagcuugggcaacagagcaagacugugucucaagaaaaaauaaaaaaggaacauuaauugugguggaccuuaaaugugaaaccaagaacuuuugacuauguguguguguguguguguguguguguguguguguaucuguuuguguggucaguaagaagccacuaaaacuuucugagcaaguagauaucauggcuagugacaauguguagggugaauugaaaaccacggggcuuuaagcccaauuuucuuucauuuucuuuuucuuuagcuuuaauggaggaguaugaguuguguuuuaaauuaaaaguuuuuuaaaaccuacaguuuauaacucagcacaaacuucuccauaaaaacaacaauauuagugaugagcauaugaaugccuggauaauucauagguaacugagguguuauauaguuggacuuuggaauuagacuagcuugaauucugguuuugccauucacuuuguaaaauugaacaaacuuguuaaccuuccuaagcuucauucuuuucaucuggagagaggagccaauaauauugcccucuucaggguugugagcauuaaauaagauaaugcauguaaaaagcacuuagcauacugccuggcaaauaguaaacaucucuaaugaauaucucugcuguguuaauuguuauugauguugcuauuacagucaucuuuaucauguacuaaucacugucuguaauagucagcucucuguauucgugggcuccacauccauggguuccacauccauggauucaaacaacuguggauugaaaauauuuuuuaaaaauuuaaucugcgcugaacauguacagacuuuuuuccuugucauuauucucugaacaauauagucuuaacaacuauuuacauagcauuuacauuguauuagguauuauaaguaaucuggagaugauucaaaacauaugggagaauguguauaaugcagauacugggccauuuuauauuagagacuugagcauccugggauuuugguauccuugggaaguacuggaaccaaucccccauggaugccaaggggacuguauauuauuuccauggaacaugcauucugaauuuugaucuuguaccguaggaacacucuucccaucugguucacagucucucuccugccccaccuaaacuucauggccuacuugcugccucuaggcuuuucuuuucuuuguucucucuugccuuaucaaugggggcauaccaaaaaaccaagacuuaugggugccauagcgaaggcaccauuugcugccaguuaugggggagugugguaagcuuugguuuuguagagcacguguaguauuagguguucauuuugcuuuguguuuuuguacaggugaguuuuguuaugcuuuaaacugugguguuuauuauucagacauuuagacuuaucuuuacuuuugucagguuuaagccguuuuuuccauaccagaccuugcaaggauuugaagaagaugaagagcauauccauauacaacaaugggcacuuacugaaggccgucuuaaaguuacguuguuagaauguagcagguauguucuuuguuuugucauuacuaaguuacgggaagaacagugcagugaaaauauuccuaagcaguauuuguguuguguguucauuuaaauuauauuauuuaccuguaaauucuuuaauuguaaauuuaauaucauaaaaguaguccuuucuaacuuuaacaaauauaaaucauauuuuagaaaguguuuuaauggagggagaggcauuuacucuguagucauucugacacuauuuagaugcauagugcucuguuggcuuauuuuuaacuuauucuaccuacuggggagcuguuccuauguuaaagagaaaauuacucaaugauacuuauuaaagcagaguaaggaagucuuuauucaggaccaucaugauaaguauagcagccacugcagugaggucuugaagugggugagagauugggcucaacucugaauacagcaugggcagguggaaauuuauagccaagaagcaaugugggaucaguggauggaaacuuacuaagaggaaacaucaaggguaaaggggauuuuggcuaaaccgaccuaacaggauucuugcuaaaaacaguccagggugaucagacaucauggaggaugguaaaggacgaucagauaucaaggauagggguuucuugcuaaacugacuucgcagaguucuuugcugaaacuggacagaugggccuagcagaagauucagaaaccucaguaaaguuuggccuggcaaagaaucuuugucaccuaucaaaacgguuuugagaauuguuugugauaauuggaaacacucaggaaaguugcaaaacuagacuuugaaccacuguggauuuuuagcguuuuagaacuggaagcgaucucagaaauaaucuugccuagccuccuuguuuuacuuugccagcaccaaaguuuaagcuauauucauaucuugcuugagcuacuuacuauacuagccuucauaucuccuaguccucugguccccaauauaacaaccaacaugaucuuuucaaaaugcaaaucuaauugucagucuccuaguuaaaacucuuuaacagcuuccccauuacucuuaggauguggacccaaauccucaccaugacacacagguuccucuuagcucuccagcuucagucucaccauccuccgcccagccccucauucauagugcuucagcuacauaggccuucccaaggcaagguguuggcagacuguuucucuaaggggccagauaguacauuuuaggcugugauucacaugcucucuguugcaacuauacaacucugccuugcaguacagaagcagucacagauaauguguaacugaaugaauguggcugugugccaguaaaacuuuguauaugaauuuuguaauuuucauauguuauaaaauauucuuuugauacuuuucaaccauuuaaaaacauagaaacccuugauagcccacagguuauacaaaacaggcaguggacugaauuuagaccauaagcuguaguuugccauucccuacuuaaauauuuuaaagcaccaagcccauuguguugacuagcugcugcuuucuuggcccccuucucugcuccaugaagccaaccuuucuugguuugguucaaaagcuaccuucuuaauguaucuccugaucauuccaaguacaaguauacuauccuccggcuacauuucuuugacacuuguuuguaccacuuacuugguacauaugacuuuuauuuccaacccauaauacaauuaaguacuugagcacacagguuauauuuuauaucuaauacauuuguguccuugcuaaugguuagguuaguuuugaguauacuaauaauauacuuaauccuuuuuuuuuuuuuuuuuuuuuuuugguuaaguccagggugacucaggauuguguaucauuauguuagaaagccugguagacaaagaaucccuuuuuuuuuaaaucaaaaaaagacuaaauauguugucuauuuuguaaaaggaacugcaguguacaguaaaauacauauaauagguacuaugcuagguauuuagaaaauacuaguucauuugcuuuaauguugcuggugggguuagguauugauuauaugucuguuagcuuguagcuauuuaaccacuagcuuuggugucagcuuugcucaccacauuuuugcuuuaccugcaguacugcucacuuaaagccuugcuacaggaaucaaagacugcauguaaggcauugagaaaguauagccagacauucuuuaggucauguugagauaaaugaaaagaaaagcauuagaaugugugaaguaccuguaaccaacuuuauuuuaauaaggaacuguguaauaaaucucugaaaggauaagugagaaaccaauaagaauuuuuacgggguauacagggaaggaacuggguugaugaugauggacaggggucaaggugauagcccagcuauucacuauaaacuuguuuauguuguuuuauuuaucaccuggucaaaaauuaagguccaguauuuuuagagaguacauaauuaggcugaagggaaaaacauggaaaaauaguuuuuuuaauaucugaaguuauguaacugucggcuuagguuauauagccagcaccuuuccccaagugauagauucaucuugggaacaaguacacuaucuagagauuuccuugugccauuuuuacaaauccaagcauguaaaaguuacucaguguugugguacuguguuauuguuuacauaguuuaagaauuauuuguguaugaaggcaagaguaagucucaacucauuccugcuuuuuugucuucguauuaaguccuaacauucuuuccguuaaaaacuuaacguuacuguuuuucuuguaaacuuuuuucuuaguauaaaaacagaaaacucuguucagguagauuuuaaguuuauaggauucaaacuaaagaggacauauuacuguaaccuaagcauuuuuauuucaauaguuaaucucauuuugaauauaaauucagcuuguguguuuuauucuaauuccugaagcaaaaagaggcacuagagaaaaugaaagcacaaauaacagugcuuucuuuuuggaagaaggaccaaaaaaaugcuuauuacuucauauauaguggaauaacauagacuuuugaguuauagaaagcacugaauucaaucuagccauaugcccuuauauagugucacuaggcaaguuacacaucugugaaaugggcaagggagcuacuuugcugguaauuguaaucagagauaggcaacuacccacaaugccuaccacauaggauaccuacaguagauguagcuucuauuauuaugucucaagauaaucguugcaguaucugugaagaaaaaacggcauguuuuuucuugcauauuuguuugugagaauuggaauuugaauuuuauuaauuuaaaaaggucucauauuguaaagggagguucuuuccuaacuaucugaaauacuguuucgcauuucccaagcaauagcuugaggguggaaaggcaguauuauguguaaaaauugguuuucacauuuugcuuuugucaaguauuuuuuaaaaagcagucauucugaacaauugcauguuuuuuugaguugaugaaagcugauuuuuuuuaaccacagaugaaugcaauggcuguuugucguacugcuaguaggugaaauuauuucacauuaguguugcaaucagauuguuaagaugauuauuuuuaaauuuauaauuuauagucuaucuucugucuugaaggauagaagauauuugagauauuuugcaaagaaaacauguaagcauguauacuuaagcagaagauauauuagaucaaaaacauggaaaagagaucaauuuucuggcagcuaagacaacaaaggaaacuuuacggauuaguuagaucuuacuuuuuuuuuuuuugagauggagucucacucuguggcccaggcuggagugcaguggcaugaucucggcucacugcaagcuccaccuccuggguucacgccauucuuuugccucagccucccaaguagcugggacuacaggcgcccaccaccaugcccagcuaggguguuuggucucacuggauuucaauauuacaucuuuuuuuuuuuuaaguuuuaaauguuaaauauaacacaaauacagaaaaccacagcaguugacauucuauucuguuaccaagagucuucccuuauucuuaguuuauugucaccauugacccaugaauuuuuauuuuucucaaugguuauaauucuuuacuguccuuaauuauuuuggugucuaaauugucucagauuuggccaguaggaacccccucaagauggauccugugugugauaugaccccaucuuuuuuuuugucuuuuuuuuuuagacuucauuacuuucugauguaacaagcuguucugcauuuaucuucuaucuucucugccacggucccagaacaacuauuuuuccaaagagccccaauucuuuuuauuuuuagcugagacuacaggcauguuccaccaugacuagcugccuaguucauuuuaguaaaggaugguauuauuaauagaaacuaagaucugaauguuggguguguuuauugcuacuucauauauucauagaccucuucagaggacacuuaggaaauauauucauguaucaauacuuauacaugcauacacauacguaauuuagaaaucaugaguucaccugauacagguugagcaaccuuaaucugaaaaauuugaaaucccaaaugcuccagaaucugaguguuuuucggugcugacaugaugccacaaguagaaaauacacaccugacaccuucgcuuucugaugguucacuguacacaaacuuuguuucaugcaggaaacaauauuuuuguauaaaauuaccuucaggcuauaaaguguauaugaaacaaauuaauuuuguguuuagacuugggucucaucuucaagauaucucguuaaauauaagcaaauauuccaaaaucugaagcacuccugguccuaagcauuuuggauaaagaaugugcaaaccuguaccuccaacucuaguucauccuuauggaauuguuccuugcuuugguucuuccuccaauucuuacuucauggcucucaacaacaucggcacuuuuauucacuugcucaauccuauaauaaucuuaauuaguuucagaaugcauuguccauacaaguacaaaaaacauaauacaaagaguucaggauuccuuuguaauucucccuuacccugcccaagguugagggaacgugggggucaaguacuguguucuuaaauuauuuagacuuguuuuuccucuuuggugugauuaugguguucauuuaaaauauaguuggguuuguuucagauugcuuucagauuuagucuccccccacuccuacuuuucuucauccuuacugauuuucgcuuuuaaauacauagaguauuaacaugcuucugcaaacccagaacuguacaaaaagauauacagaugguauauagguuauuaaaccaucagugguguuauuuuugccuuacacuguuaucuguccuuuaaagaaauuaaaagaagaacaaacuuugguagugguggguuguuuuuacauuuacuguauauuuaccauuucuguugcccuuuauuucuucuuuuauaucaaaauugucaucugguauuccuucccuuuauccugcagaacuuccuuuagugcuucuuguuauguaggucugcuggcaacaaauuaacucauuuuuugcuuaccuggaaauuuauuuuccuuucaucuguuccuucagcacuuuggcuaugucaaucccauauucugaugagaagucagcaacuuuuuuuauucuucccccauauguaacauguuguuuuucucuggcugcuuuccaaccuuuuacuuuauguuuggcuuucagcacuuagaccaugucugagggagcuuucuuuguguuuuuuccugcuuccauuucaguuagcuucuuggauauaugaauuaaugguuacaaccaaauuugggagcuugggcuauuuuuuuuuuccaauuguuuuggccuuuuuuucccaccucucuuauucuaaauuacauauuauguugggcuguuucauuuucccauagguccccugagguuugguuuguuugcuuguuuauuuguuuguuucuuuaaauucuuuuucucuguguacuuuggauugaguaauucacguggucuaauuucagguucacugagucuucuccuaucuccaguuuucuguugagcucaucuagugaauuuuuaaucucauuuauuauacuuuuuggcucuagaauuucuguuuuguauagugucucauuucuauguugauauuuccuaucuguucacucauuauguuuuccuuuaauucuuugaacaaauguucugucaguuuuuugagccauauauauauauaauggcugcauugaagccuugaucugcuaaaucuaguaucugagcacauuaggagucaguuuuguuuuguuuuguuuugagacagggucuugcucugucacccaagcuggagugcaguuacaugaucaugccuuaccacagccuugaccuccugggcucaagcgauccucccgccucagccucccaaguagcugggaccacaggcaugugacaccaacaucuggcuaauuuuuuguauuuuuaguagagaaagaguuuuauccuguugcuuaggcuagucauaaacuccugcuucaaccagcuucauccagcccaccagcuucaaccucccaaagugcugggcaugaagcccaacauuacaggcaugaagcccugugcccugccugcagcugcaguuuuuugauaauugaaauauuaaucucaaagcaggcuucugucuacauucagaagguuuucauugucuuuaaaugugauaaaaaauuuuguuuauccaguuuuuauaauuacaaucuguggaagaauuugagugacacuucacuacuguuaaaguauuggccaccucauuuuguuguacauguuguugaauuuugcuuuuguuucccucauugcuuuuuguccuuuuauggggggguuuuggggagacucaaaacugugucaccacucuugacaucauucuggaaccagaaauacauugaucuuuuaaggcaaagaaaaucauuuaauuaugugauuaaauucuuuuuuaguguugucaucuggucuugauucacauauuaggugaagcauuuucaaaguagaaguuugacagaagagagaaauagggaauuaauccuuuaaauagcauuauguucauauuuuaaagugaaauguuuaguucuguagggaaggcugcuaauauuaugaaauuuugaaauucauuuacaagaggagcuauuuuaguaguuauaacuucaaaauauuuccaguuugcauuugucuaugaaucccguuuauguuagcauugaguuugauuaaauuuguuugguuauuuuggcuugaauauaacuuaaauccaccugaagcaaaugaggcuaaauaauaauauuugcuuuuuuccugaguaguugguaugugggugcuucuuauauuaccugccuuuauuuuaauguuuugacauuuuuuuaaggaaaaauaucuagcuaaaucugaagauauuuggggcauggcucuacaaauaauuguauuauuaguuguacuuauuaucugcaauauguagguacuuuacugcauguauuauuuucagcucuuagagcaucguuacaagauuaguguuauuauauccauuuuauagaugaacugagauccacaaguuacuugcucaguaccacuggaauuugaaucuaguuuugucuaacuccagaguuccucggucuuucuguuaucuuauucugccuccauauccccuuuuuuuuuuuuuuuuuuuuuuuuuugagacagaguccacucugcuguccaggcuggagugcaauggugcaaucuccacucaccacaaccuaugccuaccaaguucaagugauucuccugccucagcuucucaaauagcugagauuacaggcacccgccaccacacccaucuaauuuuuguauuuuuaguagagacgggcguuucaccauguuggccuggcuggucucaaacuccugaccucaagugaucugccugccuuggccccccaaagugcugggauuacaggcaugagccaccacgccuggcccauauccuuuuuuaaaaaaacuuuacagaggccaggcguggugauucacgccuguaaucccagcacuuugggaggccgagguggguggaucaccugaggucgggaguucaagaccagccugaucaacauggagaaaccccauuucugcuaaaaauacaaaacuuagccaggcgugguggcauaugccuguaaucccaguuacucgggaggcugaggcaagauaaucaccugaacccaggaggcggagguugcggugagucaagauggcgccauugcacuccagccugggcaacaagagcagaacucagucucaaaaaaaaaaaaaaaaaaaaaaacccuuacagaauaaaaauuauuuugguucugaaaacuuuuauauuauguuagaaguguagguuuuggaaaauuguaacauuuuuuagggcagggcauuauuuuuaaaauaaauuaccuuuucagaaagaucgagggauggagaaauguguauaauaaugaaguauuuuuuaguugaaggcugaaguucuguuuuuuguuuuuuguuuuuuucuuggagggaacgauaagaggaaauuagcucaggcauaagacauuuaaauuuguauaaaggaaaaguugcacucaaaaugaaugcuuuugaaaaccagaaggaauuacuuggaauuguugcugaauauuauuccucaaagucuuuaaagcuguguaauucuguguaaauuuaggcauaacucuaccagaugaaccaaguuccuguaaagauuuugagacuauguuugcauuuauuaauuauuuaacaucuuauaugcaguuaaauaaaaguugagugauguuuuccguuaguuuuuauacauuucucucagauauaaagaaucuuccguauaauuagguugcuuuugacuagaggcagacuuuucaaaagacugcaaauuuggaauuucucccuccuguauuuauguaggcucucuuuucuuccccauauccuuuucccuaagguugugaugcuggaaaauagccuuguuucuuuuguaauuguauaccuccacuacuguuucauacuacaaaauauagcucuuuaauucuucugaugucugaauuguaagagaauguaagaaaacuaaguaggaacacagcugacauaauaccagugcucuuuuuuaaaaugccauacuccaaaauguuuuaaaugcuguauugguaugcuauacacucauacaauaccuucagcaaaaaugaacuguggucagaaaauaauaauuuaaaagaggauugugucuuugauaaucagugcuuuuaauguauuuuauucacggguagcauuuguaauuuuaaccaaaagacaacugccuuuauuuucucucuuucaaaauuuuuucaacccauuugucucaacuuauauaguccagacuuuucauuuauuagcugugcaaugucuggcauguuacucaaccucucuguguucauuuucuaauguguaaauuagggguaauaccauuaccuauuuccuugaguaauugugaaaauuaaaugaaauaauaaauguaaagcucuuagaauuguccuuacaguaaauguuagcugcuucaacuauuucugcuacuaccaccaccacuacugcuuccaccacacuaccaccagucuuuccaacaucaauagugaaugcauuuugucuaaauacuacgaugaauacaaaaaauauggagcucagugucugcccucuagaaacuuaaaauguaguuagggcuaacagacaaaaacaaaugcauaaauaagucaacuauaugaggcugucuaauuugaauugaggcuuaagugauggguaguauagaaacuuagugcaaggaaaaaguauuuuugaauugacacuaccauggaaaacuucauggauaagauucaggaaacuagauggauuguagauuuuagguaauuggaaaaagagccauaagauaaaagagaauuagaauuguaaaguauuuuccaggucuugucugaaugaaguguagaugucucagggccaaauuugcuggcaagagaaguuacaauggugauccuuuaaucagagaaaaguuauugaaggugauauuaagaaaaaugugcauauuuauggaguaaauuguauauauagagauugaagucccagagacaaauuuaagagguguuguggguuaaaggugaggaaguaaaugccucauagauauguuuuaauaggaacaagaaggaagggacacgugggauaacuaggacaggguuuagugagugacugaauauauggaugaguuaauaggcaggggaggcaaaggaacucuaaggaucugaguguaggagaguuauguauccauugacguugaucugcucagcaaguacugauuauuuucugcauguuauaggauagaaagaacaagacacaguuaccuuccaggacuggauggggaaauagagguacucauuucaaaggcagaugaauuugauuuuacauaucuuaaguaguaaggcaugguuagauuucccuguaggaguguucugcaaacucuugggguuuuagagguagcagggggaaaaugaggacugaagauuagauuuggaagucgugaaaauugaggaaaauugaguucugcaugaggauguuucugagggggguugggaauauagagaggaggugagcauguauaaaaggucaaccaagccugauucuuuuaacaacaggugaagugguauuugacccccuucaagugcaggguuuuccuuucaaauuaaguuuagucaccaaaggaaaaaaaaaaaacagauuuuucccucccucccucccucccuccuucccucccucccucccucccucccucccuuccuuccuuccuuccuuccuuccuuccuucccuuccucccuccuuccuuucuugagacagggucucauucugucaccaagacuggagugcagugucuuggucuugccucacugcaaccuccacccgccaggcucaagcaauccucccacuucagccucccgaguagcuaggacuacaggcauacaccaccauacccaacuccuuuuuguauuuuuuguagagacagaguuuugccauguugcccaggcucgucuugaauuccuggccucaagguauucaccuacuuuggccucuccgagugcugggauuacaggcaugagccaccaugccccaucauuuuguacuuuucuuuguagaaaugacuuucuuauagcaugagcauugggaauuacuuuccuuuucucauugguuucaucuuuaauccauuuauaccuaguguuccauuauuggaacucuaagcuugugggaguuauuuauauccuacugcucaacgucaucgccaaggucugauuuuucacaaaaaaauuuuucaaccuccgguauaaauggguuaaucauguaaacgaucuuaacauguuucuaggugguguuuguauuuaugcuuacuggaagguuucaacauaccuuugccuuuaaaagaauacuuugaacuugguaagaaauuucacagagguaauagcucuuucaggagauagacggcaauuuagaggagauaaaaggcaauuucuuuugcuuuuuuguuuaguaguacugacuucccuuuggaaguaguaguaguagaaauuuauuuauacucauuuauugcauauuuaacacauguuuguuuauauuuaugcaaaauauuuauuagccagugauuguuacugcuugcuucuggucauuauauaauuugaauggaaagccugucuuuguuuaagauugaacuguaagaaaugugaaaugaaaaguuauccuuuuguuuaaauguagagauuauaauucaccuuaagcuaaagcaaaugucgucuauauucaccuaacuggcugguacucacguuuccagugggaacuccuuucuggcauuucuucagaaauuuccauguuuuucaaauaccaagaggagauaucagucaaggccuggugcuguggcccacgccuauaaucccaacacuuugggaggcugaggagggaggauuauauuuaauuauagaucuaauuggcuuuuauuuaugauucaugaauuaagacagcuucuguucugcaaauagaaugaaaacucccacugggcauuggcaaaacaguggguuugguaagguagaaacaaggaaauagaacaauaggaaaaaaaaagacugauugguuaacauaaguuacuuuuucguaagagaguuugaggcaacauagugagaccuucucucuacaaaaacauagaaaaaaaaaauuagcugggcaugguggcucgugccuguagucccaguuauuccagaggcugaggugagaggauugcuuaagccugggaagucaaggcagcagugagccaugaucacagugcuucacucuagccugggcgacagagcaagacccugucuccaaaaaaaauaauaauaauaaaaaaagagagaucuuaagaaaucaggaaaaugcaggggaggggggaauauuguaauucuucugagaauuaaagcuugacagucaacauagagccacugcugguugaaggaauccauugaugucaggucaaaagcaggcacaagaagcacugacauagggaauuaggucccagaaaccaaaucuggaacuuguaggagagaaacaaucacauucugaacaguuagucuugaguauaacuuuggugaugggagucauucuugcaaacaaaauaaauaaguuggugcacauauuauacuuuauauaaauccuaagaaauaauuuuuuuuuccaagaaauaaguuuuggagcaaaacaaauccuuaaauuggcagauuggacagaugcuucuguguagugaagcuaaccuuuguaggagacacuaauguuauuuuauuagagugguaauaaugcuuguggguguuuuccaguauuugaauauccacuaaaagcuacaguucuuuauauauacuucaacagaagaaauguaaagagaagaugugaauguugcauaauucugugacagaauaaaaaaguaaucuaaaaaucagaauuaauaaaagccauauccauuucaaagguaaaaccaaauucagaauaauuggacaaaauauuuucaucauggaaaaaaguaaauguaugugaagcaauguguacccuaacaccugucaaaagacaauuauaacauuuaauuauagauugaauuggcuuuuauucaugauucaugaaucaggacagccucuguucugcaaauagaaugaaaacucccacugggcaauggcagaaagaacaguagguuugguaagguggaaacaaggaaacagaacaauagaaaaaaaaccugauugguuaacauaaguuacuucuugguaaagauuaaagcacaggggacugacuuaugcuaacucagguagacuggaaucaccuguuuucaggaaaaacuagucuguuggcaucuauuugcuuauauggcauuuaacauuacagagacuguauuuugauuuggucuguuuuguuagggccuaaugcaggagcuuaguccaaaacaauggccucccauaauuuuuguuuaacaauuccccccauuuggucacagucucaccuaggugagauccuuuaguaccccuaggugagagucugaccaaaacuuagggcauuagugcuacuuucaguuucuaucauucugcauugccaguuucaacaugccauucauggauuacaggguccucauggucacucauuucuuugaguuuuuguuguuccagccaagagagaccauuugacguuucacggauggcugcauguaaacauucaaagcauuugagagaauacagugcauagggagacuacuacuaucagaaggauaguaugaagaguuuggaguauguucccuaagcaggguccccaugaaccaaagcaaucaaaucagauagaucaaagaaugagcuauauuagaagucuacccauuuuaaccaagucgccuuuuguuaauuuuuuguaccugagucucuuuaauaccagauguauuuauccaucuguaacaagaagugucugcaacugcacagaugccucccuguucagcuaguagguagaaauucuauuauccagcuucccaugacugugcuaauuuaaaacaaggagagagaaugagugguucuagaagucuaacucuaugcaagggaccacuaguucaauuugaacaaacaguuguauuagagauguugcuaaaguuaaccacuagguauauuaaaggaucucuuaggucauguaaagauuuggguuugacaugacagauccagcacuucaucaaguuaccuacagaagcuguuugauuguggaauuuugauuacagcauuauccugcgccaagcaaaagaggaaagcuuaagcaaggcauuaagagaggugagagucucauuaugaugaggaggcuuguuccaaagucuugggaaaagcuauccacagcacaaagcuaucaacuucuuguccugguucacuguuuuaaugucucugguuauggcauagggugauuugcugaacucuguguggcccacacauuaggcaugaaacuugucucuugaaauuuauauugauuugucuagcuucaccuuauagggauuaaagaacagagcaguuauuauucuuaguuggagaguuguauggagccagauauuggagguguauuaguccguucucaugcugcuauaaagaaauauccaagacuggguaauuuauaaagaaaagagguuuaauugacucacaguucugcauggcuggggaggccucaggacacuuagaaucauaguggaaggggaagaagaagcaggcaccuucuucacaaggugacaggagagagauugagugcgagcaggggaaaugccagacacuuacaaaaccaucacaucuugugagucucacucacuaucacaagaacagcaugggggaaaccauccccacgauccaauuaccuucaccuggucccacccuugacauauagggauuauggggauuacaguucaaggugagauuuggguggggaaacggagccaaaccguaucaggaggaaacuagaagaauccaggauccaguucagucuauaggaagauaauaaaaacuuacagugaaccaggcuguaaucuaacagaugaaguguggauuuuuucauaguuuuggcugggcgugguggcucaugccuguaaucucagcacuuugggaggcugaggugggcagaucacuugaggccaggaguuugaaaccagccuggccaauauggcggaaccccaucucugcuaaacauacaaaaauuagccaggcaugguggcacgcgccuguaaucccagcuacuugggagguucaggcacaagaauugcuugaacccaggagguggagguuguagugagcugagauugcaccacugcacuccagcuugggugacagagcuagacucugucucaaaaaaaaaaaaaaaaguuggcuuuucuggaacuuuugauagguaaucucaaauaagucuuuuagacuuuuaaaagacucucaaggcugugaagccaaacccagggcucaccauuaaacgucaccuauaguacuuaauagauuauggugaauuccucucugaggucccaaaaauauccugaguuuccugggccugucaggaagugacauuuuucaccccgcuauaagaccaccggcugggcuguuguauucaagguaccaggccaguuuuuccaugguggcaguuggggagaggggugacagagguguuaauggcgccacaaagucaacuuuaauuccuugaaguugucuggucauaucugaaaauacgagauuccagucaaagcuugguacuaguguuuccaacuguguccuuuuacaaggagaacagauucuuaagaaacuuucauaaaugauuauauugccauaaaauuaagaauacucacuaauaguuuccaaaaucuggagggaucagaugggaugaaaaaguaaaggcuucaaauuuugcucacaaaagugaacuuuaccacacugccauaagcuauagauuaaaagaaaaaaaaguuucuuuaaaucuggaaaacaaaacacugaagaaucagcaauauuucaaauaaaaagucauaaaaaauuauucucaucaguuuauucaguuccguguaauuuauucuuauucugccagaucuugguuagcaguuucaugaagccaucaguuucuucauuagaguuuuauaaauucuuauccaggccaaugguaugaucuuaaaguuaucagaaacuuguauuccagaguacuuauaaugaaucuugacgaauaagcaauuuuggacuguaacugacugcacaugcuuuuagggaagaaccaaaaccauugucuguggaugaccaagaguuagaaauggccauggcuaaaaaucugaugagaguucauuauaaucagcaauugacaaagaaauuugguuauugcuauggcauuguaacauuuaacauaauaaccaaaaaucaugacugauaacuauuagauuucuaggaaucucuuacaaauuuuggaauaauuuggaagucauuuguuucuuauuuugcucuaagguccucuugaaauguucugcuaugauuacuaguuuagcucaguccuguagccucuugucuuuuuuuuuuuuuuuuuuuuuuuuuugagauggagucuugcucacgcuggaccaucuuggcucacugcaaccucagccucccgcguucaagcaguucuccucucucagccucuugaguggcugagauuacaggugugcacuaccacaucuggcuaauuuuuguauuuuuaguagagacaggguuucaccauguuggccaggcuggucucaaacuccugggcucaagugauccacccuccuuggccccccaaagugcugggauuacgggcgagagcuacugcucccugccugucuuuugucuuuuuuaugagccugcaucaaguugggggaagcuggaaugccuuaccaaaagggcuuccaagugaauuuucaagucaguaacagcuucauauuucucuagcacgcaggucuggaugauagaccacauagugcaaauggaaaaacacuuuaggaaugccuuucagaaagucauuugcaauucugggggcuuugccuugcccauaaguagauccagguaggucuuguugggucacugauaccauucucaggagaauacuguucugccucuuacauucauuuuugugcuuccucaggucccuuucaacaaaguguauuaguugguagaggucaguaauaccaggucauagguuccaauuaagaccaugaauucuucagaaaaauuuugaaguucuucccuggauuuagaaaauugucuaugcuuuuguccaggaaguauaaguuacugggggaucauuuuggaauuuucaggggguuuuauuuuauaaaaaagcuguuuaacugcuuuuucagagaagaaagguaguucaaacgguaguagacugaauauucaggcaaaguaggauagaggggagcaguaguagugaagccagucuuauuuuccuugguauaugaggauuaucuugcauuuuuagcuuuucauuagcuuuuugcaaugaaucuuuuauaaaagcuauuuuugaauccuguuguuucuuuaaggcuucugaauaccaauuaaaaggagaaucccauucucucuaccaauuaauugggaggcuugggauucaaguacauuucuuagaugaacgaucuuguucuucuggaacggucuucauauggccauuguaauucuaaauuaucuuuaauaagguuuugccacuucuguaaguauaugcagcuuucaggcuuaauacucauacaugugaaagucagguguagucagaaggcugaguacucagcucuucagaaauuaaggauccuauuuuuaccuugagucuugggucucccagagccaagauaaaaaccuaagagggauaugccacgaguuugaguccuauaauguuucuacaguauacuucauugcauggauauuuucuuguggcugcuggacaacuuuauguuaacugacccauucccugaccaggcuuaucuucucaugguagucuuauuuuuuagugauggguugcucuaauagcucuuacaugccucacccguuuccaccagucagguuauggcuuuggcucugacauuccacugaucaaccuagccaaugauuuucccauuucucugugaaccagacaccugaggccucucuuaccugaguguacaagaaaaaugaagaauguagaaccaacauaacugcaaauucugaaaacuagaguucgugcccccugcaguaauaaccacuuaguucaaccacugucgguuacuuuuaaaacugcagcucuugccagugacuccucagcuacugcaaauccaaaagucaagugccuucucacagcacagauuaaccccaaaccacagagaucagggaacucagggcaaaagaaagcaaagcuugaaagcaaagcaaaagaaaacaauuuuccgggcuuccugaggaagacagaggauccaaaaggggggucagcagcaccuuuaccauguuccucgaggucucugggucaugggucaucagaaaucuccuucaugucccuucauauggccgccagaacugucaaaagacaaaacuacaacuaauuuaguuauaagucuguuugggccccuuauuugguuuguucuuauuaggaucuagcacaggaaggagcucaguacaauggccucccauaauuuuuguuuagugcacccaaccuggagauguuuuugggaauacucauuacaauugaacgaaucaguaacaauccaaaacaaaaacuuuuucugugguauuugucacaaaacaaagaucaagucuuugaauaggacaaauaaugcuuuguaugcuuuaaauuuuuauuguuaagaauguuauuaauauguaugguuauuuuucacaauuaaugauguuuuugaauuuauuugguuuuaagguacccuuuuaauguuuucuguuaucaaauaucuguaucaaauaaagagcagucuuacauuuuauugguuuauaaucuugucacaauauauugauuuauaaucauaauaaaccaaucauuuauuauuacaucuuuuuaaaaaaaucuuugaaacuuuaaauguaaccuuaccacagaaaaaugauucauuauuuauuguuacgcuuacuuauuuuuucuuucaauuguuuuauugagauauaauuaauauaccaugcaauucacccauuuaaaauauacaaguaacugauuuuuaauaaauuuacagggcuguauaaccaccgucagaguuuaauuuuagaauauuuucaucccccucaaagaaacuccauaaccauuaucaguaaugcccauuuuccucuaguacuccuccugcaacccuaaauaacuuucuaucuguauaaauuugccuauucaagauauuuuauaugaauggaaucauacaauauguagucuuuuguggcuggcuuauuucacuuagaaguuuuucaagguucauucauaguguauguagcauguauuaauacuucauuuauugccgaauaauauuucauuauauggauaugacacauuuuauuuaucccacucaucauuugauggauauuuggcuuguuuccacuuuuuggcuauuagguaugaauaaugcugcugugaacauuugcaugcauguaugaauguaugcuuucauuucucuugcuuacacaccuaggagugaaauuacugagcuauguguuaacucuauguuaacuuuuuagguaacugucaaauuguuuuccaaagugacuauaucauuuuacauucccaucagcgauguaugagcauucuaauuucuccauauccucagcaauacuuguuauugucucuuuuauuauagccaaucuaguggguauaaagucauuuugauuugcccuucuucaauggcuaaugauguugagcaucuuuucaugugcuuguugaccauucgugcaucuuuggagaugugccuauucagauuccuugcccauuuuaaaauugcauuauuugucuuuuuauuguugagcuguaaagaauuuauauguuuuuuggauacuaggcccuuaucaaauacuuguuuugcaaacauuuucucccauucucuggguuguuuuuucauuuacuuuaaaacuuuccuaacuuugguggaauccaguuuaucuauuuuucuuuugguacuuauuguauuuaagaaaccauugccuaguccaaggucaaaaagauuuacuuuuauguuuucuucuaaggauuuuauaguuuuagcuuuuauauucaggucuguuaauuuugaguuaauuuuuguuaaacuuuugaguuaauuuuugaguuaguuuauguuaaauuuugaguuaauuuuuguuaaauuuuuuauuacucuuucuaaaaacauuuuuaaagugcugugaaaaauauggaauaacuuacgauuacaggggagaauuucugacaauuuugcuuuuucauuccugaauucugaagauuuauaccugucaggaauuuggggacacuagcuggugcaguuuugucugccugauaguaaaggcccuuagguaguuuacucuuugaacaggugguggcagcagagcuuuaaugaauguaaauucucauuuuuucccuaaacuuaguguuuuauguuuaagaauccuguauguauuuggacugccuucuuuuugauaauagguuguuaagcacuaaguuuaaaguuccuuuuaagauuauuuaagaauuguuuagagcuuagaauuuuagggguuuguuuuuguuuguuuggguuugauuuuucaccaugaguuuauucagacuucuguuugugagucuaguuuguggaguauggacaugauuugcuugaggucuuuaaccugcggacacaguuuuuuuuaaauuucucuaauguguuuuauccaccuuuucauuauucacuacuaccucaugaucuucauagagagguaaaguaauagaguaacagucaacauguucguuaguguuaaagcuguucucaagcuuacuccugaaacaaguuggcagauuuacauucugauuuugaggauagauaauauagaaguuggacccaugaguaaccuuuuuucuucagcaauaaaaacuauauuauauaaucucgugacuggaccucauaugucuuuuuuagaucuaaauauuaaacaguaaaauuacaugaugccaguauuccuugacaauuguuuucaagacaauaauagagauaacauuuauugagcacuuaguguuugcuaggcacuaugcuaaaugccuugugugcauugccuuuuacucacaacaguucucagagguaaguacuauuuuugcccagaguuucuagaggaggaguugggcuuagcguagagaaguuaaauaauuugccugaggucacauuaguagaugaagaguguguguguguguguguguguguguguguguguguguguguuuaugagcaauuauauugcacuuuaguguguguauguguuuuacagaguugaugguauacuagcauuauucugcaucuuguuuguuuuuaaauucaacagucuguuuugaagauguauagcucuugcugcuacauguacauauuuggucaauuucuuuaccuaaugaguagauaauacuuuguauuuguuugacuuagcugcugaaaaauagcauauccuggaaucucaccaaauuuuagcuuuacuucauguuuccacuagaggguguauaaaauauuugacuuaauuuuuuuuucuguuacuaaagcuauaauaguaauggaguaauguguuguuucuuguuauaauaaucagaaagaaaaauuuuaaugaauauaacagguaugauacucucccuuguuuuguuuuauucugcagguuacucauuuuuggauccuaugacagagaggcaaauguucauugcacacuugaguuaagcaguaguguuugggaagaaaaacagaggaguucuauuaagacgguaaaauggauuuacagugauuuauaucuauauaaaguucuauuuuauaagcaugcauuuauuacuauuucuguauuccuagaguuauuuuuggucaugugcaaauagcuaugaacaguucuuauuuauuugucucguuacaauacaacuacagugauaaaguaaaucacaagaaacuauaaauaguauucauauuaccugcacaagaaaccuaguccgacuagcuuuccuuucagaacuuuaagauugcuucaguuaugaaauuagaaggaacuaauuuuaacuaaacaccuucaaauacaugugaauucagaguauucauuauucauucauuggacagauauuuuaugagcacuuacuuugugcugggcacuguuuuagaugcaagagaaacuguucaagacaaaaaaggccccuauucuugugauacuaacaugggguagauuugugguauggggauuagaagagggaggaggugaucuacauuuuauaggguaaagauagaacacaguaauaaaugguaaacaaaaaaagugaacaaagcuauucccaaagauucacaggugcuaugaagaaaauaggcauaugacagaggaauuauaaguuaugauaaaggaggcucuuuagaucuggugauaauaggacucuaaagagaugacacuggagcaggcuuaccagaggacacccaguuaaaucugaauuucagauagugaauaauuauuuuaguagaagcauguacccaguacuacaggauaacagucaaaauccugcuaagucuuuaauggacaacuauguaguauuuuuauggauauuccuuugacuuuuaaauuguuucugauuuauuuauguauuaacuguugugaacaucuuuauauaaaaauugggcaguaugaaauuauuuuggaagaaagaggguaauuuugaucagaguggagaaggagggacaagaaaaacuggaaagggaggaugguuggcccacaguguuugcguuuaugaaagcaguggggagcuguugaacauuuugagcaugguaaugacauggucaaaauagagguuucauggaaaguuuccccuuucuuugguggcuguucuugccccaaccuucuuuauguuauaucucaaacaauuugaagcaauuccucagaagauugaaauaacuagcauuagaauuuguuuugaaauacauaacuacaugaagaagcauuauuguuuuguccagcuaaauuuuugcguuuacuuugaauuggucauaacuugccauugcuauuggcauuuucaauauccuuuauuauauuugcaaagauaugagauuagacaguucuaauauuuuauagcaaaaauugguaagacuuuaaucuugucauuauuuuagaucuuaguauaugucauaaguaguguugaggaaagaauucuagguuauuaauuauaucugauguugaaaaugucagcaaagugucuacaggcauuaaauuacgaaugucugaauuuaauauuccuagggaggagaauuauuaguuccuuaagacaaaacaucagggaguaggauucaauaauuuguaauacauuacaaauauggguagaaaauagaacaucauuaaaacaauuaugcuaaauuauuugaugaguuuaggaugcuaucuuuguauaaauacaaucucuagauuuaaacaguauuuaauguugaaauuuguucagucaaguuagucacuaauuauaaugaauauacagaauaaaagaaacuuaauuccugucauacuuuuaaugugccuugaguuuuuaaaggaguauaauacuguaaucuaggaacauagcuuccuccuucaucuucguuagcauggaguuuuugcccugaugguugcaagaugucuaaugcauccuuaggauuuuaccuuucaagaaaaaggguguggucuaaagcuggccaaaagcacaugucagccauguccuuuuuaaaacuuuccuggaaguuccucccagggauuuccaguuauaucucauuggccagaagugaguccuauggccuccucagcagcaagaaaguacaguaugagaagccauuuuaauuuuucugccuuuguagaaguagaaggcaagggagaaacggaguuaugaauggcuuuuauguagccaguccacaagaaaacaaaucuauuugaugaccuuuucauuuuuuauuuuuuuagagacagggucucgcucugucacccaggcuagagugcaguggcacaaucauggcuuacuacagccuccaacuccugggaucaaguuaacccucccaccucagcuuccaccucccgaguagcugggacuacaggugugcaccacuacacucaucuauuuauuuuuaauuuuuauuuuuuugguagagacagggucuuucuaucuuagccaggcuggucuugaacuccuguccucaagcaguccucccaccuuagccucccaaagugcugggauuaaagggacuagcugucacaccuggccaugacuuuuuauuuuuaagggaauuuuuuauaaauugggacauaagggagaaauugcaaagaauaauuuagcaaauacccuacauaaagccuauuuuagaaauaccuuauuagaaauccaagaaaaguuuggagcaaacucacucagaccagugcccugcuuagcucauuuauacaauaaaagagcucauaggauaaaugagguaccuugugguuguguuuguucuuugaaaauaaugaagauuccucaugagaauccuauaagccaagauagcugagguauaaguaaauuagauauuaggcuuaaacaaaaauuaggggaucaucuuacaagagaugacagaguaaauacuaaaaauuacuuuaccacaccagaaagagacagugcaauuugugauuuauuucggguccauugcaguauuccgguuuggugaucauacuuugcuuaacuuucaccaagaaagaaauuuaaggaguuuucagauuuuaaaaaguuucaggccaugauauuuuaguaauaaacuauaaaaauaucuauaaauaucuguggaauguauagugcuuacaaauaaaauucacaauaaauuaaucugacauauauuaaagcacaugugaaucauuaugugccugguuagcgccacagaacacauaaaugucacaguagcacacauuguuugaaagagagagauccuaaguuuuacccucccagaauuggaguuuucuugccacugaccacccaguugcuuuaccccuaguuccagacacaaaauagauuauuguuuuuuuuuuuuuuuuuuuuuuuuugagagagucuagcucugucgcccagacuggagugcaguggcgcagucucagcucacugcaaccuccaccuccuggaucaguucuccugccucagccuccugaguagcugggacuacaggcgugcaccacugcacccagcuaauuguuguaucuuuaguagagacaggguuucaccauguuggccaggcuggucucgaacuccuggucucaggugauccacccaccucggccccacaaagugcuugaauugugggcaugagccaccgcgccuggccucagacaccaaauagauuauuaauaaaaguuuuguucucuuucccucucucuuccuauuuuagcuagucugccugugccuucuguaucuucucuucaucauuuauccacacugacucacuugauucuucaaauagguuguucuauuccaacucuauccuuccaauuuggaauguuugaggccacuggggaagagaagguaccaugaaaaugggcucuggaaccucugaaucugggaauucuaggguagaggaaaaggcaguaggggcuaguacaaacacccaccuauucuuucauucugaauaaaaggauguaaggaguucugauuuuuagaaacaagcguuuauguacauuuucugaugcuaacccuacucuccaucuuccuucaaccuaccacgcucugcauucagguacuugacagcaauugccuuucauaagagaccaaguauuucccuuugcaauuagagacacgagguugaaaauccaaacaauauugguauauaaauaugucacuaucagaaaggaaagaugaauaugaauuuuuuccucuuuugaaauggagaggaaauuauaaaagaagcuuuugcccuuguuuaaaguacaugggcagaagagagaacaaucauuuguucaguauaaguaaaagaguagaaguacuucauaccuuuuguagcccaguaugcagguaccagagggaacugugguuaaaggcauuaggagaugacaugcuacuucagaucuaccuaaaaagcaagaagugaugcaucccugaaaagcauucagcuaacaguuggggagaagcuguaagugauauauuggaguucuuaaucagaacaguauauucuuucugaguguuacaugguauuaacuggcaaccguuauaagaagggcuuuagauagggucagccauauuuaaaauugugaagccugaagaauucaccuccuagauuuuggacuuuuucuuucuguuugaauugagugguauuuuuucuucuuuuuagaaaagaaagcuauuguuuucucaucaaaguguaauccgauucuaaaagguaaaucauugauaccagccuccuaucaauuuuuaaacaugcccauacaauuaaagagauauuugaggagaugauaccuauauucuaagaacuacugccaggguaagaaacaagauaugcaaacaaaaugucuaacauauguagcacuuuagaaucuaugaaauacucuucccauauacaaagagccaaagucuucugacuauaagaucucuacuuguuugauuaaaucccacuaccucuaacaaaaacuggacugugaaugguauucaaauaauuaguagugaugauaaugggaucauuuuagaacagaguuaaggagagaucugaaaguauggggagaugggauuugaauacaagggccuucaaaauacgaucagccauguuuacuugccuaagauuaagccugauucagagacagucuggcuuauuauagagcccagugagucuuuguuuacuuccagaguaaugauuagggcaguugaauucaggaaagacuuaguguaaaggaaaaguaaucaguugggagaaaaaaacaguauuuagggaaaucauuccugauacaaagaugcuaaaugagcauauagaagaaaugaaaacaguaaaugcauuuucaacuuucagaaagcuuuugaugaagauccauaccaaaguuucccaacaucuaauuccuaggagaauauuuugucacaauuagaucuggcuuagagaugugggaaacaggguaaggaugaucagguauaguguccugaaugauugagcccgagacuuugaucauuuuucauaaaugauuuaaaacagcacuaauagaaauauaauauguggcacuuacuuaauuuuagauuuucuaguggacacuguaaaaaacaagcaggagaaauuaauuuuaguaauguuuuauuugacccauauaucccaaaccuggucauuuugacauguaaucaacauaaaaaucaaugagauauuuuacauucuuuucuuauacaaagucuuugaaaucugguauauauuuuacaauugcagcauagguugaauuucagcuacauuccaagggcucagaagcaugugacuaguggguaccauauuggacagcacagaucuagaagaaggaauguacaguauaaucuucagauuuacacauggcacucagcucagaagugccagguuaagaaguagaauaugaaggaagaacucucaggacaaguauguaagaaauaaauccaaacuacacuuuaaaauaugagaucuaggauucuuaaagaaguagucaguaugucacugugcuuccaaaacaagaaaucugacuuuucaugaaagaugucacaaaaugaaaucuuuuuauacccuuauuuuaaaacuaugaaauucucugggaauaaauuauuugugcauuuaugguugcuauaauacaaggaauuuaaaacagaacuggauagggcgaggacaaauaauuaaaauuaacacggaaaugagauagccauauaaagauaaauggaugggaaaaaaauuaguguucuucagcugaaaagacaaaggugggugaaugacuaauggaagcauauaaauacaaaaaguaaacaauaaggauagucagcaaccuuacuggaacuaaaucuguagagcaaugaagauaaaucucauguuccugaugauaaucagaugauucacgcuaaaagaauacuuaaaaggucuucgauaauccagcaugcuagacacuugcugguagacuucacagagacacaaacaugcuguauuuuuuuuacgcuauguauccugcaccuaguagaguuucuggcuuguugcaguuuagugaauguccugggaggaaaggggaggaucaaugaacuuuugagauaaaaaucugauuuuaucaguugccugccucagugguuucugauugcguauuguaggaugacaaauuccagcccucgcaggccuggucccuauuuauuucucagcccuccuuucuccccugccauucuccaguuuagccaugcuuucacuccuccacacuugccauacucucuguccucuacacagccaugguacaugugcacucuacccccaacucauuucuccccauacaaaccuugguuaacccauucauccgaucucugcuuguguuagaccuuagcuuguuugcccucggauacauucuugggcccuucccugcuguaugccaugagagggcugaccuuugcaggcuguauuucagcuagguuugaccaauguaaagcacugaugggaaauaggagugaacugggaaagccaggguuuucuuccucuuccccccucugcauuggacaaugugucugacagccauucuuucuccuucguggcaccaugcuucugacaggacaggcccaccauauuuccagcuucugcuugauacuguagccucuggccucuacuaauaccaccucuuccucccccugcccuuccuuccagccaaagguugauaguaacuucuuagaacuguuacucauaucugaguguccucacugucuccuguuugguacucaguucuucugucaccaaguagccauccucuguuuuaaagggcuuccauauuaaauacuuaguuuucuguuuucuuagagccuauuaauaaaacaguaaucaucauuuccucuggaaaccuuuccuaacuaucaugaaacuccuugguaaugcuuaucacaguugggauuucgcauuuauguuucuaugauaaugugaucaguauugucuccagcaauaucuuccguaucagcagguaccaugauuguuuugcucauagcacguggcauucaguggguauucaguaaauguuuucgguaugacuaaggcuggcugucugaccaugagccuucauacaaccucaacccuucuucuuccagaccuucaaaguuuuagcgugacuuuuagucacacuucuguuuccuuuccaucuucaaggcuauuccugauguauguuuuaaccaaauaaaaauguuuaggguaaggaaguccacaaaaugagagauauacuacucaauauuaauuuugugaaaagccugauuuuuagagugaggauuuuaguuuacagauguggugcauuauaguauuuuauuucuggcauuacuaaacacaucaaaaacauuucuuacucuauguguauaguuuaauguaaccuaaauaaaaugacuagguauaaucuaaaauuuuacuugccuuacuucccuuucaguuuuggagaguuuuagaagucuugcugaaugaaauugaaugcaccuacaagcccaccucugucauguauuguugaauguacauacaaagaguauaaaagagcuuccuaaagaacugugauuucaaguaagaauauuugagacagacaaacuuacaaauacguuaggccagaugccucagaguuggcauuuugguguguuuuuuuaaggccagauuccuugcagauagcauuuuggugcuccuauuuaaccauuugccauuuacagucuuaaucuuaucaaaaggaagagaaagauuaaagcaaauaaagccuuuuugaaaaugucaguuuuuaugaaaacucagguuuaguucaauuugauaauacuugugaauacaguagggacucaaugaaauuuuaaccauauauaacauucuauaguuuggcuucuuuaaaugccuuugagcuuuaauaguaaauccuauggaacauuucuucucuuaaaguucaucuugauuaaaaaugagggauguaguucucugucuuagguuuucuaaguauguuuacuaugauucuaagaugcuggggaaagaauaggaaguuauguuaaaauauacaaacauaaacucuccagaucaaaucaguggaaggcacuaugaguaugagaacaggaaacugaguaugagguguaaggcauuguaucaucuuucccuucaaggaaaauucguaguagggaaaucagagcaacaguacugugaguaucaguaguacugugagguuccaaugagggagaaguaacauucuuuugggaaaacaagaaaagaauauauuaaggcggugacauuugaaccaaaccucauaguauguauaggauuuugagauggcagagaggccaguucaagaugaggacauaacaaaauccccaguuaagagugagacuauuugaguaucuuugagauagagugaguuguucaaguuggcuaaagaauaugauagcauaggaaguuaugcaaaacaagaauaaaaaggucggaccaccuuauagaggacuuuaaauaccacacuaagaaguuugccuguuacucuccaagacuguuggaccucuggaggcuuuuagaaugaaagugacaucagaaucuuucuucaggcagauugagagcuggauuugagucucagcuaggccacuuuuuccagcaugaccuuagucaagaguccccaaacccguuucauccacaaguacuuuauucuauaaaaugggacugaugcuucuuaugguuguaugaggguuaauugagauuaaauauauuaaaauguccagcacaguauuuagcacauaguaguuagucaauaauguuuauugaaccuggcagcaauggauaaaaucaaggaugauuugauaggguaaagaccugaaaaaguagaggugagggguaaugaaagucugaacuagaaagguggcaauggaaauggaaaauagagucuguguggcuugaauaccacugggaauggaggguuuuuggagugagcaaggaagccagaaagaugagcuaugaggagggagaaggaaaaggagaaagaggaucucauucugugcaagcuguuugagguauagugacuaucaaaggccaggcuagagauggaauguuuuucauguggugcuuugaucuacuauguuuuuuuuuuuuuuaauuuuuacugcuguuauuucaacuuuuaguaucuuaacuaauaaguugaaugcuuugagguuuaugcuauguuuuuaagcucucuuuuuuucauauaggguaaagaaaagcaaaguaguuucacaguauuguaguaagaaucuaaauuuuuuuaagagcaaguuaaaggaggcaacagucauaaaacuuaaacauuauuuuuagguucuguuucucagaauccugcaguuuacugagauucaacuaaaacugauucacacaguccauauauucucacuaguuaaaacauccuuuucaaggcacaguagcaccuuccuauaaaaauccacuuagccaaauagcugauuuucugagccauacacggaugcagaacuaggacauaaacacacacuuuaggaaaguauuagagagauguuuugggagaucuggcaguagcauucaacucccuguccacauauauucaguccagugguagucagcaauuacaaguuucugcaauuuuucugugccagucauaguuuuaagauuuuacaugcauuaaccauuuaauccucauuuaacaauaccauaauaauaggcacuauuauuaucucuguuuuauauaugaggaaauugagauguaaagacagaaguaauuuauccaaaucacccagcuagcuggcaguaaaaacagucugcaaacccaggcagugugacuccacagcugauguucuuaacuaguacuauaucauuuccacaaaugguguccuauaggccuggguucagaucuagcuuuuuccacucucgcucuaugacuaugagcaagguauuucauaaucucuacaguagagguaauaguaacugccuuacaggauauaaggguuaaauguauguaaaacccuuagcauaauaccuggcacauaauaucuauuauuauuuaacuuaaccugauugaccucuuuuguuccuaugguuuuagugcauauauuuuguguguccucauaaauccccuacacucacucccuuuuauuuuauuuguuuauuuuuucuuguacaaguuuauaagacccuuuuaaauccuuccuguaacaaugugaggagggcagggagaguauccuccucaaucaugagauagugguauuguuguuguuguuuaagauuguguucucaaauaaugacuugagaauaucagcaagcuuauuaagagcuguuauaaggaggauggagaucaguagcugcugcccaugucaacugaggauaaaauauggacaagcauuuauauuucaucaggaauauuuaagauaagaaauaaagaacuuuuuaggaauaaagaauauuaauaucauagcauggauguuagugcuuccagauaguuguaauuaauaacagaaaguuuuaaagcauuuaggaaguaguucaugauacuucacuauuugacaucucuaguuucacccauuugcauuuugcuguaaaugugaaguucuauaauauacuaauugaagguacuuuaaaaugaauaagcuaaaaguaagacuaguuaaaauuuuuguuuuugccuucaaacagguaaguggaaagggguagaaacagcaacacuuaauucguaugucuuauuaaacccgucuuuguaguauuuucauuaguuauuguguauuucucaacuuaaauauugaacaugaguagaguuuaaagucgauuugggaacagccguguuucccauuuguaagcauguugguuuacauugauauuggauuguacuagagaaauaggugguuauauuugaaaauuguuuguguauaaacaauaugcccuaugcuggaagagauaaggauguuuuauuaacuacuguaaauaagacuacuucuggauaauucauuauauuuuuuaaagguuaucuaguaauucuuagaguauggacagaugacuuuuuuccuaaaugaaugauugugaauuaucuuuuguaaguugaucaauacugagaguguugucagaaguuuaaguaggaggccauuaagcaaaaggaaguaucaugaagcagauuuuuaauuuuugugaugauacacucauuuguuugcagaaacuugcauauuuuaacaaaaucaaccuguguaagauaaguuauauauguuuagaaauugguaugggcaauuuucccccauuuaaaaaaaauuagaaaccuauaaagaagacuacaaaagucaaccauaauuccacuacccagagagaucacuguuaacuuuuuagaaaaaacuuuauaaacauacacauacacccauugcucacauacgaauaugcuuguguguucuuaaagcauaaguagccaacaggcaguaguuuacuacugauguaaguaaucccuuggucaaagauuaugcaaaaauaaaaggcuguugauucauauuucaaauuauauuucagcuggaauaaggucuguagauuagauaauaguauuaucccaauguuagcuuucuaacucuggcaguuauacugugguuaugugagagaauguccuuguuagguaauacaugcuuaaauauuuagaaguuaaugacaucauauguauaacuuauuuucaaauaguucagaaaaauaauaugcagagugaaacaaauguggcaaaauguuaauaauuggaaaaucuggguuuaggauaaaugggaauucuuuacuaguuuuggagccuuucuguaagguugaaauuauuucaagauaaaaaaguaauuuuuuaaaaaaaaaccuuauuuauaaaaaaaaaaacaaaaccuaucuguaccuaaggcucucauacuuccuuaguaagauguaagucaucugcagaaguagagugauacuauaugaaguugaggccugaccuggugauucagaauaagaacuguuucuauuuaacaaaggaauuaaaaagggcaagaguguucuacucuguuguucaccugacaaccucggccuuugcauauuuuacugaaauuuuuauuuuacuggaaugguaguauaaaauuuaaauuuauuuccaacaucaaucauuguaaaagagagagaaaagaagaaaccuuaaguauauugcaagguaaucauuaggauguaauuauuuuccuaacagccuuuugaaccugagcagaggaucauuuuuauuccuuagaucucuuaaauugguuauauuuguauaauagaguuuacuuuuugauauuauacuucuagaucuuuguugucucuuagaugaggugaccaguggauacauucccgauuuaccauccaguugcuuuagaaaccaaguuaucaaauggccaagcuggcauucuauuuugaagauugaggggggucacuuguauuuucauccagaaagaaaucuucuugaggggagauaacagacguaccuguaccuagauugcgccagauguuuaugccaauaguuucauuuaauguugacaacaacccagugugguagauaucagaugucaccguuuuaugguuaagacucacaggggcuaaaucacuugucuaaggugacaaaacuaguaaauguuagagccaaaacucaaacccaacucuuagaacaaagccaugcuagaugacauggaagauuuucuucaaaaacuaauuuuaaaucugcccuaguucuuaggagaggcugacuucagcagcuucuuagcuauccauuaaauguuaauuucugaaaauuuaggcguuauacaaguugagcauuccaaauccaaaaaucugaaaugcucugaaaucugaaacuucguaucaccgacaugacacuuaaaggaaaugcucauuggagcauuucagauuucagauuuccagauuugggauccucaacaugugagauaauuuaggauucauuccuuguacuauucaaaugcaccccuauaagaauaucucucucucucuccauauauguguguguguguguguguguguguguguguguguguguguguguauguguguguauauauguguguguguguguguauuuuguuuguuuguuuguuuguuuuugagacagagucuugcucuguugcccaggcuggagugcaguggugcaaucucugcucacugcaaccucuugccucccggauucaagcaauucucgugccucagccucccaaguaggugggauuacuggcacgcacuaccaugcuggcuaaguuucguauuuuuaguagagaugggguuuuagcauauuggccaggcugguuucgaacuucugaccucaggugaucugcccaccucagccucccaaagugcugggauuauaggcaucagccaccaugcccagccaagaauacuuuuuuauuauacaguugcugccauauaucugagggcucugcaucuuuguauucuaucaacagcugaugaaaaauaugguauuugucggauauagaacccacagacauggaugacuuuuuguaucuaaaaguuccacagggcugacuguaagauuugagcaucagcagacccaguguccauggggguccuagaaucaguuuucuacagauacuguauuagucuguuuucacgcugcugauaaagacauaccugaaacugggaacaaaaagaggcuuauuuggacuugcaauuccacauggcuggggaggccucagaaucaucucaaggcaaaagacacuucuuacauggcagcagcaagagaaaaaugaggaagaagcaaaagcagaaacccccugauaaacccaucagaucucuugagacuauuugcuaucaugagaauagcaugggaaagaccggcccccaugauucaauuaccuccccuugggucccucccacaacacaugggaauucuuggagauacaauucaagaugagaauuggguggaggcacagccaaaccauaucauuccccccuggccccuccaaaucucaugucuucacauuucaaaaccagucaugccuucccaguaguccccaaaaagucuuaacucauuucagcauuaacccaaaagcccacaguccaaagucucaucugagacaaggcaagucccuuccgccuaugagccuguaaaaucaaaagcaagcuaguuacuuccuagauacgauggggguacagguauuggguaaauacagccauuccaaauaagagaaauuggccaaaacaaaggguuacagggcccauacaaguccgaaauccagaagggcagucaaauuuuaaagcuccaaaaugaucuccuuugaccccaggucucacauccaggucacgcugaugcaagaaguggguucccauggucuuagacagcuccaccucuguggcuuuacaggguacaaucucccucacagcuguuuucaugggcuggcaucgagugucugaggcuuuuccaggcuuaugguacaagcuguugguggaucuuccauucuggguucuggaggaugguggcccucuucucacagcuccacuaggcagugcccugguagagacucuguguggggggcucugaccccacauuucccuuugacacugcccuagcagagguucuccaugagggccccaagccugcaguaaacuuuugccugggcauccaggcauuuccauacaucuucugaaaucuaggcagagguucccaaaccucaauucuucugugcacccacaggcugaauaaggcuugggggcuuccacccucuaaagccacagcccaagcuauacguuggccucuuucagccacagcuggaguggcuaggacaacagggcacuaagucccuaggcugaacacagcacagggacccugggcccagcccaugaaaccacuuuuuccuccugggccucugggccugugaugggaggggcugccuugaaggucucuauauggccuggagacauuuuccccauggucuugggauuuaacauuaggcuccuugcuacuuaugcaaauuucugcagccggcuugaauuucuccccacaaaauggauuuuucuuuucuaucgcauagucaggcuccaaauuuuccaaacuuuuaugcucuguuucccuuauaaaaccaaaugucuuuaacagcacccaagucaccuguugaaugcuuuucuucuuagaaauuucuucugccagauacccuaaaucaucuuucucaaguucaaaauuccacaaaucucuagggcagggguaaaaugcugccagucucuuugcuaaaauauaacaagagucaccuuuacuccaguucccaacaaguuccucaucuccaucugagaccaccucagccuggaccuuauuguccaugucgcugucaguguuuugggcaaagccauucgacaaguuucuaggaaguuccaaacuuucccacauuuucuuuucuucugagccuuccaaacuguuccaaccucucugccuuuuacccaguuccaaagucgcuuccacauuuucagguaucuuuucagcaccgccccacucuaaugguaccaauuuacuguauuaguccauuuucaugcuucugauaaaggcauaccugagacugggcauuuuacaaaagaaagagguuuaaugggacuuaacaguuccacauggcuggggaggccucagaaucaugccaggaggcaaaaggcacuucuuacauggaggcagcaagagaaaaaugaggaagaagcaaaagcggaaaccccugauaaacccaucagaucucaugagacuuaauucacuaucacgagaauagcacaggaaagacuggcccucuugauucaauuacgccccccugggucccucccacaacauaugugaauucugggagauacaauucaaguugagauuuggguggggacacagccaaaccauaucagauaccaaggcacaacugcauauauaauuuuugucauaauugagauacagcauuucuccuuaguugagagauucuuuuccauuuaucuggcuuaugaguuuaagaacuuuucugauuuuauaucuuuaugaauuguuuaaauauagugacaggucuuuugaaaaguucugugggaguugauaguaauuuuuaugccaagugauaaaaacaagacauuugccauaugucuguuucaaagaguuauacuuacuuugaaaaagauggugugauugugugcauccaaauugugaauccucuuugcugguaagacaguuucaaagaugacaccuaguaaaugugguaucuccuuuguuuuucuauuaaagugauggaacuaaauggaaaaugauugagaauauaguggguuccuuggaacaaggucuauuguuuccaaguaguugagggucccaugaaguauuucaguuuauaucuuuugugcuguuaaaacugccuggcuuagaaguaaauuagauugauaccagaaggacccuucagaagcucaguauuuuguuucuuuucauguguuuucuuuguuuuguucuagaaccuagaaauuguuuuauuaacuuuucagaauuauaauuuacugaaauaugcuuuauaaacagaaauugaguaauaguagucuaguucuaacuuagucacuucuaaacugaaccacauguuacuugaguuaccuuacacucaaggguguuugugggggcuguccgggggagggagagaagagggaauuagaggaaaaagggagggaggagagaacaaaaaugaacaagaacaaauguguaucucuuuguguuuagccuaaugcuaauggaguuaguugggaucgucaauuaugguugugauuuuuaaaggugauggaugguaaaauaggaaauuuagcccuagaucuucaacagccuucuugcugccucuaauugggauggacaguaagcugguagucccucacuuggcaguaaauuguauccuuuaaccauaaacaaauugaucugacaucuggcauuuaccgaaauagccagaguugcucauucagaaaauguaaccaaaguuacauuucuaacauauuuucugccaaguauguuguacauagaaguucaccuugcaaacagcucaguaacuuauuuaauauaaaaaguuguuuuaguuuuagaaaucuugaccucucaauuguaacugaaaauuuggaaauaauuaucuuauacuuuaaucauaauggcccaaguuccugauauucagaauucaauugccaagugccaaaagcaagccaaacaaaggugauuuguauacuggucccucaaaaaugaugauuuuuuggccaggcgcaguggcucauaccuguaaucccagcacuuugggaggcugaggugggcuaauuacuugaggccaguucaagaccagccuggccaacauggugaaacccugucucuacuaaaaauaaaaauuagccaggugugguggcacgcaccuguaaucccagcuacucugauggcugagguaagagaauuauuugaaccugggaggcagagguugcagugagccaagaucaugccacugcacucuagccuagacaacagagcaagacugucucaaaaaaaagaaaaaaaugaugauuuuuaguugcugccuuaguccauuuggacugcuauaacaaaaauaacaaacugaguggcucguaagcaacagaaaugaauuccucacaguuugagaggcugggaaguccaagaucagggcaccagcagauucacugucugcuggcuucuugauucauagcuggcugucuuuucccuauguccucacauggcagaagggauaaggguguucucucaggcuucuuuuauaaggguacuaauaaaagagggcuccacccucaugaccuaaucaucucccaaagaccccaucuccuaauacaaucauguuaggggguugggauuucaacauauaaauugguagaagguuggggaugggggaacacauauauuuaguucauagcaaucgccuuuggaagaucuguagcauguagaguuuugguuccuucaaccaaaggagcuuuuuuauauucucaugagcagaaggacuaaauuuuauaaacuuaagaggcuuugugacagaaauguuuggaugcuacauuauagaaugguuuuugaagaccauuuuaaaauuugaauaaucugagaauauucagaguauuuggcauuaacaaauauuucuacuuucagacauguuuuccaaaacuuccauuuauauaagcaaauuuuuaaagagucucuguacuuauuagucuaauucuacuccugcuuauuuaggauguuuauccagccagaggaccacgaaacaaaaauauugcauuuuucuggaauaauaggaauuaggaagccagaacaaacccuaagugguggcagcuuuuuaaaaugagggaauagcaggcccaguuuuuuuaaccugugagaaaacaggugaaauuagagaacuggccugguacugaaaagagaccuggaggaggagaggguaaagguguugauuugacaugggggggguuucucauauaaccugugcuagcauauagguucccuggccagucuacaaaaacccguguaauagcugaaagaaguggugguucuguuguuuuaaaaauguaggcaacaagaucacugcacacaagugcaauaguaauugaauaaaacaggauuccugcacugaggaagaaauaucuuccucaagguucuauaaaacccccaaaagaucacaccagcaauggauccaaaccaagaagaaaucucugaauuccagauaaagaauucaggggguugauuauuaagcuauucaaggaauaccaaagaaaggugaaaaucaacuaaaagaaauuagaaaaaaaauaggauauggaugaaaaauucuccagagaaauagauaucauaaagaaaaagcaaccacaauuucuggaaaugaaagacacacuuagauaaauacaaaaugcaguggaaaguuucaacaacagacuacaauaaguagaagaaagaacuucagagcuggaagacaaggcuuuugaauuaauccaaucagaaagagacaaagaaaaaagaauaaaacaaaauaaacaaagcuucuaagaaauuugggauuauguugaauggaaaaaccuacaaauaacugguguuccugaggaagaagagaaaucuaaaagucuggaaaacugauuugagggaauaauugaggaaaacuucccuggccuugcuagagauuuaggcauccaaauacaagaaguucaaagaauaccugggaaauucuuugcaaaaagaucauuaccagauucaaucaacuguggauugaaacccaaccguggacugugagggaucagauuuucuuuguuuucugaaagagaacuaaaacuauuaaauuuguagaugguggcaaacuuucaccauuuauaaagauuuugagugaaaacgucuauagauguuaauguuaauuccuuaauuguagguuaucuuuuggaauaaggaagcacccagauuuacaucuugggauucagccaacuacggacugaaacccagcuguggauuaggacugugaggacugugauggauauggagggcugauuguacugccucauuuugcauaaggccucauuauaugccucauugcguauguaucugagcauauaccgauuuugguauccucgagugggguccuggaacccuuguggauauggagggcugacugcuaaagauauguuuaaagaaaaaaaacuuucaagaaaaaggcuguacaagacaaaauguaaugaugcccagcuuugcaguaaacaauauguagucacaauaucguaaacauuauuugcugauuuuuaguuuuagaaucgaucaaccuuguagcuucacuguaguuacaaaaggaauauaauaguuauuaacuuugauaguagaguuuagaagguagaaguauaaggaggagagaaagagggaagaauauaaaguccugauaucagauauauauauugucuguaguugauaaauaagaaauauagggguauaacuguauugaugauaguuauaaagaaguuauguagaagaacuaaaaacagugcuguaauuacuauaauuugggggaaaggugaguagccuccuugccuguaauaguaggaagucaacacauugucuaaaauuugguauauuaagaaaugaugauguaugcauauuaucuagagaaaaaagguaacccccaaaacgacuaaaaacaaagaguuuaaaagcaguugcuaugguguggggaugggguaaaggggacuugaggagacaggacuauugcucuuguguuauuuuucuauauuugauuuuuuaaccacaugcaaguauuugauaauuacaaguucuaauucuuuuuaauaguaguaaaaacuugaguuacauuuuuuuucuuucagacacgcuguucuugcuucuuauaucugguuucauucuguaucuacagucuaguaauuccaauuauggguaggucaaagucaguaugcauuugauugacauaaguugaauuuaaaaaaccauauaaauauugcuuuucuuccuuauuaacuuaaggaucaucuaaauucauaccaaguugucuuuuauuaaauuagguaaauuggaaaacuaaagguuaucugaauuagugaucugcauauuuaagcaucuuaggacaaaaacuggcauauauaagguuuuguuuuugcuuuccuuuuaguagcuuuauuuugagguauaauuuaaacaauaaaauuuacuaaggguacaguguggugaauuuugguaauuguauacaaucauguaaccucuaccuucaucaagauagagaauaauuuuaucaccucauccauuacagauguuccucaacuuacauugggguuacauccagauaaacccauuguuguaaauugaaaauaguauguuuuuuacuuaacaauauuuucaacuuauaggcuuauccagauauaucccccauaauaaauugaggagcacacugaaacuguauugcuuucccacaucguaaagucaaaaaaucuuaagucuaacccucauaagucagggaccacuugcuauuuguguuacaguucaccucaucauuugaccaguuccuggcuuuuaugaaugaugcucugugaauauuggcaugcaagucuguguguggccauguuuucauuucucuuugguaaauaucuaaaaguaggauugcuggguccuauggugaguguauguuuaacuugaaaaugccaaacugcuuuccaaaguagcuguaccauuuuauauucccaucagcaauauaggagaguuuuaguugcuucacauccucagcagcaguugguauuguccaccuuuaauuuagucauucuaguagguauguaguaucucaugguuugaauuuguauuuuccuaauggcuaauugaacaucuuuuaauaugcuuguuggccauuugcauaucuucuuuugugaaguaucuguucaaaucuuuugcccacuuuuuauugggcuuuuucuuauuuaguuguaagaguuauauauucaugggucaagguccuuucucagaugaauguuuuucaaauauuuucuccuaaucuauggcuuaucauuucauuuucuuaacugucuuucaaagagcaaaagucauuaauuuuaugaaguccauuuuauaacuuuuuucuuuuauagauuuauacuguuugugucauguuuaagaaaucuuugcccaacucagugucauaaagauguucuccuguauuuucaucuauaaauuuaauaguuuuaguccuuaaguuuagguucauuuuccuuuucccauaaauuuuuauguagugugugagucaagguucacuuuuuucccuauucagacaucuacuugucucaguauacccuuuucccuauuaauuaaucuagcaccuguguccaacauaaauugaccauauaaguguuguucuguuuguggacuaucauuccauuauuucaugugucugucauuagaccaauaccacgcugucuugauuuaucuaacauauagcaagccuugaaaucagguaguguaagaccuccaacccuguuauauuuaaggaguguuuuggcuguucuugguccauuucuucucuaaaugccugcagggauuucgacugggauuguguugaauuuguagauaaauuugggaagaacugucaucucaacaauaaugaaucuuaugcaugaaccaugguauucuccauuuauuuaaaucuucuuucauuucccuuaaaauucucacaauaaugcaguauauuguaauuugcaacauauaggucuuacacaucuuucauuaaacuuaaauauuuuuaauacuauuguaauagauuugggauuuuuuaauuuuucuaauuauaauuccauauauucuauaauuuauaauuuuaauuguaauaauuuucugauauagagacacucauuugacuuuugaauauugaccuuguagucugugacuuaauuucacuuaauagcucuaauaguuguuuuguagauuucuuggaauuuucuauguauaggaucauaguaucugcaaauaaagacagaguuuuuuccucccuuccgaucuuuacacuuuccuuuuuuuuuucauuacacugacauuaacuuccaguacaguguugaaguguuaagagcagaaauccuugccuuguuacugaucugaguuauaaaacaaaaucuuucaucuuugaguuuuguguuauuuguagauuuuuguagaugucuaaucagguuuaggaaguucucuuauacuucuaguuugcugagggcuuuuaccauuaaugaauauuggauuuuguuaauuuuuuugcaguauugaaauauggcuuucuccauuguuuuguuaacacgauaaauuacauugauugauucacuugguuaugauuauuaucuuuuuuaauguauugcuggguugaauuuccuaaaauuuuguuaaauuuuguaucuuuuugaacauuagagagauuagucuauacuucuguuuucuuguuuuauguuugccuuguuuuauuuuuucuuucagaauucaccgaugaagcaaccuagcucccaacugggagggaguuuuuuguguguugggaaggaaggcuuauaauuaugaauuuaauguauauaauugauauaaccauguacacuuuaaaagaauguauuuugccauuguugaguauaauguucuauaagugucaguuaaaucaagguugaugauguugagguugccugugccuccacuucuuuuuucuaguuauauugguugcugagaggaugaagaaaccaaguuuuaccucuaacagcagcuuuaguaaaguuacauugcaaagagacaugcuuauaagaauaggaggaauuuguuaccauguuuuauggucuaccacugaguucauuuucagucuuuuuuggguuuuguugguggugguggguuuuuuuuguuuuugaggcagggucuagcucuguugcccaggcuggacuguaguggugcagucauggcucaaugcaaccuccaccuucccagcucaagugaucaaaucaggauaacuagcauagccaucaccgcaaacauuucuuuguggugaaaauauuaaaaauaaucucuuccagcuauuuuggaauauacaauacauuauuaacuauaguuacccuauugugcaauagaacaucagaacuuauaccuccuaacuguaacuuuuuauagccacuucugaucuccccacucccccuauucuccccagccucugguaaccacucuucuacgucuauuucuaugagaucaaguuuuuuagauuccacauaugagugagaucauacaguauuuguccuucucugccuggcuuauuucacuuaacauaauguccucuggguucauccauguugucauaaaugacuuuucucugggguuuuguuuuuuguggcugaauaguauuccacuguguuuguauaccgcacauuuuuuauccauuuauccauugauggacucuuagguugauuccauagcuuggcucuugugaauaguacugcaguaaucaaggaagugcaaguauaucuucaucauaccaauuucauuuucuuugacuauauacccaauagugggauuauuggaucauugcuaguucuauuuuuaaauuuuugaggaaccacuguacuguuuuucauaauagcuguaacuaaucuacuuucccacuaacaguguauaggaguuccucuucuuccacauccuugucaauauuuguuuuuuuguuuuuuuuuuuuuuuuuugucuuuuugguaauagccauuuauuugguaauaugugucuucucucuuguuucuugaucaguuuagccuauaggcuuaccaguuuuauuggucauuuuauugagucagcuuuuauugauuucucuauuauuuaaguaucuguuccauugguuucuguucuuuauuauuucuuugcuucuacuuugggguuuaauuucuuaaaauggggacuuaggucacuaauuuuagauuuuccccccuauauaagcauuuaaaacuauaaauuuccucuaaaacacuacuuuaguugcaucccacaaauucugauugguugcauuuucaucauuucauuugaaauauuuuuggauuucucuugugauuuuucuuuaacucaugaauuauuuagaaguguguuguuuugcucuccagauauuugggguuuuccuaguuacuaauuuguaauuuaauuccacuauggucagaaaacaugcuuuguaagaguucugucuuuuuaaaauuacugauauuuguuucaugaccuucuacauccuggugaacuuaccauguacacuugaaaagaauguauuuugccauuguugaguauaauguucuauaagugucaguuaaaucaagguugaugauguugagguugccugugccuccacuuauuuuuuucuaguuauauugguugcugagagagggaugaagaaaccaaguuauaccucuagcagcagcuuuaguaaaguuacauugcaaagagauaugcuuauaaggauaggaggaauuuguuaccauguuuuauggucuaccacugaguugauuuuacuguucucuguacuuuuguauauauuggaaauuuucuguaauaaaaucuuaaaagccaaacccucucaggugauauuauauuccagggaaugcauguugaagccacagcaugcuucaccauguacaggaaaaauauuuaggguuucuauuuauguuuguuuuuuacauugucauuuuaaaaguucuauuuuggcauauguuuuauagugccaggcauauccaauagucauaaauaauuuuaagauauagaugcauacauaugggagagaauuauauauuauauaucauuguacuauucugguuuuaaaauaguaguuuuacccuaguggaaaaucaguuuuguuccaaaaguuguguaucauugcauggucuugaaccuuaucuuaaauuuuauauuaaaauaacaauguuuuugugaaauacucauuuuaaaaugcuuuguuucaccaggcuuuuaauuaagagguguuuuuauauucugaaacuucugaaucaugucagaacuuaauuaaggugaugauuuucauuucagggaaugcugaaauuaaaaucuaaaauuaggucaguggggugcaggcuuaaaaggaaacaaaaaccagcuuguaaaagaaacagugucuuauguucuguucccuguacauacuugaaauuaagaguauuuacuaauaaucaguaaaaauuggggagaaagugagguaauguaauauuggcccuaauuauugcuacugaaaaccuuaucuuuuuuuuuuuuugcaucuggaauguuuacuucagguaucauuugaauuaagaaaagcaaagggaaagauaugauuuauagauagaaaauaaauuaagaaacuaaauuacacuaacaccuuacacuagccucuauucacuuccuaauccuacccccugaaucuccauucuacuuuuaaaagcagaguaaauaacaaaaaaaaaaaacacauuccaaaugcagguguuaauuuuuaaacuuuacaguacucagacuuacacuguuuagguuuucuacccauuugcuaucauuagcuuccugcaauuagaaaaacuuacauucuaaauuucagcuuuggcaaucuguauauuaagaauauauuuauguuccuggauuugagagaauauguuguuaaggguuuuguuaaaagccuuaauuguguacagcacuuuacauuguaaggugauuaauugcugugucauaaggcagggauuggacaaaugucuuaggagauuuaaacacaaauuacguguuuuggcggggcuuuguguuuuguaaaccuuuagguaauucagaauuugaccacauaucccauuucuugagcacaguaugauuaagauuuuccuuaaaauaacuuuacaaaauuuguuaacacccaaauuaaagagcaacuuccagugaggguucuuuuaccagcgaauaucauuagguaggaaaauugaauuucuguccaagugggauuuauauauuaaagcagugcagccagugauauauuuggauauuaggguauuuggcaaagucccucaugagauauccuugaagaauaggacuuaagaaauguggacuggagaauaauacaauuagacugauuuguaauugagcgccauaaacacuaauugaauccuugucaacagcugggauguagcacucugccuguuuuuuuuuuuuaaaucaguuguuugaaugaggacacauagcaugaugauguuguuguuaauucacagaugauguuaaucuaguauccacauuccugaaaauuggauggcagguuuauuuagaaaacaaaaugaucuugauggguuagaauaggacaucucauuaacaauguaacuuuuuuuuuuuaaauaaagauggggucucaccauguugcccagguuggucuugaacuccugggcucaaaugguccucccaccucagcccuccuuaguagcugcgauuacaggugugcaccaccauccccaucauccccaccacaugauaacucuuuuuuuuuuucugagguggagucucgcuuuguugcccgggcuggagugcaguggugugaucucagcucacuucaaccucugccucccggguucaugccauucuccugccucaggcucccgaguagcugggacuacaggcacugccaccacgccuggcuaauuuuuuguauuuuuaguagagacgggguuucaccguguuagccaggauugucuuaaucuccugaccuccugauccgcccaccucggccucccaagugcugggauuacaggcgugaaccacugugcccggccgauaacucuuaauaaaguauaaauguaaacucuuuuccuuugccuauucccaaaaaagaaacuugaagaauacacuggccgggugggauggcucacgccuuuaauccuagcacuuugggaggcugaggugggcggaucacuugagcccagaaguuugagaccagccugggcaacaguggugaaacccgaucucuacacaaaaaaauacaaaaacuugccaggcguaguggugcacgccuguagucccagcugcuugggaggcugaggugagagaaucacuugcgccugggagguggagguugcagugagccaggauugugccacugcauuccagccuaggugacagagugagacccugucucaaaaaaaaaaaaaaaaaaaaaaaggauacaccauacaaaauggaguuuccaaagcacauauuaugaaugacauagaucauuuucauuauauuugaaaaaagcaagauucagaauuauauucaugauuauaauuguauugacuacuaugucucaguauuauugagacaaaucucaauuuuguguuaaauauauauuagaaaauauauagaauaguucuagauuguauaauuaggaaugguuuucuuuuuauuuugccuuucuguuuauuucccaauuuucuacaaugagcauggagcaaggaguaauaauaaaacacauugaagauaaaguguuuaauuuuuuugaugauuuaaauguguagccuaaggauaguuaauuuauauuguuacaguaaagauuuucuccuuccuuuauuugccaugauagaaaagucagcaucagccauggugcucucugcacauaacagucuguuacuguuuuuuuccucuauuacuaggaauccauugaaucaguuuucauuuuuuuccccuuuaucaaagguugaauuaauaaaaggaaauuuacaaaguguuggacuuacacuucgucuuguccagucaacugauggguaugcugggcacgucaucauugaaacuguggcuccaaacucgccugcugcaauugcagaucuucagcggggagaucgacuuaucgccauuggagguaauuaugcuaauaugcauuauacuuuaccuuuacagauaaacuacaaaguaggugugagguuuuuccuuucuuccuuuuuccuuauuucuauaauaugcauaugucacuuuuauaauggaaauaaaguaauaaacuuuauuauaaauaaaaauucaaaggaggccuucaaaauacauuuaaaacauacaugccauuuuaguucuaguguauaaaucuuuaaaauacuuuguuuagaccacuuuuauauaaccacucuaauccuucccuucccaccuucuacuacucuauuuauuuuuucuugaaugugaaaguaagggcaaauaaacagguuaucuuucuguacgacuaccaccauugcuacucugaaccuaaaauugguaguauuagcacuacugcccccaucacuuagcacuagaugaugagcagaagaaccaacauuccuuuuccaggagggcacaucugaacuguccugugauccugugucaucuaaauggccagccauuuguuaguauguuguugcucagaauucagcccaaaucacugguggaaaaaugugucacuuacaugccuuccuaucacuuggauuguuaacaguaaaaacucucugaagauagcagguuauuugcuuguauauaaaugucuaagcaguaggacucacugugcacagcagugaggggaaaguccaagccuuuucaaccuuuguaguaccugucccaucuauucuaggcuuguugagagauuucuugaacauaugguuggucacaguugaucugaaaagggcaaugugauauuuucuuucacagcuuagacaauaaauaaguuagaacaguucccaaaucaaggugcaguuguccuugguuacaugucaaagaaacucugccuuugauucaaauccaccuugacaauaaaauaaugaaaauuauuuaguugcauaucugggagcccaauuaagucaauauuuucacaugggaaucucugaucauggcauaagcagugcuucucagacuuucccauguaugccagucacccagaccugauguuaaaaugugcauucugaaucaggagaccuguagugaggcccaagauucuucauuucucacagacuccucccaaaugaugaugcuuaugcauaaacacuuagggaggcauaaaauagacaucauucauuauauuaauaucauuuaauauuuugguuuuagcuacaggauaaaauuaauuuuuucggucuuuuuuggggguuguguuucaauuacacaaguaguaaauaccuauuaucaaaaauaaauuaauuaaccuaagcgauauaaauguauacagagugaaaaagcaaaagucaucccuugacaucuaacauuuguuaauuacaauaacaacaggccgggcucaguggcucaugccuguaaucccagcacuuugggaggccgaggcggguggaucaccugaggucaggaguucgagaccagccuggccaacauggugaaacccaucucuacugaaaauaugaaaauuagcugggcaugguggcaggcgccuguaaucccagcuacucaggaggcugaggcaggagaauugcuugaaccugggaggcagagguugcagugagcugagaucauaccauugcacuccagccugggcaacaagagcgaaacuccaucucaaauaauaauaauaauauguauuaagaugaagggcagauacaauacacauucauuguuuuaaaaaaaagaaaaaccuuggaacauaacagaaaagcuuuuguaugucucuuuuuuuguuuuuuuguuuguuuguuuuuuucuguacauaaauauaugccuuucccaauuuuuguuuaggaaacaaaaauuucuaaacuaugcauuuuuguaauagucuuuauuucuuuuagcauguuguaaacuuuccccaugucaacagauauuuuucaaaacauuuuuauaucgcuuugauucauuuauauggguauauaauugaugauaguugaaauaagauuggcaaaauauuauauuugaagcucaaaauggaauucauuuuacuguuuccucagcuuuugaguguguuugaaauauuccaaaagaaaaauccagacuugaaugguguauuccugagagagaguugcaauggccaucuccacaaaacaccugaugacugaggaauagaugagacgagggcagauuuuuagucauaaaaaaugaguucagauugaguugaaguuuuugccuacuguagaucauuagauggacuaauuuuucauuuaugcauaugucaaacuauaauuuugcugagacauaguaugguuagaaggacguaguagaacuuaaagcuagauaaauaaugaagcaccauauuagaaagcucugaauuuccaugugauaaguuuguaggcuaaaggggcaaaugcuuuaggaaaauuucguagcaauauguuugguguuuaaaguagggaaggucugagugagagauugcaguuaaaagcuguuuauuacuaaagugaaggccaguuaucaggaggaucugaacagggaaggaaaaugggcugaaaucacaaguuugaguugacagcugaauguuucuagggagucaaauaucccuaggauucaaauugaguuaacugggaguggcaaguugauugauaguagugaggacagagagacagucaaagaaagguuuuagcucugcugaauauuuagucccaaaggaacauccagguggugauguccaguaguugggaauguagaacuaaagugaagaagaagggaaaccaaagaaaaaguugauaguuuuugagacuacuggaguggcuguaauuuaccagggagagagcaaaaaagggugagagaacuaguggcaaacuuugguaacaguugcauauaaggugcaggugguauagguggagaaaaagaagcuagaggagaggugaucagaaccaauuguguaaaguguuguggaaacuaagaaaaagaaaaauuuuaaagaaaaggaagaaaaaguuuaaggauaauugauagagcaaagucaggaaggagacaggaggauuggauccaaaguaaguauacagauagagggauauuuucuccucugaaguaagauaauacuaaaaaugaugguagggagaaaagguagcuucauauugaucuuuuuggcaaauaaggugauagcaugcacagaguaaaagagaguagggagaguagacuuuagggaaacaggaaagauuuacagcugauguuugagagacuuaguuguuuacagacugaucaaaagaaugcuaagcagcccugaacaccuugccaaagauggauggcuaacuugaugcuagauccaagcggcaagcucaagagcaggaaagggcaauaguggggcuaguaaagcuggggaucaaaaaacaugaggacgagaaaauaaaauauugguaagaacaucguuguaaucuugagacacaggguuggauagaagagcaagugguaucaggagaccaacaggaccaugagaagaaaagaggaaugauugggccgggaaguugccuaaaaguagugagcagacaggauuguaagaggugaaaaauaggagcuugugaucagagacuaauugaaaaugaaagaucuuugauguggacaaguuccaagugaugaccgagucuaaagccugaucuucccagacagcugaaguaagagaggacacagguugaggaaaccugaagucaaguuaugagaaaggggugguguuacuuagauuuauuuaggauggcccuaagaucuuuggaaaacaaagagccuucucauucuuucucuaaguucuacauaaagggauagcuugggcaagugcuguuuuagagagugugggaagagugacaggaaacaaguagcaccuuuaagugcuaacacaccuagaauaucuauagaagcauacacuagaagcuacuaaggucagggaagggacaguauggcugggagacagagguggaaagaauauuuuuuacuguacaucuuuuuauaccuuuauaccuuucaaauuuuaaacuacguguaacaauuaaaaaauaagaaaaauaaaaacaacguagauauuacagaugcagauaguaaccagcuuguuuaacuuuaaagcaguuuaucccuuacuuguucuuucugguuuugaaaaagaugaaugugauggguacgguugauaaaaagaaucuguaaaaguacguuauucauaguauaguauuuugcuacauuauuuucaagcacugcucucuuaauuugaaucuuucaucauaugucuuguaaucccuggaguauuuuagaauuuccuucaguggaaucacagcuuucccucacucuaagucugauuuagccauuaauagaauccuuuaaauagaucucucucuguucacuucuucaguucaaacugagagaugucaucuaaccuaagaagagauagaaagcaauuaggaguuagcauccuggcacucuuuuugggauccugugucaucaucugguuugaaaagguaaacaucuccaggauaucagcacauucaggguuugagaauuagcacacugauucauccaaaagccaaauaaaauauuguugagauuuuccuauuauucuucuauuaguuaaauaaccagagguaauggcaauuauauauauuuaauuaaauacauuuaacaaauguaguaauuucuauugcaauaauuuacauguuuucccuuuuaaaaucuuaaaccaggugugaaaaucacaucaacacugcaaguguugaagcuuaucaagcaggcuggugaccgaguccugguguacuaugaaaggccuguuggccagaguaaucaaggugcagugcugcaagauaacuuuggccaguuggaagaaaacuuuuugucaagcucaugccaaucggguuaugaagaggaagcugccggguugacaguagauacugaaaguagagagcuggauucugaauuugaagacuuggcaagugaugucagagcacaaaaugaguucaaagaugaggcacaaucauuaagucauagucccaaacguguuccaacaacacuuucuauuaaaccccuuggagcuauaucaccaguuuuaaaccguaaauuagcuguaggaagucacccacuaccaccgaaaauucaguccaaagauggaaauaaaccuccaccccuaaaaacuucugagauaacagacccagcacaagugucaaaaccaacccaaggaucugcuuucaaaccaccugugccaccacgaccacaagcgaaaguuccuuugccuuccgccgaugcuccaaaucaggcagaaccagauguucucguugaaaagccagagaagguggugccaccuccucuuguagauaaaucugcugaaaagcaagcaaaaaauguggaugccauagacgaugcagcugcaccuaagcaauuuuuagcaaagcaagaaguggccaaagaugucacuucagaaacuuccugcccuacuaaggacaguucggacgaccgucaaacaugggaaucaucagaaauucuuuaucguaauaagcuaggaaaauggacaagaaccagagcauccuguuuguuugacauagaagccugucacagguacuuaaacauugcauuguggugcagggauccuuucaaguugggaggucucaucuguuuggggcauguuaguuuaaaacuugaagauguggcuuuaggaugccuagcuacaucaaacacggaauaccuuuccaaauugagacuggaagcccccucaccuaaggcuauagucacuagaaccgcacuacgcaaucugaguaugcaaaagggauucaaugacaaauuuugcuauggugacauuacuauucacuucaaauauuugaaagaaggagaaucagaccaccauguaguuacuaacguagaaaaagaaaaagaaccccauuugguugaagaaguuucuguucucccuaaagaggagcaauuuguuggacagauggguuuaacagaaaacaaacacaguuuucaggauacucaguuccagaacccaacauggugugacuacuguaagaaaaaaguuuggacuaaagcagcuucccaguguauguuuugugcuuauguuugccauaaaaaaugucaagaaaagugucuagcugagacuucuguuuguggagcaacugauaggcgaauagacaggacacugaaaaaccuuaggcuggaaggacaggaaacccucuuaggccugccuccucguguugaugcugaagcuagcaagucagucaauaaaacaacagguuugacaaggcauauuaucaauacuaguucucguuuauuaaauuugcgucaagucucuaaaacucgccuuucugaaccaggaaccgaucucguagaaccuucaccaaaacacacacccaacacgucagacaacgaaggcagugacacggaggucugugguccaaacaguccuucuaaacggggaaacagcacaggaauaaaguuagugagaaaagaggguggucuggaugacaguguuuucauugcaguuaaagaaauuggucgugaucuguacaggggcuugccuacagaggaaaggauccagaaacuagaguucauguuggauaagcuacagaaugaaauugaucaggaguuggaacacaauaauucccuuguuagagaagaaaaagagacaacugauacaaggaaaaaaucacuucuuucugcugccuuagcuaaaucaggugaaaggcuacaagcucuaacacuucuuaugauucacuacagagcaggcauugaagauauagaaacuuuagaaagucugucuuuagaccagcacuccaaaaaaauaagcaaguacacagaugauacagaagaagaccuugauaaugaaauaagccaacuaauagacucucagccauucagcagcauaucagaugacuuauuuggcccauccgagucuguguagcagacaggucuauuuaagcuuucaaaugaacaggguaaaguugcaucuaaaguaccacagauacaaccauguuuaaauccucguaugcacucuggccugcuucuccaguuacuugcuuguguaagaacaaaaaugagaaagguuguuuuccaguaaaaacaugaccagcuuacuaauugguuguuuuggauugcauuuauagcuaugcuuuuuuggguuuauacugggaauuuauuuuuacuaaauuauuuaacuuuucuaauuauguaauuauguaagcuagcuuuucauguuuauguauguaugguguccccuuguguuauuuuucuuccucuugguuuuugaauuaguguuaaauagaauacugucuagauucuuaaaauauuuucauuuccaucaugguuauaacaaauuugcugcaugcccaaacugacaacagcaaucacugagggaacagguuuugaaucuuucuuuuguguuaugaaguuuaucgucucuacuugcuugagauuuuuguuauuuuggggguuugggggugcuuuuuguuuuguuuuugccaaauguaacaugaaagcagaugcugcagcuuuagucuguuaugcugauuuaguaaaaaaaaauuuuuuacauauauugcuugcuuucgaugcuucugugaaauuuuuuucuaaagcuuuugugcagcuguaugguaaaaauauggugauuaauuugaagagcuuacauugaaagacaauguaauaggaaauaaauguagauugcaguuggucaagaauuuuguagagaggauaacaagacuuaauuacugaaaaacaguaacauagcauuuugaaauauaaucuuuuaaaauauugaugcuuuccuuuuaaauggaaauuuaaauuuuauaauuaaaaguuuaaacauuuaugauaauuuuccucaucaguucucccauaggaaauaaagcaugugaaaggguauuuaaaguuuuggaggacucuuuuuaaaaugacuguguugauaacuaguuugggcugguuuuguuuuagaaaaaacauuuucauguaggaguauucugugaaggaaaggaaucaugcaaaauauacuuuuugcuuuggcgucuuacaguuguaaaggaauggugaucauucugaauacuucuguagugaguauucauuaagaaaagaaugacaaaaauaguauucauacauaggaauugggaccaguucucugaaaaugaagauauacucacacuggguccauuuuacgggucccaguaacauuugacugagggaaaacaaguaagcucgacuguuguugggguaccuuaaugguuucggucuguuauauaccuauaaaauagacaaguauauguuugucccuuuguagguaacugcuaugaugauugcuauauagugaaacugacaugaguuuaaaacuagauggagcagcuuuuauugcuggcaggaaaaagcaugguguaauauuaaggacuggggcccaggucuagacuccaggacuccauaaaagaguuuaaguucaagcccuuccauuaaugaacuguguaagcauaggcaguuacaaaaggacccaucucuaaaaugggaauaauaauacuuuaccucccucacaguauuguugugagggaaacaauagcauaacugcaaaagugcuuugaacaguaaaaagauauacaaguaaaaggcauuauuuauaugaguaagaaagacauuuuugaggggagaaaaguuauuccacuuuaaaaaucaauagccaagucucaugccuuuuguuacuuuaguaagcgaaaauuucagguacuaaauaccuuucuuagccaaguuuauaacaaaaacaucucaguauacuucauuacuuauuuaagcgugaugucuuuuuuuuuuuuuuuuuuuuuuuuuuuuuuuuuuuuuuuugagacagagucucgcugucucccaggcuggagugcaguggcaugaucucggcucacugcaagcuccgccucccagguucacgccauucuccugccucagccuccggaguagcugggaguacaggcgcggcuaauuuuuuguauuuuuaguagagacgggguuucaccauguuagccaggauggucucgaucuccugaccucgugauccaccugccucggccucccaaagugcugggauuacaggcgugagccaccacgcccggccacgugaucuuauuuuaaaagaacacugcuauagaagaauuuacacaccaaauucccugaaagcuaaaguauuguuccauaacuuacacuugaggcaaucugcucaguguguaaccacuuuauaaaaaauaacuuaccauugauaaccuggaagguggacuacuuguaaguagcugguguuuauugauuaaaccauggaaguuuucaugauacccaagcauguugcugaaacugaugcauuugaaagagcuguugaaauaaugcaaaacuuugguuuuauaagaaucuacucauguuuuaaaaguauuuaacucuguagaccacaauuauagaaagcucaguaaugcugcuaaugacauuuguaaacuauaucuguaauguagugcaauauuuuuauauuucacugggagaggcaguagagacaucauaguuguacuuuagugcaagugggggaacacuccaaauagccuagaguauaguaagguacaaagcuucaaugaaaaaagcuguauuauauuacauuacugauguaaucuugcugccaugcuauguaucaauagcuaaaaaauaauaauaaagacuaccacagaaaacaagaauaucuucauuuaaugaaaucuuuaaaaaaggugauugcugcaucucuauggaauuaucuucugguauaauuuggccaugcagaaaagcauaacaaaguccacuuuuccuaaacaaaauugcuguuuugcagacugccccaaaacauuuuuuuacuauuguuuccuuauggauuaucaaguuuauggguuuccuuuggcuauguauuaguaauuagacuuuaaaauauauuuucuacauuaguauuagcugagugaauggcuuagacaaacugagcaacauuuuagcauuauuagcaaucauaauaggcuauacuucuucauaucaagccuuauauucaauaucagaaguacuugaaauaaguggcuauuuugugaugcugggaggagaaaacacaaccuaaaaauuuugagggguacuaucaaguucuaaauguauagcugaauuuuuuuuaaagcaauuuggaaauauuuggcucuuaaaaauaagauaaauaauaaaauguuaaguccccuaaaagugaauaaauuuuaaauaccuacuuuuaaaaauacugucuucuaaauugacauaauugcuuuucuuaccaaaagaaggagagguuccccuaauuccuuuugggccauagauccgcuuuuaggaucugauuaaagauguggacuuucaccgcaggaagauacccaugggcacaccauucaaaauguaucagauuucaacgguuuuacaaacucccccgggauuaagucaaauggguggauauuacagcuguuuucaucagauaugguuauuuguugacaaccaucaggacaacaauguuuauagauggaaggauaacuuccugguuuuuuuccacauugaauguggcuaguuacauaucucaauuuaaaauaaauuguggaaagccaaaaaaguauggucaagcuaaccugggguggcuuuuaccugaugccuacaagcacagaaaaauaguuuuuaauuaaauauccacagucaaaaugauaccuuauguauuuuauuccaacaacauuugguuuauaaaggaauacaaacaggcacaaaacaugguucagaagauuuauuaaguaaacuugcuaaaauauggacagauacacuuagcagucaaacaguugaauauucauugcuaccucauuaaaguuuuuguaucuguauuaccagguccaaacauaaaaaccaccucuguucaaaaaauaaauguucagagagcuguauguucuuuguucugguauguacauuuuaaaaaaacaccucuuuccagucuugcuaaccaagaauauuagucauauaaaagaacuuagaauuuuuuuccccaaguacaagcuaucuuuugcuccaaaacaguucugaagguuuuauuuauauuuuaucuuaucccgagggaccaacagcaggcauaccuuugccaggccuucuugcagaaagacacagagccguaaaggcaaaaauaaaauugcaauaaaguauaugguauugggggcagggagaaccagaaacccucaaagagaaccaauuuguagcacguucuuuuuuaaggcucuaccccuguagaaguaagaaacuagccugccuuuuuagccauaugagaguuuccuccagagccaucuuccaaaguggcagacuuggccaaguugcccaaugccaaauaagugaguuggaaguucguuugcuucaaacacacugcacuuagaaaccagacuugaaauaaucgaagccccacagaaaagcuucaugaaacgaaguguuacuuuccuagagaauaagaaagucacaagauugaggagucuguucuaaaguucuuugcuccuugaugucgaaguuaacacaaacacaaucuuagcuuaacgaaacuaaguaauuuuuguuuaugauuauagaacugcaggauucacaaguaguauuagagacauuccacacugcacacuccagucauaucucuuaacaaaaugacauaaauugacaauguucacuaacaguauuugcuguuacacugaaaaggcacaucaauguugucaugcuuagaaaaauacacaacacugcacacuggaugauauaguuagcacauacauuuuuagauguuccauuuuucuuuucugccugaucacuauuauuuuuacuucuuaauauaugauucaagacauaauuucauucuucauuuucauuuaaaauuugucuucacauugaugugaacaacuuucaggagucuaaaaaauaguaguuucagacaaccuaaaauaaauauauuccuagaaaacacuuggaugaccugcaaacagaucaaagauauagucagauauuaaagucagagcagcuguuuucagcuucuuguuuccuuuucuaaaacuugaaguagauggcgauuaaccuuaucauguuuaaacaaccuugacaguauaagguacauguacccucaauuuucuucauccaguaagacaaguaugcaucuuaaagggaaagcuuuuaguucauaacaauauguuugguugcuuuucucugcuuucggaacauuuacuguuuuuccuuuauuggcuuuaguguuugcugccaaccagauaacauguuaacauauaauuuacaacucucucuagguaggugauuacauagaaaacuaaugccagcuaagauuuauggauucaaaagauaacugacacaaguucuuguccucuacacuugagagaacuagcuguuuaacgcauaaauauauugauaguaacuacaaguuaaauaacauucagugucacuauauaacaugcugucuuacuugauucuguuuuucagacuucauucuaguuucucuuuguuggaagagucucagagauaaugugugcuuuaauuuuaaacacucauuaccaauaugauuuuugcccaaauguuuguuaauguaaguuaaaaaauuauauuugguuuggauucaaauauuuauagauuuacacaauaccuauuucaucaaaauauauuguaugauauuuaauaaaauuaaauacauaaaauaaaguuucaacacuauuuauacaaaccccuagaaaagcuucuuuuucuuuauaaggcuguuggcaaucgaccauaaccauggaaaggaaauaauaaccuuugguuuuacucuuucaccagggauggaugguaugacuaagacaguucuggaugaguugugucacuggaaacacuguuuuauacaauuaaacacuuugaugauuuuugaggaucucaucucagucacuuucagauucuucaucuucaccuaucggauaugacuggauauuauucugaguguacauuuuuguuuuaauagggcaguugugauccaugagaauagccuaaaagagagcaaagugcaaguauauuaacuucuuguuucauaaagauaagaugguuuuaaccuacuguuuuuaaggauuauuaguuugaaaacuauguaguauuacuugcuauuaaccagucauuuggagcaaucgccagacgccugaccuaaaagaccuguaguucuacacucuaaaaauuccaggcaauuggagacagaaguggucucugcaguauuuucauuauaccugucaggggccauaaguccacucugggaacuuauacucuaugaagcaagggacaggcagguuagguuuguuauacuuagaaucuuggaauugggguauggggauccuggaggucacccaguccaacuucuguuuacagacgucauuguagcaacacaccuugaaaggaugugcucucuccuuaaugagagaagcccucacaugugagaaauguaccuaagucuggacuacaacccguuuccauuguuugcauucaugaaucugguucuggua

SEQ ID NO: 18886 - RNA, 7192 nt, Homo sapiens
agaagaggaggaggaggaagaagaggaggaggaggagaagaagaaacuggaggaagaggaggaggcgaaggaggaggagaagccgcagcgggcgccgcaggagcgagugagcugggagcgaggggcgaaggcgcggagaagcccggccgcccggugggcggcagaaggcucagccgaggcggcggcgccgacuccguuccacucucggcccggauccaggccuccggguucccaggcgcucaccucccucugacgcacuuuaaagagucuccccccuuccaccucagggcgaguaauagcgaccaaucaucaagccauuuaccaggcuucggaggaagcuguuuaugugauccccgcacuaauuaggcucaugaacuaacaaaucguuugcacaacuugugaagaagcgaacacuuccauggauuguccuuggacuuagggcgcccugcccgccuuuugcagaggagaaaaaacuuuuuuuuuuuuuugccucccccgagaacuuuccccccuucuccucccugccucuaacuccgauccccccacgccaucucgccaaaaaaaaaaaaaaaaaaaaaaaagaaaaaaaaagaaaaaaaaagaaaaaaaauuaccccaauccacgccugcaaauucuucuggaaggauuuuccccccucucuucagguugggcgcguuuggugcaagauucucgggauccucggcuuugccucucccucucccuccccccuccuuuccuuuuuccuuuccuuuccuuucuuucuuccuuuccuuccccccacccccacccccaccccaaacaaacgaguccccaauucucguccguccucgccgcgggcagcgggcggcggaggcagcgugcggcggucgccaggagcugggagcccagggcgcccgcuccucggcgcagcauguuccagccggcgcccaagcgcugcuucaccaucgagucgcugguggccaaggacaguccccugcccgccucgcgcuccgaggaccccauccgucccgcggcacucagcuacgcuaacuccagccccauaaauccguuccucaacggcuuccacucggccgccgccgccgccgccgguaggggcgucuacuccaacccggacuugguguucgccgaggcggucucgcacccgcccaaccccgccgugccagugcacccggugccgccgccgcacgcccuggccgcccacccccuacccuccucgcacucgccacacccccuauucgccucgcagcagcgggauccguccaccuucuaccccuggcucauccaccgcuaccgauaucugggucaucgcuuccaagguacgugccacgucgcggaacugcagcgcgccgcucccgccgcauccuucacugcccccggccugcuccgggugggcgcuuggcaaggccugggcggagguuccuccggcucgcgggccagcgcgcccuguugggaaacuaggcggcgcggggccgggcguggugucgauccccagucuccgaagcuacgacugguuuggagugauggccugcgggccgcuugacccuuugggaaggggugcgaacggagaaguugucccccagugcgcucgaaucagagcaggcugggcugugcgugcccggcgccgcggagcccagagcccgcgggauccccaggcuccugguacccucggcaaugcccccaaccguccuggcuccgaggggcgcggacaggacucggccgccaggcuugcuuucgacugcguucgacccuguucaccacccacuuugcgccccuucaguccagacccgcggcuucuuagucuuccacccucuucuggaggcgagaggauccucgcgccccgggagaaaaguaugggauuuguuuuuucuuuccugcuuuucggaggccuggggaggggcgggaacccgugcgggaggaaagcuccagggcuuggcgcucucgccgcgaccugcuuaauuggggcgccgagcagccacagcgggaaggcagguucggucugguuuuuguuuuucuuucuuucuuuaaaaaaaaaaaaaaagaaccuggucaggaaacugucuuagagggaaauaucuguucguguguuuucauuucuugcgauauuuuuuauuuguuuguuuuucucuggguacggggugggaggaggagaguuaaaacuucagaaaaaggaguaauuaguuuacggauuggagucaguaaaagaccuaccuccggcggcagccgaucaauacuccgcggcuuguccauucauuaacccauugcguuccugccggagccuagaaucggguagaugucaccccccuccccauauuuuaaaaaaucaaaccaaaggaaaaaaaacccaaaaagccuuuuacccuuaaucccgaacuggauuugccugcauccugccuggacugucggcuuguuuuucuuuguuuggguuuucggugaaucgauuuccuaugcuaaugagugaacccaaaacucugaggcuuugcuugaaaaguuuagggcugcccuuccucauucgcuaucagucaugcuuaugguccccucaccagacccggagccgcugggaucuuccugcguuacagacuguccuggcggugucugcaagucgguaaccccccggguuucgaucccuucgcucgcguuucucuucuaguucucgggagccgggagccccggagcccaguucgcgagaggcagcagcggcuguagccaagcacacccgccggccagauuucugucccgaucgggcuucaacgacucgccccgccucuauacuuuuccggaggggcaauaaaacaaauaauuuaaaaauaaaucuccaugaaaacucuggagagcagcccgccgccuuuccaccgugggucaaaguuccccgagagguuagaaagaagagaaaguaguuucuucggguugugggcgccaauccccuggccaggcucugcggcucccuccccugccuccagcgcccggcgaggagguggcgaggcccgcggcgccagggcggcugcggagccggccgaggucaggagccuggggacuggcuccucugcgacagcggcugguugggugccgcaccgguggagacccggcguuccgggccgggcagcugagcaggcguucccuucgugagcccuugggaggaccaccggcccccgcaggucgagcggcgcggcuaugcgaaggcccugagcacggugccgggccagcccggcucgggagaagugcgcggcuccggucagagcagcccccccuaaugggauuucugcugugcuccccgcagggaacgacacuagccccgagaguuuccuuuugcacaacgcgcuggcccgaaagcccaagcggauccgaaccgccuucuccccgucccagcuucuaaggcuggaacacgccuuugagaagaaucacuacguggugggcgccgaaaggaagcagcuggcacacagccucagccucacggaaacucaggugacugcggcccgggcgcgaggaacccaucuaggcgugcgcccccuccccaaagcuggcucccaagcacacccaugagcacggagcucugugagggccuuccgcacagguccugguagcugguuccacgccugggcucgggauguaugucucaaggugcuggcuuuguugggcuccagaaaggggcuguaagugccaaucugccccagguucuggggaaacgcgccgaguuguuucucuguccaguugggcauguccuggcuaagacaucccugcauuucuggugagacuuuugaugagagugugaagaccccugcugggguccaggaagagggagagcacagugggguuucuggguguuuggagcuggaggcugguaaggacaggauguggguuaaagaugaguucugagcgacugugagcccacggcucacaccgucggcuccagugacuucccugaaggagaugggcgaugggaagguagagggcaagcguccuguguguacccuauaucagagaaguaaaguugggaggcugcagagagggucugccucagggcacaggccuucugcacagcagggucccugggcgggccuggcuuggguuuaucccaggguggggaggggguuuaggacuacacuaggcgcuacuguacacggagccgcagggcggggucaaaguucccagcaaacaguaacguuuuuuugggcagacuaaguuguaacacuuuuccugggcagcucagaaaggucgaggcuuuuguuuuaaaacauguuccccaccccaaaaccgaggagggccuggcggguuugugcggagcccggcacaaggcgcggcccggcugauuucuccuggacagccgaggcggcgguggucuuuguccgccucgcugcccacgcugccuggagucuuugugugcgugucaagccccgagcgcaccgacgcgcgccuugggccagcgccggggagaaaugaaccguccucccccucaauuagcaaacucaaagcaaauuaaauucagccuuguucccgcucagcuuuuuucauggagcacuuugggcgacuguggcuuuccgggagagcaagacggaccggccugcggccucaaaggagggaauggaauggaucccagggguccagggacuggcacugggcugugggguacucuuauccagauagaauaggaguuguggggggaggguaucagaggugcagucacugccaucucccuuaccuguacaccacugcugugaagauuggacuguguuacugucugguggcuaaaugaggacccacgacucagcuuuccuagggggccgugggauggcagccgacucccaccucauugcuccugagaccucucacagccgcucuggugaggccgggccuccagccccacccuggugggaagugaugggacugggguccgagguugugugaccagcagccuguuccggggcuguuuagaaggagggaagagggggcuugcugucaccuccccuucucuuaguuucucuuacuuuccguguaacccacggucuuucagaagcuuucaguuuugaacucauuuuccuagcuauaaagguacagcuggguuggucuggaggccuacacacuccaugucccuccuggccuccuccagccccauccccuuccugcucaccugugagagucccccgcacggaggaugcagcucaggcaaacccugaucgccuacccagggcccccgccacgaagaggagacgcuauauuuaggaaacgccgcccagaccagcagaaaauagaaagcacauugggcccugaggggagcugcagcagcggcggacugaggucucucuugcacucgcuugcuggagggaguuagggacaugucucuuuuucuuuuaaucacuuauuauuuuuguaggggcuucccaugcuuugcaaggcuuugcucucagcgggauauagaugcccucugcagggccaggagagauggggcucagugcacuccgggccacagggcccuggggaaaggcucuucaggaagccucagaagggcagggagcugggcuucuguuccaccacgcacuagcggcccugcucccugagggcaggccuuggggaggcuggaccuuaggacuugcaucucgggggcugggucuuugcugagucuggaacuggagucugggcugggugaaaggaucaggcacuugauagaagggugcucugaaagaacuaacgcaccccaucugccucucacccgcagguaaaaguaugguuucagaaccgaagaacaaaguucaaaaggcagaagcuggaggaagaaggcucagauucgcaacaaaagaaaaaagggacgcaccauauuaaccgguggagaaucgccaccaagcaggcgaguccggaggaaauagacgugaccucagaugauuaaaaacauaaaccuaaccccacagaaacggacaacauggagcaaaagagacagggagagguggagaaggaaaaaacccuacaaaacaaaaacaaaccgcauacacguucaccgagaaagggagagggaaucggagggagcagcggaaugcggcgaagacucuggacagcgagggcacagggucccaaaccgaggccgcgccaagauggcagaggauggaggcuccuucaucaacaagcgacccucgucuaaagaggcagcugagugagagacacagagagaaggagaaagagggagggagagagagaaagagagagaaagagagagagagagagagagagagaaagcugaacgugcacucugacaaggggagcugucaaucaaacaccaaaccggggagacaagaugauuggcagguauuccguuuaucacaguccacuuaaaaaaugaugaugaugauaaaaaccacgacccaaccaggcacaggacuuuuuuguuuuuugcacuucgcuguguuucccccccaucuuuaaaaauaauuaguaauaaaaaacaaaaauuccauaucuagccccaucccacaccuguuucaaauccuugaaaugcauguagcaguuguugggcgaaugguguuuaaagaccgaaaaugaauuguaauuuucuuuuccuuuuaaagacagguucugugugcuuuuuauuuugauuuuuuuucccaagaaaugugcagucuguaaacacuuuuugauaccuucugaugucaaagugauugugcaagcuaaaugaaguaggcucagcgauagugguccucuuacagagaaacggggagcaggacgacgggggggcuggggguggcgggggagggugcccacaaaaagaaucaggacuuguacugggaaaaaaaccccuaaauuaauuauauuucuuggacauucccuuuccuaacauccugaggcuuaaaacccugaugcaaacuucuccuuucagugguuggagaaauuggccgaguucaaccauucacugcaaugccuauuccaaacuuuaaaucuaucuauugcaaaaccugaaggacuguaguuagcggggaugauguuaaguguggccaagcgcacggcggcaaguuuucaagcacugaguuucuauuccaagaucauagacuuacuaaagagagugacaaaugcuuccuuaaugucuucuauaccagaauguaaauauuuuuguguuuuguguuaauuuguuagaauucuaacacacuauauacuuccaagaaguaugucaaugucaauauuuugucaauaaagauuuaucaauaugcccucaga

SEQ ID NO: 18887 - RNA, 7486 nt, Homo sapiens
cauuuauuauaggcauccaguaaugugauaaacaauuagguaauuaagaauucucaaaucaguauugagaaacuuaauuuuaaaauguuagauauuuuugaagcaagauuuuccaaaaaccuuugcuaugaaaucugguguuuguaaaucuuuguaguaguuauaauuauaugccaccucuaucccuugcauuuauuaauauaugcacuaaauaaugagcauucuuugaugggauccauauagaaacaaucgagauuuuuuuuuuuuucugagauggaauuucacuccugucacccaggcuggagugcaguggcgcaaucucagcucacugcaaccucugccucccggguucaagugauucucgugccucagccucccgaguagcugggauuacaggcacaugccaccaugcccggcuaauuuuuguauuuuuaguaggggggagcggguuucagcauguuggucaggcuggucucgaacucuugaccucaagugauccaccugccucggccucccaaagugcugggauuacaggcgugauccaccaugcccagccccagaucauucuuaaacauacaaacauuaauuccuuccuaccccaugccucaguucuucccccucugcuaucucuuuccccauucugguaacauuuccaccaucagcaauuguuaugagcugaauguuugugcaccccuaaaauuccuaucuuaaagccauaacccacaguguggcuguguuuggagauguggccucuaaggcaguaauuaagguuaaauaaggucagaaggguagaacccugauccaacaggauuaguguccuuuuaaguacagagaagagacacuggagagcuccccaaacugugcauauaaagaaaaggugaugggagcacgacagggcaaggguggcugccuaccacgcaagagaagaggccucaaaaaaaaaaaaaaaaaaaaccuacuuugcuggcaucuugaucuuggacuucccagcaucuagaacugugagaaauaaauuccuguugccuaagcuaccuugucuguaguauuuugcuauccccagaugaagagcaauuaagaagccuaaugcaguuacaacagcacucucaggcacaccuucuuguuaccuguuuaacuuuuuaaagauuuggauucaaggaaaauccuacugagaagcugaacagauuuggccaaaauaguuuuacacagauccuuaacucauucagccuugcuucuacucuagaaucagagaaugugaacaggaagagggaccucggcgauccaaacuugcugauucagguuuuacuaugauucugggguuauagaaaacugcucucuaaacuuggcgcaucuucuggaagauguuggaggugaggugguuuaguggauaguuaauaggcuuaaccaucuguugaugugaaauugagauauauuacugagugcaaugcaaaauuuuauacacauuuagcuugcuuugaagaaagacauuauugguaauguuaacagcaaaaaacagcugagauugaaaauuagcgugggcuagguaacauguuaaagucuuuauguguacaguagccucccuuauccgcagggaauaccuuccaagacuccccgguagaugccugaauccuggaauaauggcgaaccccacauauaguuuuucaaucugauaaccaagauggcuacuaagugacuaagaaccugguagccuaacagcaugcauggacaaagcgaugauucacacugcagauuucaucaggauauccagaaugggcuugcaaugaaacauuugaauugcuuauuucuggaauuuuuuacuuaauguguuuggaccuugguugaccccagguaacugaaaucaggcuaagagaagccacagaugagggaagccuacuguauuuucuuuucuuuucuuuuuuugaaauagggucugguucuguugcccaggcuuuucuuauauaaucaucacaaaauuagcaaauagguacacuuaauguuauucuuauuauaaaacaguauuucggaaaaugcaaauauuucuaaaauagcccuauucccaucccuauccauaggguauuuuauccucuucgcagugcuuuucucucucuuuuuuuuccccuuauuuucuauguuccccaagcacccccuucugggcauaacacagugccugccacaaauaagaaaaaaagaaguucgguaaacuuuugguccagucagugaagcaccuuggaccccaucaccagacgguaggcgccaagagagcaagagucagcauguuuucugcuaaccagagauuagcacgaugccugguacaaaguaggcgcccaauaaauaggugaagaaagaaaaaaaauuaaaaaaaaggaagagagugaggggaaaggaugaaugaaugaagacguuugcagaggggccuagaaagaaagcacucugcaagauucucccuccugguggcaucaacucucaguucaaggucuaugucagcccuuuccuugcccagacgcauuggccuacagcagggaaugaagaaagaacaaagucuuuaaaaauguucagaagaaagagaaaacggcaagauaaaagagagaaaaaaaagaaagaaaggaaccaccuccuucgggcggacuaaaaagggaagccccaggaggccgguugcuaaggcgacccuagggccagaacggccccagcccauugguugagacgcaggagccaaugagaaggcgcgauguugacgggguccuaagauggcugcugggcgaccacuuccugacaggugaguacggcuuauggaggguugguuacccgccgguucgggcuccggcaugaugagucugggagggccucuugugggcagccgagggaggcggcaugggcggccucauagcuccucggccgagccucccggagcaggcuagaaaagcccccggcccggggccgcggaagcgacggcggggccgcccucagccuuccucgaaaggggcgucgcagcggccuccccagccuguuauguggaggggguucuccgucccacccaggucaaagugagaggggauugaggaggcugucgauagggaaaacaggcucacguuuacaguugcuguauuccggaaaacagcuccaguuaaugggacugccagcaggcuagacauccuucgccggaaugugcagcgcuuaguucugugcccgggaggggcuucucucucuuuugggauuggaguguggcauugccgccagaaagccugcagaauuccggguugugcagccaagcaggaacgguguaccuuucuagacccauccucuugcaaucuuggacccuguaaguauucucacagcggaaucgacuuaaaaugagccuugaacuguuaacuugguuuauugucuuuccaugcaggaucuugggucugggaaaauguuuuccaggccucaaguaaacgaacacucucuuuaauuaaaacaguugaauacaugcaaaaucuugcuaaauaaguaguuuuucuggauucgcucucaggccuguaauucaguuguccuuucuguaccuuuuuugagaaaaggaacacauucauuucauaaaaguaaauaggauauuuacguuaauguugauguuaacaugcuugaaaauaguaacuauuuuuaagucacagacucugauuaugauguaaauuacaaucuucagauuguuaaauaauuguggcuuauaauuaguauacaagugaaauuaauuuuagaucagacgaaguucaggcuucuggaauuauuucuaaucaaauacaaaauauaggaaauaagacagccuuauacgaugaaaauggaauuuaaauucuggaauagagauggaaaacauuuacccaucgagcugcucaaauauaucuuuuggguuuugauuauaagcagcugucugguuguccagaaaauaugacauuauuacucaaaccucugacugugacuuugacuuugauguaugcaacuuaguauagcaucuugcauagcuuucuguacucaaaaaguacagaaaaaaauucuuaaccaaauuuaacaagucuguaauuauaggcuaagaucauucucagccccagucgcaaauccuuguccccgcuuacaacucugcucuguaaaauucauaaucuaaagccauggggcuauuuuuguaaaacaaauggaucagaaugcauuaggcaagucaguuaucccaucuguaaauugggggcggggcggguaggggaggggcugauauagauaguaauuccuaguggaaggguuguugugaagauuaguggaaaaccaaggccugccacacuguuuguaugccaugugcagcagugacuugcuuuguuuccccuuucugguucuaguguuuccuguuguaacuaggguuccuuccccuucucaguguccugaaguguacagaguuucucugaaaacauccucuuggcugaguugcuagguagaggagagaaaccuuaucuacuggauacugggcucuaaucaggauugcagugcuagagagaauggagugauacauccaggagugaggugacucugggcauuuagggcacuuauaauaucaaaaucauaaagaggcauuuuagagcuguaagacaucucagagaucauuugaucaaaccuuuauuuuauagcuuaagaauggaggcccagacaaaugcaguggcuuucuccuaauuauguugcucaggacuagaaaccauuuuccaacuuugaagacuuuuucccccuguaaccagugcacaaucuagaacgguuuuuauuauaauuugauuucucccuggcugcuuuauuuugaaagauugugucuacucaaccuuauuuaugaauguuuuuuucugauaaaaaucagaccuauaacuaccagugaaccucugauuaacaugugaaaaauagugcuucacuaaauuggucuuuuccuguaaugaugaaugguacagucuuacugaggggaaaaauaaaauaguuugggcuuuuugaaauuagcuuagagacuccuguuacuauauucauacuuagauuaggaaccacugaacuguacccuguuuuugauucauuguuaucugaccaaguaugcuaaauaauaacgaugggugguuuucaagggcaaacaaacaaacaaacaagaaacccuaguuauucagacuaggacaguauauaaauauuuucaguucauggcaaauuguguuagcccaggacuaaagauguguucugcauaguacacacagaaugucuugaggauaauugugggauggaauaaaucuuaacucuagagguggaggguguguaaaaugaagaaagugauauucaaaaccauagagagaaaaaggauucugagucauuuacauuuuccuuggggcuaaaaugauuaaauugaaaauuauuuggguugcaggguaaaaaaaaugaaagcuuaugaauuaauacauuggcuguuauauggacuuggcuauaaucuaugcuaaacaaauuuaaguuucuguuucucugauauuccacguuucuggagacaggcugagugaauuuucacaguuaaaggguaacuugggauuaucugccuuaaaauaaagaaauacgcucugaaaggcauaaguaagagacacuuauagagaaucauucuccacagcagccaaaacaagaauaacaggaggccuaacauggugccaguuggaaacuuugugaaugacaaguauaugcuaugaauagaaagacuguuuugaaacaugaguccaaagcaaaagucacuaagcagccacuccauauuggcugaucuguaacugggcugcugcuuacacgggcaacuccauuuugcaggcugcacaguaaguggcagcaguuauccguguuuaucagugacugcucagucucccuuguauuuguuuuuuugagagucacaggaaaauggcacaugacuaaagguucuaaagaguggaauucaaaaccuaccugauuugaauuuugccuggauuuagagguggauuccaccuuuuucaaacuauuuuaauuuuuuuuccuuuggguacacucaagaaauuaucauaccaggcagaugccacacugaggacaguuuuuaaugccacaugagcaggagcuaaaaauauauaauuuugagaaaauuuaaaaagccauaaaaaaugccuaacuacuugaaggcugauuagcaacaacaacagcaaaaagcaugccuucuucggggcaacugagacugcuucccagagggaagcauguuugggugcccagagcauagacuaucacccugcagagaugcuaaaacagugguuuaguaggagaccugugccacugcccauuggagaggcauacacguuucaugagcagucacaucuaaaguccaggucaaggaauacuuggcucaaaaacugagcagaaacuugcuauguguauagcugucauuucgugaggcuagggauuuuugccuguuuuauauacuucuguccccagggucuugaagagugucuggcacauaagugggcauguaaaauauuuuauggacaggaagggaaagaguuauuucuaacauagacuccagugaugcuaagaaauccaaaccugaaauuuguuacuguuuuaaguccuuaaaugauaaugagccuaaagguauauuauauggcgguggccaagucauacuggaacuuauuacugcuuccuuccccuugcucucagaacaggagaaaucuuuuuuauuaauagcaugacaccuguuuuucaauauuggcauauuuuacaugaugucuuuugugcuauuggaguauuucaagaguacugcugucccaacuuuaaaaauccacagacagguuuagggauagaucuggguuuuauggggccuggagcuuauauaacuucggguuucuuccuuuaaacaaagaaauguaaauucugaauagaaaacuagguacagugcuuuggaaggaccugugcagaugaggaaucuuggagcuuaagguuaccauuaucuuccuaguaauuugcccucauuuuauuccuccauucagaaaaccaaacacuaacauuuguuauagacacuucacaucagauugugacuaucaaggaagcaaaugauugcaucaguugcuaagugagugcaccacaauuauuagaaacuucaaaacuaucuuaugaacccugucacucauaauagaaaugauaaaaauguaauacauggccacagaaauaauaauagcaaagagaacuuaacauuuauugagccccuaggaccuccuaaacacuguguugaggggcuuaucucauuuaauccucagaauagcccuauaagcaguauaauuaucccugcauuacagauaaagaaauugagggucagagaugucaaaugauuuccucauacuacuaguagugucagaguuaagauucuaguuggagcaguuagaugccagaguccuuccucauaaaaagccaacagaauauuuggugaggauauuucagagagccagcaacugaugaggcuggacca

SEQ ID NO: 18888 - RNA, 1889 nt, Homo sapiens
ggguccguagggcucccggcccgggcaggagguggagccgaggcucucgcgugcauuguccccgggagggagccauguuucuuacuccccggcacucccagauggcggccggggacgcgggcccuaagcagaccaaagccccagggaccuggagagccagaggacgcaggcagcaaggagggagcuccaguccggguaggggcugucucccgggcugcgguccccgcgacgcacccggaggcggcagggggaaggaaaggccccuggggcgacgguuccgggcuacgcgccucccagaccccagucgauagagugagaaggaaacccaugcccaaccaccggcugggacagcggcgggcaggccgcaucggucuccucuccccgcgcgggccgggcggcggagcagugggaagcaggcccgcgcucucgaccucggaggccucgggccgccccagcccggcgcgccccgaucagcuacucaccguuggcgcguuugagggcauuuuccggccucugaaaauaggccggcaucuuggcggcaggcucagcucacccggcgucagcgaacucucuaguggcccgggccgggagaggagacgaaggggaaccagcguaaggucccacgcgccucgccagcagucgcccgcgcccagccggccagagacggaaaggaaggagccacgugaccuccccgcggcggcccugcugccgcccaggccccggauguagggggcgggucuccgugcgcgcaagcgcgcuggcgucacgcacgccgacagacguggcggcgccggaguccuaggcgcgcaagguccaguucccgucuugggccuguccuggauagcguuagggagacaguucacaggcucuucaaucuucgagcgagaauuagggugggaagggugaguguggggucagaguuucugucuggagaacaagcaaacgucugcagauugguuuucaaagcgacuugugcggagucgugcaguuacaguaaggucccauccagccugggaaucgccugucuuggcuacgugaaaaugcugaguuuaacgaaaacgcagugagcaggugucaucaggucagcgccgcucaaccgugagagacaaucauggggaagagugacgccuaaaauaaacaagcaagguucuuuuauaucuugguaaaguaaaaaguuugugucacagggauugccuugagaaauggaggcucucagagggggcgaauggggacagcgaccuggcaaagggcgaaacgcccuggagcacagcagacuugcuugguguuugaaaacacacggaaaggagugucgucacuuuuuacauacagcgcacgucacaaacaaauuaagaaaaauuaguguuagugaaaaaaaucaaucugagaggcccuuuuauuguugcuuaacaauuuuaauguucgcagacgaaguacuuuaccuagaauuugaaaaccauuugaaccgaaucuaauucucaagcccuugguacgaaauaaaggugagcucagaaggaaaaaaauuuuuuuuuuuuuugaaacggagucucgcuuugucgcccaggcuggagugcaguggcacgaucucggcucacugcaagcuccgccuucuggauucacgccauucuccugccucagccucccgaguagcugggacuacaggcgcccgccacugcgcccagcuaauguuuuguauuuuuaguagagacgggguuucgccguggucucgaucuccugaccucgugauccgcccuccucggccucccaaagugcugggauuacaggcgugagccaccgcgcccagcccagaaggaaaauuuagaaggcagcagugaaauagauuauugucaauguauuacacauuuaauagacgagauaugugaauuaaugaa

SEQ ID NO: 18889 - RNA, 1889 nt, Homo sapiens
uucauuaauucacauaucucgucuauuaaauguguaauacauugacaauaaucuauuucacugcugccuucuaaauuuuccuucugggcugggcgcgguggcucacgccuguaaucccagcacuuugggaggccgaggagggcggaucacgaggucaggagaucgagaccacggcgaaaccccgucucuacuaaaaauacaaaacauuagcugggcgcaguggcgggcgccuguagucccagcuacucgggaggcugaggcaggagaauggcgugaauccagaaggcggagcuugcagugagccgagaucgugccacugcacuccagccugggcgacaaagcgagacuccguuucaaaaaaaaaaaaaauuuuuuuccuucugagcucaccuuuauuucguaccaagggcuugagaauuagauucgguucaaaugguuuucaaauucuagguaaaguacuucgucugcgaacauuaaaauuguuaagcaacaauaaaagggccucucagauugauuuuuuucacuaacacuaauuuuucuuaauuuguuugugacgugcgcuguauguaaaaagugacgacacuccuuuccguguguuuucaaacaccaagcaagucugcugugcuccagggcguuucgcccuuugccaggucgcuguccccauucgcccccucugagagccuccauuucucaaggcaaucccugugacacaaacuuuuuacuuuaccaagauauaaaagaaccuugcuuguuuauuuuaggcgucacucuuccccaugauugucucucacgguugagcggcgcugaccugaugacaccugcucacugcguuuucguuaaacucagcauuuucacguagccaagacaggcgauucccaggcuggaugggaccuuacuguaacugcacgacuccgcacaagucgcuuugaaaaccaaucugcagacguuugcuuguucuccagacagaaacucugaccccacacucacccuucccacccuaauucucgcucgaagauugaagagccugugaacugucucccuaacgcuauccaggacaggcccaagacgggaacuggaccuugcgcgccuaggacuccggcgccgccacgucugucggcgugcgugacgccagcgcgcuugcgcgcacggagacccgcccccuacauccggggccugggcggcagcagggccgccgcggggaggucacguggcuccuuccuuuccgucucuggccggcugggcgcgggcgacugcuggcgaggcgcgugggaccuuacgcugguuccccuucgucuccucucccggcccgggccacuagagaguucgcugacgccgggugagcugagccugccgccaagaugccggccuauuuucagaggccggaaaaugcccucaaacgcgccaacggugaguagcugaucggggcgcgccgggcuggggcggcccgaggccuccgaggucgagagcgcgggccugcuucccacugcuccgccgcccggcccgcgcggggagaggagaccgaugcggccugcccgccgcugucccagccggugguugggcauggguuuccuucucacucuaucgacuggggucugggaggcgcguagcccggaaccgucgccccaggggccuuuccuucccccugccgccuccgggugcgucgcggggaccgcagcccgggagacagccccuacccggacuggagcucccuccuugcugccugcguccucuggcucuccaggucccuggggcuuuggucugcuuagggcccgcguccccggccgccaucugggagugccggggaguaagaaacauggcucccucccggggacaaugcacgcgagagccucggcuccaccuccugcccgggccgggagcccuacggaccc

SEQ ID NO: 18890 - RNA, 9369 nt, Homo sapiens
gauggauuuuaaaauugaacacacuugggaugguuuuccagugaagcaugagcccguauuuaucaggcugaauccaggugacagaggagugaugauggacauuagugcuccauuuuucagggauccuccagccccacuuggagaaccaggaaaaccuuucaaugaacugugggauuaugaagguaaguggaaguacuguauuuuauugcaaacauaaaucuucuuauaauaaccucucacagaacuauuauuuuaucuugcuguugggaaguaagugcuucugagcaauugacauguacaguuucugauauuuccuaccaaucucucauucugacuuuuucuccauuaccugugugacuuuaacuauauaacaaaaacaguuaaaaaauggcaauuacaaauccagauuuuuuuuuuuuuuuuuuuuugagacagagcuucacucuguugcccagguuggagugcaguggugcaaucucggcucacugcaagguccacguccuggguucaugccauuauccugccucagccucccuaguagcugggacuacaggcgccugccaccacgccuggcuaauuuuuuauauuuuuaguagagacaggguuucacuguguuagccaggauggucucgaucuccugaccacgugaucugcccaccucagccucccaaagugcugggauuacaggcgugagccaccuugccuggccacaaauccagauuuuuuuauugcugccuuauuuucuuccuuuauuucuguuaccuaugcugagaagaguucaggauuccuguuuuguauuuaaguaucuuuaaauuaccacucuaacauuacaaaucuucuuuauggaagauuuggaguguuuuacuuauuguagaaacacuaucaaccucaauacgaaauguaguuuuuacuuuauccuggcaacucgucucacauaucaaauuaagacaugacauaaaauuaguuucagguuugcucuaugaucuccuucuacuguauccuaauuaagcuaucagauucaucuuucugaaauacucuucaugaugccauuucccagaugauaaaucauuacuaucccuaggauaaaguucaaacccuuccuuuaagcuuucagcacacuuaugaauugggccaccauauucaaccaaaagcucuuaaccuauguaccuucucauucuauucccccugccucuaaugcauaguucaagaucuaauucaugucccauuucuucaaagaagauuuugaugaaucuucuagucaauaugucuaguuuaugccauuuguaagcacacauuuugucaguguuaauuugucauauguuaaauauauauugucuuuuauugauacaaaacggguauauagcaucuuccuaauggaauacacacuaaugugacuuaccuucuagaggcacuacagacaugaaacucaacaaauucuaaucucaacucaccuacuucuuucauaaaccaguucuuuaccuaauuguccaauaucaauaaaugguacuaacaauacauuaaaucaccaaaucuaaaaaauugugagaucuuucuaagauauccuucuuugacacucucccuuauuuggauuuauuuacuaagucccaucaguuuugcuuccuaaauauuccucuaacucaguaucuccucuuuuauccccacuauccuugccaaaaguuaggcuuucaucaucuuuuaccuugguuagggcagagccuucuaaauagucuuuuagcccuuaagcccauucuucauuuagaagcuggacugcuauaucuaaaaugaaaauuuaaacucauccuucagcuaccuaaaaaccuucucaggauccuuuuccucucaagguaaguuuuguccuucuuaauaugaucucuguauaagacuuuccaugaccuggccccuuauucucuguagcaccaccagcuucuccuacauugaaagguuugccugguaagacugaacuguucauaguucuuuaaauaagcuacaauauuuccuaauuguguacccuugauuuuacuguuuucuugcccuagaaugcuguuucuaucauucuucaccuaguuccaaaucaucuuucaagacagagcuuaaauagcaacuucuccuggaauccuucacuaaaccacuuuuuugagcuaaacaucuguuucuauuuuuuccuguagcaaugcaugcauccuccauuuuggaacuuuuauuaaaauuuuccacuuuaguaucugauuagauuguaagccaauaaagguauuuccagaaucugauauaguguuuaauacagagaagcugcaaaaguauuuguaaggugaugauggaaaguagaaagcagaagauauauaugugcaucugagugugugugugugugugugugugugauauauauacacacauguauguauagugagagagagaguaugugugcuuauguauguauguauguaccuaucuauuuuauauauauggagagaaagagagagaucuauuuuaagaaauuaguucacacaauuguggcagcuagcaaguccacucuucccugggucuucagucaacuggcuggaaaacccacucuucccugggucuucagucagccagcuggagagucuauguugcaguucaaaucugaaggcugucugcugguagaauuccucucuugagggaggucagucuuuuuuucuaugaagaccuuaaacugauuggauaagccccagccacauuauagagggaaaccugcucuacuaaaagucuacugauuuuaauguuaaucucaucuuuaaaaaauggcuucacagaaacaacuagaauaauauguuacaaaauaucuggauaccauggccuaguuaaguugacagauacaauuaacuaucacaguagacauucuaauuugucuauauaaaagauuuaaaaagggacaauaagauucucugaauugcuggcagaauuaugucuauauuuuagcuauuuuauuauaaaaauaacacauggaaaauuggaaacaaccuaaaugucuauccauaaaggauuaagugaguaaguuauaauauucuauaaaauacuacuauucagucauuaaaauaguauguagaagcauagaaaaggucuggcagguuuuagaccaaaggggaagaaaaggacuuugacuuuuuacuucauauauauuguuuuaauuauuuacaagaaagauguauauguucaaaauuaaacaauuuuaaaaauagcaauauucagaaauuuccagaaaauuauaaaaaagaaaagaaagaucaccuaccuaaauuccugcaaucacagauaugcagucauuaacauuuuugugcacauuuugcagacaucuagacauagacacacaugcaauuuuaaugucaugcacauuuugguugcuguucugcagcugacuuaucgaauaucauggauaucuuccuauaucaacaaauauuuaaugguaucuuugauuuuaauagcugcauuguauuccauuguuuauggaauauaugaauuccauaauuuacuuaacaguucuccuguauaauaggagauguauuuagagaauaagagauaaucuuauguaauaggagauaaucauuuagaucauuucuaauuuuugaacaguacucuaaugaauggcauuauacuuaauucuuuucccaguugucagauuauuuucuuaagauaaauuccuagaagaagauaacuggcucaaaguuuaugugauaauguuaauuucuuuacaaccugaccagcacuaguuuuaauuaaucuuuucaauauguggcaaucugauaugugagaaaauuguugaugauuuauuuccuauauauuucuucuuccaggcaaugucuauuuucuuugcucuuuuuccuauuggggauaguauuauaauuaagaauaguuaauucauuuuauauucuaaaggaauaaauuauuuauuguuggaaagcaauauuaaauaucucaauauguuauaucucuguuuucaaaaguuguggaagcauuuuucuugaaugauauaacugagcaauauuuagaaguugaacuuuguccguaaguauaaaauguuuuuucuuacuuauuacuacauaauuugaacguguuauuuucuaguuauaaaugauauaguaaaagcucauuaauuccagaguaagaaugguacucugaauuugcuugaaugauaugcuuuuauauauuucuuaguuucaaguacagagcacauauuuagaauguauguuuagaauauacucauauucuaaauguuugaaaauccuaugucaauauuuucaguucauuaauguagauuuuuguaauaaauuucaagauaauuuuuuucaaaacgaaaagucauuauaaaacaaaaacucucauuauuuacgcaauaaauuugcauuauuauaauauagcuguucggaaauaaaaggagagauauggguauaauuaauugagcuagcuuauaaaaauguuucuuuuaggggauuuuuaaaugacuagaugaaacuuuaauuuuauguauuacauaauuaugcauucauguauucauucuuuauucaucaugcauuuauuaaguauaugcugugucacuuuugcauucagugccaggguuuaaaaacuaaaccacauauagauuuucuuagacucauuacaaauauuaaccuuggacucucuuuguucagguuuaacugucucuugggaauccuguuuaccugguuggcaaacuauuucuuuuuuccuguagauguacaccuauuaucuaaauuauagcacauuuaaaauuaauaaaguauuuaauaaugaaauauuucuuuauauugcaguuauucauuugaaaugccauuuaaaugccucucagugucuaacauucagaagccauugcuccuuuuguaggcuggacagagagcuccaaacaauugauuuaaaugagauuuguagauauucuuuuauuuucuuuuauuuugauauucagcuaaaucuaauguagaaaagucuagcuguuugcguucuguuuuuuaagaagaguaaucauauaccuuuguguguuacauuucaacuaacaugccaaaauuuguuauugaaaaauaugauuaauucucauaaacugccaugagaaguaagaaaauuucaacuauugugugcuuauuuuuacccuacaggugagaaaacuaaggcaaacauucauaauuugucuagagaacaguaaagaacuuggauauccuaaaauuuugcccuuaguuuuaauuuuauuagaugauaauauugguucauuuucauaaagugaugucaacacuagaugaauagaauaauuagauucucucuuguuaagaaauuacacaguaaucauuguguauaaaauuaauagauuuuaaagguuaaaaaaauucacagaguaguuugguuucuuauguaucaggauaguuaauaaucaagaaucauaguuuugcuucaagcagucauuuccuguaacaguuuauuaaccucuaggaaagcaacaggaagaauuuuuuuuauuugcaagaauuuuuacuccuaggauguacuccuaaggcugcauaauaacaauaaaaauaaucagaagacuuucaaauggaaaagaauacuuggcuucuguuagaauaguuuacugaaggaaauccucccugaaaagcucucaaaagaguaccuguauagaaauguuuuaauauauagguuuuucuagaguuagugaauuugcuucauguaaauacaugaaauccuuugguucuuaaugaccuggcuagucccaauuguacacuguuauuagaauuucccuuggaaaauauacuguguuccuuuuugaaaacaugaugcugaaugaaugguagaaagcaggaaaacacaagaggcagacauguugaggaccgugugugaaaaaaauagacaaagauuaaaaucuuuagccuguugacuaguuguagacugucuauguuuugcauuuuuuauuuuccuaaugagcuaccagauaguuuucuuacagaaauaaccuuuauuaaagugguugaauucagacuuggaaauuguugcuugcuuuaguuuuugaaacucguuuuauaaaaaacuccaaauaacaugguaucucucugaccuuuuuucauacuuuguaucaucuaaccaaaugaaguauuuuauauaauuguuucuuuaaagaauauaaaaagcaaucuaaacaugaaacuuuaugcauuugguggcaguugucuggagagugguaaacccaaagaugucauuucuaagcaacugaacacacuggcucucccuauaauuauccaauauuaauauugcaucuuuuuuuuuuugagacagagucucgcuuuguugccacgcuggaguacaguggcgcuaucuuggcucacugcaaccuccaccucccggguucaagcgauuccccugccucagccucccaaguugcugggacuacaggcacacgccaccaugccuggcuaauuuuuucuuuguauuuuaguagagacggaguuucaccauguuggccaggauggucuugaucuccugaccucgugauccacccgccuuggccucccaaagugcuggguuacaggcguaagccaccaugcucagccugcaucuuuuaauuauuuggaaaauuaguugcaagcacacacauuccauguauaaaggauagugaagaaaauaacauucauguuuuucaaacacucaugaggaaucuuaauuuugacagccacggacagcauuuagugcuuuuacuuucuggaagaagaaauguguggaaaguaaguaaauaaaaauaggaggcaaaaucauuacguacacaguaauacacauauuucuauguuuaaaguguaagcccaauuuuaucuuuuguguuucacauguuguuucuguagcaagaacuuccuuuaucguucagaauguccagaggagagacaaaaugggaaggcaaagcuuaucucccuuggaguuauuuuccaccaaaugugacaaaauucaauucauuugcaauucauggaucaaaagauaaacgaaguuaugaagcucuuuacccuguaccucagcaugaacugcagcaaggacaaaaaccugauuuguaaguagaaaauaaaugaagauauguuccaaauacacgaguuuuuucgaaauuaauucuuaguggagcagaaguaacacuuuugaucaaagaagacgacauaugugcacaaguaucuaguagaguccaauguucacugaugguccucagaaaauacuuggaaaacuuuggacugucauaaucucucucacuacugucaguagagcacuuauuuuuccauagugguaugagaaaaguguuguuugcaugugagaaaaguaaauguuguaauagcugauauagaaguauggucacaaauucauuuaaaauuucuuucagagcuaaagggccagaggcaucaguguuuccuggugugaacaaacaguccccuguuacaaggaaaucuaaucuucaguuaucucucuaguucuccucuucugguaaccucauaaggauaaaaauaucaacuauguuucuaggcaacacugcuuacgauaaaaaugacccuuaaguggcaaauuacaucuggacugagaauaauuuuggaugaacuauaaauauaugauggagacagcauggcuuugggauuccccuguaacagucauguucccugugggaacccuggaagcuauggcuauggaguuauuccaagagauauugcucucauggggcagcaggcauuugagccaaguuaucugcuaugcuuucucaauuugagucuuguuuccuugcaccuguagcucucacauaggcagacuagagcuccuggccagccuuaugaaugcuucauggacuucugcaaggacuacuccuuuagggaggaaagccagaugcuguccuggggcaagcugugauugcugcucuauaucucucuagguauacucacuauggccaagguagucucgugagucugggcauuuggaagaaccuaacagaaacauccuagugagcauugcacuaugguagauggacauuccugccuuuuaaccuguggaaugugcugcaucguccuuccucucccuguuugccuucuccuuccugccaugcucuuacuuuaugcuucuuugucuuuaucacuucuagcauauuucuuuauuuugcuugauauuuuuuccccuuuucccuuugccuuucuccccaauccugacauagcuuuuaccuagucuuuuuuccccuuccuuuuucuuauccuucacuguuuuuuccuuaaucucuuacucugggauugacaauugugauucaaaaacugacuuauccuggccaggugggcagaaugagacaaacauguaguugcaacugacucaagguccucauaucaagacgucaugucucucuggcucuucaucagcuaauaccuuccuauauucaggcucuucauucauacauuauuuggaagcuuaucuuagguggaaguacgauuauacauuggccaggacagagccaaggcagagugacuuccuacagaguggggcuccacugcagcauguuagcuaagccuuucucuccucauuaagccacaagagaaagcuucuuaauguaguuaagugguuuuccucgaaagaaaagaacugggauuaauacucuuuuacauuaaccucucuugcuucagcagagaagggaauuaagaagucuaucuuaucaauggaacugaaacuuuucaaaacaauugcuuauaugacugauauaaauuauaucaaaguuugaauauaaaaacauaugcaagagcauaauaugauuuguuuaaagcuggauggaaugaguuauguuuugagaacugauuucucccuucagcugugagggaguuauuugcagaauugaaagaagagugcuuugagaugcaggugaauguuuucagagcugaguguuugacagcuagagugagaaaacuguacauauaaaauauaucuuaccuuuaguauugcuuaaaauagaauguuguauuacaguugugacaaaauaaauagcccuucaggacaacuauuucacaaaugcauaauucauuucaauucccaccuucuuuuucuuugcuuuuagccauugccuagaauacuucaagucuuucaauuuuaacacacugcuuggagaagaguggaaacaaccggaaucagaccuguggcuaauagagaaaugugauauauaggaguaauagauaaccauaccgaucauuuuuuccucuauaccuuuuaagauaaacaaaaaauaaauaucaauuuuuuaagaugucaugcauacauuucaacaacaaauaucuucauagaagucacugaaaauauaguaucuguggcaaauuguauaugauuaacaagaaaauauaugauucuuuguag

SEQ ID NO: 18891 - RNA, 4081 nt, Homo sapiens
gccauuuccucacauuggugucacccuucugucggcuuggaacaaucugaauuaaauguuccagacacacgugggacuucccccucccagccagaauguccucuccuggggcccucggagucgccuaggcugagcccuucuccucgaggggcacgccgagccacugucgcacccaccucugucugcucuuccuucaggaaggcggcuggcacgcggaucuagguguuugcagccuggugggcgaugggccucuuuccuucuaagcagguccugacugcuaaagccagucauuugcaagagguuugcauugggggauuuuugcucuauuuuuaacagaagcauaggaccguaaagaugugucaugaaaccccaagugucccaaagccucggggcccacaggagcaucgggaagugaggcagugcgcucauccugacggagcagcgucgugucuguagcggggagggaggcuggcccaggggcccggcauguuccugaagcguucacaggguuuugagaccuucacagccccaucaaugugcuggcccauguggcauggaugggguagucucucugggcaaaugagaggcccaaggagagaccaagccaccaaagggcucaagacaaagucacuguuccuuccccaggaagguggggcagaggcaagaucuaucggacauuucaaaguuucaggcaggagcuccuagaggacuugguggcuuugccagcccaggggccucugaaggcagcccccagacccuuguagcagggcuguccauccccagggagcagcuggccaccuccuccugccucgaagaagugaccaggggccaaucugcucccaccucccguccaggacagggugaacauuugaccucacuguccccugcccggcugagucccugaugucugacugugccacccagcagcugccagggucucucaccauguggacccugcccuagcugcagcugcaccuccugucaaaagugcagacucgcagguuccaccccaaaccacagaaugggaaugccugggagcccaccccugcugugggcucucagcggggcuuugggggugaucaucccaaacacauuucucuggaugacgcaggcagcauuggagcaugagccguggggaggacagucgugagcacaccagcugugaggcccgguuuccaugccuaacccccggacucuaccccuggguccuggggcguaccgcuaaaaggguccuggccuuugggacugaucauuuugaggcccuuuuacaaagaaaugggggagaagaaauagcugggcuucccucaaaucuuuuuaaugugcaguauuuuuuuguucaagaccagcucuuguuuuaugaggcuccuuccauuaccuuucuugggcugaaugcaaaacaaauacagccacauucaagucuuccaaggaaguagaaaacucuuugaaugguaucuuaagauccuuaagcucuugcugaacuuccuuuuucaaugaaaagaaggaccaucauccuaggauggucaccagcccaagccaccaccccagccacccauccaggagguugguuccuuuugcccaguucauagcagcucaguccuuaccagauggauucuugguguugggaagcagccucuuuuuauuccugaaaggcaaugcccuguccguuugcaguagagaauccccagggagcaagaaagaugacagaaguguggcugccguguuucuaggucaugagagcucuggcgauacuaccacaaggccugcacguggacucuaugauaacuugagucuuccaucauguuugccaccagcccucccugagugcccagaggagaugggggcagagucacuuggccuacuaaagccuccuguuccuucuggcucaugcauugcuuugugguaagagaaaggaagucuuuagaacagcgccugggaaucagcccuucucccuacugaguccccaguccugucccuucccugacucgcuccuccuccaaccuugguuucuauagcugcauuuuuuuuuuuuuuuuuuuuugagacaagaucucauuguguuccccaggcugaagugcaguggcaugauucuggcucacugcagccucaaacuccugaguccaagcuauccuccugccucagccuccgagguagcugggaccauaggcgugcaccaccauacucagcuaauuuuuaaaauuuuuuguagagauggggggggggucuccccauguugcccaggcuggccucgaauuccugagcccaagcuauccuccugccucagccucccaaagugcugagguuauaggugugagccacugucccuggccuauacggucauuuuuuaaaagauauuuuaaaauuaaaagcaaacaacacuguccacccaucuaccuguccaggauaaggcauauuuggacggugaacggauuuacucucguucaugcauuugagcgcuucacagaagagucuuucuugcuccaggcaugacauuuuuuuucaccagacguucacugacuucgugacuuugaggugagacaugggaucucucagaagcgucucugcaucugcauuucaggagaugagcugcugucccugguggacagaggcggucucugccauggucaccaugaugcccuacaaguguuuauugaguccccuggggggcacccagaauaccacccaaaauagcaagaagacccgguccccgccuugcggacgaugcacucacaugccacagcaacccauucucgccucuuccuuggccgggaacccggggcucuagggcugcucgcugcugcuguggccugcgcagccacgggaggcuuccugaaaggcauugcucggaggggcgggggcggggaggccuagccugccccacagacacagcugugaggccugggucauacacauaccagcaagcagcugccgagacaaaugguggugggaaguccugggaacacacacagccuuugcauugacagcacaaguaggaucagagcccaggugagccccugaggauaccgaggccuucccucccugaggcccgcaagucuccaugcgucucccgggagccuggccccgcugcagaaaucccuucucuuccuccacacccuguccuuuccccaaaggcucguguuaucaguuccagcuacccaucgacuuucccaccgagccgcugcccucaaaacggagggggcaccgcagccuccuugagccuggcaucccaggccuugccaaaggggacgguggcuuccuggauaauuggaaaucucugagaagaagaggaaacaccugagugacacucagcuguccucugggguccccuggugugcaugcacguccuccugaauaccuguacuuccaagagguggucuccuguuuucauaacccaacacucugagauaggaucuuccaacuuuuuagccccggcuguggaaagauagugaguaugaagucuuugugcauuuggaagugacaucgcuguguggauuaugaauacagagagcugccaucuuccugaucacaauagaccacgauugcaaagccuccucucccagagaccccuucugcgccugcccuccccacccaccacccagcuguugaagcucagcgugugcaagucagacccugcacaggccgggggugucucaccuggccuaaacguaaaggcuugugccggagacagugauugaaaacauuugaaaagccagcucucccuggcagagaaagacacuucccccccaaaguggaauuuagaugucuuucccuaguccaucaagaagucauuuuuguaacagucccuaagcgaguguucucaauuagaagaguuuaguggcuuuugguguuguuaaaauaauaagaauccuucuagcauccaaagcuuucuaauuuuuuucagggagauuuggacauuaaugaauggaaacuuccacaguggcggucacuccugaaggcagcggcuucuguucucccgcugcuguaacucuguguguuccgucuaucgcgucacagugccgcuggaucuagauggagccacuguuguuguuuuuaaaagagaaauaaauuccuuaauggaaguagc

SEQ ID NO: 18892 - RNA, 1872 nt, Homo sapiens
ugugguagguacuuccagagcuaaauguugcaaguuauccuacuuuuuucucuaauaucaacaauaccugauacgaugaaaaauaacaaaaagaccuuacuaauuauccaaucaaagucaucaucuuuggguaaauuuauaucaacacaacuuaaaguuuuguccaagauguuccugacacaugaagcuuccaguugaauuucagaaauguuaacaaaaguaucuuccuuuuuugccugugaauguuugaguauugcuguauuguuggcuuauauccacuacagauacugguucuaggccagcccaaggaucuucaagcauugaaggcuugaaauaauuuuccaacucauuagacauucuuuuuucucuaacacgcccugauccaaaugguguagauguccuuggagaacccuuuagaaaaaaaaucaguuaaaaaaacacuuaguaaagauaauugguacuucuuccuuuagcuaaagguuagcgggaaucacauugcugcuuaaaaguugugacuugaaccuaaauaauguucaauuacaaaguccaugcuuccuuuaaucaaguguuccuauuuuuuaaaaaaaguacuuaaagcaauucguuauucucauuuauuuauaauuccaugaccacugucaucucaaauacuuuugugucuaauguaguaacuuugcaguaauuaaauacaagcagugaugaaaucaaguaauuauauucaauuuucccucgaaauuuucacuuuuuucaggagaaaacaauacuauaguuuuaaaguuucuagaaccuuucuagcucaugaacauuuucuuuacuccuuagcuccaggcucaaaagggguaggggguugguguagaauacagcaaguuggaaaaccacguaguugcaaguuguaaaccacagaaaucccagacaugcuagagauacucucucugucuuuuguauuuacucucacuaaaggaauggaaaacuuccacuaccaccgauuuucuuuucagggaaguuggagcagaagccaguguagcucgaaagaaagauaaaaaaaaaaaaaaaaaaaagaaaaagaacuauuucuugaaacaaacuggcaaggccuuuggcaaacaggaggaaauggagaauuaggaaaaucuguguacggguggcaguguauugguuaaaagcacgagggcucgaaaacagaacguacggcucugccacucuuucggauaaucuuccggaagucacucaacuucucuaagccucaguucgcucaucugcaaaauugggcuaacaauaguaccucagagaggauuagacaaaauaauccacguaaagggaauauuaguaccgugccugccauaaaguaagagcucggcaaacgcuggcuauuauuauuaccugggggugggucugcugcugcccuggggaguagccgaauugcugcugggaccccgcgggggaccuggaguaggagccaggguagccgccaggggacggagacccgaaccggccccccgggaagcugccgccgugucgcggagagugacugcucccguacggccuagaccggggcccguacggcggcguguggugcggacucccguacccgucucgaggggagggcggccgugguccgcccccgcccgggguuccccggaagcugcuuccgcuaccccaaccuccuccacccggaccaggguaaggaggaguugggggccgaaaauucugucgcugcauaucaggagccaaagccgaaaaccucgcagccgcguucucccaccggaacuguaucaaccggcccuccgcagagaacugcuaguccuuuaccaaaacaguccuccgaccgcagccacccuacggcacaucaguuccggcgucacaaagguuccg

SEQ ID NO: 18893 - RNA, 1872 nt, Homo sapiens
cggaaccuuugugacgccggaacugaugugccguaggguggcugcggucggaggacuguuuugguaaaggacuagcaguucucugcggagggccgguugauacaguuccggugggagaacgcggcugcgagguuuucggcuuuggcuccugauaugcagcgacagaauuuucggcccccaacuccuccuuacccugguccggguggaggagguugggguagcggaagcagcuuccggggaaccccgggcgggggcggaccacggccgcccuccccucgagacggguacgggaguccgcaccacacgccgccguacgggccccggucuaggccguacgggagcagucacucuccgcgacacggcggcagcuucccggggggccgguucgggucuccguccccuggcggcuacccuggcuccuacuccaggucccccgcggggucccagcagcaauucggcuacuccccagggcagcagcagacccacccccagguaauaauaauagccagcguuugccgagcucuuacuuuauggcaggcacgguacuaauauucccuuuacguggauuauuuugucuaauccucucugagguacuauuguuagcccaauuuugcagaugagcgaacugaggcuuagagaaguugagugacuuccggaagauuauccgaaagaguggcagagccguacguucuguuuucgagcccucgugcuuuuaaccaauacacugccacccguacacagauuuuccuaauucuccauuuccuccuguuugccaaaggccuugccaguuuguuucaagaaauaguucuuuuucuuuuuuuuuuuuuuuuuuuuaucuuucuuucgagcuacacuggcuucugcuccaacuucccugaaaagaaaaucggugguaguggaaguuuuccauuccuuuagugagaguaaauacaaaagacagagagaguaucucuagcaugucugggauuucugugguuuacaacuugcaacuacgugguuuuccaacuugcuguauucuacaccaacccccuaccccuuuugagccuggagcuaaggaguaaagaaaauguucaugagcuagaaagguucuagaaacuuuaaaacuauaguauuguuuucuccugaaaaaagugaaaauuucgagggaaaauugaauauaauuacuugauuucaucacugcuuguauuuaauuacugcaaaguuacuacauuagacacaaaaguauuugagaugacaguggucauggaauuauaaauaaaugagaauaacgaauugcuuuaaguacuuuuuuuaaaaaauaggaacacuugauuaaaggaagcauggacuuuguaauugaacauuauuuagguucaagucacaacuuuuaagcagcaaugugauucccgcuaaccuuuagcuaaaggaagaaguaccaauuaucuuuacuaaguguuuuuuuaacugauuuuuuuucuaaaggguucuccaaggacaucuacaccauuuggaucagggcguguuagagaaaaaagaaugucuaaugaguuggaaaauuauuucaagccuucaaugcuugaagauccuugggcuggccuagaaccaguaucuguaguggauauaagccaacaauacagcaauacucaaacauucacaggcaaaaaaggaagauacuuuuguuaacauuucugaaauucaacuggaagcuucaugugucaggaacaucuuggacaaaacuuuaaguuguguugauauaaauuuacccaaagaugaugacuuugauuggauaauuaguaaggucuuuuuguuauuuuucaucguaucagguauuguugauauuagagaaaaaaguaggauaacuugcaacauuuagcucuggaaguaccuaccaca

SEQ ID NO: 18894 - RNA, 6931 nt, Homo sapiens
aaguuuagcucaagaacaaaagcuagguuuucggagaggaggaaucaaucuuucugggcuguggaucugucuucugaucagccuucugcacuuaagucuaggagagagggggccuacaaguaaacucugaagaauacuuuuuucaauuuuuauuauggaaaauuucaaacauauacaaaaguauagagaauaguauaaugaacucucaaacauccaucacacagcuucagcaauuaccaauuuauggccaaucuuguuucaucuauguacucaauuaccccacacucagaugauuuugaagcgaauaccaguaacauaucauuucaccuguacauuuuucaguauacuucucuaaaagauaaucauuuuuuaaaacaacauaaccacaguaccauaucacaucuuaaaaaacaauaaaucaagaaguuauauuuuuauuucaaauuauguaacaacuggggacacaaucaauacauuucacugguaucaugaggaagagugucacacuaaaauggaguccaagcuuuuaucgaugcaauugcuuuauaauauaaaagaaaaaaucaaacaaacuagcauauuagaaccacuuuugguaauuuguaaggagcugaagacugcugauaucacacaucccauggcaaacuccguaagauuucuucuaaacaucuuuguuauuuucuuaaaauuguucuggaggcagcugaugcaaguccucuuuuuuaaaaaaaccuucacuuuguguuccccucuaauagcagccucuuuccuaaaugccuuuucuaaaugacaacaauuuugcccucucucagcccucugcauucucauaugcagaaaccagguaggaugaggagcuagcuguguguacuggaaaagggaugaaaacuacagccaaauggaucagugagagaggcaaaagaaaucuagacaaacuaaauggcauaauuaaguuuggaaacugccuaugauauagccuguuggcucuggcaucaaauaauacaguauguuaaaucuguaaaaugaggaaacaguguuuccucaaagagauguuaagaugacauguaagaagugguuagggcaggcauugcaaaaaaaugucuuauauaucauuuuaaaauuuauuuuuauaaaaacucacaacauuauuuugcguccacuguauuuauuuuuacaauuaccuuuauagcaagugauaguuuuugaauaaaauuuaagcaaaucaucaacaguacaaaaacacuagaguuguuacacgaaggacugauucuacaaaacauuacccuaggugauggcauaaucuuaaaacugugcagcuacugugugguaugacauagaaauaggaguaauaauucuuguccucaaacaucuuacaacugucuugaaauauuucugaaacaccugauacacaaaagccacacacauggugccuagauagcauauacucuacuagcaccagauuggaaggggaauguuuugccacacggugauuacaaaauauuaauugaaucaaagaaccuucagugaugccaaccauauuucaaguagugucucagaugcagaauaugcaaagaguaaggaaaaauagucuuugcucucaaagacaucauagucuaaugaaggcagacacaucaaaaaagcacaacaaaaggcuauaggugcugaauuaagagucuauucacguauaagaguacaacaaccagagcaagagucagugguauagacagggaaggagugucccaagaugcaggaagaaaccagaugagcugucuucuugggaacacagaagugcucaccuguacuugacaauuccacugaucacuggguucacaucaauguuucuuucagcacaauacugaacaucuuugcuguucaucuggaaaaacaaaccaacacacaauuagcaggcuuauguuaauaauuccuccaacugacaaauguaccaagagcuuauuauguacaucaaucacuuugcaucaagcacuucacuuccacagaauuaucuaaugcagaugcaaucaaugagucuggaucagcaacugagggguuauaagccaauguauaccaugauguaaaaaagucaggaaagcagcgauaucagaaguuuuguaaaagaggagugaccauuuaagacauaaaauauccuaaauuccauguuacagacucuagacucauggaaauaauucaggcugauucccacccacgaaagaguuuucaguccagugaccacauggccaagaaaacagauuaaguacaauaaacucugcgaaccaugacacagaagaggguuucuuaacccagguggucaggaaaggcuucucauuggagauguuuguaaagugucuauuuuuacuaucuccaacaacagauuuuuuuuuuaaacugagcgucagauaguuagauaacuuggcuuaaguuucagugaggaagaacuggaacuagaucugucugacuucaaacccccaauguaguuucuaucacaucaugcgcucacucuuuuuuuuuuuuuuugagacguagucucacucugucgcccaggcuggagugaucuuggcucacugcaaccucugccuccugguuucacgagauuguccugcuucaaccucccaaauagaagguauuacaggcacgugccaccaugccuggcugauuuuuguaguuuuacuucauuaauaauuagaaguagaguugggguuucgccauauuggccaggcuggucuccaacuccugaccucaagugaucugcccaccucgaccucccaaaguacugggauuacaggugugagccaccaugcccagcccaugcucucuuauucuuauaaaaguguuauguuuuagcacagucagcauaguaacuuccacuucuuauagugcuguuugcccaaacauauuuaaaaucugcuaaauaccauuaguauuaauagcuaucuuaucaagagaccacuaccaggaaaauauuguuuaaagucuuucagagaguaccugguggcucccccacaagggaauucuagaggugaaagcucugccaggcaaauacacauuuucuaacuguaaacaaauuggcauucuuauacuaaccuucugaaaugaaaucacagaaagaauuuaaaaccuuuacaucaauuguugcaaaugaaucuaugcaaauaaagcaacaaaauuauuuucgaguuucuucccuuuaguuuguuucuuuaaaguguagucaacagauuuuguaucuaaacacacacauacuucuugagaaaaacuguauauauuauagacacagcaccaauuguuuccaguauaugcaucuauauuaauguuuccucuuuauauauucacaagaauaaaacacuugaccagcugaaaauguaagcuauuuauaaaacaugcagaaaauaaaucugauucaugucugcaaaccucaauugucuguguacucuuuuuccuuucuuuaucaagacagggcuguaaaauuuagguguacauuuuucugcuaucacaaaagaaauaauguacaagugaacucuacuacucuuagaaggaaaaaaaucucaacuauacaucaaauuuuggagcacugaaguggcagaaauuuucuauauacuaccucuguucuaaagaaauguggugccacuguuccgaaaacaaaucuuauaacacauuuaaguauagguaaacaaaguacaaaucucaguuuuucaaaacauuuucuguacuaaugcuuuuaacuugaaacucuugacuuaguuuugaagagaaaaaaagaaucuccuuggcgcucuuaacuauucugaugagacuaaguuccagagaauauuuuacaaaaacuacuuaauuuaacaguacgccuugaaaaguaacacuacauauucuaaguguuucuggaaaaaaaaaaagaaaaggaaaaaccacgacauauuuauaagcuaacaauucuuaagagaggguuacuaugaaugcuguacauuaauuuuuacuuugucagauacauaacuuaagaaccaaauaagaugaugcauaauuacuucuaaugauagaaaguacgaguuaagucuccaaaguaaucgugacaguguuucauguggaacacauuucaucuacaaaaauauccauaaaauacaaucuaguauaccuccuaggucaauauuaauguagaaacaagaaccuucuguaauaauuagguuauugaggaaaaucuuaagauccauuuuagacugaauaauuaagucaaauuguuuggaauuuaaaauaugugcuucaugaugaugaaauaaucuguacaacaaauaaccaugacauaaguuuaccugcggaacaaaucugcacuuguaccccuggaauuaaaaguuacaaaauauuuuuuaaaauaugugguucaaauauauauauucaacauguaucacuuuguuaagagaaaaauagaaaaauacuccguauuugaucagaccauguaauucagauaauaaaacuguuguaaguuuuaaaaagccacaauuucuaguuuacucuuuccuuugauagcauuagugcagaaaauauuuugagaaacagauuuguacuuuguuuaccuauacuuaaauguguuguuguaauauuucuuuucaaaacaguggcaccauauuucuuuagaaagugcaacggcacucacuguuuagcagcauaaaaaauauuauuugugaaauuacaauguacuccaaauagagaaaaauauuucaguguuuugaaggguaaaauacaaaaagcacacaagggggcagcaaaaaaaaaaaacagcagagacgguuucaaaaggaacuuuucuaugguauuaaaagacaggagagcaaaauaaugaguaggagguuuuuggauuacaggcaacguuaaguucuugauguagaugcuggucaccugcaccuagaauaggguguccugugagacaaaacaauuauucucuaucguuaagagagauuguucaggaauccuaauaguuugacaauucuguaccagcugaacaucacuagagcuaacucaguugggauguaaucaccauaaaagauuccauuccugugguuacugggagucagggagguuuaagcggaaugucacuacauucaaauaugggagggagaccacuuucaaaaacgaacuuaaauccagagaaccaugguucuucuaugguauccaguaaggggcaaugggaguuggaaguugaguaugggaaaucaaauucugugaauacgguuuuucugauaagauguguuuggcuagcagauccuccgcagcaucuauucaauaagguuaaucuacaugggaaauagccauuugaagucagcagugaaaaauuaccacuugugaaaauuuuuugaaaaccaaaugaucuacauauagaaacagaaaaagaaauuucugaaaggggcaaaugagaucccauuucagaagcuaaagugacuguagagugcagaaagagcacaacauguaggauuucccaauuuuuaaaaaaauucaaaacugaucuuuuaaaccaacucccaccacagaaggccucccugacaacaagggcgaacgcugugaaggagaaaacuaaaggggaaaaagaauacuaaaagaugccacacaaccaagcuggucagacuuuaaaggccuccacuaccaaacaaaccacaaggcugguaucaaaaaugcgcacgcacgcucacccacgaauaugugugaaauauaaaagaaccaaaaacaucacagggcgcacaggcagacacacacuccacacacaauccccacccaccccucgccccccacacacaccucccaaaagcagggugaacaguuaaggcaccuaaaaccccaagccgcauaggcuuccccgaaacauuuuacaguguaaccaagaagcgauuuugaaagcaucugaaaaacgugcaaacugucuugaaaacagggccuggcaacugagacaguuugcaagcgugauucagagggucugccaaggaaacaaaagaagccucccuccuccccgugagaccgcacauggcacgagaggugcuccaggcgggacgcauuuuaagcgaggcagacaaauagaagucugcgcgagcgcaagcgguacauacuagggaucgcuaucuggcgaggauggggccauggaguuuccauugguuggggaaccgcccagcuuuaguuucuccagauauucggcgugcacgggcuuguggcacuggagaaccuugauggcaucuucgacuuugaaccacucucgcuuccucccaaugcuaaccgaaucuucccaauccuccagcagcuccgugacagucaguacauacacguacguucugugcuugcgauccugguucuguucgaagacgcccaggagccggccuaacuuccccuugacucccgcuucuucguacaccucucggaccgccgcaccgcccggcuccuccucgggcuccaugcccccgcccggcacgauccagcgguccggguaccggcugcuacucacuaacaggaccucguccucgcguucgcuccggaagcacaggcacgccgcccgcuucuugaaccccucggggucguagguccgcgucugguuggguuugcacuucauccucgaggcagccuccucgaggcagccuccucucgccucucgcugcugugugggccgccgcugccgcugccgccgccggggaacagccgaggugcugggaagagaaagggccgaggcgaggggcggggaaagagaggcgccuccgucugcccgcgagcccggggagcggagggagagaugaagcugggcggggcgcaggcggaggcgggggcagcgaggcgcgucagccagucggccaguccgaugggcggccggccgaacccgggcccgccggaguggaggaggugccgccgcccgcgagcccgcgacuguccacagaccccacucgcuugucgggggcgcgucucccucccuccgccgccg

SEQ ID NO: 18895 - RNA, 9675 nt, Homo sapiens
caggccacacagcaacauuaaugccaauuagcagcauggguucacuuugcacguuuucaauccucuucauagguaaguguaggaguucaggccuuagggauggaggaccuaggacuuuuaaaaucgaaaaagagcuuaaagaaauaaacaaauaacuuuacaaauggguagccagaauaggacuuagagaccccuacucuagucaucuuugacaccagaugcuccugaucccuaguccugucagugucaaaaagaaagcaaauuggcgguccccuguuuuuuguuuuguuuuguuuuguuuuguuuuguuuucagguuccucuuuuccugucaggcuucuuaguuguaucaacagaaccaauuuuagcuuacccagaaaagggauuuuugaacaccuauugaguagcucagggaaaccucaaaaaggccagagaaucugguuugggagcuagguggccacgaguugcaauccuacccccucugcggacaggagcuacugaggcugaguccagcaccacuaggauaucucuuacaguuguuugugaaaacucaguacggcugcuugugaaaacucagugucucucugacacugucaccaggcauagcuucuucuguucuucugauuuccgcuggucucuucacguguuucuccugauucaaaaucugaauggggaacaucuaauugguggagccuagggcucacaccucuccucuaggcugaguucugguuuccaccuuagggaggaaggacucuuuuuuuuuuuuuuuuggagacagauucuugcucugucacccaggcuggagugcuggaguguaguggcacaaucucagcucacugcaaccuccugggaggaaggacucaaugcagggcuucuccaaaauuuaaaagggcuauucagaagagccuggguaggacaggggaugaugaugcucugacuuugggaaaacagcauugagcaugugugcuucagagucccacaucccuucuccagguccugucuaucuagcuguagguucuacauaugacccaggcaguacugggaaucuaggucuguuugacucaguggucaggccggguaugguugcacaugccuguaaucccagcuacucgggagacugaggugggaggauggcuugaguccaguaauucaaagcagcagugaacuauaaucaugcaacugcacuccggccugagugacaaagcaagaccugccucuuaaaaacaaaaaaaugguggucagacuccauauugauuauuaggggacaggucauggugauaccagauggaaggauuuuuuuggacagggaaguccaugggggcgguggggcacagguuccauggccgacugguuuaccacuguauucaacagcagcuagcuuggugccucaauacaugacugaaagaaugguggaauaagagaacaaacuaagcuggccaccuuccuucuguaguuguaaaauuucacugacacuuagggccccuaauuucggaagaaaccuaagagauguguuuuggaggugucuuguuagauaagggagaucaagaaagguaacuccacucauaccaagcuacaccuucacguaggguuucugacucccauccaggaggugacuccccuccacauuuagugucuccacucagaggaaaagaacaaucaagugugugcuacaagauucuacuguccauccacacauuuucuuucuuucuuucuuuuuugcaacagagucucacucugucacccagacuggagggcaguggcaggaggcucacugcaaccuccgccucccagguucaagcgauucuccugccuuacucuccugaguagcugggauuacaggcaugcagcaccacacccggcuaauuuuugucuuuuuaguagaaacgggguuucaccaucuuagccaggcuggucuuuaacuccugaccucagguaauccaccgaccuuggccucccaaacugcugagauuacaggcgugagccacugcgcccggcccauccagauauuuucuugaaacaauucugcacuuaggacauauuuccaggagaaauugaugaaacauucccauaguggaauugcuugagauugcugggccucaaggucuauuggaaucuaacuucaacauccagcugaugggucagccugcggccuccauauuuccuucuaugaaucaaugauggcaagugcccaucucuggccacgccagcugaaaggcacagaccaccagagggagcaggugugccucuuccaugguggaacauggcacuuccuguuugccgccccccccaaccugcccugcucuggaaaacaccacuguugcuuagcaacagggaaggcagucauccagggccccauguuucuaucagucaccaacccaagugagacauggaauguaaaggccugccuucagaucacaucuacuguagcacuuuggaacuugcuggccacucaaaauguggccugugacccuucaacauuucagggguccccaagaccacccagacauucagugaauuagcuaggacucaugggacucaguauauuauuguacucauggcuguuauuacagcaaaagguuauacaauaugaucagcaagaaauagaaagaacagguggggucugcagaaguccacgcacaggcuuccucaugcucucuuucuccugugagggggcccauagagcacauccuuccccaagaaugaaaaugcacaauauguggguaauguuuugcccagggaagcucacuuagugccccaaauuuuuacuagggucuggucauuaggcacccccugccuauuauguacccaaguuccagacucucggaaggaaagcagguguucagaauaaacuacguuguugguacaaacugguuaggcacugugaaccacccuucucaauuagggaacaugucaacugcugucuuaguuuucuauugcugccauaacaaaugaucacaaacuuagaggcuuaaacuguauaaaugaaucgucuaacaauucuguaggucagaaguccagcuuaggucucugggcugaaaucaagguguuggcaaaguuguguuccuuucuagaggcucuaggggagaauccauuuccuacucauuccaggucggcagaauucaguuucuugacauuguaggacagaggucccuguuuccuuaggcugucaucugagggccauucucagcuucuauaggccaccacauuccuuagcuuguagcauuuuccuccaccuucaaagccagaacagugagucgaauccuucucaagucacaucucucuggccacagcugggaaagguucgccacuuuuauggucuccugugauuggauuggguccacccaguuaauccaggauaaucuucccaucccaaagccccaacccuuaaucaugucuacaaaauccuuuuugccauguaaaguaacauauucauaggucccagggauuaggacguggacauccuugcauauccaguauuuugccuaccacaagugccaaguuccuagaugccagccaagggucuuucuaaauauaacagucucagggaugcuauguuaacucuuuucugcauacucaugcauaucuaaaggaaggugacaucaugagugauaggggauacccucuuccaauaucuuguagccccuuucaugcuuaaaaugucuuggacuucauaaacaacuggacccggggcucagcccacaaagaugccuuauaacccagauuccaauauggcauacacauucugaccuugggacugcgcagugcuaucccuuuccugcuucaaccuggacaggagccaacgucuaggaaacuguuagguuacguucucucaagcauaggacuugacagaaaauauauuucaguuuaaauucuuagcuauguaccaagagcaaguuauuuguucucuguaagucucauuuccucaucugcuuccagguauaacacacugucuuauagauuuaaaugacagaauacauacaauaagguauguguaaggcagugcuuuccagaucacaauggcuagugugcuaggagauggaacauccaguaggaacaaaaacaagacuaaagucuccuguuucaacauggagcuuccucuagggggagaaagaagagaagaggcagagguucacuuuuaggaucugccugggucuuuuuuuuuccuccugagcucaucacuuuauugacaaacuuauuucuccuucuuccugugaaggugugauauugugaaugauuaaccuuuguuuuucaccccaagcuccagcuugcccuuguacucuuggcccugcugcagaugacagacccaaggcuucugccccaggguagaguuauuucagcagaaaugcaaauagaaucaaagagcccaagaucagcauuugagucacagaagagauuucagaaaauguacacugagaaaauagaacuaaacgaaaggcuuuuugaguuggaagaucuuaggucuuuugaauaccaagacauaaggaccuggccuaucgacaggcauacaaggauauaugguuuguccaagggacuuccagccaucuaagacuagauaaagcucccuuacacuaaagggagggcugagagggaggcagagagauaccgaugacauucaaggccaggggauuucaaccuccauuuuagacuauguugaaaucuuaaggagaaucaaucucucucucucucucucucucucucucucuccucuccucuccucuccucucucucccuccucucucucucucucucucucucuccucucccugcucccgacugguuuggguucccuuucauuucaucuccaaauaucacaaugguauucccuggagggcaagaaagacuuuuagucugggccuugggauugaggaaauagaagagaaucugugguguuuacagacacuagcaccauccauuaggguaggaacaguaagaaagcaaagguuugugucaaagacuugaaguuuuccuagugugggucuucagaaaaccacuuuagggccucugagaaaaaagacacugccauacuggcuugguagugagagucagguaaagaccucauuccucccauuacuggaacagccaugaggucuccugacagcaaggugacaauguccagauaacaacaggugaacaaaauagcccuacauacccagagacagagccacuugccuugggcccagcuguucacuaagucaucggguucuuccauuucagugcaagggugccuagccaauguagugagcaaagguugauuucaagauugaauuuugagggaucaaaguuggagcaggucaaaauuauuaacaacucggcgaugcccgaucccuucugccugcagcuacuaacacugcaugguuccuagcuuaacaacccucugaauuuuggggaagcuuccuguaaacacuaaauaaaacaaacaauaugucuugagagcaguguguauuaugguuaaaagcaacugaauauuguuccuccagcuggguugcaugaaugcauaucaggggaaccaugagucccauugaauuacaggcaaacguacuaugccaggugcuuuucaugcauuuuucaagggagaagagauauagcguaaucagauucucagaggggucugagucuuaagccacuguugcaauggggagucuuggauuugugcuuuauuaacuguguguccugugaaaauucauagggaacccccaugucauauuuuccugccaguagaguggaaaaaaccaauaucaaccccauaacauuauuguggggaauuaauuaaaagaugcuuuauaaauaaauucguuuuaaaugagacguucauguguucccuuccccaucccccaauaaauagcucuauuaaauaaaaggcaaccgguugagauuuuggauaacagagauauguauuuuucaaaaauguauguguacacaguuuauauauguggaauaaugaugugucuaauccuguauuuuuucaagaaucauuuucauagauuauuuggcaucgugugcuuuaaaauaaugaugaugaugauaaugauaauucuuugcacuugcauagccaguaguccucucauuuaucucaucgguuguugacaaagcccuccucuuacucuuguaaaugaaaugaggcuagugcugggucugcaguguuugguugccaugguuuaaauucguuucauaagcuguugcuuggcaaucccacgcgucagcuggcucuuuuuccucagcacucucgccacacgcugucugaaguauaaugagacugaggcugggcaaaggaggauggcaguccccaagcacguuccaucuucccacacaacacuguuuguuaccaugaugcuugauaaauguguuaaaagcagagcagugaagugguugcaaacaugggauuuagugucacauagaccuggguucaaguucuggguugggauuuggcucagugucuccuuuggccauucaccuagaaacccgucucaguuucuccauguaucaagugagagauuauaauaugcagcaccuggaguggaugugagaauuggaggaaaaaauucauuuaaaguaccugcacacaguaggugcucaguagcuguaaccuguacuaauaagggucaugggagcugguagaacuauaacuuuccuuguucuguaguaaaaugcucugauguagcagucaguuuggacuuaauuuguguaguuguggcccacuuucuuuuauacauaguaugagugggcucacuacaaauccauagaguaaaacagaaauuuauaaauaaacuaucaggaucaaggaaaagacugggaguguugugacuaaaggaagacaaguagagaugcugcagacagaacauaucaauagauguccacuccagguagugaguggguaggcacugugcauucaaaggggcugucaugggggaggcuucucuccucccuagauaaacacauacccaugggcaguggugugcagguaaaacagcucucagggagagaaaagccuugauuuguaacauuugccuauuucugugguguaaauacuccuaccaugaccaauuuuaaacuaccaaugugaugccauugaagggaguguagaguuggaaagcaaugcccacaauuggcucucgggagcccaucagagccugcuucagcgcagaaguaaucccuucccuaggggaagcuuuuuuguuuuugcuuuuguuuuuuuucucuuuuguggacauuuccaacaagcucuuguauuuauagcaguuuagggaggucaguucucaggacugcucuucuggcauuugauuuucccugauuggaagcauauggcugaggaaauagccucuguucuguugugcaggcccaucccacaucuccauaggcugacuucagcacccuuucuggcuuaagaucaggagcccaugaucuuugcaggauccagaggagacuugggagcuaggaauuaccuagaugaaaaucuuaauugagguaguaucuucucccaaaguuauuuuaucuuuuuuauauaacccaacucagccauacugcccucgucauagucucucauacucucauggucucucauauucauuguagcauucucagugcuacaaugcaugugaccuuacuauguuuauauuagccaccaagcaguuucaaaaugaaucacuuuuuaaauucauccaugccacuguaaagcugcuucaucuaauaugacuucaguguaguugucugauuuugauagcuggaguaaacaaacugugcgugcuugaauuccauucuggacugaacaguuucaagugucagucagugaugcucauuuguaagaacaggcacauugaccagcuuucagugaaaauauguugcauguguuuuacauuuuacaugguccauaauuuguauuuccuuuccacuucguaucugacaauguccaguuaaauggcuccuacagacagagugccccaaaacauagugucuuucuuacgaaucagcugaaaaauaucaggauguuuaugaggcagcagaacaggaaauuagauauaaaacccacaacuuucuaaggaggguaggcccuguuaacaggagauuuuuuugugggggcagugggguuagauacaaagucaugaaccucaauauaauuaauggccugucacaguucugagaguuuucaguaguggguggaguguacaaauuugaagguagaagcuggaagacacuuaaacuucccagcaaaagcaagauccuugagggagagaccaaagucagggaaaauggaagccuguuagggagauggugcagggagugaggggagggggaucugauuacuggagacugaaaagaaagauuugugagaaggaauaaugucuaauggagacuuucuaguuaaauucuguggggggaaaugcuccuaauacauuucccccaggacauuuucauuuaauucuacaaugcucacuguuuaaugggcacagauucucuauggugaaugugaguaaaaucguguuccaagauuuagauaugguagaaaaacaaagcccaugagucaggguagcagacauguggcuuauauauacucucgugugaaugaagggacaucuuugcauagaaagaucucauguucaccauuaacuuaccagguaggggugggggauggaggguauuuucugugccuagcuggaggacuguagguuagacaggcuuggugggaggauggaaauggaguuucuuuaacgagagccugcagguuccuggaacuccuccucaugcugacugcucagaagugccccaccaaauucugcccaguggcggcagaguccugcuggggauggucucgucagauccagaagaguggcuuauaagcaagaauaagcauacauuuucucuuaagaaaccagaguuaacaauuauuuuauuuuccauugucuuggucagcuugggcuacuguaacaaauuacuguagacuggguggcuuaaccaacaaacauuuauuucucacaguucuggaggcugagaaguccaagaucaaggugccagcagauccugugucuggugaggggccgcuuccugguuugcagauggcugucuucucauuguaucucacaggguggagaguaguaaaagcucuuuggagucccuuuuauaagggcacuaauucuauucaugacggcuccacucauguccuaaucaccucccaaagacuccaccaccuaauaccaucauauugggagcuaggauuucaacauaugaauuuggaaggggggcauaaacauucaguccauaauaccaauguuuuugaaauauuugaaaauguuguauaccaaaaggaagcucagggacuuuacucuuaauauuguuuugccuuuaagccuuuguguccauuuaaaacuucucaagucuucuuuuauauauugaacaaauuuucagauccuaaaagagcucauuucuaauuuaucuucaggaaauuuugccucacugccuuuuuauaaaauccaaaauuuugucuccagcuaugacuuauuuggaaacuaauuuuuugaaaaggaguaaggaggguuguggucauaauagauugauggcugccugcuuuccauggcauggaauuguugcuaggagaagcugcacagccauagaugacaguucucagugcccgcuucccccgauccagcugacuuguacuugccaguggaguaugagaguuacuaca

SEQ ID NO: 18896 - RNA, 54306 nt, Homo sapiens
uggacugcagguggaagaacuacaguucccagcagcuauugcaagcucaaccuccgugcacacucaccccaggccucacauccggcaugcgccgugcucgcucacagaacuacacuuuccaacucuccccacacgacccgugacacucuguggaccgcgagcacggagcaggguuucuacagcugcuccccacuuucucggacccgguccuggacccagcccccgacuccgacacggcuccaccauggaggaggcggaccgaauccucauccauucgcugcgccaggccggcacguaaggacagagcccccgcccacccccgaagcccacauccgggacucuaaagcccaggaccccguuucccgggaaccuuaaaacccgggauccugacauucagggcuccaacuccaggauccuaagacccucacccccuuacacacacacacacacacacacacacacacacgcacacacacacacgcacacacacaccgcccucccugacaccgacaucagaggccucccaaauccuuuaaccaugauauuugguacacccaaagcucugggacccagacaccuugagacguuacaaccuugaaaccucaagacccggaacccuguaaucuggggaaucuuaacaucaguucccugagacccuguuaucuggagacccuaagacaccugugcccuaagaaccagggagcguaaaaccccaggacccuggcacucggggacuccaaaaaaucccuggaccagauacuugggauccuucaaacuccaguuccccaaacaccuggggcuuaaaaaaacccaggauucuuuuuuuuuuuuuccuuuuccgagauggagucucgcucugucgccuaggcuggagugcaguggggugaucucagcucacugcagccuccgccucccagguucaagugauucuccugccucagccucccaaguagcugguauuacagccgugcgccaccuugcccggcuaauuuuuguauuuuuagcagagacaggguuucaccauguuggucaggcuggucuccaacuccugaccucaagugaucugcccgccuccgccucccaaagugcugggauuacaggugugagccaccacgcccagccaaaaaaacccagaauucuaaaaucugacaucagcauuuggucacccugacgcacgaagacuccuccguucagaggcccuaaaaacccaggaugccaacaucuagggagucugauuuuuguauugcuugaaacuagguggucuugauauucagggaucuugauacccagggacccugacauuuggaacuucugaaaacagcagccuccuaaaaucuagucuucucaaaacucuagcagcucaauauguaugcaaagaacauacuaucugggaaccaagaaacccagagauugugccaccuggacccuuucaccuucccagacucccaaauuuugauauuuuucuaaacugaguucucuuccacccaccauucuccuacuccaagaucuuaggacuugaggauuucccuaguuccugguuuuccaaauggaagucacagucaccaacauccaggaucugucugaacuguaggcauccucccugccccgacccugguacuaguguuuccaaaaggcugcagggcucagccugaucccuguugccugacuauuccugugaucaagcugguccccuucuucagggcaguuccuccagaugugcagaccuugcgcgccuucaccacugagcugguuguagaggcugugguccgcugccugcgugugaucaacccugcggugggcucuggccucagcccucugcugccucuugccaugucugcccgguuccgccuggccaugagccuggcucaggccugcauggugaguggcccuccuccuaaugcacacauccucuuucuuccucuuuuacaaaguaaccaaguuccuuugcaacacuugccuuuccucugcaacacuugccuuuccucugcaacacuugccuuuccucugucauuuuuccugcggcuuaguuuucauuagugguuaaggcugcugacuguacugccaaacugccugaguaguuuagauccuagccccaccacuugguaacugugugacccuaacccuucugggccccaguuuuccuauuugugaaauggagaugauaaauguagugcuuuuaugaggagcaaaugaguuuauccaguuugcaccugggcugcuccuggcuucuauguuuuaaauuuagcugcaaaauaccacccccaccccauaguauccauuuccuaguuccagaaaauacucugucugggucauauacuccuaaacuaaucacucugugcucugauuggcccagucuggaugacauggucauuccuuuuuuuuuuuuuuuuuugagauggagucucacuuugucgcccaagcuggagugcaguggugcgaucuuggcucacugcaaccucugccucccggguucaagcaauucuccugccucagccucccgaguagcugggacuacaggcgugugccaccacacccaacuaauuuucauguuuuuaguagagacgggguuucaccauguuggccaggaugguuuuaaucucuugaccucaugauccaccugccuuggccucccaaagugcugggauuacaggagugagccaccgugcccagccuuuucuuuucuuuuuuucuuuuuuuuuuuuuuuugaugugaagucucucucugucacccaagcuggaaugcaguggcgugaucucagcucacggcucacugcaaccuccgucuccuggguucaagugauucuccugccucagccucccgaguagcugggacuacaggcaugcaccaccaugcucaguuaauuuuuguauuuuuaguacagacgggguuucacuauguuggcuaggcuggucuugaacuccugaccucgugaucugcccaccucggccucccaaagugcugagauuacaggcgugagccacugcgcccggccgacacggucauuccuauaggacacugugauuagccacuccuucaggauccuguggaguugggauaaggaugauuacccaaagaaaggcaugcugguuacccaaaagagugucugcuauauuaccucugugggaaccacauauccugccucugcuaagagcaauuccaacaaugucucugugacagaauaaauaaagugcuuuucuuuuaaaaaauauuuuaauuuuuuuagagguaagugucuugcuauauugcccaggcuggucuugaacuccuggccucaagagauucuccugccucugccucacuaguagcuaggacuauaggcacaugccacccugcccgagaauuuuuaaauuuuucguagagauggggucucgcuuuuguagagauguugcccaggcuggucuuaagcuccuggccucaagcaaucuucccgccuuggccuccugaguaguugggacuacaggcgugcaccacugugccugguaaagagccauucugaugaaacacucacccauucccaguauagagcugaguccaggaguccaguuccuguauucaagagcugcaaguaaugccacucccccuggcucacucacucugugacuuugggccagucuuuuuuuuuuuugaagcccaggcuggagugcaguggcacaaucucggcuuacugcaaccuccuccgccuccuggguuccagcaauucuccugccucagccugccgaguggcugggauuacaggugucugccacugugcccggcuaauuuuuuuguauuuuuaguggagacaggguuucaccaucuuggccaggcuggucucgaacuccugaccuugugauccacccaccucagccucccaaaguguugggauuacaggugugagccaccgcgucuggcucucuuaaccuuuuugaggcuaaguuuccacauguguaaaauggguauaagaauuguagcuacuguauaggguugcugugaggauuaaacaugaguuaaugugugaaaagcugguuauaauaagcuuugcauaaaugggauuacuauuauuggauagguccgaucuggaaccugugaauacauagugaauggaaacacuuugaacugacccaggaaguauauggugguggagggacgauagaguaacuaccgugaaaacuuucauuuagauauaggggacuggguggcuagaguuguuaaauuugggccuugcuuaugcaguuucugucucuuagcaacaggucucagagcuccauccaucccuucgcucucagguucacccagcucucaggaguugucacauuguucucucuggggcucuugguggccuuaugaggcaggcagucuguccccuggcccaggacuguauguauucuuaagguuagcacuuaauaggggggaaguuaugucuucuguuugcagaggagaguacacagcaggagguguugaggugggggcucaggcuuccugcaguucucuguucuucccucagugcugucucucuuggauuuuguucaccugcuuuugcuuacauugauuuuaguggggguuagugacuauggcuuuuccaguggccaggagguacaugugggcugggcacguuggcucuugcauguaaucccagcacuuugggagucugaggugggaggaucaguugagcccaggagcucgagaucagccugggcaacauagugagacccccaucucuacaaaaaauaaaaaaaaaauagcugggcaugguggcacacgccuguggucccagcuaugugggaggcugagguaggaggauugcuugagccugggagguccaggcugcagugggcugugauugcgccacugcacucuagcuugggaaacagagugaaaccccaucuccaaaaaaaaaaaaaaaaaaaaagacuggggacgguggcuccuguaauuccagcacuuugggagguggaggcgggcagaucucaccagaggucaggaguuugagaccagccuggccaaccuggcgaaacccugucucuacuaaaaauacaaaaauuagccuggugugguggugugugccuguaaucccagcuacucaggaggcugaggcaggagaaucgcuugaacccaggaggcggagguuccagugagucgagauugcaccacugcacuccagccugagcgacagagcaagacucuuguuuccaaaaaaauaaaaaacagguacauaugguugucuggcccccagcagccuugguuuaucagcagcaggcaaaaggaguucucuuaauccagcugugugcugucccuguagcccccccgcaacucagcacugccauguucuggcaucuuuucuucauaugcccugcuccuggcaacaguuucugcaccuuagccaccuccauauuuuggcaccuuccccacuccuggaaugaguuucuauaucagucacagcucuuugauugcauauuguggaaaaaauccaaaguaaaauaccuuaaaagccagugguuauacuuauuugaccuugagccuccaaaauaaauauaucuugcauugugacccaguauacuccuaaguauagaauaaugauggcuucuaaguguacucugugccaggcccugugguaaguaacaugguguuaacucauuuaauucucaggacaaccuucugcuauauguacuguugguauacccucuuucagaugaagaaagugaagcacagagggauuaagugaucugccugaggucguauaguugguaagaggcaaagcuuggguuugaauccaggaagucugcuuucagagucuaugcaguuccaaagcaguggcaacucuggaagaaaaaggcuuuccuaggccggguguggugauucccaccuguaaucccagcacuuuggguggcugaggugggcagauugcuugagcccaggaguuugagaccagccuggccaacaugguguagcccugucuacacugaaaauacaaaaauuagccgggugugguggcaugcaccuguaaucccagcuacucgggaggcugcgugggaggaucacuugagcccaggaggcagagguuccagugagccaagaucacgcuacugcacuccagccugagcgacagagcgagacccugucucaaaaaaaaaaaaaaaaaaaggaaaaaggcuuucuuucucuccuggccuguuuccucaguccccaucagaacccucaugaguccuuuuguucugagcuauugugcuucuggucuuuuuguccuguuuauuuuuaggcacucuuucuauaauagguagauuugcucuuuaccuaugauaugggcuccaaauauuuuuucccaacuugucauuaacuuuugacuuugcuuauucuauuuucuuuaaauauuuucuuucuuuucauguauucaaaaguacccaucuuuucuuuuauggccucuggauuuugagucauagaaaggccagagcuuuaaucuuguuucuuguucucuguagcguugacuaucaucacucugugacuccccccagggcccagaggccuuggggagcugggggagguugggaggguggugguuagugagaaagugggagcguuuucagccuaggcccaagucucccagggcaggaggacccugccugcuuccugauagccgcccaccaacccucaggaccugggcuaucccuuggagcuuggcuaucagaacuuccucuaccccagugagccugaccuccgagaccugcuucucuucuuggcugagcgucugcccaccgaugccucugaggaugcagaccagccugcagguacugggugucugggaugugggcgggggcggugaggggagaggagggccuucuaggggcuguagggcugagagagguagaggugguaaaaagguugauggguagggguggcgguaugugccuucaggagagcuaggcaggaggauuaggcaucagagaggggcuacagggcagggggcagggggcugagguugagcugaccccgguggugcguuggugcggggaggggccucccugacucaaccccugugcccucccucucucucacuucgcucuaaccacuugggccuccugggugcuacucaaacauaccccaguacacucccgccucugcaccuuuguaucguugguuaccuuuccccuagguacccucaugguucacucccuuaccucuuugagguuaaccuccucuccgcagcccucuccugauccccaccuggcugcagucuggaugguauucaggauccuauucaugaucucucuccucugcuagcuugccggcucccugagggcagggaccuuuauccaguuuguuccacgaaguagcccuagugucuagaacagcgaccuguacauaguaggugcucgguguuuguugaaugacugaacgugagaacgcaagcuggauagauguguaucucuggaugggggucaggaguggaggcuggucuccuaggguaugcccuuuuggauuugcagcauugacaucugauucacuuccucccuaucccccauaggugacucagcuauucuccuccgggccauugggagccaaauucgggaccagcuggcacugccuugggucccgccccaccuucgcacucccaagcugcagcaccuccaggugagaccccugacucccauggaucuucucuuguccccgucugggugcccaggguuuuggcccccuaccccuggcaacccucaucccacuucacccuggagauucugagccugcucucccaccagggcucggcccuccagaagccuuuccaugccagcaggcuggucgugccagaauugaguuccagagguggugagcaugaggcuguggggaggggugaggaggaaggugggggggaaccucauagcguugccaugcggcagggccagcugacucuguuccugccuccagagccacgggaguuccaggcgaguccccugcugcuuccagucccuacccaggugccucagccuguuggaaggguggccucgcuccucgaacaccaugcccugcagcucugccagcagacgggccgggaccggccaggggaugaggacuggguccaccggacaucccgccucccaccccagguacagccagaugccuggcucccugcugucugggcugcugcucacugacacucccgcugguccucugcucuccuuccccacuuugucccucccuuccauuguuuccccucugugugugcuuaccuagcuccccaccugaaagaacacuggagucagaaaaaaggagaaccugggacaagucaguaucccuccucagagccuugguuuccugugcuaaaauuugggguaguaauagugcucuccucucagggcaguaguuagacugaauaaugugcuugagauuccuggcaacuggagcaauccagauuggcuaccugccuucaucauucauuaauucauucauucauuuggagucuugcucugucacccaggcuggagugcaguggcgugaucucagcacacugcaaccuccaucucccggguucaagcgauucuccugccucagccucccaaguagcugggauuacaggcuugcaccaccacaccuggcuaauuuuuauauuuuuaguagagacaggguuuugccauguuggcuaggcuggucucgaauuccugaccucaggugaucugcccaccuuggccucccaaaguguugggauuacaggcaugagccaccgcacccggcccuaaucuuucucuguuucugcacuugucacugauguucauuuuucugguuucuagguuuuugcacaauuucugccuguccccauuauucuaguucuguguuuuugcugcuccucuuucuuaccucucugucuccucguuucuguacugaauuccucucuugcucugucuaucuaucuguucccccuucuccucugucuacuucuuuaucuguccccucuucuucucugugcaccuuuuuaucuguguccccuucugcucuguccaccucuguaucucuccccuuccuugcuguccaccuauauaucugucaccccucugccucuguuuacuucuuaaucucucuccucuuccucucuguccaccucuguaucuguugccccuucccucuguccccuuaucucucccuucuuccucucuguccaccucuguauuugucccuccuccccuucuguccaucucuuuaucuguccucucuucuucuuuuuuuuugagacggugucucgcucugucacccaggcuggacuacaauggcaugaucagggcucaaggcagccucaaauucccgggcucaagcaaucuucccaccucaggcaucugaguagcugggucuacaggugcgugcgcccggcuaauuuuuguauuuuuuguagagaugggguuuugccauguugaccaggcuggucucgaacuccugaccugaagcaauccacccaccuuggccuuccaaagugcugggauuacaggcaugagccaccaugccgagcccccucuucuucucugucaaccucuuuguccccucuucuucucuauccaucucuguaucuguccccucuuccccucuguccacuuaucuguccccucuuccucuguccaccucugcaucuguccccuccuucucucuguccaccucucugucacccucucccucuguccauuucuuuaucuguccccuuuuccucucuguccacuucucuuuuucccucccuccauucugcucuccuauuucuguucccucuuccucuguguucacccagguaucaguaccccuccccuucuguccaccuuuacaucuguccccucuuccucucuguccaccucuguauuuggccccccuccccuucugucugccucuuuaucugucuccucuuccucuguguccacaucucugucugccccucuuuuucuccaccucugugucggcccccuccuggucuguccacuuuuuuaucuguccucucuuucugucuucaccucugugucuuuuuacauuuuuauuuuuuuaucauuauuauuauuuuuugagauggagucucgcucugucacccaggcuggaguacagugguacgaucucagcucacugcaaccucugccuccuggguucaagugauucuccugccucagccucccacauagcuaggacuacaggcaugcaccaccacgcccagcuaauuuuuguauuuuuaguagagacaggguuucaccauguuggccaggauggucucgaucucuugaccucaugauccaucugccucggccucccaaaguguugugauuacaggcgugagccaccacgccuggcugucuguuuuuguuuuuauaucuguaguaauuuucaaacauaaauguagagagaauauucuagugaauccuauguaccauuuugccaacuuuucuucaucuuuucucucccaacuuuuucuuuguugcuguauuauuuuaaagcaaaucucagacaucaugucauuucagcucuaaauacuuaggacuacaucucuuaacucauaaggacauucaguuuucaagguaaccacuggaccauuuucauggcuaaugaaguuaacaauaauaucuuguggguuuuuuuuuguuuuguuuuguuuuguuuuuuguuuuuuuuuguuuuguuuuugagacggagucucucucuguugcccaggcuggagugcaauggcgugaugucgcuucacugcaaccuccacuuccuggguucaagccauucuccugccucagcccccaaguagcuggaauuacaggagcacacuaaguuuuguauuuuuaguagagucgggguuuuaccauguuggccaggcuggucuugaucuccugaccucaggugaucuaccuaccuuggccuuucaaagggcuaggauuauaggcaugagccacuguacccggccaacaaugauaucuuaauaccauccaauacuugaguucauaaucagauuuucccauuaucuugaaacucuguugucccucucuugccucucucucucugccucuuucugugcuugguaccuuugauucccugucucugcccugucccccgauauccugucuaugcuucucuuggauuugggggcucuaggcccaccccccucucuucccacauccuucuccagcauggggaucuaguggguggagagaaguaugucugugagcaagaggagaccccuguccucgaggagaucccaggcugguggagcaggagaguagagcagggccugccuuagugggaaggcuggagggugggggugacuugucuguauacucuugucaggggguccuuggaggaggcagggccuugggugcuaggugggccccuacaccuuccugcuucccccgccuuuucuccccaggaggacacacgggcucagcggcagcggcugcagaagcaacugacugagcaucugcgccaaagcuggggccugcuuggggcccccauacaagcccgggaccugggagaacugcugcaggccuggggugcuggggccaagacuggugcuccuaagggcucccgcuucacgcacucagagaaguucaccuuccaucuggugggugcgccugaggacaugagauguguggaugggcguggcaggcuuggaggguggcuuuuugugucagcaccacaccuuuauccacacagguuccuguguucccacuggacaggcccucgccccacugugggauggguacccagagggguccccuagcuuauuagggacuugacuggagaaaauguggauaggugggaaccaugcaaagguguggggguguucuuggggcaacacccccuuuccucaggcaguuuccuuugagcauaucuucuguccuaagauguucacucugagggccccccauccuucucaugggcauuugaggcuugagagauggggcagguggguaggagcugugacagggucagggagauuucuccacgagcaagcacucuggcccgagguugcagauggugccuuuacccacauagucacagucuggccaccaucggugcuucagugggcaugcaugccgcacugggggcaguucucaggggaggcugaggcugggccacgugaggaagggccuucccuggcagccaggaugccccucgucacuccccuuaggagccccaggcccaggccacucaggugucagaugugccagccaccucccggcggccugaacaggugagcagagugguuuggaggggggugucccaggcccuugcuugucuacugggccugacaccccaacccugacuggccugggccucccaggucacgugggcagcucaggaacaggagcucgagucccuucgggagcagcuggaaggagugaaccgcagcauugaggagguugaggccgacaugaagacccugggcgucagcuuugugcagguaaggggcggaggaggggcugcgcguugggcuaggucagaaggagggccucggggugugagggacuagauggggcaagaggugcucuguagaggucugcacauggcagaaggguuccugggagccauuagggaucugugggccucuugaggguggcuaugagaaucaggccagggugagggucugugggcaucuauggggcaccgcgggucugcaugggcaggggauugagggguccucggagggucugugggcaucugugggguacccacgggucugcauggacaggggauuaggggguccucgggguccuuggcaccagcguggagcuguuagagaggccugugggggccacagggguguacagucaucuguggagcuccaugggggcuguggcaugugacuggguauccaccggccaggcagagucugagugccggcacagcaagcucaguacagcagagcgugagcaggcccugcgccugaagagccgcgcgguggagcugcugcccgaugggacugccaaccuugccaagcugcaggugggguuggggcuguagcugggcggagaggggcagggugggguggggugggguuggagggcccagccugugugacauguacccaucccccaccagcuugugguggagaauagugcccagcgggucauccacuuggcgggucagugggagaagcaccgggucccacuccucgcugaguaccgccaccuccgaaagcugcaggauugcagagagguaagcaguggggcccugggcugugggcgggccagggcaggcucggucccucucuagggggccaucccuaugcucugcucacugucuucugccugugggcucauggcagcuggaaucuucucgacggcuggcagagauccaagaacugcaccagaguguccgggcggcugcugaagaggcccgcaggaaggaggaggucuauaagcagcugguaaggccugugugagggaccuggguagcuuaggaggguggggggaugguccuggggcagugccugcuauaucccugccuagaugucagagcuggagacucugcccagagaugugucccggcuggccuacacccagcgcauccuggagaucgugggcaacauccggaagcagaaggaagagaucaccaagguacacugccagggccauggagggugggucaugugggcugucaggcauaguguggccgcacagggaccucacacccucaggcagagcuguccagucacacucuaacacagaauagucacacacaauccaucccagucaccccugacacagugacacagucccugucugguacacaugaggacccuccacugcuagccagccugccccaggcaggggcucauggcugccauggugucugccagaucuugucugauacgaaggagcuucagaaggaaaucaacucccuaucugggaagcuggaccggacguuugcggugacugaugagcuuguguucaagguguggggcagguugggcgggggugaguggggugaggcugggcugcugccuugugcaucugcuaauuggcuggcugggguccagacccaggcccugugcgaggcuggaggugcacugauacccagggcuggcuuuguuucauggaggaugaagcuagugggguggugggagaggguggccuucuuagggcauggagauggucaagggcagcccacugauaccuuugaggucccugugucuggucaggaugccaagaaggacgaugcuguucggaaggccuauaaguaucuagcugcucugcacgaggugaggggagacaugugccugggguggggcugcugggggugggugggacugggugcaagccuucugcuccuguuguccccagaacugcagccagcucauccagaccaucgaggacacaggcaccaucaugcgggagguucgagaccucgaggagcaggugaggccugggggcaggauggggagccaaggcgggccggggggacaguuccucagguuaugcugacagaggcuguggagccacacacagccgauggcuggacacccagcccugccccuuagugccugugaccugggacaggcaaguggccuacugugagccccagcuuccaccccaagggcccuccugucugccucccagggccaugggcagaggcuucagcuuaaagauguagggggaauccugccacauggcgaaggaugcuuuggguagagggaacaccacacgaggccuggccaugggacagagcaggcuguuggaguuggugggaggggcccagaguggcugugaugggggcuggugagcaggagcugggaaaggggcugugugugcugagggggcauguguucacauugccucagaucgagacagagcugggcaagaagacccucagcaaccuggagaagauccgggaggacuaccgagcccuccgccaggagaacgcuggccuccuaggccggguccgggaggccugaggagccgccggcagaggucucuccccagccucaggcagggauuuggggugcuggaggcaguggccaagcacaugcccuagcuacuuccuccgcuguccaguuccuccugcugcggccuuggacccagaccccugcccacugaccgcaacccuuauauggggugauaguccagcauguggggagcucggcugcaguuuauuggggacgguacuguggguugggggccuuggaucccaaauaaaugaguaguuccucugcagucuaagcugaggcauggaucagggcucagggaaugggagugaggugaguggcaggggagacacgggguauuuuuggcaaggcaguguguguggcugugugugucugcacgggacucaagagacccacuggggggcugugcgugugcauaugcgugagauacacaggugaauucuaacaggccgugugugugagcgagcacguguugggaccucagauccugaggguacugacgcugcuucuguguaggccucugggcacaccccuguguugacagugccccugugggcccugaggcuggcugugggugcgugccuugggguguguggguugucagggcugugcuugugugugauugugugaugaugcagcuuugagguuguuugaguguacugaggcaggcucucuguguuuugggguuuguguugagugagggacaggauugugacauuuugugugucugugugacuuuuccagcccugaaguaaucugugcgagcagcugaggcaggcucuguguggcugguugugaaggcucuguuuggcugcagggcucgacuggggggugugucuggggcggaggugggggcuggggccaggaccggggccccucugagcagccuuggggcaaaggauaugaugggggaggggguggcugccagcgggggaacaggggcccuggcaggcaagacaguggaaaccucacuucuuggucccugugggcacauccagggccuaucaucccugcccccaccaccucugccucccaccaguuuggccccuguucguccauccuccuuuccuugaucuugaggucaggggccagguguaggguuggaacaccugcugggccucuggcuccguuucuugcggaacuccagcucauccacgguccacacagcccccuucucgcucuccacccgcacaaagcacuugugcagacucagguuguggcggauggcguucuguggaaggccggggacagggagcaggugggcgucaaccucugaggccagcagccaccaccaacaacccacaucccguuccuccccaaugugccuaugagcccagacccaggccugcccacuuugagcugcgauggcacuugaggccaucccagucaccgccaccucagaggagcucaccuuccagguggcaggaugguuucugaagaaggcaaacaugcgugugaaccagugguagaucucauugaguguccgcugcuucucuggagccuccaggauggccuggaaguuggggggugggguaaggggcacauuccccaaacuugggguuuagaggggcuaugaccuaccccgagccaucugacaugggggcggaauuguaggggcagguaaucagggacaggacuagauguggggugaagcauggggucaaagaugggguuagaaaaggggugaagugucggguugggcaggguuagauggguguggguaugguuguucugggauuagguaagggaucaggacugagguugggaguggggucuuguucagggcuagggcugaagugaggugaaaggucugggauggaguuggaguugggguucucuguggaggugacauuucaggguuggggaaggugaagggucagaaguggggucaaggauuuggaagggguaaagggccaggccaacuuaagggucagggaagggguggguuaagagucaggcugggguggacucagguggggggucuaggggugagggaugggaugacuuggcuuuaggucagaagccagagaugguuugaauuaucgaguaucuuacgugucagggacaugguuaggugguuaggcucagggcaaggaugagguuaguugugggguucgguguggagugaggcugagggucagggaauuugaucaguuuggauucaggaaugggauuacagagucagcgaugaugauugcagugaggcuaucagucaggauggggcuaggucaggguuucaguucagagacagucggggaauaucugguaucauguaggggugagguucagguuugggguuagguguggcgcuaggaugaagguucugagaaggcauuggggaggcugagaugaaggaguugggauggggugaugaaguuaaggaucaaauggguguuacaaggaaagguugggaauggugcccaguuggggguguauugacauacugggguacguuggggccagggaaggagaugggguuggguuggcauaaaggcuggggaaggaguuagaguaagagcugggguacguuuagggcaaggugcagagaugggguuagcuuuaggcuauuuuauggguccaggagaggguuagguauggggcugagguggacaucuggaaagggguagguuuagggucagaauuuggcaugcucuggccuggauggugguuuagguuuggauuugcggacagguuuggggugaagccagcaugaggggucacauuugaggcacggcuuggggauccuuggggcuggggcuugggaauggaggaacccacucugagggcacucagagggagacaggaguuugggaggcaggucccccaccccaucuuugucuuccuccuccuuggggccgagcugcccugcuuacccagcggaugagcguggcguaggugaaagggggucgcauguuguggaacuugaaguaguccauguuguggaggaacucugucagaggguggggaugaaucaagccccaugcaggaccuccuagcuagcucccuguccccucccccuacaaggugagucuacaggccugagaucucaccgucaacacccguguccacgggcacagguacuguuugcugagcaccugacauaaguuguaucauuuauucuuugcaccacuucugccaaaauaguucuccccgagguugaaaagaagcggaguaacuugcacaccaaaggaugcaagagguuaaauggcagagccaggaugacagucaaggucucugaucccugcuaagcccacaggccaggccugguggagagcaguggauaggugagcucgggcgaauccaccccgauuuuccuuggucaggggaggaaaggaggugcuccuggaauuacuuagcagggucccucccuucugauggccgaauauaguagcuggaguccagagugggugaggcauggccccaauccccaagggagucagggcuaggggcccgacacucgagaccauauggggggcuuucaggccacggacaucccgaaaggaagcuuuugugagcggaugcauuuucccaaaggcugaguggcggcagcugcagugguggugguggugggaaggggcagcauggagcuccuuugcacccuccacccagagccugucaggauuaggagcuugggggcaccguguagugcaaggaccauucuuaccugggaaugugcuguuuccauggcuaccccacaggugccuccggacagcaaacaggcugucaggggccucccgggggccagaccaggcugggacgacagggccuuggcugccagcagcuacgaugcagcaggagcccuugucggaugaugccugggugagggggagaggcuggugacccagaggcuuaaacuucccacuuuuuacuuucuauuuuauguuuuuuauuuuuuuugauacugagucuugcucugucgcccaggcuggagugcaguggugcaaucucggcucacugcaacccccaccucccagauucaagcaagucuucugccucagccucccgaguagcugggacuacaggugcccgucacuacgcccagcuaauuuuuguauuuuugguagagaugggguuucaccauguuagccaggcuggucucgaacuccugaccucaugugauccacccgcuucagccucccaaagugcugggauuacaggcaugagccacugcgccuggcuccacuuuauuuuuaaaucaguguuuuucaaagcaaggacgcccucuucuaaauuccagucugagguggaaucccacaaaacagcaugagccguauuuauuagagcacaggugcggaugucguauguggccacugaugcugggaccaugaacugggguugaauagggcucuuuaccacccaacugugaccuugggaaagucaccuaaaccccccuggccucaauauuccucaucuguacauucgcaucaugagaaauaaauuaccaccagcaaagcgcucagaaacagugccuggccuccagggcuggcuucaugggcgugugaccuaugugguuauguggcacccugugcuuuguuuaaugcucuguggucgccaucuugaaaucugaacaaggggcccugcagguuacauagcugguccugcuggcacacagccugcaucuggcaagucuggcuauuugcauuugcuuuaacaacucaggaucacaguguuuggggaucuuagagucagaggguuuuuuuuuuuuuuuuuucuugagacggagucuugaucugucgccuaggcuggagugcagugguaugaucucagcucacugcaaacuccgccucccagguucaagcaauucucugccucagccucccaaguaguugggacuacagacaccugccaccacgccuggcuaauuuuuuguacuuuuaguagacacaggguuucaccaucuuggcgaggcuggucuugaacuccugaccucgugauccacccgccucggccucccaaagugcugggauuacaggcgugagccaccacgcccagccggggucagaggguuuguaaguagaaggggacagauuuccaggucugggcauguuuggagcuggggacaggggccccuagcucucaggaccugaaugugagguuagguucccugcaccgugcagaccuccucccugccccccagcagucugagucugccaccaccaguccuggggucgcucaccacagaugaagccuuggucagugccauuuucccagccaggugggccugcauggcacucagcuucuccuucuccagcaccagcugugaaauggcacaaacaugaggccucagccuggcccuucucugccacaucuuugcccaggcuacggucuucccugggagugcccgcuccucuuccuuccuuuauaccagcccucgucccaggugaacuugguuucuggcacaugguggacagaagguuuugcgcacuaucccuaucccuuacccuccaccgcccuggcauuaccugcugcuccagagacuguaccaucucucucuggaggagacauugugcccugcccuucucauccagaagaugguccgccuggcagugccuaaguagggagaagauuccaugcaggugaccacgacaggccuggucuggcucaaugcucugaauggggagggcccagacccucugggaguucucuccucugagccccagcuccccuccccucucuaccucagucucccucucacaccccucguucccuuaacacaugccccucagcaccuacugcaugucaggccugaacucaccacuugagccuggccagagugcuggagauaauguuggaaguguggugaguugagaaugggccagggaggugagagugggcaaagcauucuggguggagggacggccugugcaaaggccuggcugcaaggaggacaggacaugugggguugcugcuaaggguuguguguagugugguguguauuugugugugugugugugugagagagagagaaagagagagagagagagagagagagagagagagagagagagagagagagagacauauggggggacugaggggaggcagcagcagccaucuagaggagcuagaacuuugggaacaguggaauaaggcuggcauguuggcaugaggaguagcagggcaaagcaggagugcagauucuagagccuggcuacauggguucaaaucccagcucugucacucaggaacugggagauuuugaucaagacacuuaaccucuuuggccucagucuccuugucuguaaaauggggguaaauaacagcacaaacguuucuuauuauacauacgagaaaacugaggucgagagaagcuaaguaauuuguccaaggucacacagccagucagggauggagcugggauuugaacccacagucucagaguuuagcucuugcaucuuacuacuuauugggaugaagccugagcugagaucugcacccuagaccucuccccacaagccagggccgguagacuggcacaggccugggccacucacuugaggaaguccucuggcucuucgaagaccuucucacauccgggccacuugcagacaccauuugccagcaguggguaggagcucuggggcacagccgaaagggugcuggggggacagagggugucaggggaggggauaggagggcgaggauccuucccagcccuguccacugaccuguccuuccugggugcacugggauuugggaaggugcagagcagugccggcucccuggacacccauuccaggcuggccacguugaucccuguggguggggacagggcaccuauggaggcugugggcugggcucuggagcuuggcccacaaggccucucauuuugagcuucccacccuccugagccucgaaaacccugacucccagggggcucugcuguccccaaagucccaggcuucuggcagagaagcuuaaagacggccauucgcaggugcugacauuuugacuagcuuuguaaagcucugugguuuugugauuuugacauucugcaucuuuaagguucugcaccugacguuuuuuggaggguggaguuuccaagccucugagaccugacaccuuugacccccagaguacugcaauucagaauagccuacacugcucacagccaaggaucuggggacuuggggguucugugaagccaugggguacgggcugagguguuaccaggugggaggccaggccgggccuugagggagaagaccccaguggcggugguggguggugugaggcugaucauggcugggcucuccagggggugcaccugcagcacagggguccgggcgugggcauccaccguugagagcuggggggcacaugugggcugugguucagccugacucggggccccuccccacaguucucccaccugcucccuccucccugcccauucaccguccauaccuggugcaugaaauguggccuguccuggaggagugccuguaaguggggcaaggggcccagccgugccccggagggugccaccaugacuaggggcagugugggcagcugggcagaaaggcaggugggugagaggccauccugauccucacuguucugugucuaauucaaauacucugcacugcaagcccacaugguagaugcuaugaucaucccccuuuuacacguauggaaacugaggcucauggagaucgaguaacuuuuuaaagaucaaacagcuaauaaguugcagagcuggccucagcccugucaccucaccuacuuggccccaguccucuucucuugucacauggggauggggacacauagcuaugcucaugggacuacaauacggccuccuccucuccugagacagggauugggaggucggggagagccuccaaucucugaggccuggcagguggggauuuucuuggcccugcaacaucugcauaagucacagacuugccugggacccagaaaccacuuccugugccccagccagccccccucccgcccagugccacaguaaaggucggcaccuguagguccagguaccccacccugccugccccauccugggcccagggccucaccugcagcugcgaugguggcaugggguucaaggaagaagaggaggcaugggccccgccucgaagaucucggcccuggaagguucccccugggccccgggcccccagcaggucugaggcuuugggugcagcccuccagcugggcgaggcuccuggggaugggccaagggccaaggaaggggccgagggcuugccaggccugggguugggcaucggguccuuguccaagggcaggcugcguagacaauaggggaaaggagucacacgugugcuagggcgguaugagauacucgaccaccugagccacguggacacuccucuggucaaagcaggcauuggcugggacaugucccgaggggccccauaguugcaccccagcucuagacacacacacacacacacacacacacacacaccaagaacacagguacauguacauacccacacaugccccacgugcagagguccagcaccuggcuugccugcccacgcuagcacagcccugguguggauguguccucuaugagggcaaugguuguuucccccuccacuugagagcuguuucaagccucaggccucuagcccucccugcacccugcacaggcuguguuugcucaucuugccggagcuggucucggacuuucuccucggaguccuauuuugccccagugacuaggcauggacucaaaagauucaucuggcugcugugaguggggcuagugaggaggcuauuguaacaguccuggcaagugaugaugcuggcacagaaugggcugguggcaguggagaaggcgagaaguggguagauucugagacuuaaucugaagcuggaucaggagcagugcuagcagcuuggauguagugggcaagagggagagucaaagugacauggguuuuagcuugagcagcuggaaggaccgagcugacauuaccugagaugggggacauggcggggaguuggauugggugcaaaagugcagguguagauagacaugaagagucuggcauuaaauaugugaguggaggagcugagggggcagcugaauacgggggucuggaucucagggcaaggaggcgaguccaggagugugaucaugcacggauccagcauggcaagugacagagaggaggagagauggggucucuugagcuggggccuguagaagcuucucuacccagcccccaucagaguucaccccaauuucuggcccucaagccuggcucaugcuacacccccugccucaaaugcccacuccuucuccucuuucccuguccaagccacgcaagaccugcucuucuauuguccucaccuugaaagcccuccacaauggcuccgggcccccugcugagccccagaaccuuccacucccugagggaagcacuggcuuuucaggauccuauaauccuggucugagaggaagccagagcuggaagggacugcccagccaaccccauuauacagaaggggaugcucagaugccgaguuccguagucccauagugacuugagaacuccacuucuuucuuuaggaaguguuuccgugugcacauuuuauaaacucucuggugugugugugugugugucuccaucuccccguuccaccucacagcacugaguugggcacacagcugcugagagcagcccgggggaguauagaaggguucugggggagcaguugcuccuuccuuucuuugcugucaccuccugggggugguugucagagcuguggugcugagggagaugagugugagaauccagguauuaaguucuuagucuccugggggcuuagaacauuacugcgugagaaacaggagugugggucuguggaggcuccgaacaagggccugggagagcacuggugagaugagaaggugagugaaugaaugaagccagagauggggugaugcuccuucaagccaagaaauaacaaagauugccagcaaccaccagaagcugggggagaggccuggagcagcuucucccuuauggcccccagaaggaaccaacccuggcaacaccuugaucuuggacucuggccuccagaacugugagaugaucaauuucuguugcugaagccacucaguugugguacuuuguuauagcagccagaacaaacuaauaccgauuucggugcaaauggauguuuuccaccacucuggccuggcccauguggcuggccuguggucacuucugaagcugccuggacacuuggccagagcuaagaauucuccccaaacacaugugggauggccugacucagcaaagcauagauacauucucagacagggacauggagaugaucugucuggggguagaggaccuagagggccgggcugggcagccggcuuccugcacugucuguugggacgucccuuucugacuggguuucucagaagcugaaugggggauguuucugggacacagauuauguuuucauaucggggucugcaucugggcccuguugucacagcccccgacuugcccagauuuuuccgccauugacgucauggcggccggaugcgccgggcuucaucgacaccacggaggaagagaagagggcagauaccccaccccacagguuucguuccgagaacuggcugcccuguccugcagcaggcuuggcccagguggggugacaugggugcugguggaugugguaggugauguccaucuggccacuaugacaagccccuagcucugaagaccuggcccuucuuggguuguggagaggacccagguuugaagcucugagagugccaggcaggcuccacagauacugggaccccuggggucuucaaauaguauaacaccaggaccucagaaucauagaacagcauuucuuagauuuaaaggauccuagaaucucaaaaccacagacuguggggucuacggucccaaagucucaguauguguaggccagugucccugguguccaaacuccuuggaaccaucugaaagucaggcagcuugcugcuucauagggccucuugccuaccaggccuggaaacagagccagccucccuagggccucagucucccuguccacucuggaacaacguucccaaauacauggccacuccgccagagauggcaacagggggaggaggagguugaggcuggugugccuuuggucugggccucauggggggagcuggaaaagccucagccuucgccaauacagagcccaucaucagacucucuagaggggccccacaaucaagguuuucggggaccagcaccagcucuggggacacacagccugacugacugacaugccuccaucaucaccacgcucuggccaacuaggccuccugaccuauggaguccggggccucaccuagcccagcucuugugaggcugggccccacacugugaucguggaucguccaaccugugggaaguugggguccaacgugugagaaggcagaagggggaaugguagcccagguuccccuucccccuucugggugcugagggguaaacugaggccuucaguuggggagagagccagaaccagggucccaccuagaguccugagaucuaggcuuggauuucaacucugccgcugcauuucggugaggcccugagaucucuggucuucaauuugcccuucuacacugagcacggagaggcguggaguagacaagggccagggcccuucuacgcugucugguuaagucauuaggugucugcagggcuucaaguugacaauugccccucuauccaggggacuggcugagagauagggauacauagagacaaagagacacacacaaagagcgagcaagagagaacaagagauagugagagacauugagagaaauggacacaugcauggagagccagagugcaugugugcgagaggaggauugccucaaauaagaacauuugcuggucucuggcugguucaacugaugcugccugaaauaaucaagaauaaagaagggcaaggugccagggacacccauggcuggguauugaauuguauugcaaagcaacaaucagcaaaacaguguggcccugguauaagaacagauacuggggaagagaacagaauagaaagcuuggacauggacccacauauggagagaacugaauuugugaugaauguggcauuucaaacuggaggaccauggaguaugguuuaacaaaugugucugagauaauuagggagaagauaaaguuauugagugaauagucaguccauuaucccaacaaccccucccugcccaguuugaaaugucaccaucaucauauacccuaaaaugcccagauccauucaagauauaaguuuuaacaccuaaugcugaucuuggguuuauugugugucaggccuugugcuaaguauuuacugugguuaaaaauuuuaaucuaaacaaagacuccugaggaagguacuauuauaaccauugcaguacauaugaggaaauggagguauggagagguuaagugccuggcuaaaaaucacacauagggcuuggggugacgcuggguuugucccagacagucuggcuccaguacccacacucuuaaccucuauaguaaauggaaaaaaugaagccauaaaagagacuagaagccaacauaggugaacauuuaucucauuuucaaguaggaaaggacuuucuaagcacaaaaccagagacagaagccacagaaaaaaagacuaaccuauuugacuguauaaaaccaucauaagcaucacaaaaaacaccauaaacaaauagaaaaaaagcaaaugaugaauuggggaaaauauuugcuauauauguaauggcugaugaaagguuaauaaccauuccaaauaaagagcuguggcaaaucaauaagggaaaaauaagaugaacacccuauuaggaguaaggacaugaccagacaaccaaaaaaaaaaaaaaaaaaaagcaugaauggccaaugaauaguaaaaguaaucacaagaugcaaauuucaacaaugugauaauguguuuuucuuaccugucauguugggaaauaauuaaaacauaauaauacucaccuaggguuagcuuaaguagagggagcauaaaauaggacaaccuuuuggaaggagaauuagcagagagggucauaaacuuuaaaaaugcacgcccccuuugccccagcaacucccuuuucaggaauccaaggaagcagucagggauguuuauagaaaaaaacgagaaacaaccggaauguccaacaaucggcacuuggucaaaucaaucaaaguucaugcugaugugaggacagucuuguccaucaugaaagaucauguguucaaacaauuuuuaguaagcuucaaaaacacuacuguuaauugaauaaagcaggaacaaaaccaauauauagcaugauucuaauuugguuacagaaauacuaauagcuaacacuucgugagcacuuacuuugugccaaacgcugugcuaagccugcagaaucgagcucaccccagcccugaacaaccuguuugcuuccugaauauggacucuggucacacacaugcaguccugggguagguccacacagcuaaacuacgguugacaauggugugaagugcucccugcccccccgccccaagggucuccucuaaagcgauacaagcaaaguucaguuaagugcucagcuugccccggcaccuugcaauccuccugcuacuagggugaacagaacugaugcucacucucauaaaauguaaagguccucggcgacauuacuauuauuaaacgccagcuguguacaaagcucuaggcuggaugcuggcugggaaggcaggugggggaaggcaagaaaagagagcgggagagauggaggaaaggagaucgauggaguguggucaagauggaggagacagagauaggggagauggucagaggccaggagagaugcggggaaagagagucugaguguagcgacagacagauggcgggagaaagagaggcagagaaacauguaaaagagcaagacagggugagcagagagacagagaaggaugagaggcaucaagagcuaagagacaaagagaugagagagaugcaguugaaauuuucaguugcaccuggacagcauuucaaguuguucaaagcucugaaauccauaaagacuggcagcugacauauuuuaaaaauccuauccaucuacguaucaauugaugaauucauuuauuuuugccccugcccaugcauuaaguacuucaccuuuaagucuucugccauuuauucuauuauuauuuuuuuaaagaccuuaccuggcuggaaucacgguagcuggguacaucccacuguaccagagggccccugacccccccgccgugccuaccucccugccaucuccuccaauggggcccacaucugguaggggagagcagggacacucaccuuggugaaguggacugacagaaaaggaucagccuggcuugugggaaacugucacguaucaaaaacaacuuugcuuuuauaccgagaagaaaaaccacgcuguacgguguggaagccgcagaccucucucuucuaauaauccaaauuuuuuucgaugagugugugcgcugauaaucacgggguggggggggguucucauaguuuuuuuuuucucucucucuguguuucuccuuuucuugauuaugagacuuaaacggaaauuuugaaauuuuggguuuuuuucuuugcccuuuacgagucaucugaaaauaugauuucuuccccucaccacagaggugagagguaucaaugagauaauagggcucaugagaaaccacaguuuuuaaaacaaaaguguauagaguuugaaaaaaaaaaaacaagggaaaagaacuaaaauaaaucacagggccaacccgaggcaggcagagacaccauucugugagugagaggauauuugagggucucuggggaaagaaagagaaucugaagcucuauguguggaugggaaaugccagggaaagagacagaauagggcuggguucccagaggccucgcccuacuccaggccucaguuucccuauagauggaauugauaugguccccauugcuugaacuacccggcgaggggaguucugcacccccugcaacaccccucccacagagggugaggggcauguaaguuacuucauggaggagaaagcggagagcccacugucauccccuaaaauucauggacuugaagagucggagaaucccuggcucccagaaucuacugacaguuacugaaugaggaaagagagaaaagucucgccucaucacguuuuagggcuugagugcccugacccagccacugucccacugggaaggucccuagcagguccccaauauuaaugcauccauccucacgaugaaccccagaggcccauugggacccugacccucuuguuucaggaacaucauggccugaugcuucugaggcccucagccuuuggggucuuuuacuucaaaaagccccaguuuccaaggauuuaggauuccaaauauccgccaucaucucaguagcugauguuuaucuugaauuuuccaugggucagauacagugcugaacaugucucacaagugaucauguucaauccucaccauggccccuugagcuccaucucaucauuauuguauuccuguuauacagaugagggaaacggagguauaaguagucaagcaacuugcccaagaucacagagcuggcgagugugggucccgcuuucuuuggugcugggcuuugaaauccccaagcuuuccugaacuugauguucucagguuuuaaauucuaggaugugauggcagggagauccugggauuuggagaguccuuggagacuugaagcuugugaggcuuuuagguuguccaggaauuggcggcugcaucucuugaccucagcaggcacucuauucaaccacuggucagcaugguagaccagcccccaggggcuucuccugacaggccauggugaagacuuccagcucccagcacccugcaaagcccaggguucuagucguccaacaaccacuccagcccucuacaagacuggcuucagaccuggggaagagaaauuggaaagggcuuuuuauuuacaugguacaaaucugguggccaagauccaccccuucaccccuuugcccccuuuccucccccaaccuucuaagcccucguaaaaaggagggccucuuuccucaacucagacucacccuucuggaaaagcccagaaugggccugauggccuggcuuugugaagacaagaaaaaaaaaaaaaaagaauagaaaaaaaaagaccuuaaaaaaaucagccaacaacaauuaaaaaaaaaaaaaaaacacccaacccuccccaccauuaguucaaaacaaaacuuucgcugguugaggcuucugaguuggugggacacaucugagacccaaaaauggcuuggguguguuggacagccaggggaggcaccaaggugggaugagguccccugcuuggaggccugcagggacccugugaacagcagguguuuaacagaugucacggcaugugggagggagcaagggagggggugaggagcaugcaugucaggaaggaguccuggggagcugauucuagugauggccccaagguuaaugaccccuugcagugaugguccuaagguuaaugaucccuugcacugauguucccauaguuaauaaccccuugcucccugcagacuugggucggaauguucccuacaccuccugcguaauuauaaaccaggccaguucuaucagcagaggcauuguucccugccccagcaccugucccccuccuggaaaagggggcuaguuuucucucucaggaucagaggugugggcugcauucuccuuauaccuuccccagaccaucugucccuuacugucacucacuccaugaaagagaguggccagagauauaggaggcaaacgaagugaggaugguggccgagaaugugagcuggccccuugggcaggcccagggugugagagggaaaugcuacggcugcugaaagccaagauccuugcagaaugggggcuggggucaggagggcagagagggguagaggucgcuaccuccccucuauacuggacuauauccucucucauggagggcuucucgggaaggagacugggagggcugggaguugggggugaguaggcaagauuaaacgggucaggaaaaguccccagagacaggggccucugacaaagacuugaaggagaugagggagggagccagcuagauaucugaggaacuccaaaggaaacagccagggcaaagguccugaggugggaauguaccugauuuguucaaggucuacaagggggcuggugugguuaguguggagagagcaagaagagaagcuggaggugaggucagaaaggggacucggagguuagaccacgcaggaccuuguaggccaugguaaggacuuuggcuucaacgcugagugaggaggaaggcaugacaggguugcaagcagaggagaaacacaaaccguguuaggauuuaacaggaagccccugaaugcugaguguacaauggggucuagggccugaauguggaagcaggggaccagcaaggagcuggcuacugcaguagucuaggugacuggugauagugcuggcaguggagguggugagaagaggauggauuugguaaauauuuuuaauagacagccaaaaggauuuguugaagacugagagucuuggagccagaucgggacagacaaugcccaaaccaggugggcaggaaggagucccuggacuauuugccagcuugaacuuuuaggugagaaaaaaauaaaguucugucuugcuuaagcccccauuauuuuaugauuuuucuguuacuugcagcugaacauauucauuucuaacucauggacauccugaacauggagaccuggggagaggggcugcuggaaggaucaccucccuccuaggaugcugugagguucuaaugagauaacagcaugcucagaaccuggcacucaguagguguucaguaaaucuucccaggauggagaaggaauguaugaauggauguguucagcggacaaaagcugcaguugaguucccacagaaggugagaccccaaagggagagcgaaaggaguuuacuagauggaagcagcagaaggaacagcacucuugggagagggaacaguagaagcagagauggggggacagaaagaagggaggugaggccccugugggguguggagugucagguugggcaagaaggacagggcuuugauugugauuccauuagucagaagcuacccauaugcccaaucaacuucugguagcacacagucaggucaguguuugcugagcugaaauuuaaaaaagugaauccuucagaaaguuaaauuuccuauucggccauucauucaacaauaguaucaaguccuggagagugcuugcggcuaacaaucaggggcauucuuggcuuguggcacugcucaagaaaagguuguaguugggcagggaggacccaguaaguaacuaacugcaacaggacagucauuuucacuuuccuaguucacacaccaagguguggucuaggccuucaggggcucuggguauuccuggggcaauggggagucacggaggguuagggagaggguaaccccaucccugagaagcacauuuuuccuaauggcugccugcguucuaugguucugcuguccggccacccaauaccucagacucugucuacacagcguccuccucuccagccuccuuauuggcuacucaugccucccuucacaccaccuacacugcccccgucggcucugcuuuuuuccccaucuugccuccaaguccucccuccgucccgcugcacuaucuagccucggcauuggcucaucccauacuaguacuguccuuugaggucucuacgccuucacccuggcucccucauuggcuauccgccagcucucguccucgcucccgccuucagccuccaccuccauuggcucggcucccuacacacccgccucuuggucuccuuuuagccuucguauuggcuagcuccaccuuggcaccaccccuucgaagccgcagugcacgcucacaagccuccccauuggcucgcugcagccauugucgucaucccacgcguggcucuccauuggcuguucucucucucuagcuaccguuccaccgccuacgcaacccgcgggaucucccacuuuuugggccucugcguucguucccggcugcccucaucgccuguagccauuccacuuuucccaccgcccacaugccucucucgcucagacuuccgcauuagcugucugcuucuguuuucuucaucauggauuucgcaccacccccauuccggccucuccauugauuccucgaucaucccgcccccuacaccgcccacucccgggcauccccauuggcugcgugcuucuccggcucucaauucgcuguacgucauccgugcauggcugcccauuggcccucugcaauacuugucuucaucucaccgccuaugcccccgugagccguaccccuccgcgcuggccuucccauuggcugcccgccccuucaggcccugcccccgccggucccgccgccggugccgucggugccgccgccgccgccgauauggcgcguacggccccuguggagcccccgcugcggcauuccgcgccccccucgccggccgcgggugagccccgcaccucggucgaggcggcgguggccccgcggagggugcuguucgccgacgaggccuuggggcugccgcuggcgcaguugcgccgcuaccggccguggggcgggcccggggcgggcaagauggcggcggcggccgggcaagauggcggcggcggcggcggggccgacgaggacgacgauggcgaggauggggaugaaggggaggaggaagaggaggcuugccccgagcccucaccgcugugccccguccccgcuggcgggggguuuuaccugguccccacauuuucgcugccgcccgcgccgggccgucuggagcgcuuggggcgcgucaugguggagcuggaggcgcugcugccgccucccggagcgguccccgggggugccggggugugggugccugggggccgcccgccggugcugcgcggguugguacgcgugcugaaccgcuccuucgagaaggcggugcacgugcgggccucacacgacggcugggcuuccuuuugcgaccacccagcgcgcuacgucccgcgcagcccgccgugggcaggagcgggaggaacaggagcaggagaucccauccuggauccggggcucggccugggucccggccaggcauccgccuccucgcccgacgacggcggccgcaccgaccgcuuugccuuccagcugcccuuugcugagggcgcgggcgauggggcgcgccucgacuucguggugcgcuaugagaccccugagggcacuuucugggccaacaaccacggccgcaacuacacaguccugcuccggaucgcacccgcucccacacccacugaugccgaagggcugccccagcagcagcagcugccgcagcuggagccacagcccgagugccagggucccguggaggcugaggccaggcagcugaagagcugcaugaagccggugaggcgcagguaaugucagccagcgccaccuccgccaacgcagggcugugucugggauggaggacaagcauuccggcccaggaaccccucaggccugcucuccaggacagggaggagggugcauugagucagucagucaaagagugauggaggucaaacacgugcuaggcacuguuuuaacugggguuuuauuccuccauuuauugaguuccacuguaaagcccugaacaagacagacaucuacccuacccucaaggauucauacaggcuccuaugggagacaguuugaaaaaacaagcaagcaagcagauaggauaaauagggacaaaguuagcugcugaagggaguaaggggauagauugggagggaaugacugugucagacaugcuguuaaagggagggccuuugaggaggugagucccgaaugaugauaaagaagaguuaugcagauacgguggggaggugggggagaguuuguaggaaaaggaacagggaggacuuuucugaggagguuucauuuaaacuaaguccuggaugaugaauaacaguuaugugcauauauggaacaaggguguucuagguagaggaaacagcaagugcaaaguccugggguggaaaugagcuuggugugaaugaucagcagugugcuggaguggagagaacugcaaugacauaguguggaccaagggcuuugccagugggggguagagcagauucucuuucugacagagcaggaaaccaggauuccagagguggagaaacugguugaggcagugauggcaccuggcucuuccaguucacccaugccugaccuugaagccugugcacucuacuguuaacgcuguaaucuacuuuugaguccuguggaggcgaggggcugagcccaugcucucacaagaaagcaguggcucuagcagagagacagaaccagauggguacuggacuugaaguuuuugucccuuguuuuuuugccacaccaccugugaucauuuagggacagggagaaauaaucaguuauaccccagggggccccagaagauuucccuagguuuccucuaucaagcuaugaguucuuuaagggcagcagcuaguccugauucuuuuugcggucaccuaagucuggcccaggaucacuagauucucccuaaaauguauacauuucccuguuccugggaggacugggaauggaaaugggaaaaugcuuuuuggaccuuguauguauacgcuuggucagaagccccuggcugcaguaagacauuuguggguucugcugguucugguaaggccuuaggcugugagugguucagaaaggucuagcuccggucuggugggcagaugugccuggguaacugagcaggcaggcagguacccacucacccaccugugagccccaccauaaucugagacuucauuuaaagggggcaggcagcaugguuuuucuuacagcauuaagaguguggauucuggcauagauugccuggguucaaauccuggcgcugccacuuacuggccuugugaccuuggccaacgcauuuaacuacaccaugccucaggacccucaccuguaaaacagaauuauagcaucuacuuuacgggauaagaguaaaggugcucagaaccgagucuggcucaaaguaguaucauacagguguuagcuagugucaguauuuagggagccacaccuacaguuuccuggauuccucuccuaaauucggcuccgcccaucagcuguguggccuugccuccguuuccuucucugcuaagggaaaugacagucacuuugcaugguuggauugaaugcagcaaacaugggcaagguaacugaagcauggugguaacugcaaaagauaacuggccagcauuuacugauuucugugcuaugaacaucagauccauucucuccgugaggccugcugugcaugcuguguuguguaggugcuaugauuauccccauuuaguagaggggagacagguagcucagagagaugagccagcuugcucaaagccucucagcuagugagugacagggccagggaagaaaugcuagggacauuuauuuuuuucuauuuuuuuuuuuuuaaacugguccucuagaaagcguggcaugauucagggcaaauucuggauuucacucuugguguucccagcaugucgugcuuuccuuuuaccuuuuuuuuuuuuuuugcuuuaucgagguauaccuacauaaaguguacugauauucuguguauagcccaguggauuuguacauauguaugcacuuguguagccaccacccagaugaagauacugagcagguccaguaccccagagcuaccuucauuucuaucacuuucccaagcugucauccccgccggcugucaugggaacccugucuguaagaugcgacaguuuggguaaaggaguuuggucauuuuaaagagugugaaaggcagagaacagagaaaucaaaaccuugcagggccaagguggguggagaggguguuuuucuuuuaacauacaugggcgguuuuaaggagaaauugaagcagccuguucagacaauuguuuugguaucuggccccaggucugugguuccuaacaugacuugugauauuauuuuaagugggcagauggcuuuuugauagcuucuuuaucuuucgaucucagcucuugcaaaggggagguuggugcucauugcaagaucagcgauaaggguuucuuuguaggucgguggcuuucuuggugaguacauuucaacauauuauuguuuuagaaccugugugcugccagugacuugcagcacuguugaagacuagccacccuuugugaccuagcccucuugggaaauggcggaggaucucaggguauaucccuuaccugugggagcccuaucagagggcuuccuguugaggaaauguuggcuguaggcccucugugcacugagcacagccacaucaggugagggcaugggagaaguccgugguagccaucaggauagaguucagaaacccaaauggcugcuuucccuggguugcuggaccaggcauuugguaacucuaaagcuuagagaugauucaucgacaagcauuuauugacugccuacugugugcugggcacagugcuagguuccagcagggaaagagaugcagagugguccuaagaugucacagggcuugugggauggaguacagaggauuuguuguaugagaccuggcugagccccugcucuucgccaggcacuucacugaguacuauauuuucaugcaaggucugguuuaauuccgacaacauucccugugaaguagaggguuuuaaauuucucuuuccuggaugagcaaacugaggcucccagaguccaaaguccuagggcugguguggggaaaagcccuccugaucuuccuuggcacuugacacuacccuuuggaaguguccuauucuucuuaaaaguaaagaccaagagagccucaccauggucuucaagcacccucccaucccauuccccaaucuggccuccacuggcucauagucuuaacaccaguggucuuucugagcuccugucaccauggucuuucuguuacuccaaagggccucgcuccuuucugcugcagggccuuugccccugcuguuuccuucaccaggaacauuuaucccguaccccuugcagucuccuccaguguugaucccucaguucuaagaggacuuccccaggggagccuguccaccccaguguccucgggccccuggcuuuuucauagcacucaucagcccagcacgugcuaagcuuuguuagagaaugucccauggcagagcagaugaacaucgccaccagucgaggggucaucggccacccugccuagcaguucuacuauauuuuuuugauccacucguuucuccucugaagugacucuuucaaauguucuuuaccuucagacuuucucuccugcuucaaaaaacaaaacagaagccauaagaauggaacucccuauaacuuguggcccccaagucugcacgcugauuucccuccccuguguuacagaugacgaggagucccuucuugcucaggccacuucucccuccugugcucugggucccaguuucugcuacuugcucuagaaucugacaucaucagucaccuuuucucuccuggcagguuuucugcugcccuccuugcuugauccucuauucaccuuugccugugccagcaucccuucugucuccgcugaccccacguucucucccuccugcuucuggccagcaccucaucacccuccccuucacugcugaccccugcagaguugccuguacuugccuucugcacuugcucacccccguaaguguuagcccccggcaucugccagauucugcaggugguuuuuuaguuuuccucuugaagugguugaccacuccuacuuaaaacacuuugucuucccuugccuugagaccacacucugcugguuuuccucuuaacucucuggcccuucucuuucuccuggcucuucccuuagcuucauguauccaaacucggcaucuccacuugacugauggcccaaauaauuccucaaacucaccuugucggggacugcauucaucaccucucccacaguguucccaagcagccucucacuccccuaccuccccacuugcucguuuugcuuuucagcauccuuaaguaagcccugccugacccuguagauugggccagggacccuuauucuagggcauucuuuccuuuucuaaaggcacugaucgcaguuuguaguuauaucuuuauuaggggguugcuggaugacucucugccccgcuagacuguaagcuccgugagggguagggacauggucugcuuucauucaccacuguauuccugcaggccugccacagugccuggcacuuagcaggugcucaauaaauguuuguugaaauaaugaguuugaguauuuuuuuaaugucuuccuccauacugaauuguaagcuuccuaguuggguuugcucaccauggugucuccaggauccgucacuggggcugaugcacaggaaggcccacugucuuucagugcaccuauaacugaagggauggggauccaaccugcuaucugaguuggcagccucaggggaaaccagaauaacuggaguugaacgggacaagucaggggcaucuuaguuuucuguagagugaggaauuaaugugaacgugauccucuuuuaugccacagaaaacuugguagggcauuaugguuaaggacaugggccugaggccacgugcuaagaaaguggcagagcugggaucugagccugugugguccugcucuagugcuccagcucuuagcuacuguaccaggcugggugaugcauuuuaccagcagggcaacacugggcaaguugcuuuccuuucagagcuucaguuucccucaauggaaauuuggaggggguuacuguuaagugcuuuauagguacuuuucaaauauuucuuugaucugcugaacaacucacugauguagguauuauuauccccuccuuagagaugagguaacugaggcacagagagguuaaguaacuugccccaggucacacagcugauagguggcagagcuggaauuguucaaaauugcauauccuaacccuuuauugaguugugaaaucaauuuacuggguuucaacaagcauuaaaaagaaaaaggaaauagcauaagaaaugccaguguaucaccacaugcaguaaagguaaguauuguuucacucgaagaacaaccauuuuucaguuauuuauaugucuguuuacacgugugggugugcuggguuaugauguagaauggauuucuuacuaugggucguggccaaagaaugaagucauggcuguugaagaagcucauggcacgagaaacugcucucccucuaccccacuggaucacccgcaagucccagaguugaggcugacacacuuguuggggaaggcaaagcagugccccacauaacuugguggcuuucacagccaccuucaaacccuguucuuuucagaaagcagauggcucaggguaacugcaauucugaguaucguggggcagguuucugaagccacucauccccccggaaagucagcguuaucuucagguugacuacaugggagccggggucugcugaguuucccuuuggguuucagugccugacccacuuugggcuggcaaaauucuuugaaaacaugaaugcugggggugcuccagaggacucggguggugguggcaauggcagucugugacugcucugaaagucugcuuugcuuuucuccacagggcuugucagcccucacccgcucgcuuacucugugacuggcgaaucaccuuucuuggcuuucuuggcuggccuaggccggggccaacaccaccucuuuccaaauccucacccucuggucuccucggggccuaucagcuuggcagccauuguguuuccugauggccggaggaauuugcacgcccaggagacuggcgugcaggccugagauggccccuuuuagucgacaccagcuugacuagugcucacuagcacccaaaugaugcauguccaagauuuuccagaucugugugcccuggccccuauggcucacugcccuugaggggaugccacgugguacuuguggggcuggugccaaaagaacagguuuccuucuugaaaacgagcaggcauacugcagguacaguuuuguucuuaaucuucucccuccccauuuuucuaagaaccccucuucucuguuaccgaucagugagucaguauacauuuguacuugauuucucuuacuauccucauguugauugaagucauagcugcccuugaguuuuuacugugaaagacgguucaaagauaacuuguuucuuuuuaagcccacaauuucaaacucucuucaaaguggagcccuccuggaguguuuguuaccagcgugguuguguagucagugaguguagagaugcaguuccuugaguuuuaguuuuugcauuuguaaaaaggaaggguguuguuuugaaggauagaugugaagguuuucaaaugccuuggugugucaaugagaggggcccaugguggaggaggugaacaauacaugcuugugcuuucugcuuucauaucugacuuuggagaacgacuuguuugcuucugucgauguuguggaucuugggauuggcucaauggcgugaccugcuuuuuggauguucucgcccuccucagccauggaaagggugcucugggggcugaaggauugauuguguauuuguuuuucuuucuccuuccuccaacugaauuguggaguccuuuaccugcuggcuagcugauuccugaguguucuccuuuuucugucucacaucuaugacugcaguggcuuuuagaagccuguuuguaauauauguccggacuaggccagauggaggagaaggcuugccugcuacugcgcacaggugggagggcuggcuuucugucugucugugggccuucuugaagaggcuugguuuagaagauccuaggaggaggauguuuucugucaugaaggacuaugguaacaaaaagaaguaaguuagugcagccuggcagaaauuguguugaaacaaaaguccaaagaccuggauuuuaggaccacggaggggauuggugugagaccaagcugguuugcucugaaucucucuuucucaucugugaugugugggagguggcagcugggcucccagagucacccacccuaggcccuguaguauucugauucaaguaccucuggugggauuugugaguccuagacaguagagaaagacagacggucccuucuagacucuagauccguauauaugguucaaauguucuccccgaggguguuuauagaaagcaguucuugcagccauucugugucuaguggccuccuagccacgcaugucccaggcccauggagguagggaaauggggaaugaauaugugggcaaaggcagguccaaagaaaagccugcaugaaggaggagggagggaucuugucuaguauugaugccucccucuaucuacuucuagaaaggauggagauggguuggguaagaccccagucucccucauccaagaagcagcagcugacuggguaagagccaaaaggccuggguugugaugugaaguguaugaccuugagccauuuacucagccucuguuuuauccucuguaaaauggagacaauaguacugccugcuucagaggauuacaaguaccugucucauagggugauugugaggauugaauuaacacauguugcccaggcaccguggcucaugccuguaguacuaggacuucgggaggcugagaugggaggaucgcuugaguccaggaguucacgaccagccuggucaacguaggaagaccccaucucuaaaaacaaaauacaaaaaaacaaaaacaaaaaccaaaaaaccccaaaaacuucuuuaaaaaaaugugaagcacuuagaacaguguguaaugccauaguagguacuauguaugggucagauggugauacucguuucugugaagguaauugguuauggguuuucaaaaaguuucaaccaggccgggcacgguggcucaugccuguaaccccagcacauugggaggccgaggaggguggaucaccugaggucaggaguuugagaccagccuggccaacauggcgaaaccccgucucuauuaaaaauacaaaaauuagcuggcugugaugguggguaccuguaaucccugauacuugagaggcugaggcaggagaaucacuugaaccugggaggcagagguugcagugagccgagaucaugcuauugcacuccagccuggcgacagaacgagacuccaucucaaaaaaaaaaauuuuucaaccauugucagaaguaucaagaaugucacauugccucuuaggaagaaaaaggugugggcauucgccccagcuccucucagguuuuagucaaugcuucccucauuuaccuuaaucuguagacacuugauacucauuuucagaauaagaacagugacuucuccaugaugagaugccaccccugggaggacccaccugaaaugcacucggcuuaugccacucagggaucugacuggccuggugaaggaggagcaagacccauaaauaucuacaguugauucaaucccagcugugugucaggcccugauuucuggcuguccauccucauuccucuugacugcccugugcuuagugcacauccugacuccccggggcucuguuuuaugagugaggaggugaagcgaccugccaggcugauacggggacgagaggguuagcauagggacccaggccucugugaccucccucccagucuccauuugcauuccuuccucugccucacagucuugucuaccugccauuucuuagaaaagguguuuuuguuuuguuuuguuuuguuuuguuuuugugagauaaucucucacucugucgcccaggcuggagugcaguggugugauuucggcucacugcaaucucuaccucuuggguucaagcgauuuuccugccucagccucccagguaguugggauuacaggcgcccaccaccacgcccagcuaauuuuuauauuuuuaguagagacggaguuucaccauguuggccaggcuggucuugaauuccugaccucaggugauccaccugccucggccucccaaacuguugggauuacagaugugagccaccgcgucuggcccuuuuuuuuuuuuugagacugaguuucacucuuguccccuaggcuggagugcaauggcgcgaucuuggcucacugcaaccuccgccucccagguucaaaugauucuccugccucggccucccaaguaguugggacuaugggcgugcaccgccaugcccagcuaauuuuuuguauuuuuaguagagacaggguuucaucauguugcccaggcuggucuugaacuccuaaccucaaguggucucccugccucggccucccaaagugcuggaauuacagguguaagccaccacgcccagccgaaaagauggguucuucuaucuuuucucuuuccauagccaggaauguauccuaaagaaaugauacaagugucgauaaaacuaugcccaaugcuguuugcugguuugcuuugcaaccucuaaaugaaagaacuuagcugcucaguaggaagggaaugguaugauaugaguauuaagcagccauuugaaauguuugcaaaaguguauaaugauguuucuuacuguuaaauggacaaagcuagcugugaaauuaugucuguagaaucuaaaugauuucguagaauaucuggaaggaaauuuuccagaaugguaacaguaguugucucuggcugaugugugauuguuuuucuugcuucuuuagacuuuccuguauuuugcgaauuuucuauaaugaggcuguaggacuuuuaggaugaggggauaaacaaaggcagcagaagagaaaacagcagcugucaggugaaggugggcuagcacagaggcucagaaggugccaguggguggcagaagugaccucucaggguauuauuagauccauguacucucuccucugcccugcaggccugccgaggaggaacugaagacgaagaacauggaugauaacaccuuugccauggguaagcaauuggcaagcuucggaaguuuuagcuuguauuuaccaugucuuucuuccuacuguuuuucuuucuauaaaaaugaaaaaggcugggcucaguggcucaugccuguaaucccagcacuuugggaggcugaggcaggaggauugcuugaggccaggaguucgagaugagccugggcaacauagugagaccucaucucuuaaaaaaaaaaaaaaaagacgggcaugcuggcaugcauccguagucccugcuacucgggaggcugagcugggaggaucauuugagccugggagguugaugcugcagugagucaugauugugccacugcaccccagccuuggugacacaucgagacccuaucucaaaaaaaaaaugaagggguacccucugcuuuagauugucacagaaagcuucagaggcaaaacugccaguuggcuaggauggcagauuuucuuaacaaaaccauaccuacuuguaugccugucuugcccaaugcugccuuucucuucccucuagcagagcauccugauguccaggagucaguggguccacugguagcccccaccccucuccguccauggccccagaugacacuucagguaaguggguccuugcagccuuggaguagacagcccaauaggaggcucacagugugacuauugcugggcugggugguggggcccacuagcucuggguccucccuggguuggagggagggcacaaaacucagaaccugaugggggagggggagaaugcaguuacucagcugggcuuguagaaaugucauuuguuaauuuagcaaaaauuuauggagugcuuguucugugcuaagcacuguuacaaacaugcaaaaacgcucuuugagggggcuuauguguuaguagggugagacaugauaaaguaauagaauauaugguacuuuaggugaugaugagugauaaggaaaaauagaaaggaauagggagugggugagagacucuguguguguguguguguguguguguguguguguguguguguguguguguugugggcgggggucgguugcaacuuuagauuggguggccugggaaggcuuuagugauuagugagaucugagcgaagaucugaggaaggugagagagugagccacguggauaacuaagggaagaacaucccaggcgagugugaaguuccugaggugaggccaugacuaacgugugugagggacaguguagaagccagcgcagcaggggcagaacgagggagggggagaguggugcggggugagggagagagguggcugaggacagauuggguggugccucacaggccauggugaagacuuuggcuuuuacuccgagugagggggagccgcaagagcauuguggacggaggagggauguaaucugauuuaggauuuaacaggcucccucuggcugcugcuuggaaaauagacgucagaguaaggguggaaacaggcgacucgugaaggggaggccacugcagugguccaggcgagagugaugguagguaggggagguagagacauuuuggagggugugugugugugugugugugugugugugaacuuuuuaauuacaaaaaguuucaaacauacaaaaguaaaauaguauaaugaaccuacguacaccaucccccagcuucaguaaauaucaacacgugcucauucuuauuuuaucuguaccccgucuccucccucccauucccucuggaauuauuuuggaagacauccagacaucaucccauccauaaauacuucuguuuguaucucagaaaauuaagaacucuuuuuuguuuuuuuuuuugagacagagucucacucugucaccuaggcuggagugcaguggugugaucucagcuuacugcaaccucugccuccuggguucaagcaaguacauccagcuaauuuuuguauuuuuaguagagacgggauccguugccuuggccucccaaagugcugggauuacaggugugagccaucacgucuggccagaaaauuaagaauucuuaaccccacaauacuaucaucacaccuuagaaaauaaacgguaauuccucaguaucaucaaguauuuggucaguguucaaguuuucuucucucauaaguguuuaggauccaaacaaaguugacauguugcauuugauugaugugucucuuuagauuuuuaaaaucucccccacuuuguuucuuugcaauuuguugguugaagaaacuuugcuuguccuguagaauuuuccagucugggucuggcugauuacauccagguggaaauacauuucuuacuccauuuuuauuaauuuauuaauuauauuaauuaauguaaucuuauuaaauuuauuuaauuuaucaaauuguauuaaacgaauguauuuaaucuuuuauuauuaaauuaacuagaauuaacucuauuuaauucuauuauucccacuuccuuuauuagcuagaauucuucucuaaagaaaaacugucccacaccagcuauuuggcuacuuugagauauaguuugugcagaaaaagcaguguaaauauuuaauuuuuuccauuuuauuuaccaguuuucagagaaguacuacuacaaaggugaccaauaaaaggauuuuugguuuugugucauuaugaacucaugaauucuaaacauauuugaaugaguuucaauccauugcacuuauuuguuugcuuuuuuugaugcuuaaauugaacuaucccuggcuaguaggagcuuauugagaugggcuacucuguccuuuugacacgcccucaucauucugugagccuuucucacaucuuccaugacaauaugugcuagguucauccuguacucucccugccccaagccuggaaacagccauuucuuucuugcuuuucuuuucuuuauuuucuuuuucuuuuucuuucuuuucuuuccuuuccuuucuuuccuuaccuuuccuuucuuucuuuccuuuccuuugucucucucuuucuuucuuuucuuuuacuuuauuuuucuuuccuuucuuuccucucucucucucuuucuuucuuuuuucuuuuucuuucuuuuuuuuuuuuuuuuuuuugagucagagucuuucucugucgcccaggcuggagugcaguggcacaaucucgguucacugcaaccucugccuucuggguucaagcaauucuccugucucagccucuugaguagcugggauuacaggcacaugccaccacacccggcugauuuuuguauuuuugcagagaugggguuucaccauguuggccaggcuggucuugaacuccugaccugccuggugauccaccugccuuggccucccaaagugcugggauuacaggcgugagccacugagccuggccagaaacagcuauuucuuuaaggagcacugauuccuuucaguggagaguggcauucaaaggccaagauuugggggcucggcaugcuugcugcuacuagauuggucauuguuucuaggcccuuucaaaagauggagcuaggaaauaauuguuuuuuaaagagaagaugauacaucauggguucauauggacauccuggcuauguuuugggauuuuuuugcauuuuauuuuuuuuaaaauuuuuuuaauuuuuaauuuuugaggggacauaguaaguguauauauuuauggagauguuuugauauaggcaugcauuguguaauaaucacaucauggagaaugagguaugcaucuccucaagcauuuauccuguguguuacaaacaauccacuuacacucuuuauuuuuuuuuuuuuugagacaaagucucugucgcccaggcugcagugcaguggcacagucucggcucacugcaaucucugcccucuggguucaagugauucuccugccucagccucuugagauuacaggcgcacaacaccacgcccagcuaauuuuuguauuuuugguagagacgggguuucaccauguuggccaggcuggucucgaacuccuaguuucaugugauccgcccgccuuggcuuccuaaagugcuuggauuacaggugagagccacugugccuggcuacuuacacuuuuaguuauuuuaacuggcucuguuuugaagguaagccagcaguauuuagugaugaucauucaccaaauauucacacccaccgaauuccucagcuuuauaaucugcaagaagcccuguuuuacugcauccaauuguguuauuuuaccauagaugacagucuuuggagucuagacagugacagagggcgcuuuaaggcauuuuuauauagaaaccccuguggggcuggcugugggcugucacacuucuuacugucucugcuuguuccauccccuccucugcuucauucccuugcuuuuucucugcccccuugccccggccauggcuccagguuucugacguuccgaugacuggcaaccccgcagaagaaggugauguccccagaagcaguccaccuguggcuuuuacagagguccuccaggcaccggccaucaggauuccccccuccuccccucucuguggccuggguggcucccccagagaccaggccucagggcccgaugcgagcgagggggccaccgggccuuuccuggagcccagucagcagcaggcagaggccacauggggaguaucgagugagaauggaggggggcuggaggcugugagugggucagaggagcugcucggugaggacaccaucgaccaggagcuggagcagcucuaccugucucaccugagccgccuacgggcugcuguggcugcggguggggcagggggugguggggagggcuccacagauggagggaugucccccagccauccccugggcauacugacggaccgcgaccugaucuugaaguggccuggcccugagcgggcccugaacagcgcccuggcugaggagaucacgcugcacuaugcccggcuggggcguggcguggagcucaucaaggacaccgaagacccugaugaugaaggggagggugaagaggggcucucugucacacccuccagcccagaaggggacagccccaaggaaucgccuccagaaauccucuccggggcccguucugugguagccacgaugggagauguguggcucccaugggcagagggcucaggaugugacggcccugugguucuggguacagagggucaguucauuggggauccugagaaagggaugggcaaggacaccagcucuuugcacaugaauagggugauagcuggggugacugagucccugggggaggccgggacagaagcccagauagaggucaccagugagugggcaggcagcuuggaucccauaucuggcaaggagccagccucucccguccuucugcaggggcaaaaucccacccuccucagucccuugggggccgaagucugucucucuaguguagccaggccucaugugagcucccaggaugaaaaggaugcaggcccaagccuugaacccccaaagaagucucccacccuagcagucccugcagaaugugugugugcacugccuccucagcuccgggggcccuugacccagacucuggggguccuggccgggcuagugguggucccuguggcucugaacagcggugugucccuccuggugcuugcgcugugccucucucuggcuugguucucauaggcucugcuugugggaucagcagaggcuuaagaugggauacauggccugugcagugaggggaccuggguccuuugcuucugagaaugcucaacugaaagagaggccuucucauccccaagcucuccagucaacacagggcucccuguggugacaccaguggagaugagggaacggguagauggugugagugaggggaacuuuuagaguggaacugggcauguccuccgccuaccccccgagccuguauuuauuuuuguauaauucucuggaugagggagaguggucgugagcuggucuuggggcacaauuacccagagauauauuuauuaacagccaaccugugcaaccugcuggagcuuuauuuuuaauuuaauuuauauagaguaccuauuauuauaugccacaauagagcucuaugagaaacagugucuugcgguguaguguucuccuguuugggcaugagugugcaggguggucacuuucugugggaggaucacaguggggaguugggggugggacguggucgccugcugcugcuucaacaugucuuuccuugaagaugugugucuccucgucucgugguccuaauccauaugguucuuugucuuuuccacauucugccugugggacccuacagguguguauuuggauggugguggugggagccagggaggaagaguggcagccacaugaggguuuggugucagucacaugguugcagugguagcuguggucuccuguggauguggggacaucaguugugaaucagccacaagguuuugagguuacugaaaaaacagccuuugacaccagcagggagaccccuuagucccugagauaaggaaggccucagaaaggaaagaggaguuaauguacugcaguacuugguagcacaguugcuguccacagacaucacauuucuacuaaaaacaggaagcccagaagcuuugaaagaaagauauauauuuauugcaugcaaauaaaaaacugcucaacaaaauaaaacaccacauauuuauuuacuucccuuuacagcaaaaccuauuggaagaaauaucuauacgagcuuucuucaguucuucuaugaugccuuucugaaauagccccaaucagaucuuuuuugcccaaccauuucagcaaaacugcugaagauauucacauuguuauagccaugguuaagucucagaugucaucuuacuugggauauuggcagcauuugacauaguugaucaucucuaccuugcaacccuuucuucacuugguuuccaagauaccacacucuccucauuucccuucuuccucacuggccacugugcaaagcugucaguucucuugaaacugcuuuguagguucaaugcaaauccaaccacaauuccaauagaguuuugccuguguguagaucaugacacauuaauucuuaaauuuauguagaagugccaagacuagccaggacacugauacuuauuguaaugguauauucagauggcacgauauuuuugcaagaguagacaaaucgaccaauaaaaaaacagugaucucggaaacaguguagacacacucguguagacacagaacuggugaccaaggaaguguguuagaccaguggggaaaugauuggauuuugaauaaauagaacaauugguuacccgcauugaaaaauaugaacuuggaucccuacuuuacaacacaaauaaaaauaauucuaaguggguuuaaagccuaaaugcgaagggcaaaaccaaagcgcuuuaagaauacaaugaggcagggccgggugcuguggcucacucuuguaaucccagcacuuugggaggucuagaugggcggaucaggaguuugagaccaccagccuggccaacauggugaaaccccgucucuacuaaaaauacaaaaauuagcugggcauccaccuguagucccagcuguuugggaggcugaggcgggacaaucguuugaacucagggggcagagguugcagugagccgagauggcaccacugcacuccagccugggccacagaucgagacuccaucucaaaaacaaaacaaaacaaaaaacaaggcaaaacaccuucguauacucaugguagcaaaguuuuucuucaucacgacacagaaacaaccauaaaugaaaauuacgaaacauucagugaccuuaaaauuaggaauguccauugaucaaaagacaccauaaagagagugaaaaccuuauguaguagguugcuaugaauaaaagcaaaacaaaaaggagugaaaacacaagugaaaaauugggaggagauaauggaaucacauauaacugaugaagggcucaaaccuuagaugccaauaagcaucuaaauaaauugugguauauucgcagaauggaauauuguauaaugagaauggaagauccauaacugcacgaaagcauacagaugaaucacaaaaagccaaaaaaaagcuuccacacugauccauuuaugcaaaguucacaagcaggcaaaacucaugaauuaccaccuaaauggugacauuguaaagaaaagcgaggggcugauuaccagagucaggauaguguucaccucuggcagagggagggauguggcugagaaggggcccagagga

SEQ ID NO: 18897 - RNA, 21598 nt, Homo sapiens
acacugccagggccauggagggugggucaugugggcugucaggcauaguguggccgcacagggaccucacacccucaggcagagcuguccagucacacucuaacacagaauagucacacacaauccaucccagucaccccugacacagugacacagucccugucugguacacaugaggacccuccacugcuagccagccugccccaggcaggggcucauggcugccauggugucugccagaucuugucugauacgaaggagcuucagaaggaaaucaacucccuaucugggaagcuggaccggacguuugcggugacugaugagcuuguguucaagguguggggcagguugggcgggggugaguggggugaggcugggcugcugccuugugcaucugcuaauuggcuggcugggguccagacccaggcccugugcgaggcuggaggugcacugauacccagggcuggcuuuguuucauggaggaugaagcuagugggguggugggagaggguggccuucuuagggcauggagauggucaagggcagcccacugauaccuuugaggucccugugucuggucaggaugccaagaaggacgaugcuguucggaaggccuauaaguaucuagcugcucugcacgaggugaggggagacaugugccugggguggggcugcugggggugggugggacugggugcaagccuucugcuccuguuguccccagaacugcagccagcucauccagaccaucgaggacacaggcaccaucaugcgggagguucgagaccucgaggagcaggugaggccugggggcaggauggggagccaaggcgggccggggggacaguuccucagguuaugcugacagaggcuguggagccacacacagccgauggcuggacacccagcccugccccuuagugccugugaccugggacaggcaaguggccuacugugagccccagcuuccaccccaagggcccuccugucugccucccagggccaugggcagaggcuucagcuuaaagauguagggggaauccugccacauggcgaaggaugcuuuggguagagggaacaccacacgaggccuggccaugggacagagcaggcuguuggaguuggugggaggggcccagaguggcugugaugggggcuggugagcaggagcugggaaaggggcugugugugcugagggggcauguguucacauugccucagaucgagacagagcugggcaagaagacccucagcaaccuggagaagauccgggaggacuaccgagcccuccgccaggagaacgcuggccuccuaggccggguccgggaggccugaggagccgccggcagaggucucuccccagccucaggcagggauuuggggugcuggaggcaguggccaagcacaugcccuagcuacuuccuccgcuguccaguuccuccugcugcggccuuggacccagaccccugcccacugaccgcaacccuuauauggggugauaguccagcauguggggagcucggcugcaguuuauuggggacgguacuguggguugggggccuuggaucccaaauaaaugaguaguuccucugcagucuaagcugaggcauggaucagggcucagggaaugggagugaggugaguggcaggggagacacgggguauuuuuggcaaggcaguguguguggcugugugugucugcacgggacucaagagacccacuggggggcugugcgugugcauaugcgugagauacacaggugaauucuaacaggccgugugugugagcgagcacguguugggaccucagauccugaggguacugacgcugcuucuguguaggccucugggcacaccccuguguugacagugccccugugggcccugaggcuggcugugggugcgugccuugggguguguggguugucagggcugugcuugugugugauugugugaugaugcagcuuugagguuguuugaguguacugaggcaggcucucuguguuuugggguuuguguugagugagggacaggauugugacauuuugugugucugugugacuuuuccagcccugaaguaaucugugcgagcagcugaggcaggcucuguguggcugguugugaaggcucuguuuggcugcagggcucgacuggggggugugucuggggcggaggugggggcuggggccaggaccggggccccucugagcagccuuggggcaaaggauaugaugggggaggggguggcugccagcgggggaacaggggcccuggcaggcaagacaguggaaaccucacuucuuggucccugugggcacauccagggccuaucaucccugcccccaccaccucugccucccaccaguuuggccccuguucguccauccuccuuuccuugaucuugaggucaggggccagguguaggguuggaacaccugcugggccucuggcuccguuucuugcggaacuccagcucauccacgguccacacagcccccuucucgcucuccacccgcacaaagcacuugugcagacucagguuguggcggauggcguucuguggaaggccggggacagggagcaggugggcgucaaccucugaggccagcagccaccaccaacaacccacaucccguuccuccccaaugugccuaugagcccagacccaggccugcccacuuugagcugcgauggcacuugaggccaucccagucaccgccaccucagaggagcucaccuuccagguggcaggaugguuucugaagaaggcaaacaugcgugugaaccagugguagaucucauugaguguccgcugcuucucuggagccuccaggauggccuggaaguuggggggugggguaaggggcacauuccccaaacuugggguuuagaggggcuaugaccuaccccgagccaucugacaugggggcggaauuguaggggcagguaaucagggacaggacuagauguggggugaagcauggggucaaagaugggguuagaaaaggggugaagugucggguugggcaggguuagauggguguggguaugguuguucugggauuagguaagggaucaggacugagguugggaguggggucuuguucagggcuagggcugaagugaggugaaaggucugggauggaguuggaguugggguucucuguggaggugacauuucaggguuggggaaggugaagggucagaaguggggucaaggauuuggaagggguaaagggccaggccaacuuaagggucagggaagggguggguuaagagucaggcugggguggacucagguggggggucuaggggugagggaugggaugacuuggcuuuaggucagaagccagagaugguuugaauuaucgaguaucuuacgugucagggacaugguuaggugguuaggcucagggcaaggaugagguuaguugugggguucgguguggagugaggcugagggucagggaauuugaucaguuuggauucaggaaugggauuacagagucagcgaugaugauugcagugaggcuaucagucaggauggggcuaggucaggguuucaguucagagacagucggggaauaucugguaucauguaggggugagguucagguuugggguuagguguggcgcuaggaugaagguucugagaaggcauuggggaggcugagaugaaggaguugggauggggugaugaaguuaaggaucaaauggguguuacaaggaaagguugggaauggugcccaguuggggguguauugacauacugggguacguuggggccagggaaggagaugggguuggguuggcauaaaggcuggggaaggaguuagaguaagagcugggguacguuuagggcaaggugcagagaugggguuagcuuuaggcuauuuuauggguccaggagaggguuagguauggggcugagguggacaucuggaaagggguagguuuagggucagaauuuggcaugcucuggccuggauggugguuuagguuuggauuugcggacagguuuggggugaagccagcaugaggggucacauuugaggcacggcuuggggauccuuggggcuggggcuugggaauggaggaacccacucugagggcacucagagggagacaggaguuugggaggcaggucccccaccccaucuuugucuuccuccuccuuggggccgagcugcccugcuuacccagcggaugagcguggcguaggugaaagggggucgcauguuguggaacuugaaguaguccauguuguggaggaacucugucagaggguggggaugaaucaagccccaugcaggaccuccuagcuagcucccuguccccucccccuacaaggugagucuacaggccugagaucucaccgucaacacccguguccacgggcacagguacuguuugcugagcaccugacauaaguuguaucauuuauucuuugcaccacuucugccaaaauaguucuccccgagguugaaaagaagcggaguaacuugcacaccaaaggaugcaagagguuaaauggcagagccaggaugacagucaaggucucugaucccugcuaagcccacaggccaggccugguggagagcaguggauaggugagcucgggcgaauccaccccgauuuuccuuggucaggggaggaaaggaggugcuccuggaauuacuuagcagggucccucccuucugauggccgaauauaguagcuggaguccagagugggugaggcauggccccaauccccaagggagucagggcuaggggcccgacacucgagaccauauggggggcuuucaggccacggacaucccgaaaggaagcuuuugugagcggaugcauuuucccaaaggcugaguggcggcagcugcagugguggugguggugggaaggggcagcauggagcuccuuugcacccuccacccagagccugucaggauuaggagcuugggggcaccguguagugcaaggaccauucuuaccugggaaugugcuguuuccauggcuaccccacaggugccuccggacagcaaacaggcugucaggggccucccgggggccagaccaggcugggacgacagggccuuggcugccagcagcuacgaugcagcaggagcccuugucggaugaugccugggugagggggagaggcuggugacccagaggcuuaaacuucccacuuuuuacuuucuauuuuauguuuuuuauuuuuuuugauacugagucuugcucugucgcccaggcuggagugcaguggugcaaucucggcucacugcaacccccaccucccagauucaagcaagucuucugccucagccucccgaguagcugggacuacaggugcccgucacuacgcccagcuaauuuuuguauuuuugguagagaugggguuucaccauguuagccaggcuggucucgaacuccugaccucaugugauccacccgcuucagccucccaaagugcugggauuacaggcaugagccacugcgccuggcuccacuuuauuuuuaaaucaguguuuuucaaagcaaggacgcccucuucuaaauuccagucugagguggaaucccacaaaacagcaugagccguauuuauuagagcacaggugcggaugucguauguggccacugaugcugggaccaugaacugggguugaauagggcucuuuaccacccaacugugaccuugggaaagucaccuaaaccccccuggccucaauauuccucaucuguacauucgcaucaugagaaauaaauuaccaccagcaaagcgcucagaaacagugccuggccuccagggcuggcuucaugggcgugugaccuaugugguuauguggcacccugugcuuuguuuaaugcucuguggucgccaucuugaaaucugaacaaggggcccugcagguuacauagcugguccugcuggcacacagccugcaucuggcaagucuggcuauuugcauuugcuuuaacaacucaggaucacaguguuuggggaucuuagagucagaggguuuuuuuuuuuuuuuuuucuugagacggagucuugaucugucgccuaggcuggagugcagugguaugaucucagcucacugcaaacuccgccucccagguucaagcaauucucugccucagccucccaaguaguugggacuacagacaccugccaccacgccuggcuaauuuuuuguacuuuuaguagacacaggguuucaccaucuuggcgaggcuggucuugaacuccugaccucgugauccacccgccucggccucccaaagugcugggauuacaggcgugagccaccacgcccagccggggucagaggguuuguaaguagaaggggacagauuuccaggucugggcauguuuggagcuggggacaggggccccuagcucucaggaccugaaugugagguuagguucccugcaccgugcagaccuccucccugccccccagcagucugagucugccaccaccaguccuggggucgcucaccacagaugaagccuuggucagugccauuuucccagccaggugggccugcauggcacucagcuucuccuucuccagcaccagcugugaaauggcacaaacaugaggccucagccuggcccuucucugccacaucuuugcccaggcuacggucuucccugggagugcccgcuccucuuccuuccuuuauaccagcccucgucccaggugaacuugguuucuggcacaugguggacagaagguuuugcgcacuaucccuaucccuuacccuccaccgcccuggcauuaccugcugcuccagagacuguaccaucucucucuggaggagacauugugcccugcccuucucauccagaagaugguccgccuggcagugccuaaguagggagaagauuccaugcaggugaccacgacaggccuggucuggcucaaugcucugaauggggagggcccagacccucugggaguucucuccucugagccccagcuccccuccccucucuaccucagucucccucucacaccccucguucccuuaacacaugccccucagcaccuacugcaugucaggccugaacucaccacuugagccuggccagagugcuggagauaauguuggaaguguggugaguugagaaugggccagggaggugagagugggcaaagcauucuggguggagggacggccugugcaaaggccuggcugcaaggaggacaggacaugugggguugcugcuaaggguuguguguagugugguguguauuugugugugugugugugugagagagagagaaagagagagagagagagagagagagagagagagagagagagagagagagagacauauggggggacugaggggaggcagcagcagccaucuagaggagcuagaacuuugggaacaguggaauaaggcuggcauguuggcaugaggaguagcagggcaaagcaggagugcagauucuagagccuggcuacauggguucaaaucccagcucugucacucaggaacugggagauuuugaucaagacacuuaaccucuuuggccucagucuccuugucuguaaaauggggguaaauaacagcacaaacguuucuuauuauacauacgagaaaacugaggucgagagaagcuaaguaauuuguccaaggucacacagccagucagggauggagcugggauuugaacccacagucucagaguuuagcucuugcaucuuacuacuuauugggaugaagccugagcugagaucugcacccuagaccucuccccacaagccagggccgguagacuggcacaggccugggccacucacuugaggaaguccucuggcucuucgaagaccuucucacauccgggccacuugcagacaccauuugccagcaguggguaggagcucuggggcacagccgaaagggugcuggggggacagagggugucaggggaggggauaggagggcgaggauccuucccagcccuguccacugaccuguccuuccugggugcacugggauuugggaaggugcagagcagugccggcucccuggacacccauuccaggcuggccacguugaucccuguggguggggacagggcaccuauggaggcugugggcugggcucuggagcuuggcccacaaggccucucauuuugagcuucccacccuccugagccucgaaaacccugacucccagggggcucugcuguccccaaagucccaggcuucuggcagagaagcuuaaagacggccauucgcaggugcugacauuuugacuagcuuuguaaagcucugugguuuugugauuuugacauucugcaucuuuaagguucugcaccugacguuuuuuggaggguggaguuuccaagccucugagaccugacaccuuugacccccagaguacugcaauucagaauagccuacacugcucacagccaaggaucuggggacuuggggguucugugaagccaugggguacgggcugagguguuaccaggugggaggccaggccgggccuugagggagaagaccccaguggcggugguggguggugugaggcugaucauggcugggcucuccagggggugcaccugcagcacagggguccgggcgugggcauccaccguugagagcuggggggcacaugugggcugugguucagccugacucggggccccuccccacaguucucccaccugcucccuccucccugcccauucaccguccauaccuggugcaugaaauguggccuguccuggaggagugccuguaaguggggcaaggggcccagccgugccccggagggugccaccaugacuaggggcagugugggcagcugggcagaaaggcaggugggugagaggccauccugauccucacuguucugugucuaauucaaauacucugcacugcaagcccacaugguagaugcuaugaucaucccccuuuuacacguauggaaacugaggcucauggagaucgaguaacuuuuuaaagaucaaacagcuaauaaguugcagagcuggccucagcccugucaccucaccuacuuggccccaguccucuucucuugucacauggggauggggacacauagcuaugcucaugggacuacaauacggccuccuccucuccugagacagggauugggaggucggggagagccuccaaucucugaggccuggcagguggggauuuucuuggcccugcaacaucugcauaagucacagacuugccugggacccagaaaccacuuccugugccccagccagccccccucccgcccagugccacaguaaaggucggcaccuguagguccagguaccccacccugccugccccauccugggcccagggccucaccugcagcugcgaugguggcaugggguucaaggaagaagaggaggcaugggccccgccucgaagaucucggcccuggaagguucccccugggccccgggcccccagcaggucugaggcuuugggugcagcccuccagcugggcgaggcuccuggggaugggccaagggccaaggaaggggccgagggcuugccaggccugggguugggcaucggguccuuguccaagggcaggcugcguagacaauaggggaaaggagucacacgugugcuagggcgguaugagauacucgaccaccugagccacguggacacuccucuggucaaagcaggcauuggcugggacaugucccgaggggccccauaguugcaccccagcucuagacacacacacacacacacacacacacacacaccaagaacacagguacauguacauacccacacaugccccacgugcagagguccagcaccuggcuugccugcccacgcuagcacagcccugguguggauguguccucuaugagggcaaugguuguuucccccuccacuugagagcuguuucaagccucaggccucuagcccucccugcacccugcacaggcuguguuugcucaucuugccggagcuggucucggacuuucuccucggaguccuauuuugccccagugacuaggcauggacucaaaagauucaucuggcugcugugaguggggcuagugaggaggcuauuguaacaguccuggcaagugaugaugcuggcacagaaugggcugguggcaguggagaaggcgagaaguggguagauucugagacuuaaucugaagcuggaucaggagcagugcuagcagcuuggauguagugggcaagagggagagucaaagugacauggguuuuagcuugagcagcuggaaggaccgagcugacauuaccugagaugggggacauggcggggaguuggauugggugcaaaagugcagguguagauagacaugaagagucuggcauuaaauaugugaguggaggagcugagggggcagcugaauacgggggucuggaucucagggcaaggaggcgaguccaggagugugaucaugcacggauccagcauggcaagugacagagaggaggagagauggggucucuugagcuggggccuguagaagcuucucuacccagcccccaucagaguucaccccaauuucuggcccucaagccuggcucaugcuacacccccugccucaaaugcccacuccuucuccucuuucccuguccaagccacgcaagaccugcucuucuauuguccucaccuugaaagcccuccacaauggcuccgggcccccugcugagccccagaaccuuccacucccugagggaagcacuggcuuuucaggauccuauaauccuggucugagaggaagccagagcuggaagggacugcccagccaaccccauuauacagaaggggaugcucagaugccgaguuccguagucccauagugacuugagaacuccacuucuuucuuuaggaaguguuuccgugugcacauuuuauaaacucucuggugugugugugugugugucuccaucuccccguuccaccucacagcacugaguugggcacacagcugcugagagcagcccgggggaguauagaaggguucugggggagcaguugcuccuuccuuucuuugcugucaccuccugggggugguugucagagcuguggugcugagggagaugagugugagaauccagguauuaaguucuuagucuccugggggcuuagaacauuacugcgugagaaacaggagugugggucuguggaggcuccgaacaagggccugggagagcacuggugagaugagaaggugagugaaugaaugaagccagagauggggugaugcuccuucaagccaagaaauaacaaagauugccagcaaccaccagaagcugggggagaggccuggagcagcuucucccuuauggcccccagaaggaaccaacccuggcaacaccuugaucuuggacucuggccuccagaacugugagaugaucaauuucuguugcugaagccacucaguugugguacuuuguuauagcagccagaacaaacuaauaccgauuucggugcaaauggauguuuuccaccacucuggccuggcccauguggcuggccuguggucacuucugaagcugccuggacacuuggccagagcuaagaauucuccccaaacacaugugggauggccugacucagcaaagcauagauacauucucagacagggacauggagaugaucugucuggggguagaggaccuagagggccgggcugggcagccggcuuccugcacugucuguugggacgucccuuucugacuggguuucucagaagcugaaugggggauguuucugggacacagauuauguuuucauaucggggucugcaucugggcccuguugucacagcccccgacuugcccagauuuuuccgccauugacgucauggcggccggaugcgccgggcuucaucgacaccacggaggaagagaagagggcagauaccccaccccacagguuucguuccgagaacuggcugcccuguccugcagcaggcuuggcccagguggggugacaugggugcugguggaugugguaggugauguccaucuggccacuaugacaagccccuagcucugaagaccuggcccuucuuggguuguggagaggacccagguuugaagcucugagagugccaggcaggcuccacagauacugggaccccuggggucuucaaauaguauaacaccaggaccucagaaucauagaacagcauuucuuagauuuaaaggauccuagaaucucaaaaccacagacuguggggucuacggucccaaagucucaguauguguaggccagugucccugguguccaaacuccuuggaaccaucugaaagucaggcagcuugcugcuucauagggccucuugccuaccaggccuggaaacagagccagccucccuagggccucagucucccuguccacucuggaacaacguucccaaauacauggccacuccgccagagauggcaacagggggaggaggagguugaggcuggugugccuuuggucugggccucauggggggagcuggaaaagccucagccuucgccaauacagagcccaucaucagacucucuagaggggccccacaaucaagguuuucggggaccagcaccagcucuggggacacacagccugacugacugacaugccuccaucaucaccacgcucuggccaacuaggccuccugaccuauggaguccggggccucaccuagcccagcucuugugaggcugggccccacacugugaucguggaucguccaaccugugggaaguugggguccaacgugugagaaggcagaagggggaaugguagcccagguuccccuucccccuucugggugcugagggguaaacugaggccuucaguuggggagagagccagaaccagggucccaccuagaguccugagaucuaggcuuggauuucaacucugccgcugcauuucggugaggcccugagaucucuggucuucaauuugcccuucuacacugagcacggagaggcguggaguagacaagggccagggcccuucuacgcugucugguuaagucauuaggugucugcagggcuucaaguugacaauugccccucuauccaggggacuggcugagagauagggauacauagagacaaagagacacacacaaagagcgagcaagagagaacaagagauagugagagacauugagagaaauggacacaugcauggagagccagagugcaugugugcgagaggaggauugccucaaauaagaacauuugcuggucucuggcugguucaacugaugcugccugaaauaaucaagaauaaagaagggcaaggugccagggacacccauggcuggguauugaauuguauugcaaagcaacaaucagcaaaacaguguggcccugguauaagaacagauacuggggaagagaacagaauagaaagcuuggacauggacccacauauggagagaacugaauuugugaugaauguggcauuucaaacuggaggaccauggaguaugguuuaacaaaugugucugagauaauuagggagaagauaaaguuauugagugaauagucaguccauuaucccaacaaccccucccugcccaguuugaaaugucaccaucaucauauacccuaaaaugcccagauccauucaagauauaaguuuuaacaccuaaugcugaucuuggguuuauugugugucaggccuugugcuaaguauuuacugugguuaaaaauuuuaaucuaaacaaagacuccugaggaagguacuauuauaaccauugcaguacauaugaggaaauggagguauggagagguuaagugccuggcuaaaaaucacacauagggcuuggggugacgcuggguuugucccagacagucuggcuccaguacccacacucuuaaccucuauaguaaauggaaaaaaugaagccauaaaagagacuagaagccaacauaggugaacauuuaucucauuuucaaguaggaaaggacuuucuaagcacaaaaccagagacagaagccacagaaaaaaagacuaaccuauuugacuguauaaaaccaucauaagcaucacaaaaaacaccauaaacaaauagaaaaaaagcaaaugaugaauuggggaaaauauuugcuauauauguaauggcugaugaaagguuaauaaccauuccaaauaaagagcuguggcaaaucaauaagggaaaaauaagaugaacacccuauuaggaguaaggacaugaccagacaaccaaaaaaaaaaaaaaaaaaaagcaugaauggccaaugaauaguaaaaguaaucacaagaugcaaauuucaacaaugugauaauguguuuuucuuaccugucauguugggaaauaauuaaaacauaauaauacucaccuaggguuagcuuaaguagagggagcauaaaauaggacaaccuuuuggaaggagaauuagcagagagggucauaaacuuuaaaaaugcacgcccccuuugccccagcaacucccuuuucaggaauccaaggaagcagucagggauguuuauagaaaaaaacgagaaacaaccggaauguccaacaaucggcacuuggucaaaucaaucaaaguucaugcugaugugaggacagucuuguccaucaugaaagaucauguguucaaacaauuuuuaguaagcuucaaaaacacuacuguuaauugaauaaagcaggaacaaaaccaauauauagcaugauucuaauuugguuacagaaauacuaauagcuaacacuucgugagcacuuacuuugugccaaacgcugugcuaagccugcagaaucgagcucaccccagcccugaacaaccuguuugcuuccugaauauggacucuggucacacacaugcaguccugggguagguccacacagcuaaacuacgguugacaauggugugaagugcucccugcccccccgccccaagggucuccucuaaagcgauacaagcaaaguucaguuaagugcucagcuugccccggcaccuugcaauccuccugcuacuagggugaacagaacugaugcucacucucauaaaauguaaagguccucggcgacauuacuauuauuaaacgccagcuguguacaaagcucuaggcuggaugcuggcugggaaggcaggugggggaaggcaagaaaagagagcgggagagauggaggaaaggagaucgauggaguguggucaagauggaggagacagagauaggggagauggucagaggccaggagagaugcggggaaagagagucugaguguagcgacagacagauggcgggagaaagagaggcagagaaacauguaaaagagcaagacagggugagcagagagacagagaaggaugagaggcaucaagagcuaagagacaaagagaugagagagaugcaguugaaauuuucaguugcaccuggacagcauuucaaguuguucaaagcucugaaauccauaaagacuggcagcugacauauuuuaaaaauccuauccaucuacguaucaauugaugaauucauuuauuuuugccccugcccaugcauuaaguacuucaccuuuaagucuucugccauuuauucuauuauuauuuuuuuaaagaccuuaccuggcuggaaucacgguagcuggguacaucccacuguaccagagggccccugacccccccgccgugccuaccucccugccaucuccuccaauggggcccacaucugguaggggagagcagggacacucaccuuggugaaguggacugacagaaaaggaucagccuggcuugugggaaacugucacguaucaaaaacaacuuugcuuuuauaccgagaagaaaaaccacgcuguacgguguggaagccgcagaccucucucuucuaauaauccaaauuuuuuucgaugagugugugcgcugauaaucacgggguggggggggguucucauaguuuuuuuuuucucucucucuguguuucuccuuuucuugauuaugagacuuaaacggaaauuuugaaauuuuggguuuuuuucuuugcccuuuacgagucaucugaaaauaugauuucuuccccucaccacagaggugagagguaucaaugagauaauagggcucaugagaaaccacaguuuuuaaaacaaaaguguauagaguuugaaaaaaaaaaaacaagggaaaagaacuaaaauaaaucacagggccaacccgaggcaggcagagacaccauucugugagugagaggauauuugagggucucuggggaaagaaagagaaucugaagcucuauguguggaugggaaaugccagggaaagagacagaauagggcuggguucccagaggccucgcccuacuccaggccucaguuucccuauagauggaauugauaugguccccauugcuugaacuacccggcgaggggaguucugcacccccugcaacaccccucccacagagggugaggggcauguaaguuacuucauggaggagaaagcggagagcccacugucauccccuaaaauucauggacuugaagagucggagaaucccuggcucccagaaucuacugacaguuacugaaugaggaaagagagaaaagucucgccucaucacguuuuagggcuugagugcccugacccagccacugucccacugggaaggucccuagcagguccccaauauuaaugcauccauccucacgaugaaccccagaggcccauugggacccugacccucuuguuucaggaacaucauggccugaugcuucugaggcccucagccuuuggggucuuuuacuucaaaaagccccaguuuccaaggauuuaggauuccaaauauccgccaucaucucaguagcugauguuuaucuugaauuuuccaugggucagauacagugcugaacaugucucacaagugaucauguucaauccucaccauggccccuugagcuccaucucaucauuauuguauuccuguuauacagaugagggaaacggagguauaaguagucaagcaacuugcccaagaucacagagcuggcgagugugggucccgcuuucuuuggugcugggcuuugaaauccccaagcuuuccugaacuugauguucucagguuuuaaauucuaggaugugauggcagggagauccugggauuuggagaguccuuggagacuugaagcuugugaggcuuuuagguuguccaggaauuggcggcugcaucucuugaccucagcaggcacucuauucaaccacuggucagcaugguagaccagcccccaggggcuucuccugacaggccauggugaagacuuccagcucccagcacccugcaaagcccaggguucuagucguccaacaaccacuccagcccucuacaagacuggcuucagaccuggggaagagaaauuggaaagggcuuuuuauuuacaugguacaaaucugguggccaagauccaccccuucaccccuuugcccccuuuccucccccaaccuucuaagcccucguaaaaaggagggccucuuuccucaacucagacucacccuucuggaaaagcccagaaugggccugauggccuggcuuugugaagacaagaaaaaaaaaaaaaaagaauagaaaaaaaaagaccuuaaaaaaaucagccaacaacaauuaaaaaaaaaaaaaaaacacccaacccuccccaccauuaguucaaaacaaaacuuucgcugguugaggcuucugaguuggugggacacaucugagacccaaaaauggcuuggguguguuggacagccaggggaggcaccaaggugggaugagguccccugcuuggaggccugcagggacccugugaacagcagguguuuaacagaugucacggcaugugggagggagcaagggagggggugaggagcaugcaugucaggaaggaguccuggggagcugauucuagugauggccccaagguuaaugaccccuugcagugaugguccuaagguuaaugaucccuugcacugauguucccauaguuaauaaccccuugcucccugcagacuugggucggaauguucccuacaccuccugcguaauuauaaaccaggccaguucuaucagcagaggcauuguucccugccccagcaccugucccccuccuggaaaagggggcuaguuuucucucucaggaucagaggugugggcugcauucuccuuauaccuuccccagaccaucugucccuuacugucacucacuccaugaaagagaguggccagagauauaggaggcaaacgaagugaggaugguggccgagaaugugagcuggccccuugggcaggcccagggugugagagggaaaugcuacggcugcugaaagccaagauccuugcagaaugggggcuggggucaggagggcagagagggguagaggucgcuaccuccccucuauacuggacuauauccucucucauggagggcuucucgggaaggagacugggagggcugggaguugggggugaguaggcaagauuaaacgggucaggaaaaguccccagagacaggggccucugacaaagacuugaaggagaugagggagggagccagcuagauaucugaggaacuccaaaggaaacagccagggcaaagguccugaggugggaauguaccugauuuguucaaggucuacaagggggcuggugugguuaguguggagagagcaagaagagaagcuggaggugaggucagaaaggggacucggagguuagaccacgcaggaccuuguaggccaugguaaggacuuuggcuucaacgcugagugaggaggaaggcaugacaggguugcaagcagaggagaaacacaaaccguguuaggauuuaacaggaagccccugaaugcugaguguacaauggggucuagggccugaauguggaagcaggggaccagcaaggagcuggcuacugcaguagucuaggugacuggugauagugcuggcaguggagguggugagaagaggauggauuugguaaauauuuuuaauagacagccaaaaggauuuguugaagacugagagucuuggagccagaucgggacagacaaugcccaaaccaggugggcaggaaggagucccuggacuauuugccagcuugaacuuuuaggugagaaaaaaauaaaguucugucuugcuuaagcccccauuauuuuaugauuuuucuguuacuugcagcugaacauauucauuucuaacucauggacauccugaacauggagaccuggggagaggggcugcuggaaggaucaccucccuccuaggaugcugugagguucuaaugagauaacagcaugcucagaaccuggcacucaguagguguucaguaaaucuucccaggauggagaaggaauguaugaauggauguguucagcggacaaaagcugcaguugaguucccacagaaggugagaccccaaagggagagcgaaaggaguuuacuagauggaagcagcagaaggaacagcacucuugggagagggaacaguagaagcagagauggggggacagaaagaagggaggugaggccccugugggguguggagugucagguugggcaagaaggacagggcuuugauugugauuccauuagucagaagcuacccauaugcccaaucaacuucugguagcacacagucaggucaguguuugcugagcugaaauuuaaaaaagugaauccuucagaaaguuaaauuuccuauucggccauucauucaacaauaguaucaaguccuggagagugcuugcggcuaacaaucaggggcauucuuggcuuguggcacugcucaagaaaagguuguaguugggcagggaggacccaguaaguaacuaacugcaacaggacagucauuuucacuuuccuaguucacacaccaagguguggucuaggccuucaggggcucuggguauuccuggggcaauggggagucacggaggguuagggagaggguaaccccaucccugagaagcacauuuuuccuaauggcugccugcguucuaugguucugcuguccggccacccaauaccucagacucugucuacacagcguccuccucuccagccuccuuauuggcuacucaugccucccuucacaccaccuacacugcccccgucggcucugcuuuuuuccccaucuugccuccaaguccucccuccgucccgcugcacuaucuagccucggcauuggcucaucccauacuaguacuguccuuugaggucucuacgccuucacccuggcucccucauuggcuauccgccagcucucguccucgcucccgccuucagccuccaccuccauuggcucggcucccuacacacccgccucuuggucuccuuuuagccuucguauuggcuagcuccaccuuggcaccaccccuucgaagccgcagugcacgcucacaagccuccccauuggcucgcugcagccauugucgucaucccacgcguggcucuccauuggcuguucucucucucuagcuaccguuccaccgccuacgcaacccgcgggaucucccacuuuuugggccucugcguucguucccggcugcccucaucgccuguagccauuccacuuuucccaccgcccacaugccucucucgcucagacuuccgcauuagcugucugcuucuguuuucuucaucauggauuucgcaccacccccauuccggccucuccauugauuccucgaucaucccgcccccuacaccgcccacucccgggcauccccauuggcugcgugcuucuccggcucucaauucgcuguacgucauccgugcauggcugcccauuggcccucugcaauacuugucuucaucucaccgccuaugcccccgugagccguaccccuccgcgcuggccuucccauuggcugcccgccccuucaggcccugcccccgccggucccgccgccggugccgucggugccgccgccgccgccgauauggcgcguacggccccuguggagcccccgcugcggcauuccgcgccccccucgccggccgcgggugagccccgcaccucggucgaggcggcgguggccccgcggagggugcuguucgccgacgaggccuuggggcugccgcuggcgcaguugcgccgcuaccggccguggggcgggcccggggcgggcaagauggcggcggcggccgggcaagauggcggcggcggcggcggggccgacgaggacgacgauggcgaggauggggaugaaggggaggaggaagaggaggcuugccccgagcccucaccgcugugccccguccccgcuggcgggggguuuuaccugguccccacauuuucgcugccgcccgcgccgggccgucuggagcgcuuggggcgcgucaugguggagcuggaggcgcugcugccgccucccggagcgguccccgggggugccggggugugggugccugggggccgcccgccggugcugcgcggguugguacgcgugcugaaccgcuccuucgagaaggcggugcacgugcgggccucacacgacggcugggcuuccuuuugcgaccacccagcgcgcuacgucccgcgcagcccgccgugggcaggagcgggaggaacaggagcaggagaucccauccu

SEQ ID NO: 18898 - RNA, 12580 nt, Homo sapiens
cacggcuccagccuccgggccggaauggcugccggugagacugugguacaacccgcugugcgcaggcgcguggcgggcaaggagggggcgcgaggggcggggcugcagccgccugggcuguuccaacgagcgcgcgccgcccccgccgcgccccgcgccgcccuugcuagccgagccucccgcccccugcauugcugaugcugcugcuggcggacauggacguggugaaucagguacgcgcuccagcaccguggacagagcccgccgccgcccggcugccuaggccgggucgcucaggccagccgacucugggaggugguggccagggucuggcagcggagacccgguccccggcgcuggggaugggggucugcggcaggugaaggggaggaagggggagguggagaaaaggagugcgcucuuugccgcagcgagggccguccucacugccgcagcgggggcccccggagccccguuuauuacuggcgaccgcgaggggaggaauaggggccugggggcuggagugagggcaagggacaaggggaggggagaguggaaggaagauggggggugcugcggauaagcuaggaaauagagcgacagaaggugugggggcggggaugggggagagggcuggcacccgccccucccaaacagagacuguacccccauaggcgaccaccccuucccccagagcacaccuaggggacaauccgguuuuacuccuuccaaaacccccagccuccucacccccaacacauagcgacugaagccgugucccagcccucccccaccuuaaucaguccagacccucuccgccaugucucucgucuuugccaccucagaaacucacccccaaucagucccaacccuuccccauccccaucaccucaaauaucuaccgccaccgccgucuaacacaccuuuaccccugcagacccuucccccaccugagccaaaccgacuccugccccguuaugacucaccuucaccaucacaacccccccacccgaaugcaccccacuccauccccauucucuacccgaaccccuuccccauccgacucgccuuuacguuucaaaccugcucccccuccuuaacuaguccugaccucauccccaucucccucacccccgacuuccucugccaucugacucaccaucucuucagaccuucccaccaguccuuggacccuggggcucacaccauccccaaggugucacuuucuccuucucacccucuccccgaggucacaugcuccauccccuggggucauugaugggcagccuugccgcucaccucccuguaccuccaacaaccccaccccuuccccacuguuucucuccucagcugguggcugggggucaguuccggguggucaaggagccccucggcuuugugaaggugcugcaaugggugagugugguccgggcuguuggggcagagugcagggagagagggaggucaugggguccagaagagcagggguggaguaggggcgaguagccagggaugagugcggggguuguaggggaugggggaauugggcuccagggugagguuucaggggucugaagccagaaaacagaugagcugugacgucacauagggcugaggguacccccguugugaagugggagacugugacguccuaccuccucucuugaagugagggaggggugggggagguggagccuguagcagaugcugggugagagaugcaaagucagagaaacccagagacagugaaggugacagagagaaugagggacagggaaugauaaagacagagauggaaauacugagaaaaaaaaaagaaauauggagaugagaagagauacagacauaagagagaagagacaaacagaaacaaagaaaaaggagacacagaaaacagaugcaaagagaaacagacgcagggagagaggcaggaaaacagggugagggagagagagacacagagagaaagagacacucagaaaaaagagaaaccaacacacagaggcaagagggagacagagagagaaccauccggagaccgagugagagacaggacagagagacagagacaaacagaccaagaaacagaaagacacagacauacaggcauacacuuacacagacagagaaaaaagagacaaaaagagacaucgacagaucagauaggcagaggcagagaggaucagagacacagagagacaaagagacaucugagaaagacaaagacacauagagaaacagagauaccgagagaaacagagacacagugagauacacagagaacaacagagacaaacagagaagagggaggucagcauggaaaggcagagacagagagagacacagagagagaaacaggaagagacagccauacccuuguaaucagcuuguccuuggucccgaugagcccugauuaggggguggggguggggacugcuccaucugcugcugccugugcugggcccccgaucuguccagaggagggcaccucccucccacaugcacacagguucacuguggccauccccaucccugcugcccaaggucuucgccaucuucgccuuugccacaugcggcagcuacaguggggagcuccagcugagcguggauugugccaacaagaccgagagugaccucagcaucgaggucgaguucgaguaccccuucaggugugcucccacccugggauaccaacagaccugggagaggaaggggcaggguggaaccggccaauaccuccccccgcaaguagcuccugcccagcucccaccucgaggcuacauccacugggaucacugagcaccugccuuguaccuggcacugcucuggacucuaggacuauguggugagcaaggcagacauaggcuguggcccucuggcucuguuccagcgaagggguaagggacaggcaauaaacaagauacaaaaguaagacagguguauauacauaccuuaacccaguagguacccaauuaauguuagccaauauuauuauuuaauccccauucauucauucuauacacauuuuugagaacuuauuuuauaucugguacuacucaaagugcuggaagcaugauaguaacuaaaacagacccaacucccgccaggcacaguggcucacgccuguaaucccagcacuuugagaggccgaggugggcggaucaccugaggucaggaguucgagaccagccugaccaacauggagaaaccccgucucuacuaaaaauacaaaauuagccaggcguggucaugcaugccuguaaucccggcuacucaggaggcugaagcaggagaaucacuugaaccugggagccgaaaucgcgccauugcacuccagccugggcaacaagagcgaaacuccaucuccaaaaaaaaaaaaaccagacccaacucccuaccuucauggagccuacauuauaacaaauaaauuaacaaagaggauaauagcagacugagagaaacucgaggagauccucauguaggguuuuaugguagagaauagaauaaugaggggugcugcuuagauauagggaaaaauuaaacccaauuaaacaauucugacauuuauugagcucacacugugugccgggcaauacacugggugcuaggugcacaagaaugagcacggcuggcaugggcacuacccucacaaugauguuuaccuccugcagggugggaugacagagacccacagacacaauccccgcacagguuucugagacucccccacuauuuggccaaaucacauaaccacucugggucucaauuuccucaucuguaaaaaggaauacuaauaauaucuaccucacagggucgugguuagcauucaaugaguuaauauucaucaggugcuuagcacagugccuggcacacaauaagugcuccaucagugucuguucaauaaguaaaauaaauuuaagggacucaggaaagaggacagggguugaguuggaaacugggggucuucgaguacugaggguaaauguaggcucaagugaucacccaguggggagauggaagagugaaaguagaagaaaaccuagcacaggcccugagcaaugauggaaaagagaggagaugccgggaaaguguggccugagaggcagaggggcagccagguauccauggguccacaaaggcaagggagaaaagagucuggggaaggagggggagcuggcagcaagggacacugcuuagagccaguccuuuggggauccacaagaccacaaccauccccugugcccccuccccacgccucccaugucuagaacuuuggguccuaaggcucuagcccacaaguccccuagaaaaacagucuuggcccugggucccccugagcaaaaucccucccaaacugcccuaauacccaaggaccucucauucccucuuagggacccccucuccugacccagcccacuagaaacagaaacucaaacccagaugcaacuccuagcuccaucauuuaggagcuguacaaccuugggcaaguaauaaccuugcuaagccucuguuuauucaucuguaaaaagggucuaauaaugccuucuuuagagaauugcuggaggcugucauuaaugagacauuuauguaaacugcuuaguaggugacuaauaagugcaagccucuucccucagggccuuugcuacacaaaggcauuggcaccauuugcucagucucaggauccuggccuccaaucugagacugugcuccagaacuucucccacagacauuuucucucuacaacccccaccucuccuccaucacaccacaggaaaggccuuagucccaggacaccuccccucuucccucacauacacacacccuguuccaagaucccuuuacccuccuuucuuucugucugucuuuuccuguuaucuagucgcuggccucuccucugcuaugcauacauuuuuuucucucggggaccugaacuggggugggggagaaaagucaacaugagauagggagaaaacaagguucagaucucaacucugacauucccuugccagcugugugacuuuaggcaaguuaaugcacuucccugagccucuguuuccgccucuguacauuucauuugauaaacauuucuugagugucugcuaggugccagcacuguuccagggccuggagauaaacggaggugaaaacacaggaaaaagcccugcccucuuguaguuacagcaaaaaccaagauuaaaaaaaaaaaaaauaccugguacgucagauggguaccacuacuaucgagaaaaguggagcaaggaagccaggcuaagaagugcugguugagagaauguuucaauuuaauuuuaaguagggagaucagggaaggucucaaugagaaggugacaguugagcaaagcuucaaggagaugagggaggccgggcgcaguggcucacgccuguaaucccagcacucugggaggccaaggcgggcagaucacaaggucaagagaucaagacuauccuggccaacauggugaaaccccgucucuauuaaaaguacaaaaauuagcugggcguagcggcgcaugccuguaaucccagcuacucaggaggcugaggcaggagaaucgcuugaacccgggaggcagagguugcagugagccgggauugugccaccgcacuccagccuggugacagagcaagacuccaucucaaaaaaaaaaaaaaaaaaaaaaaaaggagaugagggaguaagacccgaagcuaucuaggggaaaagcauuccuggcaaagggaacagccaguacaaacaaagauccuagggagggaggaugccuggcaaguucuagaaauaaucaagaggccagagugcuuggguuggagugagggaugaauaacaccuaucucaccaggauguuuugagcaaucagugaaaugugacugguacauaguaggugcucgaugaaugguuauuuccuccucuuccuggggccuugucagaaauggggggacccaugauugggcuggaggguugaggguguucugaggggcugggccacaccugcccaccucuguuugcaggcugcaccaaguguacuuugaugcacccaccugccgagggggcaccaccaaggucuucuuaguuggggacuacuccucgucagccgaauucuuugucaccguggccguguuugccuuccucuacuccaugggggcucuggccaccuacaucuuccugcagaacaaguaccgagagaauaacaaagggcccaugcuggugaguccccacagccacuugcauguagggaccauggggacacggaaccccagggacacagccaugcucacagaccacaccaaaucccagacaggcccacaugcaaacagccaccauaacagccacacauauaguugcugcugcuauuaauccacaccaggcauccgggacacagagucauagagucacggagacauacagccuaugcagaaucccagacaggcccacaccugagaaccuucccacucucacacaacuacacagccuagaucaaaggaagaggcccacagagguucgcugugacagucaugccugucaucaugccacacagacacacugauuccuacaccacuguacucacauacccucagccuagacacaaaaugacaaaaauucccacaugcagacaaaaguagaaagacacauuacuuuccacagauucggaaaucaucccagaguuccccuccccccaacacccacagccacauaucacaaucacacucccacauccucugugucauguacacacacaagcucaagcugggagggccaccuucaggugaaaguguugugggcuugagagcugaaaaggcaggggagagacaggccucuucugggggaccugugauccgaggaggccccagggccuagcgugaagcaguccacucacagugcugucuuccucaccccugccugccuuaggacuuucuggccacggcuguguucgccuucauguggcuaguuagcucaucggcaugggccaaggggcugucagaugugaagauggccacagacccagagaacauuaucaaggagaugccugucugccgccagacagggaacacaugcaaggagcugagagacccugugaccucgggacucaacaccucggugguaagcccugggugcuggcuggaggagggagaguggaaaacaguacaguccggcauggggagugguggagugggagaauaagaggagagucaggggagauccaaggggugucccugaagaacgcgugccaacaacaacguugaaggaugagcuagcaauuguaaccacugugacaccacagacuguccccaaagggggaacaugacagguuugggagaccuggaucccagacccagccuagacauguaaaauaagcaacucagcacccucuugggaccucaguuuccucaugugcaaaaugaaggaaaaacuugaaauguuuccccacuuggaugcccccuacuggcuggagucagacugucugcgcucaaaucccagcucuaccucuugcaagcucccugaccugaaacuagucacagccucucaagguucaguugagcaugcauaaucgaagacuaauaauagguccugcuccaaaguugaguauuuauugaacuaagaauacggagugcucagaaaagggccuggcacaagguaagucguauacaaggguuacagaugcuaagauuacaacuuuucuuuccugucacuugcuggaugugagacuucagguaacuuagccucuagggccucaguuuccucaacuguaaaauggagauaguauuuccugcccaaaacugaauuuuaagugagcuuauaacauguaaagcucuuagaagagggcuuggcauauaaggaaagguacagaaaguguuuuaugucuuaaaauuacuuuauguggccgggugcgguagcucacgccaguaaucccagcacuaugggaggccgaggcgggcagaucaccugaggucgggaguucaagaccagccugaccaacauggagaaaccccaucucuacuaaaaauacaaaauuagcuggugugguggugcaugccuguaaucccagcuacucgggaggcugaggcaggagaauugcuugaacccgggaggcgaagguuguggugagccgagaucgugccauugcacucccgccugggcaacaagagcgaaacuccaucucaaaaaaaaaauuaugcaaguuucauauaucuuauacaugugcacuuauacauauauuuuaucuacauuuauuuagaugcauguuagugguauagcuauauuuaauaaguuuguauccuuacauuuuacuaugaauauauuacaaauuuacauuuuaaacaugcauaaauguguauauaauguguauaugugcaaauauguaaauaauuguauauguaauacugauagaucgcagcauccccagggcuccaaauucuucuaacacgcccaccccgccagaggugauuuuucugcacaucgacguucucgcacugggacucagagagucuggguuucagaaacccccaccuugcggagccuacggauucauuccccgcaugcucauuccugcacgcagggccgccaaggcaaugggcgggguaccacagccgagccuugucucccugcagguguucggcuuccugaaccuggugcucugggucggcaaccugugguucguguuuaaggagacaggcugggccgccccguuccugcgcgcgccucccggcgcccccgagaaacaaccggcacccggggacgccuacggcgaugcaggcuacgggcagggccccggcggguacgggccccaggauuccuacgggccucagggcggcuaccagccugacuauggucaaccagccggcagcgguggcaguggcuacgggccucagggcgacuaugggcagcaaggcuacggcccgcagggugcacccaccuccuucuccaaucagauguagucuggugagugaccggcgagcggugcggccaaggaggguacaaggaaggagacgagcgggucagugaaccaauaagagucagggguagagaguacguaaggcguuuacuggggcaaguaaggacugaaguuugaaggagccaaucaagaggcagaacuaccugcuaagagcugaaaaacuagcuaaugaauggagaaaagaagaauggugcuucaagauggacagaaugaagagccaaugggagggagguagaagggcaacucggcggaaaggcagggggagagaagcagagcaaccaauaaagggagggaauaucgggggacuugcgcaguggcgaaucagcggagcgcaagagccacggaagcgacgaggaggugggucuuagaagugacugauaagccaauaggugauaaggccaauagauggugaggguaaaugggcguggaucuugaaggucagacgagcucaccaauccgggaggaggggauagaucugccgccucuccccaacgcuggaggggagggaaguaguguggaauuucaaaggaggaagagggauagggugggguucuggaaagguuugccggccuucuugcugggccuuaaaagagaagugagggucggggcuugguggcucaugccuguaaucucagcacuuugggagaccgaggcgggcgggccgcuugagcccaagaguucgagaccagccugggcaacaugaugaaaucccaccucuacaaaaaauacaaaaauuagccgggcgugguggcaugcaucuguggacccaucuacucaggaggcugaagugggaggaucacuuaagcccaggagguugaggcugccgugagcuaugauccugccacugcacuccagccugggcaacagagcgagaccuugucucaaaaaaaaaaaaaaauggaaagaaagaaaggaagaaaagaaagaaagaaagaaagaaaagaggccaggugagguggcucaugccuguaaucccagcacuuugggagaccaaggugggcagaucaccugaggucaggaguucgagacuagccuggccaacacggugaaaccccgucucuacuaaacauauaaaaauuagccgggcaugguggcgcacgucuguaguuccagcuacucuggaggcugaggcaggagaaucgcuugaaucugggaggcggagguuccagugagucgagauugcgccacugcacuccagccugcgcaacagagcgagacucugucucaaaacaaaaaaaaaaagaaaaagagaagugagauuucccucagauaggagggaggauauaggggaggaaaggcaggaggaaaaggcuaagggguggcuaaaaagugggggaaggcaagaagguggcaauacuuggauggagguagcuucugacacuggguuagccaggauggaaagggcaucccacaucuaauucaucaaaaaauccuguggguccuaccuucaaaaaauauauccuucaucuuccacugucaucucucccagaccucuucucaggucuccauuuccauucuguucuacucacagcaucuggagggauucuguuaaauccuaaauuaggccacaguccuccugugucagaacucugcccugucgcaggcugggcgugguagcucacgccuguaauccuagcacuuuaggaaugcuagacuugaacuccugggcucaggugauccucccaccucagccucccaaguagcugagacuauaagugugagcgaccaugcccagcucacuuuauuuuuuccauuucacuuauuauugucacccuauguuauacgagauaauccacucaugcaucauguucgcugugugaagucuaucucugcuucaguauaagcuccacaaagacagggaucuuuguuuugcucaauauaguuuaucacaaauggcuagaacaguaccuguuaagggacuauuuuuuugguuggaggaaggagacuguaaucucuuugguaccuaacccagugggggcaaggucagguauaucuucucagcagaggcagcugggaugaagcuggcuccaggaaagaagaaaagacauaaagccaggacaaaggcauaacagcccaaccccuaucugagggcgccacccaugucagacccccucuccuuucugugucuuuugucucuacaggucagugaagcccaggaggaccuggggggggcaagagcucaggagaaggccugccccccuucccaccccuauacccuaggucuccaccccucaagccaggagacccugucuuugcuguuuauauauauauauauuauauauaaauaucuauuuaucugucugagcccugcccucacuccacuccccucauccacuaggugcccagucuugagugggcccccucucuuaccccgucccuuucccugcaucccuuggccccucucuguuuacccucccuguccccugagguuaaggggaucuaaaaggaggacagggagggaacagaccucggcuguguggggagggugggcgugacuucagacucucuccucucucucccuccacuccucccaacucuggccuugguuccuccagcaaugccugccugaacaaaggccguuagggaaauccaacuccaggguuaaagaaaggcagagauugggggggcuugggguagagaggacaguuuaggacccaagguggucuuggagaggagguguggaguggaggggucagcagggggguuggguuccagacagaguggaucuggagucugaaggagaggagugcgcuagagcauucugggguggggcuuggaagggcgcugagggcaggguucuagaaggggcgaggcuuuaagcgaggcagaauggugggcuccagaguaggugggucuuggauugguaccagagccuauggaaaggguguggcuuggaacauuugggagacugagcuugauucuaaaggggacagaucuugagcaaggcaagaagugggauucaggaaugggccaagccaggguuccagacaggguggggcuuagaauggggcuuccauggugguuucagaaagggcagccccuccccauggugcagugaagaaaauguuuuacaauggcuggguuugggcaguggagaggggacuuggauaggagcuuccagauggguuuuguuaggggugggggagaauggcucuggcuacgacuugggacggaaguggccugagaagagucgagugauauggcuuguagggugaggcgugggauccagagagaagcaccccaccacacacacccuuccccacucccgugaugaaacagcuagguuaauaggaggacagaaccaacgggucugugggacuggcccaccccucuucccccuuccccugcgcccucccucccuccacaccuccacccguccuggggugguuggaggccuggucuggagccccuauccugcacccucugcuaugucugugaugucaguagugccugugaucguguguugccauuuugucuggcuguggccccuccuucuccccuccagaccccuacccuuucccaaacccuucgguauuguucaaagaaccccccuccccaaggaagaacaaauaugauucuccucucccaaauaaacuccuuaaccaccuagucua

SEQ ID NO: 18899 - RNA, 12580 nt, Homo sapiens
uagacuaggugguuaaggaguuuauuugggagaggagaaucauauuuguucuuccuuggggagggggguucuuugaacaauaccgaaggguuugggaaaggguaggggucuggaggggagaaggaggggccacagccagacaaaauggcaacacacgaucacaggcacuacugacaucacagacauagcagagggugcaggauaggggcuccagaccaggccuccaaccaccccaggacggguggagguguggagggagggagggcgcaggggaagggggaagaggggugggccagucccacagacccguugguucuguccuccuauuaaccuagcuguuucaucacgggaguggggaagggugugugugguggggugcuucucucuggaucccacgccucacccuacaagccauaucacucgacucuucucaggccacuuccgucccaagucguagccagagccauucucccccaccccuaacaaaacccaucuggaagcuccuauccaaguccccucuccacugcccaaacccagccauuguaaaacauuuucuucacugcaccauggggaggggcugcccuuucugaaaccaccauggaagccccauucuaagccccacccugucuggaacccuggcuuggcccauuccugaaucccacuucuugccuugcucaagaucuguccccuuuagaaucaagcucagucucccaaauguuccaagccacacccuuuccauaggcucugguaccaauccaagacccaccuacucuggagcccaccauucugccucgcuuaaagccucgccccuucuagaacccugcccucagcgcccuuccaagccccaccccagaaugcucuagcgcacuccucuccuucagacuccagauccacucugucuggaacccaaccccccugcugaccccuccacuccacaccuccucuccaagaccaccuuggguccuaaacuguccucucuaccccaagcccccccaaucucugccuuucuuuaacccuggaguuggauuucccuaacggccuuuguucaggcaggcauugcuggaggaaccaaggccagaguugggaggaguggagggagagagaggagagagucugaagucacgcccacccuccccacacagccgaggucuguucccucccuguccuccuuuuagauccccuuaaccucaggggacagggaggguaaacagagaggggccaagggaugcagggaaagggacgggguaagagagggggcccacucaagacugggcaccuaguggaugaggggaguggagugagggcagggcucagacagauaaauagauauuuauauauaauauauauauauauaaacagcaaagacagggucuccuggcuugagggguggagaccuaggguauaggggugggaaggggggcaggccuucuccugagcucuugccccccccagguccuccugggcuucacugaccuguagagacaaaagacacagaaaggagagggggucugacauggguggcgcccucagauagggguugggcuguuaugccuuuguccuggcuuuaugucuuuucuucuuuccuggagccagcuucaucccagcugccucugcugagaagauauaccugaccuugcccccacuggguuagguaccaaagagauuacagucuccuuccuccaaccaaaaaaauagucccuuaacagguacuguucuagccauuugugauaaacuauauugagcaaaacaaagaucccugucuuuguggagcuuauacugaagcagagauagacuucacacagcgaacaugaugcaugaguggauuaucucguauaacauagggugacaauaauaagugaaauggaaaaaauaaagugagcugggcauggucgcucacacuuauagucucagcuacuugggaggcugaggugggaggaucaccugagcccaggaguucaagucuagcauuccuaaagugcuaggauuacaggcgugagcuaccacgcccagccugcgacagggcagaguucugacacaggaggacuguggccuaauuuaggauuuaacagaaucccuccagaugcugugaguagaacagaauggaaauggagaccugagaagaggucugggagagaugacaguggaagaugaaggauauauuuuuugaagguaggacccacaggauuuuuugaugaauuagaugugggaugcccuuuccauccuggcuaacccagugucagaagcuaccuccauccaaguauugccaccuucuugccuucccccacuuuuuagccaccccuuagccuuuuccuccugccuuuccuccccuauauccucccuccuaucugagggaaaucucacuucucuuuuucuuuuuuuuuuuguuuugagacagagucucgcucuguugcgcaggcuggagugcaguggcgcaaucucgacucacuggaaccuccgccucccagauucaagcgauucuccugccucagccuccagaguagcuggaacuacagacgugcgccaccaugcccggcuaauuuuuauauguuuaguagagacgggguuucaccguguuggccaggcuagucucgaacuccugaccucaggugaucugcccaccuuggucucccaaagugcugggauuacaggcaugagccaccucaccuggccucuuuucuuucuuucuuucuuucuuuucuuccuuucuuucuuuccauuuuuuuuuuuuuuugagacaaggucucgcucuguugcccaggcuggagugcaguggcaggaucauagcucacggcagccucaaccuccugggcuuaagugauccucccacuucagccuccugaguagauggguccacagaugcaugccaccacgcccggcuaauuuuuguauuuuuuguagaggugggauuucaucauguugcccaggcuggucucgaacucuugggcucaagcggcccgcccgccucggucucccaaagugcugagauuacaggcaugagccaccaagccccgacccucacuucucuuuuaaggcccagcaagaaggccggcaaaccuuuccagaaccccacccuaucccucuuccuccuuugaaauuccacacuacuucccuccccuccagcguuggggagaggcggcagaucuauccccuccucccggauuggugagcucgucugaccuucaagauccacgcccauuuacccucaccaucuauuggccuuaucaccuauuggcuuaucagucacuucuaagacccaccuccucgucgcuuccguggcucuugcgcuccgcugauucgccacugcgcaagucccccgauauucccucccuuuauugguugcucugcuucucucccccugccuuuccgccgaguugcccuucuaccucccucccauuggcucuucauucuguccaucuugaagcaccauucuucuuuucuccauucauuagcuaguuuuucagcucuuagcagguaguucugccucuugauuggcuccuucaaacuucaguccuuacuugccccaguaaacgccuuacguacucucuaccccugacucuuauugguucacugacccgcucgucuccuuccuuguacccuccuuggccgcaccgcucgccggucacucaccagacuacaucugauuggagaaggaggugggugcacccugcgggccguagccuugcugcccauagucgcccugaggcccguagccacugccaccgcugccggcugguugaccauagucaggcugguagccgcccugaggcccguaggaauccuggggcccguacccgccggggcccugcccguagccugcaucgccguaggcguccccgggugccgguuguuucucgggggcgccgggaggcgcgcgcaggaacggggcggcccagccugucuccuuaaacacgaaccacagguugccgacccagagcaccagguucaggaagccgaacaccugcagggagacaaggcucggcugugguaccccgcccauugccuuggcggcccugcgugcaggaaugagcaugcggggaaugaauccguaggcuccgcaagguggggguuucugaaacccagacucucugagucccagugcgagaacgucgaugugcagaaaaaucaccucuggcggggugggcguguuagaagaauuuggagcccuggggaugcugcgaucuaucaguauuacauauacaauuauuuacauauuugcacauauacacauuauauacacauuuaugcauguuuaaaauguaaauuuguaauauauucauaguaaaauguaaggauacaaacuuauuaaauauagcuauaccacuaacaugcaucuaaauaaauguagauaaaauauauguauaagugcacauguauaagauauaugaaacuugcauaauuuuuuuuuugagauggaguuucgcucuuguugcccaggcgggagugcaauggcacgaucucggcucaccacaaccuucgccucccggguucaagcaauucuccugccucagccucccgaguagcugggauuacaggcaugcaccaccacaccagcuaauuuuguauuuuuaguagagaugggguuucuccauguuggucaggcuggucuugaacucccgaccucaggugaucugcccgccucggccucccauagugcugggauuacuggcgugagcuaccgcacccggccacauaaaguaauuuuaagacauaaaacacuuucuguaccuuuccuuauaugccaagcccucuucuaagagcuuuacauguuauaagcucacuuaaaauucaguuuugggcaggaaauacuaucuccauuuuacaguugaggaaacugaggcccuagaggcuaaguuaccugaagucucacauccagcaagugacaggaaagaaaaguuguaaucuuagcaucuguaacccuuguauacgacuuaccuugugccaggcccuuuucugagcacuccguauucuuaguucaauaaauacucaacuuuggagcaggaccuauuauuagucuucgauuaugcaugcucaacugaaccuugagaggcugugacuaguuucaggucagggagcuugcaagagguagagcugggauuugagcgcagacagucugacuccagccaguagggggcauccaaguggggaaacauuucaaguuuuuccuucauuuugcacaugaggaaacugaggucccaagagggugcugaguugcuuauuuuacaugucuaggcugggucugggauccaggucucccaaaccugucauguucccccuuuggggacagucuguggugucacagugguuacaauugcuagcucauccuucaacguuguuguuggcacgcguucuucagggacaccccuuggaucuccccugacucuccucuuauucucccacuccaccacuccccaugccggacuguacuguuuuccacucucccuccuccagccagcacccagggcuuaccaccgagguguugagucccgaggucacagggucucucagcuccuugcauguguucccugucuggcggcagacaggcaucuccuugauaauguucucugggucuguggccaucuucacaucugacagccccuuggcccaugccgaugagcuaacuagccacaugaaggcgaacacagccguggccagaaaguccuaaggcaggcaggggugaggaagacagcacugugaguggacugcuucacgcuaggcccuggggccuccucggaucacaggucccccagaagaggccugucucuccccugccuuuucagcucucaagcccacaacacuuucaccugaagguggcccucccagcuugagcuuguguguguacaugacacagaggaugugggagugugauugugauauguggcuguggguguuggggggaggggaacucugggaugauuuccgaaucuguggaaaguaaugugucuuucuacuuuugucugcaugugggaauuuuugucauuuugugucuaggcugaggguaugugaguacagugguguaggaaucagugugucuguguggcaugaugacaggcaugacugucacagcgaaccucugugggccucuuccuuugaucuaggcuguguaguugugugagagugggaagguucucaggugugggccugucugggauucugcauaggcuguaugucuccgugacucuaugacucugugucccggaugccugguguggauuaauagcagcagcaacuauauguguggcuguuaugguggcuguuugcaugugggccugucugggauuugguguggucugugagcauggcugugucccugggguuccguguccccauggucccuacaugcaaguggcuguggggacucaccagcaugggcccuuuguuauucucucgguacuuguucugcaggaagauguagguggccagagcccccauggaguagaggaaggcaaacacggccacggugacaaagaauucggcugacgaggaguaguccccaacuaagaagaccuugguggugcccccucggcaggugggugcaucaaaguacacuuggugcagccugcaaacagaggugggcagguguggcccagccccucagaacacccucaacccuccagcccaaucauggguccccccauuucugacaaggccccaggaagaggaggaaauaaccauucaucgagcaccuacuauguaccagucacauuucacugauugcucaaaacauccuggugagauagguguuauucaucccucacuccaacccaagcacucuggccucuugauuauuucuagaacuugccaggcauccucccucccuaggaucuuuguuuguacuggcuguucccuuugccaggaaugcuuuuccccuagauagcuucgggucuuacucccucaucuccuuuuuuuuuuuuuuuuuuuuuuuuugagauggagucuugcucugucaccaggcuggagugcgguggcacaaucccggcucacugcaaccucugccucccggguucaagcgauucuccugccucagccuccugaguagcugggauuacaggcaugcgccgcuacgcccagcuaauuuuuguacuuuuaauagagacgggguuucaccauguuggccaggauagucuugaucucuugaccuugugaucugcccgccuuggccucccagagugcugggauuacaggcgugagccacugcgcccggccucccucaucuccuugaagcuuugcucaacugucaccuucucauugagaccuucccugaucucccuacuuaaaauuaaauugaaacauucucucaaccagcacuucuuagccuggcuuccuugcuccacuuuucucgauaguagugguacccaucugacguaccagguauuuuuuuuuuuuuuaaucuugguuuuugcuguaacuacaagagggcagggcuuuuuccuguguuuucaccuccguuuaucuccaggcccuggaacagugcuggcaccuagcagacacucaagaaauguuuaucaaaugaaauguacagaggcggaaacagaggcucagggaagugcauuaacuugccuaaagucacacagcuggcaagggaaugucagaguugagaucugaaccuuguuuucucccuaucucauguugacuuuucucccccaccccaguucagguccccgagagaaaaaaauguaugcauagcagaggagaggccagcgacuagauaacaggaaaagacagacagaaagaaaggaggguaaagggaucuuggaacaggguguguguaugugagggaagaggggagguguccugggacuaaggccuuuccuguggugugauggaggagagguggggguuguagagagaaaaugucugugggagaaguucuggagcacagucucagauuggaggccaggauccugagacugagcaaauggugccaaugccuuuguguagcaaaggcccugagggaagaggcuugcacuuauuagucaccuacuaagcaguuuacauaaaugucucauuaaugacagccuccagcaauucucuaaagaaggcauuauuagacccuuuuuacagaugaauaaacagaggcuuagcaagguuauuacuugcccaagguuguacagcuccuaaaugauggagcuaggaguugcaucuggguuugaguuucuguuucuagugggcugggucaggagagggggucccuaagagggaaugagagguccuuggguauuagggcaguuugggagggauuuugcucagggggacccagggccaagacuguuuuucuaggggacuugugggcuagagccuuaggacccaaaguucuagacaugggaggcguggggagggggcacaggggaugguuguggucuuguggauccccaaaggacuggcucuaagcagugucccuugcugccagcucccccuccuuccccagacucuuuucucccuugccuuuguggacccauggauaccuggcugccccucugccucucaggccacacuuucccggcaucuccucucuuuuccaucauugcucagggccugugcuagguuuucuucuacuuucacucuuccaucuccccacugggugaucacuugagccuacauuuacccucaguacucgaagacccccaguuuccaacucaaccccuguccucuuuccugagucccuuaaauuuauuuuacuuauugaacagacacugauggagcacuuauugugugccaggcacugugcuaagcaccugaugaauauuaacucauugaaugcuaaccacgacccugugagguagauauuauuaguauuccuuuuuacagaugaggaaauugagacccagagugguuaugugauuuggccaaauagugggggagucucagaaaccugugcggggauugugucugugggucucugucaucccacccugcaggagguaaacaucauugugaggguagugcccaugccagccgugcucauucuugugcaccuagcacccaguguauugcccggcacacagugugagcucaauaaaugucagaauuguuuaauuggguuuaauuuuucccuauaucuaagcagcaccccucauuauucuauucucuaccauaaaacccuacaugaggaucuccucgaguuucucucagucugcuauuauccucuuuguuaauuuauuuguuauaauguaggcuccaugaagguagggaguugggucugguuuuuuuuuuuuuggagauggaguuucgcucuuguugcccaggcuggagugcaauggcgcgauuucggcucccagguucaagugauucuccugcuucagccuccugaguagccgggauuacaggcaugcaugaccacgccuggcuaauuuuguauuuuuaguagagacgggguuucuccauguuggucaggcuggucucgaacuccugaccucaggugauccgcccaccucggccucucaaagugcugggauuacaggcgugagccacugugccuggcgggaguugggucuguuuuaguuacuaucaugcuuccagcacuuugaguaguaccagauauaaaauaaguucucaaaaauguguauagaaugaaugaauggggauuaaauaauaauauuggcuaacauuaauuggguaccuacuggguuaagguauguauauacaccugucuuacuuuuguaucuuguuuauugccugucccuuaccccuucgcuggaacagagccagagggccacagccuaugucugccuugcucaccacauaguccuagaguccagagcagugccagguacaaggcaggugcucagugaucccaguggauguagccucgaggugggagcugggcaggagcuacuugcggggggagguauuggccgguuccacccugccccuuccucucccaggucuguugguaucccagggugggagcacaccugaagggguacucgaacucgaccucgaugcugaggucacucucggucuuguuggcacaauccacgcucagcuggagcuccccacuguagcugccgcauguggcaaaggcgaagauggcgaagaccuugggcagcagggauggggauggccacagugaaccugugugcaugugggagggaggugcccuccucuggacagaucgggggcccagcacaggcagcagcagauggagcaguccccacccccacccccuaaucagggcucaucgggaccaaggacaagcugauuacaaggguauggcugucucuuccuguuucucucucugugucucucucugucucugccuuuccaugcugaccucccucuucucuguuugucucuguuguucucuguguaucucacugugucucuguuucucucgguaucucuguuucucuaugugucuuugucuuucucagaugucucuuugucucucugugucucugauccucucugccucugccuaucugaucugucgaugucucuuuuugucucuuuuuucucugucuguguaaguguaugccuguaugucugugucuuucuguuucuuggucuguuugucucugucucucuguccugucucucacucggucuccggaugguucucucucugucucccucuugccucuguguguugguuucucuuuuuucugagugucucuuucucucugugucucucucucccucacccuguuuuccugccucucucccugcgucuguuucucuuugcaucuguuuucugugucuccuuuuucuuuguuucuguuugucucuucucucuuaugucuguaucucuucucaucuccauauuucuuuuuuuuuucucaguauuuccaucucugucuuuaucauucccugucccucauucucucugucaccuucacugucucuggguuucucugacuuugcaucucucacccagcaucugcuacaggcuccaccucccccaccccucccucacuucaagagaggagguaggacgucacagucucccacuucacaacggggguacccucagcccuaugugacgucacagcucaucuguuuucuggcuucagaccccugaaaccucacccuggagcccaauucccccauccccuacaacccccgcacucaucccuggcuacucgccccuacuccaccccugcucuucuggaccccaugaccucccucucucccugcacucugccccaacagcccggaccacacucacccauugcagcaccuucacaaagccgaggggcuccuugaccacccggaacugacccccagccaccagcugaggagagaaacaguggggaaggggugggguuguuggagguacagggaggugagcggcaaggcugcccaucaaugaccccaggggauggagcaugugaccucggggagagggugagaaggagaaagugacaccuuggggauggugugagccccaggguccaaggacuggugggaaggucugaagagauggugagucagauggcagaggaagucgggggugagggagauggggaugaggucaggacuaguuaaggagggggagcagguuugaaacguaaaggcgagucggauggggaagggguucggguagagaauggggauggaguggggugcauucggguggggggguugugauggugaaggugagucauaacggggcaggagucgguuuggcucaggugggggaagggucugcagggguaaagguguguuagacggcgguggcgguagauauuugaggugauggggauggggaaggguugggacugauugggggugaguuucugagguggcaaagacgagagacauggcggagagggucuggacugauuaaggugggggagggcugggacacggcuucagucgcuauguguugggggugaggaggcuggggguuuuggaaggaguaaaaccggauuguccccuaggugugcucugggggaagggguggucgccuauggggguacagucucuguuugggaggggcgggugccagcccucucccccauccccgcccccacaccuucugucgcucuauuuccuagcuuauccgcagcaccccccaucuuccuuccacucuccccuccccuugucccuugcccucacuccagcccccaggccccuauuccuccccucgcggucgccaguaauaaacggggcuccgggggcccccgcugcggcagugaggacggcccucgcugcggcaaagagcgcacuccuuuucuccaccucccccuuccuccccuucaccugccgcagacccccauccccagcgccggggaccgggucuccgcugccagacccuggccaccaccucccagagucggcuggccugagcgacccggccuaggcagccgggcggcggcgggcucuguccacggugcuggagcgcguaccugauucaccacguccauguccgccagcagcagcaucagcaaugcagggggcgggaggcucggcuagcaagggcggcgcggggcgcggcgggggcggcgcgcgcucguuggaacagcccaggcggcugcagccccgccccucgcgcccccuccuugcccgccacgcgccugcgcacagcggguuguaccacagucucaccggcagccauuccggcccggaggcuggagccgug

SEQ ID NO: 18900 - RNA, 12890 nt, Homo sapiens
cuaccaucugcaagaacuuugucccaaauguaguagaaauuggggccgggcgcaguggcucaugccuguauucccagcacuuugggaggcugaggccgaggcaggcagaucacuugaggucaggaguucaagaccagccuggccaacauggcgaaaccccaucuccacuaaaaauacaaaaaucagccgggcaugguggugggcgccuauagucccagcuacucaggaggcugaggcaggagaaucacuugaacccagaagacaaagguugcagugagccaagaucaugccacucacuccagccccagugacagaugggugacagagugauacugugucucaaaaaaaaaaaaaguaugacuugaauugugcccccuacggguagggccacaguguggccucccuguguugagagguauaggaggagggagagugggguaggaugcacucucuuggccuuucccuggcuuaccaacccggugcuugagucccauccugcguggggcaggugcuggaggugguggauacaagaagauaagagacugaguaaccugaccagcuaaucuaaacccccucacuccuauccugucccccagguacugggccuaaucgcuacgugccucuuuggcuaugaugccuaugucaccuuccccguucggcagccaagacauacagcagcccccacugguaaguguguguguguguguugguuggggguaaggggguugcugagagggcagagggaaaaaggaaagggaucucuuaaaggcacgaaugccaacucuggucucguauugguacuuagggcuuuuguaccaauagguaccauaagcuucgguauucuuguguguaaaauguucauggacuuuggaucuuguuuuaaaaaaugggcauauagauucagccaaugcuuucucucuuuuccucaccugcagaccccgcagauggcccgguguaggcgaacuucccucauuucucucugcaaucugcaaauaacuccuccauugaaauaacuccuccccaccccaacaacaacauucccagcagaccaacucccacccccucuuugagguaaaagugccuuuauugggagacuuuugucuuccagccugccaaucaacccuccuggguguggccaccauaugugugugccuagguccuccuucugcacgauccaauaggagacaccaguucugacugaaccaugcccccaccuaagucacaaaaugagggaaguggggaguuagauuucagaguccaggcccuagguugggacccacuccaaauaaucuccucgguguggguggugguucuauagagggauaaaugaauaauaaacauuguuaaaauauacgauaaugaauaaaguaauccuuucaucaaauguggguaaauuucaagcaucaggagggggaaauggaguggaaacagcuggggcaaggaggcaaagaagccaggccuguuuuacaacaaauauuaaauuacuucaauaauacaaacgagaggcccggugcgguggcucaugccuguaaucccaguccuuugggaggcugcgggaggauugcuugagcccaggaguucuagaccagccugggcaacauggcaaaaccccaucucuaccaaaaaauuaaaaaauuagcugggaacgcugacacgagccuggagucccagcuacuugggaggcugaggugggaggauagcuugagcccaaaacuuuugaggcugcagugagcccugaucacaccacugcacuccagccugggcaauaggguagaccaagucucuaaaacagaaacaaaaauagaaacaaacugauaaaggagggaggaagaggauuuaugacuuagguuguaggggcggggcgugggggugaggggcaugggccucaucaucuacucugacuggagaauggagcccccuccaggacggccugccuucaagccacgaugcaguucuugucucgggccugacgaggcaucccugcgcgagagucccuggggagcgauaaagauggggaguugaaggucuccauugcaguguccugagcaggcaugggccugcacaaaugcgggggcagagggaugcgcucuccuaggaagaagccaucauccucugaugauucggaacuggaacuggagggcgagcuggagcaagauuccgagucugacccugaucccgcgucacauugauaguggcgacgucugcuuggguggcgguugugauggugauggugauuaugaugaugguggcggcgacggcugggggcccugggugggggacugcguggccugcggcgcugggccgggggugcacucaggguccggcgcgggccuccuucagacaccagagggucgcggaagcugacgcguggggugcucugacgaccgaaggcacuaucaucugggcgcagguuaggcuggccgggggacucugggggcggcucggggacacugcggagccccaguuccggcauggaguggcgguggggagccccucucagaaagcgggagggcuccucagggccuguagcuguuaagggggagacagagugacuccuuguaucugcccucccacuggcccccuccuaagaggaggccugcggaagggccuucuuuccuccacuaagacugggaaagugggggcaggggucggagaauggcagggaggugggaagucugggaagugugaggccuggagcaggcucuggguguugagaggguuggaaggaagaacacggagcaagaugggacugguguggggggcguggccagggcacccgggguggcuucggauggaagagguguggcauaggcuggaguagauuugguuugcaauaaaagggguggggccugacugcagaggaugaagggugaccggcuggagaagaggaagaggaacuuggggucaagcagagacaaguugagguaggggaccagcccuguauugacaggguggaaccaggguucaugaggcggguguaguuugggauggaaaccaggccuggacugguguggggaaggaggaugagcugagaaaugggcggggcccagggauacagcaggugaagggccugggcuagucaagaaggaagggccagggcugaggcaggggcaaggacauaggggugacugggcuguggcuggguguggcuagaggguuagcucaccuggcgcuaacucugugcuggugccuuuggugguggucucugaugcccccuucacagcagagaaagaggcuguggaggcugcaaguggggcugugacagggccggcacuccagcugcggcggcucggcccuggagcugugggcucggacccaaggcugcaggcucgagagcagaagauuaggccucggcguggcaggaaugggcggcccagcagggcccgcccacagcgacuacagcagaagcagcggucugaggcaugccagugcuggcccucguaagccaucuggccuugguccaggccuguggggaacgacgagggggaaaaacugaggcagaacccccaggcguaaccccaccccucgugaacgagucccuucucaagaagagguggggaauccgaggcagggcaccccugggugccuuccucccuccuccagaauggggcccuuuuggagaaagcaggaaacagguuuugguucucuccuggagacuggcuggugaaccucucucucacuccucccuuucuuucccagggugcucucucccagagcggggugggcauuggacucuaagauucgggccaggcuuagacauuaggggguggcuccaaguggaaggagaauggaaagcugggccugaagaggaggccuggcuggugggggcagggcuuagcagguggggaguggcccuguugagaaaggagugguucucagaggauaggguguagcuagaagcuaggccugacuuaggcugauacaggagaguggaggagaacggggcacagcuuggggugguaaaggcuaggaguagggcgagcccuggggcuggaauuagagcacccucuggagguggguguagacauguggugguggccuagcauuguguuaggugggguuuagaaagcauggcauaguggggacauugggagugggacuugcaaccaagcguacaggucuauaguguuggggcuggacaaaguacagggcacaauggaggauggggccuggaggacaggaggaguccuggugggguaggacuguggcccagcuguccauccaucccucuguccagucccacagcauucacccaccgaugugcuccccacagccaucacaguacuccgcguggcgggccucguagcaggcgcagcagugggggcggcucugacgcaugacauagcgcugcccuccuagugaagcuucacacucaaagcagcagaagugauccaugugccaguggcggcccucagccuccgugcacucaggggagaagaugaucuggagggcgcaggccaucuguggcugucagaugagccugcuccuggcccugcccacccucaacucccaccccugggcagggaggcccaaaccucgucacaggcuuggcagcguggacgcaggcauucggcauggugacgcccgcaguagaccuugccaacaugguagaaguagaugaggucaaccagcaguuccuggcacgugguacacacgaagcacugugggugccagcaggcacccaggccugcacggcuggcaaacacugcgauguccccaccuccaaucugcuuuccgcacugccaugagacaagcaccaagaugguuaccaucacugucaccaagauggucagauggauggggucagccaaaguauguuacacuugggccuuucccacagugaaacuuugugaucagccccacccaugggguaacuuugacacaggcccugccuauaccagggaugggguugggcgguaccuuagagacugacccugcucaugagggaagccguagagacaggcccuacccaugguggguggccuuauaggcaagccucccucaucagggguggggaagacagacaggccaggccuagugggggaaaccacagagauagucuccacccaccgggaccuuagcaauagaucucaccuaacaguaggaucuaaggacaggcccugcuuaccacugggcccugcagacaggcccugccacugugggucagcucuugaggacaaguucugaccacaggaggaccaaagagauagcccaugccccauguccacugcacagacggggagaaaaacacacuaaggccuccuuacagacaaaccccacacgacagugggauugaugggacaggucccuguccaccagggguugccuuagagacagucccugcccaacagugagaugugaggaacagaccccgcccacaagaggggacccuagagacaccucacuggggcuuaaguggcaggccucaucuucccagugcuuggaagauguguccugcuccccagggcuuggagcagaggcacugcucacucgcugaggcccuccacggcucaccuccucacagauggccccagugauggucaccgggaagaugcgcacgaugccacgccccagauucucccgcuuccgcugcuggcuaaaggcucggagcucuuucuuuuccuccucuuccagugcugugcaguacugugccugggaggagaaggcaucucccaggcuccucccuugaugccugucccugccccucuuccagacuucauccaugccccgcaaguuuacuucuaggucuuucuauagauggugccuccugccugaaguaaccaccucuucuuccaaggcccagcugugguuuugccaaggaauguccccugaugaccccugccugucuggaccacucaccucagaucagcucaccuuuccuccucugacccugcccugcauuggcccaggcugugugcugugccuggcaugcccuuccugucuucucucuccucaccucacugucgugugggggcagcuggugcagcagcugcuugauccuguauuucuccccaggacuguugacguaggggaccuuguccucugggaggcagcugaaaaauugauauaccugggaggacauaggagugggagaaaacaacugaaaugagaggugaguugggaugcagugagauggcggguccccauuucucagaaaaugaaaggcauuaggagggaccuucugacucccucaucucuccuuccuaaaggcggaucauuucccucagcucccagcucccaaacacgcugaggguuccugcauguauugaccucacuuccuccuccagcugcugaucaccuuuuuuuuuuuuuuuuuuuuuuugagacggaaucuuucucuguugcccaagcuggaguggcgcgaucuaggcucacugcaaccuccgccuccuggguucaagcgauucuccugccucagccuccugaguagcugggauuacaggcauaccacuaugcccagcuaauuuuuuauuuuuaguagagacaggguuucaccauguuggccaggcuggucucgaacuccugaccucaagugauccgccugccuuggucucccaaagugcugggauuacaggugugagccaccgcgcccagucuacugauccacuuuucuuuuucccuuuacaggaaaauuccucaaaaaguuaugagcacuuguguucacuccacuuccuguccuuccaaucucucuugagccuacuugaggcaggcuuccgcucccaucccucuuccaaagcugucaaggucaucgaugacuuccccauuguuaaaaucauuguucaggucucagucgucaucagacuugaugaugguagcacugcaccgagcugaccacucucucuuccuggaaacacuuucuucccuuggcuuccaggacaccacacaguccagguuuuccuuccaccuuauuggcugcuccuucuuugucccuguuuuggcuccuccucaacuagcugaccccuaaaugcaggaggauccuaggacucagcucuugguccucuugccucugucuacauucaauuucuugggaauuacauucaaccuuauggcuguaaauaucaucuacuuggcuggcuaaugugucaccuccagccugugacacauaaugacaaacacauacguccagcucuguaacuuaucccuugaguuccaggcaauguggcuauuuagaugucuaacaggcaucucaaacuccagauggccacaaccaaacuuaugcucuuaccccucaaacugcuccugucuuggccucucccacaucaguuaaucuaccuauccucagggucaucuuucacuccucuuucucccacccccacaagcaaauccucugagugcuacuuccaaaauauaggcugggugcuguggaucacaccuguaaucccagcacuuuaggaggcccagaggggaagauagcuugagcccaggaguccaagaccacccugggcaacauggcaaaaccccaucucuacaaaaaauacaaaaaucauccaggcgugaugaugcgugccuguagucccagcuacuugggaggcugaggugggaggaucacuugagcucaggaaguugaggcugcagugagcugugauugagccacugcacucaaaccugggagacagagugagacccccccccauauauauauauguguguguguauauauauauauauauauacacguauaauuauuauacguauauuauuuacguaaauuauauacguaaaauaauuauuuuauauauauguauauagauguauacauauguguauauauauguguauauauacguauauauguguauauauauacguauauguguauauauauacacguauauguacguguauauauauacguauauauauauacguauauguacguguauauauauacguauauauauacgcguauauauauacguauauauacgcguguauauauauacguauauauauacgcguguauauauauacguauauauauacguguauauauauauacacacacauauauauauauauuaaauaauuauuuauuaaacggaauuuugcucuuguugcccaggcugcagugcaauggcaugaucugggcucaccgaaaccuccgccucccggguucaagcgcuucuccugcuucagccuuccaaguagcugggauuacaggcaugugccaccacgccuggcuaauuuuuuuguauuuuuaauagagacgggguuucuccauguuggucaggcuggucucaaacucccgaccucaggcgaucugccugccuaggcuucccaaaguggugggauuacaggcgugaaccacugcacccagccuauuuuuuuuuuuuuugagacagggucuugcucugucgcccaggcuggagugcaguggugcaaucucagcucacugcaaccucugccuccuggguucaaggaauucuuguggcucagccucccgaguagcugggauuacagacauuugccaccaugccagacuaauuuuuguauuuuuaguagagaugggguuucacuauguuggccaggcuggucucaaacuccugaccucaagugauccacucgccucggccucccaaagugcugggauuacaggugugagccaccaugccggccuuucugucugucugucugucucucucuccauauauauauaacuccuugcacugccagugccaucaucaucagguuccucacuggucuccugauuccacccuuauuccuccaggcugucuucugcugacaacccucuugcgacuucccuucauucacaggcaaagccaaaguccucuccauagccccugccacaucucugaccucaucuccagcuggucucccccuugcucacucugcgccagcagcacuggccuugccaucccuuacauaugccaagcacacgccugccucagggccuuggcauuagccaugcccuuugccugugugaaucgcuguaaccuuagaugucugcauggcucacuucucaccuccuuucgggcagcucaaccauuaaauucucacagaggcuuauucugggcacccuauuuacaauucuagcaucucucuccuucccucucucuuucuucaccccaccuuccuugcuuuuuaauuccauagcccuuacaccaucugacauauauuuacagguuugcuuauuggguguuccuccuuuccagaaucuacccucugccugggcagauuuuuuuuuuuuuuuuuugagaaguaucacucuguugcccaggcuggagugcaguggcacgaucucagcucacugcaaccuccgcuuccuggguucaaacaauucuccugccucagccuccugaguagcuaggauuacaggugugcaccaccacaccuggcuaauuuuuguacuuuuaguagagacgggguuuugccauguuggccagguuggucucaaacuccugaccucaaguaauccgcccgccucagccucccgaagugcugggauuacaggcgugagccaccgugcccgugggcagauauguuauuuuguguuuugcucauugcuguguccucagugccuagaacagugucucacaugcaguaggugccccauaacuauguguugaaugagucaaucaaugaagucauguggugaaugaagugcugggaggguagaauagggaguggggccacgcaugguggcuugcucuuguaaucccagcacuuugggaggccgaggcaggaucacuugagcccaggaguucaacaucagccugggcaacauagggagacccugucucuacaaaaaaauuuuaaaaauagccaggcaggguggcaugcaccugcagucccagcuacaagggaggcuguggugggcaacagagugagacccugucucaaaaacaaucaaucaaaaauaauaggauuggggugaacaggcccugaggaacuggucccucagucacccaagguauggggggcugaccacucuuccaucacagaggggccagaaggacccucggucugacugcacacucuagcguagccccagaaauagguucccaccugagugugugugugugugugagcauuagugugcacccacuggacagcaagaguggagggcuggccucuggucaccugcuccggcuuaaggccugggggcacccaggcauacuccuccgaugcacagccugagucgucgucggagauggaguggcgcuggaaguccgagauuagccgacacaugaugcguuccagguccacaggcaccgcgugcacugcaugcuccucccgcgggcauuugcaaugcuggcagaucuuucugagggggccgggaugggggucaauuacuaaggaguugcccacccgaaccccucggcagcccagguccaauggaggagcggggacauacagauuaucaccaccaaaggucugugagcagggacagggaucugggccugggggcggggcugcaggaggugggccuaugagccaggguguggcugggcugugagccagaggacaggucguggggagugggaugcuuugugggggaacuuucacuagacacaggcaucuaaccuguggugaggcucugaacuugugggcucugagccuguggguagggccugagucugggggcuguaggcucuguuuauugggugcagggcuccagcaggaggauaggacgcugggccugggagaguaggucugagucuaagaggggugcuggaggccagagggcggcgcucaaaguuagagacgaagaaucucccuagggaugcgacuccgcggcuacgggagaacacuucugggggcggggcugcguaguggguggagcucuccugggaaaggacuuuggggaaugagucagggggcggggcucugaaucugagccugaggcucuuuucccaacugagaucccucuguaggcggagcucaagcguaggggcguggcguaaggcuccuggauuuccccccgaaggcggagcucugacaaaggcgaggcccuuuaggggcgccacuuaccuccagccguggagcaggaagccagggcacugcucccuacaggaguugcagggcuggccccggucuggguccucugccucuggaggcugcagugggcgggggcagaugcagggccgggugaggcgcggaagcagggaaggagaagucaacgcccgccccuccacuucauugcccgcgaccgcacgcuggggccugucuuaccugggcagcgcugggcaggcugggacagcgcccagagugcgggggagcgggacacaaccgaggcagaggcggggcaguuggagccaccuccuuauauguccccuuuucagggaauuccccuuccuaggcuggccucggaccccccuccccguccgccccuagccucagacaccucccaccagccuuagauccuuccagggcucaagcaccuccccuauaauucauuguacucuccccacuagagcacagaaccccuacucugggcauccucuccccggccucaucccgguucccucuccaucuacgccgccagcagcacuccaguuccacaggguaggagacgagaccgcauucuuccuugagauccccacgugaacccugccccucucuucagaagcucaggagcuccuccccuaaacccuggccucaugcccugauacccaaggaacuggggacccuccccaggaucucaggaggccccugcuccauucagaaacccccaucccaagaaaccuuggccuuuacccaucccauccuagggcuauuuauuccuucuccggaccaucaaacccagaccccacauucccaggucagagacccacuccaaaggaagugaaagaaccuccugucuaagaagucaaaaacucccuugcucaggcggaacccuggaagccuuguccccccaaaucccagucucuugacucucagcauuucggcaucccaggaguguaggacuccaucccuccgugcacauuccuccaagguacuguguccuuuagaagcugaggaggucggccaggcucgguggcucacgccuauaaucccagcacuuugggaggccgaggugggcggaucaccugaggucaggaguucgagaccagccuggccaacauggugaaaccuugucucuacuaaaaauacaaaaauuaggcgggcgcgguggcgggcgucuguaaucccagguacaugggaggcugaagcaggagaaucgcuugaacccaggaggcggagguugcagugagcggagauagcgccacugcacuccagccugggugacagagauucagucucaaaaaaaaaaaaaaaaaaaaaaagcagcagcucaggagguuccugcucaaccuaaggcuucaagacccaguucucuggcccucaggauucccucccacaauucauaagagagggguccccaccaggucccaggagugcugaugaaaguguguggagaggugauuaggggguuugggccaccagaucuacaccuuccuccauccauucgccuccagcagccccagccccaggucugggaaugcaggggaugggauucccagauccucuguggggcaccuauucgcuaugccuauccauugcccccuugccugggccucaguuuacccccgacccccaccgcugcccugacucccgcucaccgcacgcccggagcggcgccuccgggacccacgcgcgaacauggcgcgcccgggcagggucaagccgggccgggucaggcgaauguaauccuugcgaccgucaggccaccgcgcguccggccugggaacucgguuccguaaaccugacacccucgugggaggagcgcgccccgcagggcccgcccccgggcauguggucucuccgcugccagggcgcccccugccuagaggugaacugcacguagcccggagugccccgcgggaaag

SEQ ID NO: 18901 - RNA, 4427 nt, Homo sapiens
uuaacagcuacaggcccugaggagcccucccgcuuucugagaggggcuccccaccgccacuccaugccggaacuggggcuccgcaguguccccgagccgcccccagagucccccggccagccuaaccugcgcccagaugauagugccuucggucgucagagcaccccacgcgucagcuuccgcgacccucuggugucugaaggaggcccgcgccggacccugagugcacccccggcccagcgccgcaggccacgcagucccccacccagggcccccagccgucgccgccaccaucaucauaaucaccaucaccaucacaaccgccacccaagcagacgucgccacuaucaaugugacgcgggaucagggucagacucggaaucuugcuccagcucgcccuccaguuccaguuccgaaucaucagaggaugauggcuucuuccuaggagagcgcaucccucugcccccgcauuugugcaggcccaugccugcucaggacacugcaauggagaccuucaacuccccaucuuuaucgcuccccagggacucucgcgcagggaugccucgucaggcccgagacaagaacugcaucguggcuugaaggcaggccguccuggagggggcuccauucuccagucagaguagaugaugaggcccaugccccucacccccacgccccgccccuacaaccuaagucauaaauccucuuccucccuccuuuaucaguuuguuucuauuuuuguuucuguuuuagagacuuggucuacccuauugcccaggcuggagugcaguggugugaucagggcucacugcagccucaaaaguuuugggcucaagcuauccucccaccucagccucccaaguagcugggacuccaggcucgugucagcguucccagcuaauuuuuuaauuuuuugguagagaugggguuuugccauguugcccaggcuggucuagaacuccugggcucaagcaauccucccgcagccucccaaaggacugggauuacaggcaugagccaccgcaccgggccucucguuuguauuauugaaguaauuuaauauuuguuguaaaacaggccuggcuucuuugccuccuugccccagcuguuuccacuccauuucccccuccugaugcuugaaauuuacccacauuugaugaaaggauuacuuuauucauuaucguauauuuuaacaauguuuauuauucauuuaucccucuauagaaccaccacccacaccgaggagauuauuuggagugggucccaaccuagggccuggacucugaaaucuaacuccccacuucccucauuuugugacuuaggugggggcaugguucagucagaacuggugucuccuauuggaucgugcagaaggaggaccuaggcacacacauaugguggccacacccaggaggguugauuggcaggcuggaagacaaaagucucccaauaaaggcacuuuuaccucaaagagggggugggaguuggucugcugggaauguuguuguugggguggggaggaguuauuucaauggaggaguuauuugcagauugcagagagaaaugagggaaguucgccuacaccgggccaucugcggggucugcaggugaggaaaagagagaaagcauuggcugaaucuauaugcccauuuuuuaaaacaagauccaaaguccaugaacauuuuacacacaagaauaccgaagcuuaugguaccuauugguacaaaagcccuaaguaccaauacgagaccagaguuggcauucgugccuuuaagagaucccuuuccuuuuucccucugcccucucagcaacccccuuacccccaaccaacacacacacacacacuuaccagugggggcugcuguaugucuuggcugccgaacggggaaggugacauaggcaucauagccaaagaggcacguagcgauuaggcccaguaccugggggacaggauaggagugaggggguuuagauuagcuggucagguuacucagucucuuaucuucuuguauccaccaccuccagcaccugccccacgcaggaugggacucaagcaccggguugguaagccagggaaaggccaagagagugcauccuaccccacucucccuccuccuauaccucucaacacagggaggccacacuguggcccuacccguagggggcacaauucaagucauacuuuuuuuuuuuuugagacacaguaucacucugucacccaucugucacuggggcuggagugaguggcaugaucuuggcucacugcaaccuuugucuucuggguucaagugauucuccugccucagccuccugaguagcugggacuauaggcgcccaccaccaugcccggcugauuuuuguauuuuuaguggagaugggguuucgccauguuggccaggcuggucuugaacuccugaccucaagugaucugccugccucggccucagccucccaaagugcugggaauacaggcaugagccacugcgcccggccccaauuucuacuacauuugggacaaaguucuugcagaugguagucuagugcguugacaaaggggccgccuguuuguaccucucaccaagguccuugugucugacaagggacuucccuucacagcaaaugaagaccuugggaggcaaaaccaaguccugggccagacuuuccuccaugucugaggacaagugugacuugcugugggucacacgauuucugccagaagcaaaggcagaaauggucccuggcuccucaaacccuucgcucugugcuucagagcugcucccauggccuuuaccccugcgacgauuuuggagugguuuccucucucaacaaggacaacaauggaggugaucagguagaggauugccgcuaugaggguucggaagaaauccugugagguguagggaggagaagagggaagucagcaaccacaguuccccgacaauccuaacugcccagaccccucccuggucuugccauuguggaccccuucucacacuccagggccaguugaugaaugguaucuuggugugcaggucacacauguagacaacaaagaaaauagcagcaaggaucaucucaaucaccgacagggaggaguagccugguguggaggcacugaagcagaucaggaucaccaggcauaauaucuggaagggugacaugggaaaggggaccucaaucagcaaccagggcugagaagauugguuuaaauugggggucccauacuaagaugccuacgagggcuggggaaaugacauacaauaauagcuaaacacuuuuuaugugcucacuguguuccaaauucaaucaucacgacaaucuaaugcucuggguacuauuauuacucuuucuaauuuauagacgagaaaacugaggcacagagagguuuaauggcuuggccagggucacccaacaaguaaggaguagaguugggugccucaguuuccucuuuucccuucuagguuacgggcagccugaggggaguggcgcugccagguguuuugugagccccgcugacgccagcuuuguggccuugaccggggcggaacacgcgguucccccagcaaccccuuugggaagcggugagagugacaccagagaggcaggacuccguuaaaggcgccgcaccccuuuuacaagugacucaaaggcggcgcccacuuugagaaggguggaaaccccgaaaagcuaaggacaucccgcccggccucugaagggcgaggaagaacuggcgaagggcggggcgcucuacaccgcgggacuagcgcggggcgggggggccccaccccaacaggcccugccccugggcgcgcugccagcccgcccuccugugcccaggccgcgccacgcccugccacaggaggcccccacuucccagcacccugggaccccuucgaugcguccacugaugaguucacgcaggcuguccccacguagcccuccguaugcguuauaggcuccuugcuucaccccggggaccaccagaucucaacaaccuucgucaaaccccaccgacucgcccugcgccccggguuucgggccuccaccgugaacccacccaccugcaccccacugccgagcgccccggccaagugccugccucacccggaccauccaguuccgcaugguccagccaccccaucccgcuuuugcccacgcgccugccccagaacgcucacaaucucagcaaacaggaggauucccuuucgagugcgcgagaaguuggugcaggcggcccagcagccaggagccgagaggcgcucagaauccgccauggcaugggcuggagucccuggugccucggaggaucugcucacuugcucgugguuucgaggacgcuguacacccagcugucuugcccgccgucuggccgggaagggggccccggggcgaaggagggagugaaucaccgcgcagagcugacgcgg

SEQ ID NO: 18902 - RNA, 4427 nt, Homo sapiens
ccgcgucagcucugcgcggugauucacucccuccuucgccccggggcccccuucccggccagacggcgggcaagacagcuggguguacagcguccucgaaaccacgagcaagugagcagauccuccgaggcaccagggacuccagcccaugccauggcggauucugagcgccucucggcuccuggcugcugggccgccugcaccaacuucucgcgcacucgaaagggaauccuccuguuugcugagauugugagcguucuggggcaggcgcgugggcaaaagcgggaugggguggcuggaccaugcggaacuggaugguccgggugaggcaggcacuuggccggggcgcucggcaguggggugcagguggguggguucacgguggaggcccgaaacccggggcgcagggcgagucggugggguuugacgaagguuguugagaucuggugguccccggggugaagcaaggagccuauaacgcauacggagggcuacguggggacagccugcgugaacucaucaguggacgcaucgaaggggucccagggugcugggaagugggggccuccuguggcagggcguggcgcggccugggcacaggagggcgggcuggcagcgcgcccaggggcagggccuguugggguggggcccccccgccccgcgcuagucccgcgguguagagcgccccgcccuucgccaguucuuccucgcccuucagaggccgggcgggauguccuuagcuuuucgggguuuccacccuucucaaagugggcgccgccuuugagucacuuguaaaaggggugcggcgccuuuaacggaguccugccucucuggugucacucucaccgcuucccaaagggguugcugggggaaccgcguguuccgccccggucaaggccacaaagcuggcgucagcggggcucacaaaacaccuggcagcgccacuccccucaggcugcccguaaccuagaagggaaaagaggaaacugaggcacccaacucuacuccuuacuuguugggugacccuggccaagccauuaaaccucucugugccucaguuuucucgucuauaaauuagaaagaguaauaauaguacccagagcauuagauugucgugaugauugaauuuggaacacagugagcacauaaaaaguguuuagcuauuauuguaugucauuuccccagcccucguaggcaucuuaguaugggacccccaauuuaaaccaaucuucucagcccugguugcugauugagguccccuuucccaugucacccuuccagauauuaugccuggugauccugaucugcuucagugccuccacaccaggcuacuccucccugucggugauugagaugauccuugcugcuauuuucuuuguugucuacaugugugaccugcacaccaagauaccauucaucaacuggcccuggagugugagaagggguccacaauggcaagaccagggaggggucugggcaguuaggauugucggggaacugugguugcugacuucccucuucuccucccuacaccucacaggauuucuuccgaacccucauagcggcaauccucuaccugaucaccuccauuguuguccuuguugagagaggaaaccacuccaaaaucgucgcagggguaaaggccaugggagcagcucugaagcacagagcgaaggguuugaggagccagggaccauuucugccuuugcuucuggcagaaaucgugugacccacagcaagucacacuuguccucagacauggaggaaagucuggcccaggacuugguuuugccucccaaggucuucauuugcugugaagggaagucccuugucagacacaaggaccuuggugagagguacaaacaggcggccccuuugucaacgcacuagacuaccaucugcaagaacuuugucccaaauguaguagaaauuggggccgggcgcaguggcucaugccuguauucccagcacuuugggaggcugaggccgaggcaggcagaucacuugaggucaggaguucaagaccagccuggccaacauggcgaaaccccaucuccacuaaaaauacaaaaaucagccgggcaugguggugggcgccuauagucccagcuacucaggaggcugaggcaggagaaucacuugaacccagaagacaaagguugcagugagccaagaucaugccacucacuccagccccagugacagaugggugacagagugauacugugucucaaaaaaaaaaaaaguaugacuugaauugugcccccuacggguagggccacaguguggccucccuguguugagagguauaggaggagggagagugggguaggaugcacucucuuggccuuucccuggcuuaccaacccggugcuugagucccauccugcguggggcaggugcuggaggugguggauacaagaagauaagagacugaguaaccugaccagcuaaucuaaacccccucacuccuauccugucccccagguacugggccuaaucgcuacgugccucuuuggcuaugaugccuaugucaccuuccccguucggcagccaagacauacagcagcccccacugguaaguguguguguguguguugguuggggguaaggggguugcugagagggcagagggaaaaaggaaagggaucucuuaaaggcacgaaugccaacucuggucucguauugguacuuagggcuuuuguaccaauagguaccauaagcuucgguauucuuguguguaaaauguucauggacuuuggaucuuguuuuaaaaaaugggcauauagauucagccaaugcuuucucucuuuuccucaccugcagaccccgcagauggcccgguguaggcgaacuucccucauuucucucugcaaucugcaaauaacuccuccauugaaauaacuccuccccaccccaacaacaacauucccagcagaccaacucccacccccucuuugagguaaaagugccuuuauugggagacuuuugucuuccagccugccaaucaacccuccuggguguggccaccauaugugugugccuagguccuccuucugcacgauccaauaggagacaccaguucugacugaaccaugcccccaccuaagucacaaaaugagggaaguggggaguuagauuucagaguccaggcccuagguugggacccacuccaaauaaucuccucgguguggguggugguucuauagagggauaaaugaauaauaaacauuguuaaaauauacgauaaugaauaaaguaauccuuucaucaaauguggguaaauuucaagcaucaggagggggaaauggaguggaaacagcuggggcaaggaggcaaagaagccaggccuguuuuacaacaaauauuaaauuacuucaauaauacaaacgagaggcccggugcgguggcucaugccuguaaucccaguccuuugggaggcugcgggaggauugcuugagcccaggaguucuagaccagccugggcaacauggcaaaaccccaucucuaccaaaaaauuaaaaaauuagcugggaacgcugacacgagccuggagucccagcuacuugggaggcugaggugggaggauagcuugagcccaaaacuuuugaggcugcagugagcccugaucacaccacugcacuccagccugggcaauaggguagaccaagucucuaaaacagaaacaaaaauagaaacaaacugauaaaggagggaggaagaggauuuaugacuuagguuguaggggcggggcgugggggugaggggcaugggccucaucaucuacucugacuggagaauggagcccccuccaggacggccugccuucaagccacgaugcaguucuugucucgggccugacgaggcaucccugcgcgagagucccuggggagcgauaaagauggggaguugaaggucuccauugcaguguccugagcaggcaugggccugcacaaaugcgggggcagagggaugcgcucuccuaggaagaagccaucauccucugaugauucggaacuggaacuggagggcgagcuggagcaagauuccgagucugacccugaucccgcgucacauugauaguggcgacgucugcuuggguggcgguugugauggugauggugauuaugaugaugguggcggcgacggcugggggcccugggugggggacugcguggccugcggcgcugggccgggggugcacucaggguccggcgcgggccuccuucagacaccagagggucgcggaagcugacgcguggggugcucugacgaccgaaggcacuaucaucugggcgcagguuaggcuggccgggggacucugggggcggcucggggacacugcggagccccaguuccggcauggaguggcgguggggagccccucucagaaagcgggagggcuccucagggccuguagcuguuaa

SEQ ID NO: 18903 - RNA, 16523 nt, Homo sapiens
guucgcuccuggcgcucccagggcaagaaaaaucgaagacccgagccggcgcuugcgcacuuagucuccgccacugcuguggucucgugccccgccccccgguccccccacccucuaggcuaggcugagcggcggagguggccgugccgcuggaagcggacagacccgaguuagaggugggggcggggguccaucgcccgcggccgggccggcgcuccccuccuacccuccccgcgacccccgucuggcccccacggcuaacgguagcgcagccgaacacggcccacgggcagggcgccgaagaggagcaggcgcgcgcccggggacgagcagggcgcagugagggaggggcgcguccacugccccggccggccgaccgacaccgaccccgccuacugcggcgcggggacccuuggugaguaaccagccccgccugcggaggaagggaggggacaggguggggugaaggcccggaaacgccgacggggcguaccugcgcgcgcacccgcgaccucugaccccguggccucagcccugaccccuuacgaccugacuacaucuuuuuuaaaccucaaccccugcuggccuuggccucaggaccuuccauccgagcccugaccuaaccauauucuggccugguaugguccucaaccccuguuuugucccccuaaauccaguccugaccccaaaccccauccaguuauguccuggggaucuuugaccugacccugauccuugccugaccccgucucaucucugaaacaucuugcccuauccuaaugcccaacacugaccccaguuucuguccugacgcuugaccugucuguucccuaaacucuuauccagucuccaaaccucuuccagucauguccugucccccuaaccacaaucugguguaguucuguccugauuccugcccucuaacuucuguccuuucucugcacccuaugugauauccucuccuauauacucgugaucugcauccuggcucaccaccuucgucuccugccuugucccugccccugacucugccccguuuuucccucuuuucuugucccaucaccauacucauuccuauccucauuguguccuggucuuuuccuguuccugaccuccauccugaaccugcccuuuucccuguccccuccuuugaccacuggcuuagccuuuccuagucaugucuucugacugcuguucuauguuaauccugaccccugcccugcuguuuugucucuuucuuguacuuuuucucugacccuuguccugaaccccaccuuaucccauccccuggccaguguucuggcucauuccccauccugccucuugaccuccauccugugauaacucuggcucuaucuuguccccuacacuccuuccuguucugucccuucccaucccagccccaggguguucuuccccuuaccaugccccuccacccuguucagaucuucuuccuuccuaauauccacuugccaucccuucugagccgaggacaggggucccauuauacugugcccggaacuugaagauucugcuguucccaggaccuccgaaguacaucccaaaugcuucucuuagcaagagcaagcagcccuaugugcccugcguggcugauggggguuuuugugugugaucuccccuauccccacccuagugaucuuacauagagcuuacauuucucuuccugccccaggagggcaugcaacuguuccuacgccccugcccucugcaagugugaaagaauacccuaaauuauucagugacucucugggagucugagaggucugggucauguuuccagucuugcuguguuggggacugccucauguuggggggaagaguuaagaaaauaugaagagaugggggacccagggguauguaugaaucuucuaggccauguuugauucugggugcaugaucccugcuuuccuggacugaaaaagaagaagucuauucuaggccaaggcuuugggacuugguauagaggagggauggggucaaggauucauucuccuucucucagcaguaagcaauaaaaaucuuggugcuaaguccacuccaccucuguggggcuugucuugggggagaaggccaggcagucacuggauuuaagaaucaggccuauccagugguaacaguaacaacaauaaugcaguguuccccucauuguccgaaucuccuugauucugaggaugauggggagaacuuggauagcuagaggguaauguguuacucaauuggguuuuguuccugcauuucucauagagacuagugaguuugaauaacaagaugccagaccuaucuuauccugaaaaucuauccaaaccuauugauaacaaaacaagcauuccucacuuucccaaucuauuugguaccugaauucugagagggagagugcccgaaguucagacagugaaaccuaccaaguuauuugaagguauuuuguuuucacaucuuacauagugaguagggaaaauugagauaaugaagaauaaugacuaacuaaaaaauguauccaaaucuaugaacuuuccugagcuccagggacaagaguugggauagugaggguacccuguuauguaaaugguuccugcauuuuguuuggaggguaaggaaaguucaagaaugagggauaccagucguaucucaaaaauguuucugaauccauucaguucuugcauuuggauggugagaguucagacaauuucucugaauguauuugguuccugcauuuuugauguugagaaaggagagguuggaucaugagggaaacagcucuguuucaaauaugucucauuuggugagcagggaggguaccgugucuagauagcaagugggauuuggaagcugagggauaccaguucugucucaaaaaugcaucugaggccggucgcgguggcucacgccuguaaucccagcacuuugggaggcugaggcggguggaucacgaggucaggaguucgagcccacccuggccaagauggugaaaccccgucucuacuaaaaauacaaaaauuagcugggugugguggcacgcaccuguaaucccagcuacucgggaggcugaagcagggaacugcuugaacccgggugguggagguugcagugagccgagaucaugccacugcacuccagccugggugacagggugagacuccgucucaaaaaaaaaaaaaaaaaaaaaaaaaauugcgucugaauacauuuagucucugauuuuggauagcaagaguucagacaaguuaucugaggaaaaacaacuguuucaaauguaucaagugagacugaaggacaccagcucugucuggaaaaaaugugucugaauguaucuacuugauuccugacuuccuguggggaagaauacuuguaacugugacagccaacauacacugagcucuuaccaggcacuguucugcacaagcuuuaaauguauuaacugauuuaaugcucacaauagccccgugagguacauacuguuaucaucguccccaauugacagagaggcacagagagguuaagugacuuguucaagcagucacacagcuaguaaguggcagagcuggguugaaucccagacucaccauuuacuagugacagcagggucacgugaggcccagggcccagcugggguagggcuuagagguuggguccucuucgaggcuauuaaaagucauggaccagggcaaugauguguguuagugacugccccauuugucugccuggcccaggagguccaguuaccugcucucccccaguuacccccacaacagcccaccucugugugaguguauuaauuguuguuaguaagagucauuaaugacaugguguguuuccuugcacuuugaaaugccuuucaaaguuauuuggggccuccauugucucuguaaccaccuuuuacccauuuuacagaugaggagaccuaagcuuugagacucaaucuacauugccagccagauucucaucccucuuggcucugauuuuauuacugucucacuucccaacaucuuugguggcccauaagaggugggagaggcuguggccgagaggacacuccccaaugcccaccuuaccacugcccgccccaggcagugaaguggggagggcgaugaaaggggccuuuguguuccaugcuggaaaucucacacccaggaagaaaggugggcagggauggcgggaggccuuaauaguaugagucuggggcauugcugauucagagugagcuccucucuaggcucagcccaucugcagcuuuucucacuucaggucauggugugggcugcugcaggggucuggguagggcuugggcccugggucacagagcagaugguccugaauggagcacaggaugugugcugugugccgggacuggcccagagcucaggugguaguggugaugguggugguggugaugguggugguggugggcggggugaggggaggcagggacaguacgucguaaggacucaaagcucucauuuccuucucuggcaugaagccugacucucugaagaagagagacccagcauggaugugaagaagcaugagcccccuucccuacuucuccuucccacuugcaggaguagccucugucugccucccagccaggacccagcccccggaaauucugauuucaccugcucuucugccacugugaucugaaucaggccucuucaccuuuccaggccucagcuucugcaucuauaaaauggcugugaggaggcugggucugugccauccugcuacauuuguaggaaccaagagggaucaaaacccauaaguguuuuguaggguguaaguugugcuugauuuauugagauuauuucuucuggagccacagaaggaucuugagaccugaccucuccuuagaaagguugacuuccucuguccccaacuugggaaacuauuauuccccagugagggugggaauugccccaaggccuucuaccacugccuugcccugggaggaaaggguaggggccucagaaugugaugcuuagugccaagacacaaaaacucaguuuacacccgaagccucccauguacuuuacagcuccccacaccucuauggcccagauccaaguugccccuugggugggcagcgucuaauccucugggaauuugggcaguaggagaggcagcugcuacucccaccacucucagcccuucuucccaguuuucugcuaaguguacggggugaggaggcacaggccuccaugccuggccaguuuuaaaaaaaauuuuuguagagaugggggucucauuauguugcacagucuggccuugaacucuuggcuucaagcaauccucccaccucagccucccaaagugcugagauuacaggcaccagcuacccugccuggcccaggcugucuucuuagacaugcugagcacccugaguggaccuggcccugaaacugcccccaggggugacccuaguccugguggcagacaggcaaggguuaaaaggugugggccggcccaguuccuggccagguaggcugggccauuaccuagugggagguggccaaggcaucugccacugcugcugacugccacuaccagccggagccagggccuggucgagacaacuauuuuugagguaucugaggcuaccccacagcacucucuggcauuggugagcaccugggagcagugggcccagggugcgagggggauaagggcauuggggagcuggggcaggguguacugaaguucccuucgguagagagcuaggucugugggagaggcacaccaacaaugcagggcaggguggugguggggggguaggggggcagugagaauggagggccugaggacaggggcaaagcccaaaacaccaauuuccuuuccuggcaccaagccgauucccggccggaaauggacgaggagggaucggggaaaagagaaguaugaguccccccuucuccacccuaucccugcuuccuuuccuccccgccaggaguagccucuguccucccccaacccagggcccagcucuccaagaaagaccagacugggcuacuaagaaaccauuacucaggcaccugccugccuaugccugauuuguucacugcaguggaggaagcaggggcucuggggaggguaauggcccagacauugagauuuuguauuugcucuaauaguggcaggauguggaaaugaccccccaaguguuggggugccacccaggugagguaucuugguuguaaacaguuauuacagccaggaauuucuuucucggcuguggugucagaauggcagaccugaaaaaccugccgggcccgccucuggguguggggggugcccucuacugcucucccgcugcagcuggucccugggacaggaugggggccauggggucacugguagggggagaccugggguuggugugggggugugcuggggagggguuugcugggaucccuuucucgccaucugggcggggaugaggcagcuccaggccccaaggcaaguaugcagagggcaggugagcggaggcagaagcuuaggaacuggguguggggguguggggcguugacugugucuagccugcccagugaccccaugacucauacucuaacuauguccccccgaggucgggcugauagggaggaguugggguuccuguguggacccugucuggacuuccaggacgcucugagaaauuagagaagaaaggauuggcugggugcagugccucacgcauguaaucccagcacuuugggaggccgaggcggguggaucaccugaggucaggaguucgagaccagccuggccaacauggugaaacccaauuucuacuaaaaauacaaaaguagccaggcaugguggcgugcaccuguaaucccagcuacuuuggaggcugaagugggagaauugcuugaaccugggaaguggaggcugcagugagccaagaucgugccaccacugcauuccagccuaagugacagagccaggcccuaucuccaaaaaaaaaaaaaaaaaaaaaaaaaaaagaaucgaagcagcccagcauggaauugggauuggauugggaccaaugcuggcaagggggaccguggauggaguuggguuccuguggggguaaaggaagguuccagggaacccugugagaguuccuugggccuaaaugggggcugggaaaguuggagccccagugaucugggauguggaggaaccccugccaugcugggaagugucagaccuuagaugaguggggauguggggccuggguuugucaaaaggcuuuagggacugauccccaccccugcuguugaaggcagggcaccacugcuucaagagagggguacaggcccuauggggcaggcaggaggacugcagagaaacaugacaccuuacaagcagcuuggccucaccccacaauacacagauggggaaggggcuugaacccaugccuccuugguuggcugggucuuccucacaccaggcuaacaugucaugacaagcugccgacuucaagguaggugauaauggagcucuguggccccauaaagcccucccagucaccugccaccuagguuaggccagguggugggaggugaugucacucagcugcccagcuggggacugagcaugauguggaaggaagggagcaaacuccagaggagggguggccagccaaggcagguuccauggucagcugagccaucgggggcagagaaggaggcaggaggcaggugguucguuauuugcagcuguggacuuugcuucucacaaaucccagcaggaggacuucccuacacuaggcucaggacaggcugucauggcaagaggggcuggagggacccugggucaagugaacauucuccuugcuacacuagagcuacagaauggaguugggacaagcacagacccacagaucugagcuugaacccuggcuccaccgccuccucauuuacuuacucuaucuuuuauucauucagcuggcacccauucauugagcacuuguguguacagccauguucagggugcuggugaugcugcugaaaaugggacagauaauguuuccuguccucgucgauguuccaggaggcacaaucucuuguuggacaaccguuugugagaggauauaacuguggaagugauaauuaaguucuagaaugauaagugugaugcaggggcugggguggugagagguugaagaaagcacuucaggcagcauccacagccugggcaaaggcccugaggccugagggaccagggagcuuaugaggaaguugguggaguuagagcgguucucaugagcgagaguguaggaccagaggggugggccugguuuaugucuguggcuaugggccaguuauuucaccucugugccuuccuuuccucaucucuaaaauggggauacgaaucuuuccggguggcucugaagauugaguguggcaucauagguaacuguugcaggcacccagguguugacugcguguccauuguuguuauaguugguugaaucugucccauuaauucuccuuccccaggcaagacucguggcugugacccaugggccucugaggaggcguuguaaguccgcccagcuccccacuugcugugcucucacucaaugcgaagggaaccaagguaccagggccaaguggguccagacauccacacggauucugaaagggcaggucaagcaggcacguggggcccagguuaccccuuauuccccgcuguggcaugggaagcugggaagggcuggggguugggguaucaugggaugugcuuccuuaacgguuccuuugugucacugccagacuuuguccagccaucagccacggccucucgacagcaccaagauggaagucaaaggucagcugaucagcucuccuaccuucaaugccccaggucgguggcugcuuccccuccugcugccuccuccccugcucugaaucaccaccugcuugcucgggaagaguuggucccuugccccacagcugcuccagaaugcccuggcugucccacugaucuuugcucccucuguguccagcugcccuguucggagaggcugccccccaggugaagucagagcgucugcgggggcugcuugaccggcagcggacccugcaggaggcccugagccugaaacuucaggagcuccgcaaagugugucuccaggaggcggugagggccuggcccuagggguaucaggcggggagguugggaggaggugaggagcuggggccccuagguagacagacuuggguggcaauuccucaaccacuugucuuggcuguagauucccugucaccuacuuucuccucaaagcucagcuuagauguguuagaaugaaugaaauaggcugggcgcuauggcucacgccuguaaucccagcacuuugggaggccgaggcagguggaucaccugaggucgggaguuccagaccagccugaccaacauggagaaaucccgucucuacuaaaaaugcaaaauuaggcugggcgcgguggcucacgccuguaaucccagcacuuugggaggccgaggugggcggaacacgaugucaggagaucgagaccauccuggcuaacacgguguaaccccgucucuacuaaaaauacaaaaaauuagucaggcgugguggcgggcaccuauaguuccagcuacucgggaggcugaggcaggagaauggcaugaacccgggaggcggagcuugcagugagccgagauugcgccacugcacuccagccugggugacagagcaagacucugucucaaaaaaaaaaaaaaaaagcaaaauuagcuggguguggugauccuagcaacuugggaggcugaggcaggagaaucgcuuaaacccuggagguggagguugcggugagcugagauugcgccauugcacuccagccugggcaacaagagcaaaacuccaccucaaaaaaaaaaaauaugguaauagaggcccacuguugacaauuucaaauccaacaaaccucagaaaacagguucuguccaaaauuuggcagcacagucugaccugaacuggcacaggcugaucuguaguuucaguuuaccccucuuacugugaaugcccacagugugccggaaauaauacuacagcucagaccacgcagccacagccccugaagugaguuauauaaugcuuaggaucucgaugguaucaccuuuauaaaaacaaaacaauucuggauuccaaagcaggucucccugccucccaugcccaccaccccagggguuugggccacugagguuugggcacaccugccuaguggagauacugguaggagggaggggaguaucgugcgugguugcugagcagggccaggcuccugguaggacuucuguagcuucugggaucauuaaugcuucaccccauccuuccaacuaacccuugguagucucugaccccugccucccaccaggagcugacuggccagcugcccccugagugcccacuagagccuggugaacggccccaguugguccgccggcggccccccacagcccgcgccuacccuccaccgcaccccaaccaagcacaccacuccuugugcccugcugaggugagcagauggguguggagagcaagagggugggaagaggggacagguacagaggaguagccaggaggaagguguggggagggggcuuguggccaggugagggagaggcuaagaugagaaggaaaagggcuucuggaguuaguuuccugugaugagggaggaugcuggucccuaacugucaggacaggccuccaacccuaaggaagaugaacagacccagcccuucaccaagagaggcccugacacgcccccuccccggggugaauaggucugaauaggcugcaggaagugcaggccagccucuacuggguuuggccccgccaggucccuguuccuggccauuuccaacauuugggugggcccaacaggagcuggcucuugaggcccuggaacgcgaggugucagugcaacagcagaucgcggcggccgcccgccgccuggccuuggccccugaucugagcaccgagcagcgccggcgccggcgccagguccaggcagaugcacugaggaggcugcaugagcuagaggagcagcucagggauguccgggcccgccuuggccucccagugcucccgcugccccagccacugccacuguccacggggucagugaucaccacccagggagucugccugggcaugcgucuugcucagcucagccaaggugagcauccccuggugagggugggagaguggacacuggcaaauggacgugguagggcugggaugggugacuggccggugaaaaccgggagguaggcacaacucaaguggcccaacccgugagaagaguugcgacaaacuggcuuaccggaaaggacaaacugugggggacugaugaauaucugccaggacagucaggaaccaaacugggguggucuugggcucugguaaaagcagauucuugggacaggaacaggaugaggcggaaacuggccagaagguggcccaaguagaggugcccacccagugguguaagggggcagcacccaggccugggagugagaggcccacuucucccccucucaccuguagaggacguaguucugcacucagagagcagcucccucucagagucuggggccagccaugacaacggugaggacuccuaucccccaaaccugcccccgacuccuacgucccuuuagcccauccccuuuauucauccgaccacauccugcaugaucagcccauccuuugaugcccagccccuccugugcugcuucagcuucuccuuagccaugcuccaucuuccuaugggucccccaucuucuuagccucaccccaccccagccccacagccccagaaccuacuugucagccuuaguuccuccucagccugcuuaaccugucccagcacuuugccccuccccauggccuugccccccagccuguccugcccccucugggccccccucauugaauucuaucccacuugcucucuuccacucagaggagccccauggcugcuucucucuggccgagcgccccucaccacccaaggcuugggaccagcugcgggcaguaucuggggggagcccugagcggcgaaccccauggaaaccaccuccaucagaucuuuauggggaucugaagagccggcggaacucuguggccagccccaccaggugagaaugagccccuccuccccuccgcaggagcugggaaugggauagcaagccugggcuggcagagggucugcugguggguacagucucuaaccuaggccugccugucucugucuagccccacacgcucgcugcccaggagugccuccaguuuugaggggcgaagugugccugccaccccuguccucacccggggcgcuggcccccagcucugcaaguaaggggaaucugagggugggcuggaggaucagaggggagggaaccauuaguucucacuggaagcuugaggacaacauuaucaaaaggugggauggcugggcgcgguggcucacgcuuguaaucccagcacuuucggaggccgaggcgggcggguuacuugaggucagggguucaagaccagccugaccaacauggugaaacccugucucuacuaaaaauacaaaaauuagcugggcaugguggggcaugccuguaaucccagcuacuucggaggcugaggcaggagaaucgcuugaacccgggaggcggagguugcagugagcugagaucaacaucgugccauugcacuccagccugggcgacaagagcgaaacuccgucucaaaacaaacaaaaaaacaaaaggugugggacaugggaggcugggcauuaaaggugagcaggcaucucgguggauaaugggguaggagucagucuccucauuugugaaauggaaauaauaauaucugccuuugaaagacauggacauaauaaguucugguuagcauauacugagugccugccaucugcuaggaauuaguguuuuacguggcaucaacucauuuaaucauaaucagaucccugugaggugggugcuauuguuauucccauuuuauagaugaggcaagugaggcacagaaagguuaaguaacuuguuaguaaacugaaguccuggaguuugagcccaggcaaguuuuacucuagaguccaugcuuuuaaccacuguccucuucugcuucuuaaacagagugccuacuuuccccaggcucugaacaaaaccaaguccccuuccuuguggggcuugcauucugugaacgguggcuguugggaugguagcuuugggugguucauacguauggugggauagagaauucaggcaggguuuuacaugugagcccuaaggccuaggacuuaauccuggaggccgugcgagccgagccaugagaacggccuuagcagggggaggggucagcuggauuaggaacagcccccugcccggcaucuacucugcuagccuuuccucugagucccuacacagauuuacaccucccuuggagcuaacagugccaggccucccccacgcauuucuaccccugaccgccuagccuaggauagaaccucagcugcccuuuacaugucacuaccugccaccuuuauacacacagcuuccaaccuugggcccauuuggagaugugaaagugaaggcuuagaaagggcugggguagggagggcacugcacgccuucugccugauuuuucugacccuauucccaugacccucgccucucaccccagaccugaaggccuucauucucgucagugguccggcagccaggacucccagaugggcuucccccgggcggacccugccuccgaucgcgccucccucuucguagcucgcacccgccgcagcaacaguucugaggcccugcugguggaccgggccgcuggugggggagcuggcuccccgccugccccucuggcucccucugccucuggccccccagucugcaagagcagugaggugcuguaugagcgcccccaaccaaccccugccuucuccucccgcacagcaggccccccagacccuccccgggccgcccggccuagcucagcugccccugccucccgaggugccccccggcucccaccuguguguggagacuuccucuuggacuauuccuuggaccggggccugccccgcaguggcgguggaacaggcuggggggagcugccgccugcagcugaggucccaggaccccucucccgccgggaugggcuccucaccaugcuccccggcccaccaccuguguaugcagcugacagcaacagcccccuccuccgcaccaaggacccccacacccgugccacccgcacuaagcccuguggccugcccccagaggcugccgaaggcccugaggugcauccaaacccucugcuguggaugcccccacccacccguauccccucggcuggugaacgcaguggccacaagaaccuggcucuggaggggcugcgggacugguacauccggaacucgggacuggcugcggggccccagcgccggccugugcucccuuccgugggcccgccacacccacccuuccuccaugcccgcugcuaugaggugggccaggcgcuguacggggcccccagccaggcgccacucccacacucgaggaguuucacggcgcccccugucucuggcagguauggggggugcuuuuacugauggguaggggucucguaaggcagauggcgaagauauccaggccagggaguggcuagucaugauagcuaaugaauuggaccaugaggaaacuagcugcugugauggcacagggucacucuacugcacaugaccugcauuaguccaugggguccugguggaggggaucuugggcacugguagcagcaauucuuuaucaaguuauaggcugaagaugagccuugaagccagggugccgggaggaagggacaucucaugccccuugcuguuuucuuccuuuuuucuccaugccccagagccugaaagugcuguccugugccugccuccaccucuuuaacgagccucuuuuccuuucuuuuucugugucuugucugucuuuucuucuucuugucuuccccgcccuguccuccggauuccugcuaccccuucuaaagauacuacgcggacuuccuguaucccccggagcugagcgcucguuuaagugaccugacgcuagagggggagcaguccuccaguucugacacccagaccccggggacacuggucugaccccuucugauaugucccuuguuggccugggcacgauuccaaucuggggagcacacagcugaccucgcugggcccuggggugugguugcucucaguccugagcagagugcgccaaccuaaucuuccaaggccccuggcuccccguaggcccaggaaggugucugacacccugcuucuucucucacacugugcuggggacugggggcccucagcuagcuuaaaagaggggggaugaugucauggggaccccaagccccuuccuccauuuauguuuacaguugugacuuagguauucacugucuuccuccaacacuaggcguuuuacaaaagggaaacugugaucucaucugguuggguucauuccuguucccaugcccaaccagguuccauucaggaacccccuccauaaaauggaccauaucgggucucagggccauuuagggcagccaggagacuccggugugaacagaaaucccugccacgcaucgccagggcaguuggggcagugggcucucugcccacacuuggaaggacugcagucugggugggaugccugaaagagcccaacccccucugugcccauggccucugcccugaccacccccagucaggaggccccacaggaggggcacccgguagaugccagugaaauccucaggggaggucugccugaaagagcccaacccccucugugcccauggccucugcccugaccacccccagucaggaggccccacaggaggggcacccgguagaugccagugaaauccucaggugaggucugccuacgggccacgggccacucaccacucacaccuuccuuggcuuuccuuccacccuuuuuuuuuucucgagacggagucuugcucugucaccaggcuggagugcagcggcgcaaucucagcucacugcaaccucugccuccuggguucuccugccucacccucccgaguagcugggauuacaggcacacgccaccaugcccggcuaauuuuuguauucuuaguagagacaagguuucaccauauuggccaggcuggucuugaacucuugaccucgugaucugcccgccuuggccucccaaagugcugggauuacagccgugagccacugcacccagccccaauccaccacuuuuuaagcaaacccacacaaguuguguuuucuaugauaccugucugugauuuucggagcuggggguuccccuacccccuuuuccuggcguuaagcuuuucuuuuuauaccaguggaucuggacccaagacauuacccacacuggaaggggauuuguauaauaaauguguaaacugaacccaugug

SEQ ID NO: 18904 - RNA, 14916 nt, Homo sapiens
cuccgcgucggaggcgucgcuuagggugggcccucgaaucgccguucagcgauuggccgccucgcuaaugggucguggccagacgggccauccauccccagugcggucacuuccuguggaguuuccccaucccugggaggagggaggagggggaagaagacgagggggaggagggcggucguccgggguuagguugagggggggcgucgguccguucugggcgggggaugacucacagcccaucccaucucccagacgccgcccgcccgcgcagugcuagcuccauggcuuagcggaggaggcggcaguggcgagcuggggggaggggggacucuuauuuuguuagggggaccgggccgaggcccgaccggccuggcagggcucgcccggggccgggcgucaugucucaugcggccgaaccagcucgggauggcguagaggccagcgcggagggcccucgagccguguucgugcuguuggaggagcgcaggccggccgacucggcucagcugcucaggugcggggccgccuggggcugggagugccgacuggggcucccaggggccugaucucgggggcagcgggggccccggacugggauuggaggcccucggccuagccuuggaggacgucggggcgcccgucuugggggggcaccuaaggaauccggcaguggccugcuuggauuguggcuuuauuaaaggagucgugggagugcauuaagcggggucugggucagguuuggggagcccuugacugcgucuagcggggccuauucuggaguauccagaaacuggucugagauagcugaacuugguagacagggucucugauuagaggcugaauucggggauuuucagucggacaugaggggaaugaauuugaggggacacugucaggugaggcacugguuuuaagggaauccuagaaucuuuuuucccucagugugggagaagggguccugagggacagaagugcugucuugggagcuuggugccucucagugacugguugcuguguuuggggauaacaugaaucuggagggauuuggagguaucucagauaugcugccugggaccagccuugugagugcgugugaaugaacaagagaagcaacauucagcaagacuugaccagaauaauccuuuccccucugcccgccuacccagcuggggcagaucccaaggauaguggaaaagcccucuucccacaccuguuaagggccugaauggaagauagacagccaggcagagggcgaugauguuaccucuuagcucagaggccucagaccuuguuugggaacccagaggaggcucuuguucaugcugcuacucgcucuagccucucagcccuucccacucccuagccccacaccccuuuucuuuuuaucuucuuuucgaucuccgagcuccuggggguaaucuugaaucuguccauagagcuggaacgaguacagauugcaccaucccugccuggguggauccccucuggccucuucucauccuuacuuucaucaaugggcuuuggagccccagcccucccugcucaccccagugcccaucucuuccaacuucugugcaaugggugugugagcccuggguggggggggucuuugccuccuuugugccugggauugugcugagcucaguggcuugcccgagcuuccucuucccaacuuccugggugguuuuagggcuccaucugagggugaggagaggaaggaagacagauccuuggggaggggagaggauucuugucaagugaagucaccagcaaucucucagcauucuaaauguuuagcuaaauugaaggaugcauauucauccacguguguguuaacugucccuugcucucuggggcugagcagagccuuucuguauaucgauucaccaucuucuaauuccucuguaacaaccuagaucaucgcaguaguggacauaguuaaagggauggguguauauggcuucuuauuuugugcgccaguggguguuaguguuggggguguguguguguuuugaucuauccaaaaaaacaggagaaggcugggcaggcuccuccgguaagaaaagaaugcuuguauaaaguggaucaaccacccaaauucucccucuuguaaauccagucuguuggagcgaggggagccuuugauauuucuauuuuauauuuaggcauguguuggcaucccaugaacucuggcuggggcugggagaaacucauuugugaaaugguagaucuuuacgucaagugaauuauuuccaguucucuuugugaugcauucaguuuguguuacaagggacuguuaugcugagggaugccccuacuugcucuguguguguguguguguacacacauauaccugggcucacauucagcuguaaagaaaauagcaggggguuggccgggcgcaguggcucacaccuguaaucccagcacuuugggaggccgaggcaagcggaucuugaggucaggagaucgagaccauccuggcuaauauggugaaaccccgucucuacuaaaaauacaaaaauuagccggacgugguggcgugugccuguaaucccagcuacucgggaggcugaggcgugagaaucacuugaacccaggaggcagagcuugcagugagcugagaucgcaccacuguacuccagccuggugacagagcgauacucugucucaaaaaaaaaaaaaaaguaggggguaugggggcugggagaacucugaauaggaagucaggaauccuucuauaaagugaauuguuauuccuaaauucuguuuuccucaaacccagguuguuacaguguggggguugggaugcaggcguucuuauuauucugacuccuaagggacuaugaguaacacaguggggaagggaaagggggaugggggaaggaggugggaauucaugguggugugguacccagcaagguggccaaauaugaggggcuuguacccuccucuucguucucccccgcucucugucucuuucucugucucaggggagggcuggggaauaagguccuucauucaaucacugaccaccacuccaccucccccucagccugaacucuuugcuuccggaauccgggauuguugcugacauagaauuagaaaacguccuugauccugacagcuucuacgagcucaaaagccaacccuuaccccuucgcucaagguauguaugacuugucuaucugauuccccucccaauuccucagcccuccucuccccucuugaugggcagaggcccucaguaccagcccaacccauucuuucaccagccugcguuuucuaguggugguaaaauuagggaccagaaagagcaugucacacaggaaaguagguggccaagcuaggauuccaguaucucugucaagaccuccccugccugcccccagcccaccugcacacccauucauaugcaaguguuucagccucagguguuccagccggccuggagugcucagagauagggcguggccugcuuaaacucauguccccgggugggcggggacaugccucuagccccaacucagucccuucccacacuaccaacucacccacccucagcccuugaggagccccugcuggucucuucuuuccccaagcuuggaagucuaaaugugcugagucaucggcccgggcucugagagaggggaggggagggggaagaggggcaggaagagaguauugugaaaucuccgagguuuucaagacugacuagcuccugggaccagaggcccaggcaggggaagaagaggaaccuggggcuucuccuaucaccugacgcccacccccaggagcucagagagcuucucuagccucacauugggcuuaggagcccucuguauccacauucugcugccaaagccucaauucugcuucuucugcucuccuguaaauaggacaaacccccccuugcagagcugaacaauagcaucuccacuuaauaugugaacaggcucaaaucuaggcuucaccauaaggaccaaaggcuaaaacucccccaccagacugaccuccagugugucccccaucagacugugaccccugagagccaucaccaagccugguuccugugucucugcuucuacauuguggccucggaaggcagagaacaggccugguuccugugucugcuccgucacgcuaagacccuuuaggcuugggaugagacuuuuagcuuaccuaaaauauggccccauauuucccauuccacagccucccaauaucacugcaggccacaccagccaccccagcuacacucucugcaucgucuucugcagggggcuccaggaccccugccaugucgucaucuucuucaucgagggucuugcugcggcagcagcuaaugcgggcccaggcgcaggagcaggagaggcgugagcgucgggaacaggccgccgcggcucccuuccccaguccugcaccugccucuccugccaucucugugguuggcgucucugcugggggccacacauugagccguccacccccugcucaggugcccagggaggugcucaagguaaggugagauccagaggcccugggagggggcuccuggugacugaggagugauccuaggagcuagggauggccucgaugcacuggugauuugggggcaaggucuuaggggcucuaaggaaggucccugguacuguuuaaauuaucuguguucaugucucauguguuuuggguuucugagaugaucuugugaaauugcgaggaguucgugggggccaugaggaugucuugguggaccauggaggcucaugagugccccaagugggcccuggcuuuguaggaagagcuucaugugugugggauacauuaguucuuuggccauuagggggucuugggaagcauuguaugguucccaggucuauuagguggugucagagacuagguggggaaucuuggggacugugacaggguuuuccagaaacuacgagggauccugucagucauggguggaucuuggcagcugugaaggauuucugagaaagagaguuuggguccugggggagacucgcuaauauuuuugggguguucucagauucugggcccagcuugucugcgugagucuaggcaccaaugaguuaggagggucaggcuggggcucagaauucaccccuuugaguccuguucugccuuguccccucucuuuccuugucuaccuuauuucacaggugcagacccaucuggagaacccaacgcgcuaccaccugcagcaggcgcgccggcagcaggugaaacaguaccuguccaccacacucgggcccaagcuggcuucccaggcccucaccccaccgccggggcccgcaagugcccagccacugccugccccugaggcugcccacacuaccggccccacaggcagugcgcccaacagccccauggcgcugcucaccaucggguccagcucagagaaggagguaagaggcuacagccaaaccuccucccacauuccccucccaaauucuucuaaaccuguauaauauuuacuucuuccccuagauugaugaugucauugaugagaucaucagccuggaguccaguuacaaugaugaaaugcucagcuaucugcccggaggcaccacaggacugcagcuccccagcacggugaggcccugagaugggagguuggucugaaaauuagggcauuucuguaucaccaagaccauacucagucuggcuguguguauaggagacccuugccuugauugugcuaagauagagagggaggccuuaugacgagaacaggguaugucaacaaugccuuuggaccuuguuggacuguguugagagguggaccauguagacugugagagauacagguggggaguucacugagacaguagggcauaucaaagugcuugggcuuugcugugagaaguaccaagagaugauaaucuuuuuuuuuuuuuuuuuucgagacggagucucgcucugucacccaggcuagagugcaguggcgcggucucagcucacugcaaccucugccucccagguccaagcgauucuccuaccucagccuccugaguagcugggauuauaggcacgugccaccauaccaagcuaauuuuucuauuuuuaguagagacgggguuucaucacguuggucaggcgggucuugaacuccugacuucgugaucugccugccucggccucccaaaguacugggauuacaggcgugagccaccacacccggccgagaugagcaucuuauagcaacuugaauguaccaagggauucaggucaucgggacauauacaccagaccauguaaugauuggagcauuuuguuuuauuuuauuuuuaccuuuuuuuucuuuuaagacagagucucacucugucacccuggcuggagugcagcggugcgaucuuggcucacugcagccucuggguucaagcgauuuucgugccucagccucucacguagcugggauuacagguguacgccacuacgcuuggcuaauuuuuguauuuuuaguagagaccggguuucacccugugagccaggcuggucuugaacuccugacuucaagugauccaccugccuuggccucccaaagugcuggaauuacaggugugagccaccacaccuggccuugaagcauaacaaaaguuuucaaacuugcuguggguuauaacaaguaguuggaucucguagugauuggaauauaccaagugaacugugccaggaggcagaguccuucuagucaguagauaaaacuuucuagagcaagggauauaccauuguaacauucugguuuugaacacuccaagagucucauaacuugcuuuauuauauuuauuuauuuauuuuuugagacaaagucuugcucugucacccaggcuggagcgcaauggugcuaucucggcucacuggaaccuccgccuaccaaguucaagcgauucucuugccucagccuccugaguaacugggacuacaggcgcgugcccccaugcccggcuaauuuuuguauuuuuaguagagacgggguuucaccguguuacccagguuaucucaaucuccugacuuugugaucugccugccucggccucccaaagugcugggauuacaggcaugagccaccaugccuggccuaacuugcuuuauuuauuuauuuuuuuuuuuuuauugaauuuuuuuuuuuuuuuuugagauggaguuucacucuccuuguccaggcuggaaugcaauggugcgaucucugcucauugcacccucugccuccuggguucaagcaauucuccugccucagccucccaaguagccgagauuacaggugcccgccagcacgccuggcuaauuuuuguauuuuaguagagacgggguuucacuauguuggucaggcuggucucgaacuccugaccucaggugauccaccugccucggccucccaaaguucucggauuacaggcuugagccacugcgcccggccuauuuauuuauuuuugagacaggaucuugcucugucacccaggcuggagugcagugguguaauccuggcucacugcagccuccaccuuccgggcucaagugauccucccaccucagccucccaaguaacugggaccauaggcuugugucaccaugccuggcuaauuuuuugcauuuuuaguagagacagggucucacuguguugcccaggcuggucucgaacuccugagcucaagccaucugcccaccucggccucccaaagugcugggauuacagacauagccaccaugccuggucucauaacuugcuuuagagcauaccaaguggcuguaguuuugcuuuuuuccaacuuaucaauaggauggaagcauguauaaaaaugggacuaauuuaucagaacuuuuuauugauuuggacacaacuagagaaugggaccuuauauccaccagacuggaaguggguucaagagauuaaagcucagccaggcacgguggcucacaccuguaaucccagcacuuugggaggcugaggcgggcagaucacaaggucaggagauccagaccauccuggcuaacacagugaaaccccgucucuacuaaaaauacgaaaaaauuagcugggcgugguggcgggugccuguagucccagcuacucgggaggcugaggcaggagaauggcgugaacccgggaggcagagcuugcagugagccgagauugcgccacugcccuccagccugggugacagaacgauacuccgucucaaaaaaaaaaaaaaaaaaaaaaagagauuaaaacucaugaagaagugggauuuggauauacuuuauuuuauuuguauuuauuuauuuauuuauuuauuuauuuauuuauuuugagauagagucuugcucuguugcccaggcuggagugcaguggugugaucuuggcucacugcaaccucuaccuccuggguucaagcaacucuccuguuucagccucucaaguagcugggacuacaagugcaggccaccaugcuuggcuaauuuuuuuuguuguuuuguauuuuuaguagagacggaguuucaccauguuggccaggcuggucacgaacuccugaccucaagugauccgcccgccucggccucccaaagugcugggauuacaggcgugagccacugcaccuggcccuggguauacuuaagauugacgugcuccucuggaguauauccaggaaagugugaaggagaggaaaaaaaaaaaaacuaggcugacauaaagcagugcuaauugaauaguuggauaagaaucuccugagagaacagaaugugcaggaagauacuggagucaggaccuugguccacagcagcaggagacccugauguggaagaugguacaacuugaucagaguggaagaugguacaacuugaucagagugaaagacuggagauuagguuggaauucuccagaaggccagauuuuggauagaauguugucaugacaauuuaccaaggucggagaagauuggguuggaguguuccaagaaugcuggauuggaauguugugcugggaggagcuaacggacuggaaugucccaucagagccgacaaagaccugagaagggugguuuuccagcauuucuucucagagccagccccgggguuugggaaaggggcuuuagaggucacugagggauaugagggacuggaggaagugauaagcaggccaggcaggcuccagucucccagcgaagcaagguagguccaguuugcucuguccucccuguuuggucgccaugugaauuugccuugaaggagaagcaaggguucuggugcugagucagccaguccuugcauuagagggugccccaucuuugggauauguggaagcucaggaaccugguucugaggaggagccaagccuggguuuguucccaacuggugguucucugcccucucugcccccagcugccugugucagggaaucugcuugauguguacaguagucaaggcguggccacaccagccaucacugucagcaacuccugcccagcugagcugcccaacaucaaacgggagaucucugguaggugauagggucuuggccccauggcccuacacuuuaccccaggugagcccugugccuaccaggucuagagaugggccugauucugaggggaaugguuuggacauauggaaauggaggcuguuuguccccuuucccccuauggcuuguggucuugcuuucaccccacuucaguuccucucgucuuggauuuaacaaccagccuaucaccauggcuuaaaauaguaaaaagaaggcacuuuuuaaaaaaggcauuuccccugcuuuuggcuaccaaacccuaccuuaguaucugcauguguuucuugccuuccugugcucagaggcccugaucacuccacucuuuuccagagaccgaggcaaaggcccuuuugaaggaacggcagaagaaagacaaucacaaccuaaguaagccagagagcgugugcauugcccgggugcugugcaggccugccucaccccgaguccuggccccccauggggaacuccuucccugcaacagccucccaacucccuacuuucugucucuuccauuuuuggcuaauugacaacucuuucucccacucuuucuuccucuccuccccucuccaaaguugagcgucgcaggcgauucaacauuaacgacaggaucaaggaacugggcacucucaucccuaaguccagugacccgugagucugggcugggacccucaggccagcgggagguggggcaggcgucccaugcuacuaaaauugugccuuggugggcucaccaggcagucucggcccaggcauuucuccucugucugguucuuucucagccugagcaggguugcagacccucacuaugucagcaccuaaaauuuuaggcacauaauguuauggucugugugccccaucugguccccguaggauauaugcaccuacuuuucuguucacuuaguacuuccuuuuuuuuuuucuuuuuuuugagauggagucucacgcugucacccaggcuggagugcaguggugcaaugguacuuccuuuauuuauucaagauuuauuuauuggccgggugugguggcucaugccuguaaucccagcacuuugggaggccaaggcggggucgaucaccuaaggucaggaguuucagacuagccuggccaacaugaugaaaccccgucucuacuaaaaaauacaaaaauuagccaggugcaguggcucacacuuguaauccuggcacuuugggaggccaaggcaggcggaucacgaggucaggaggugaaggccaacauggugaaacccugucuccacuaaaaauaaaaaaaauuuagcugggcgugguggcacgcaccuguaauccccgcuacucgggaugcugaggcaggagaaucacuugaacccgggagguggagguugcagugagccaauauggugccacugcacuccagccugggugacagagcaagacuuugucucaaaaacaaaaaaaaaaaaagauggccgggcgcaguggcucacgccuguaaucccagcacuuugggaggcugaggcggguggaucacaaggucaggagauugagaccauucuggccaacauggugaaaccccauuucuauuaaaaauauaaaaauuagcggggcgugguggugggcaccuguaaucccagcacuuggggaggccgagacggguggaucaccugaggucaggaguuugagaccagccuggccaacauggugaaaccccaucucuacaaaaaauacaaaaaaaauuagcugggcgugguggcguaggccugucaucucagcuacucagaaggcugaggcaggagaaucgcuugaacccaagaaguggagguuguagugagccgagauugugccacugcucuccagccugggugacagagcgagacuccaucccccaccgccccgcaaaaaaaaaggaaaagagaaagauuuauuuuuugaaccucugguuugugccagguaccauauuaggcccuaaagauaccagagggaacaaaacagaccucaugaaacugauguuuuagugggggcagacaaauaguaaauaaguaaacauccaugagauccauuaugaugaguguuaugagaagaauaaagacuggaaggaaaaugggagaauguuggggaggguuaguuugggauaaggaaggugaggacagggcaggccccaacugacaaggaaacguuugaauaaagagccuaaggaggcaaggcggggagccgcaugggugucuggggguaagaguauucaaggcagagggcacggcugggauugaugcccugagaugggagugguuuuccauauucuaggagcacugagagaccaauguggcuguagugagaucaaucggagggacauagggaagagaggaauccuaaggggucaggucagagacggcuuccaggguuuggagugugauggggcaccauuguaagauuccaggcgggaaguuuuccucuggauacuccauaccuuugaaagaccccagccucaaguucuaagcauguggugggaggcucccaccuggugcaauccccgccucagcuccugagaaacuccucauguggcauuuccugcuugccucccacuugggccccacagggagaugcgcuggaacaagggcaccauccugaaggccucuguggauuauauccgcaagcugcagaaggagcagcagcgcuccaaagaccuggagagccggcagcgaucccuggagcaggccaaccgcagccugcagcuccgaauucagguuugaaaagaggagaugguggugggggaagagggggagagcuuccugcagguggaggcagagagagagcaggccaggguuucccuuccuggcauacuugggggaucccugggcuucccagaucacacgaugaugauagugauaaugauaaauaauaaucauaauauuaacaaggauaauaauauugcuaauguacauagcauuuaucuugugcucuguacugugacaagagcuuuauauccacuaacuuauucaauccucagaauucuaugagauaggggccauuauuuuauuuauuuauuuauuuauuuauuuuugagauggaguuucgcucguugcccaggcuggagugcaauggcgcaaucucggcucaccgcaaccuccgccucccggguucaagcaauucuccugucucagccuccugaguagcuaggauuauaggcaugcaccaccacacccagcuaauuuuuguauuuuuaguagagaugggguuucuccauguuggucaagcuggucucgaacuccugaccucaggugauccaccugccucggccucccaaagugauuacaggcgugagccaccgcgcccagccuaggggccauuauuauauacccacuuuacaguuugcgacucugaagcuucagagauguuaagcaccuugccuaaaguuuuggaacuagugaguagcagaagcugaauuccaacccagggaaccuacccuuuucaaccuuuauacuccucugccucugagggacucugaacccuacuuauccugcacccaaccccuauuuuuuacaggaacuagaacugcaggcccagauccauggccugccaguaccucccacuccagggcugcuuuccuuggccacgacuucggcuucugacagccucaagccagagcagcuggacauugaggaggagggcaggccaggcgcagcaacguuccauguaggggggggaccugcccagaaugcuccccaucagcagcccccugcaccgcccucagaugcccuucuggaccugcacuuucccagcgaccaccugggggaccugggagaccccuuccaccuggggcuggaggacauucugauggaggaggaggaggggguggugggaggacugucggggggugcccuguccccacugcgggcugccuccgauccccugcucucuucaguguccccugcugucuccaaggccagcagccgccgcagcagcuucagcauggaagaggaguccugaucaggccucaccccuccccugggacuuucccacccaggaaaggaggaccagucaggaugaggccccgccuuuucccccacccucccaugagacugcccugcccagguauccugggggaagaggagaugugaucaggccccaccccuguaaucaggcaaggaggaggagucagaugaggcccugcaccuuccccaaaggaaccgcccagugcagguauuucagaaggagaaggcuggagaaggacaugagaucagggccugcccccuggggaucacagccucaccccugccccugugggacucauccuugcccaggugagggaaggagacaggaugaggucucgacccuguccccuagggacuguccuagccaggucuccugggaaagggagaugucaggauguugcuccauccuuugucuuggaaccaccagucuaguccguccuggcacagaagaggagucaaguaauggaggucccagcccuggggguuuaagcucugccccuuccccaugaacccugcccugcucugcccaggcaaggaacagaagugaggaugagacccagccccuuccccugggaacucuccuggccuucuaggaauggaggagccaggccccaccccuucccuauaggaacagcccagcacagguauuucaggugugaaagaaucaguaggaccaggccaccgcuagugcuuguggagaucacagccccacccuugucccucagcaacaucccaucuaagcauuccacacugcagggaggagugguacuuaagcuccccugccuuaaccugggaccaaccugaccuaaccuaggagggcucugagccaaccuugcucuuggggaaggggacagauuaugaaauuucauggaugaauuuuccagaccuauaucuggagugagaggcccccacccuugggcagaguccugccuucuuccuugaggggcaguuugggaaggugauggguauuagugggggacugaguucagguuaccagaaccaguaccucaguauucuuuuucaacauguagggcaagaggaugaaggaaggggcuauccugggaccuccccagcccaggaaaaacuggaagccuucccccagcaaggcagaagcuuggaggaggguuguaaaagcauauuguacccccucauuuguuuaucugauuuuuuuauugcuccgcauacugagaaucuaggccaccccaaccucuguuccccacccaguucuucauuuggaggaaucaccccauuucagaguuaucaagagacacuccccccuccauucccaccccucauaccuacacccaagguugucagcuuuggauugcuggggccaggccccauggaggguauacugaggggucuauagguuugugauuaaaauaauaaaagcuaggcguguuugaugcgcuuuuaacuuuggcaa

SEQ ID NO: 18905 - RNA, 14916 nt, Homo sapiens
uugccaaaguuaaaagcgcaucaaacacgccuagcuuuuauuauuuuaaucacaaaccuauagaccccucaguauacccuccauggggccuggccccagcaauccaaagcugacaaccuuggguguagguaugaggggugggaauggaggggggagugucucuugauaacucugaaauggggugauuccuccaaaugaagaacuggguggggaacagagguugggguggccuagauucucaguaugcggagcaauaaaaaaaucagauaaacaaaugaggggguacaauaugcuuuuacaacccuccuccaagcuucugccuugcugggggaaggcuuccaguuuuuccugggcuggggaggucccaggauagccccuuccuucauccucuugcccuacauguugaaaaagaauacugagguacugguucugguaaccugaacucagucccccacuaauacccaucaccuucccaaacugccccucaaggaagaaggcaggacucugcccaagggugggggccucucacuccagauauaggucuggaaaauucauccaugaaauuucauaaucuguccccuuccccaagagcaagguuggcucagagcccuccuagguuaggucagguuggucccagguuaaggcaggggagcuuaaguaccacuccucccugcaguguggaaugcuuagaugggauguugcugagggacaaggguggggcugugaucuccacaagcacuagcgguggccugguccuacugauucuuucacaccugaaauaccugugcugggcuguuccuauagggaagggguggggccuggcuccuccauuccuagaaggccaggagaguucccaggggaaggggcugggucucauccucacuucuguuccuugccugggcagagcagggcaggguucauggggaaggggcagagcuuaaacccccagggcugggaccuccauuacuugacuccucuucugugccaggacggacuagacuggugguuccaagacaaaggauggagcaacauccugacaucucccuuucccaggagaccuggcuaggacagucccuaggggacagggucgagaccucauccugucuccuucccucaccugggcaaggaugagucccacaggggcaggggugaggcugugauccccagggggcaggcccugaucucauguccuucuccagccuucuccuucugaaauaccugcacugggcgguuccuuuggggaaggugcagggccucaucugacuccuccuccuugccugauuacagggguggggccugaucacaucuccucuucccccaggauaccugggcagggcagucucaugggagggugggggaaaaggcggggccucauccugacugguccuccuuuccugggugggaaagucccaggggaggggugaggccugaucaggacuccucuuccaugcugaagcugcugcggcggcugcuggccuuggagacagcaggggacacugaagagagcaggggaucggaggcagcccgcaguggggacagggcaccccccgacaguccucccaccacccccuccuccuccuccaucagaauguccuccagccccagguggaaggggucucccaggucccccagguggucgcugggaaagugcagguccagaagggcaucugagggcggugcagggggcugcugauggggagcauucugggcagguccccccccuacauggaacguugcugcgccuggccugcccuccuccucaauguccagcugcucuggcuugaggcugucagaagccgaagucguggccaaggaaagcagcccuggagugggagguacuggcaggccauggaucugggccugcaguucuaguuccuguaaaaaauagggguugggugcaggauaaguaggguucagagucccucagaggcagaggaguauaaagguugaaaaggguagguucccuggguuggaauucagcuucugcuacucacuaguuccaaaacuuuaggcaaggugcuuaacaucucugaagcuucagagucgcaaacuguaaaguggguauauaauaauggccccuaggcugggcgcgguggcucacgccuguaaucacuuugggaggccgaggcagguggaucaccugaggucaggaguucgagaccagcuugaccaacauggagaaaccccaucucuacuaaaaauacaaaaauuagcugggugugguggugcaugccuauaauccuagcuacucaggaggcugagacaggagaauugcuugaacccgggaggcggagguugcggugagccgagauugcgccauugcacuccagccugggcaacgagcgaaacuccaucucaaaaauaaauaaauaaauaaauaaauaaaauaauggccccuaucucauagaauucugaggauugaauaaguuaguggauauaaagcucuugucacaguacagagcacaagauaaaugcuauguacauuagcaauauuauuauccuuguuaauauuaugauuauuauuuaucauuaucacuaucaucaucgugugaucugggaagcccagggaucccccaaguaugccaggaagggaaacccuggccugcucucucucugccuccaccugcaggaagcucucccccucuucccccaccaccaucuccucuuuucaaaccugaauucggagcugcaggcugcgguuggccugcuccagggaucgcugccggcucuccaggucuuuggagcgcugcugcuccuucugcagcuugcggauauaauccacagaggccuucaggauggugcccuuguuccagcgcaucucccuguggggcccaagugggaggcaagcaggaaaugccacaugaggaguuucucaggagcugaggcggggauugcaccaggugggagccucccaccacaugcuuagaacuugaggcuggggucuuucaaagguauggaguauccagaggaaaacuucccgccuggaaucuuacaauggugccccaucacacuccaaacccuggaagccgucucugaccugaccccuuaggauuccucucuucccuaugucccuccgauugaucucacuacagccacauuggucucucagugcuccuagaauauggaaaaccacucccaucucagggcaucaaucccagccgugcccucugccuugaauacucuuacccccagacacccaugcggcuccccgccuugccuccuuaggcucuuuauucaaacguuuccuugucaguuggggccugcccuguccucaccuuccuuaucccaaacuaacccuccccaacauucucccauuuuccuuccagucuuuauucuucucauaacacucaucauaauggaucucauggauguuuacuuauuuacuauuugucugcccccacuaaaacaucaguuucaugaggucuguuuuguucccucugguaucuuuagggccuaauaugguaccuggcacaaaccagagguucaaaaaauaaaucuuucucuuuuccuuuuuuuuugcggggcggugggggauggagucucgcucugucacccaggcuggagagcaguggcacaaucucggcucacuacaaccuccacuucuuggguucaagcgauucuccugccucagccuucugaguagcugagaugacaggccuacgccaccacgcccagcuaauuuuuuuuguauuuuuuguagagaugggguuucaccauguuggccaggcuggucucaaacuccugaccucaggugauccacccgucucggccuccccaagugcugggauuacaggugcccaccaccacgccccgcuaauuuuuauauuuuuaauagaaaugggguuucaccauguuggccagaauggucucaaucuccugaccuugugauccacccgccucagccucccaaagugcugggauuacaggcgugagccacugcgcccggccaucuuuuuuuuuuuuuguuuuugagacaaagucuugcucugucacccaggcuggagugcaguggcaccauauuggcucacugcaaccuccaccucccggguucaagugauucuccugccucagcaucccgaguagcggggauuacaggugcgugccaccacgcccagcuaaauuuuuuuuauuuuuaguggagacaggguuucaccauguuggccuucaccuccugaccucgugauccgccugccuuggccucccaaagugccaggauuacaagugugagccacugcaccuggcuaauuuuuguauuuuuuaguagagacgggguuucaucauguuggccaggcuagucugaaacuccugaccuuaggugaucgaccccgccuuggccucccaaagugcugggauuacaggcaugagccaccacacccggccaauaaauaaaucuugaauaaauaaaggaaguaccauugcaccacugcacuccagccugggugacagcgugagacuccaucucaaaaaaaagaaaaaaaaaaaggaaguacuaagugaacagaaaaguaggugcauauauccuacggggaccagauggggcacacagaccauaacauuaugugccuaaaauuuuaggugcugacauagugagggucugcaacccugcucaggcugagaaagaaccagacagaggagaaaugccugggccgagacugccuggugagcccaccaaggcacaauuuuaguagcaugggacgccugccccaccucccgcuggccugagggucccagcccagacucacgggucacuggacuuagggaugagagugcccaguuccuugauccugucguuaauguugaaucgccugcgacgcucaacuuuggagaggggaggagaggaagaaagagugggagaaagaguugucaauuagccaaaaauggaagagacagaaaguagggaguugggaggcuguugcagggaaggaguuccccauggggggccaggacucggggugaggcaggccugcacagcacccgggcaaugcacacgcucucuggcuuacuuagguugugauugucuuucuucugccguuccuucaaaagggccuuugccucggucucuggaaaagaguggagugaucagggccucugagcacaggaaggcaagaaacacaugcagauacuaagguaggguuugguagccaaaagcaggggaaaugccuuuuuuaaaaagugccuucuuuuuacuauuuuaagccauggugauaggcugguuguuaaauccaagacgagaggaacugaaguggggugaaagcaagaccacaagccauagggggaaaggggacaaacagccuccauuuccauauguccaaaccauuccccucagaaucaggcccaucucuagaccugguaggcacagggcucaccugggguaaaguguagggccauggggccaagacccuaucaccuaccagagaucucccguuugauguugggcagcucagcugggcaggaguugcugacagugauggcugguguggccacgccuugacuacuguacacaucaagcagauucccugacacaggcagcugggggcagagagggcagagaaccaccaguugggaacaaacccaggcuuggcuccuccucagaaccagguuccugagcuuccacauaucccaaagauggggcacccucuaaugcaaggacuggcugacucagcaccagaacccuugcuucuccuucaaggcaaauucacauggcgaccaaacagggaggacagagcaaacuggaccuaccuugcuucgcugggagacuggagccugccuggccugcuuaucacuuccuccagucccucauaucccucagugaccucuaaagccccuuucccaaaccccggggcuggcucugagaagaaaugcuggaaaaccacccuucucaggucuuugucggcucugaugggacauuccaguccguuagcuccucccagcacaacauuccaauccagcauucuuggaacacuccaacccaaucuucuccgaccuugguaaauugucaugacaacauucuauccaaaaucuggccuucuggagaauuccaaccuaaucuccagucuuucacucugaucaaguuguaccaucuuccacucugaucaaguuguaccaucuuccacaucagggucuccugcugcuguggaccaagguccugacuccaguaucuuccugcacauucuguucucucaggagauucuuauccaacuauucaauuagcacugcuuuaugucagccuaguuuuuuuuuuuuuccucuccuucacacuuuccuggauauacuccagaggagcacgucaaucuuaaguauacccagggccaggugcaguggcucacgccuguaaucccagcacuuugggaggccgaggcgggcggaucacuugaggucaggaguucgugaccagccuggccaacauggugaaacuccgucucuacuaaaaauacaaaacaacaaaaaaaauuagccaagcaugguggccugcacuuguagucccagcuacuugagaggcugaaacaggagaguugcuugaacccaggagguagagguugcagugagccaagaucacaccacugcacuccagccugggcaacagagcaagacucuaucucaaaauaaauaaauaaauaaauaaauaaauaaauaaauacaaauaaaauaaaguauauccaaaucccacuucuucaugaguuuuaaucucuuuuuuuuuuuuuuuuuuuuuuugagacggaguaucguucugucacccaggcuggagggcaguggcgcaaucucggcucacugcaagcucugccucccggguucacgccauucuccugccucagccucccgaguagcugggacuacaggcacccgccaccacgcccagcuaauuuuuucguauuuuuaguagagacgggguuucacuguguuagccaggauggucuggaucuccugaccuugugaucugcccgccucagccucccaaagugcugggauuacaggugugagccaccgugccuggcugagcuuuaaucucuugaacccacuuccagucugguggauauaaggucccauucucuaguuguguccaaaucaauaaaaaguucugauaaauuagucccauuuuuauacaugcuuccauccuauugauaaguuggaaaaaagcaaaacuacagccacuugguaugcucuaaagcaaguuaugagaccaggcaugguggcuaugucuguaaucccagcacuuugggaggccgaggugggcagauggcuugagcucaggaguucgagaccagccugggcaacacagugagacccugucucuacuaaaaaugcaaaaaauuagccaggcauggugacacaagccuauggucccaguuacuugggaggcugaggugggaggaucacuugagcccggaagguggaggcugcagugagccaggauuacaccacugcacuccagccugggugacagagcaagauccugucucaaaaauaaauaaauaggccgggcgcaguggcucaagccuguaauccgagaacuuugggaggccgaggcagguggaucaccugaggucaggaguucgagaccagccugaccaacauagugaaaccccgucucuacuaaaauacaaaaauuagccaggcgugcuggcgggcaccuguaaucucggcuacuugggaggcugaggcaggagaauugcuugaacccaggaggcagagggugcaaugagcagagaucgcaccauugcauuccagccuggacaaggagagugaaacuccaucucaaaaaaaaaaaaaaaaauucaauaaaaaaaaaaaaauaaauaaauaaagcaaguuaggccaggcaugguggcucaugccuguaaucccagcacuuugggaggccgaggcaggcagaucacaaagucaggagauugagauaaccuggguaacacggugaaaccccgucucuacuaaaaauacaaaaauuagccgggcaugggggcacgcgccuguagucccaguuacucaggaggcugaggcaagagaaucgcuugaacuugguaggcggagguuccagugagccgagauagcaccauugcgcuccagccugggugacagagcaagacuuugucucaaaaaauaaauaaauaaauauaauaaagcaaguuaugagacucuuggaguguucaaaaccagaauguuacaaugguauaucccuugcucuagaaaguuuuaucuacugacuagaaggacucugccuccuggcacaguucacuugguauauuccaaucacuacgagauccaacuacuuguuauaacccacagcaaguuugaaaacuuuuguuaugcuucaaggccaggugugguggcucacaccuguaauuccagcacuuugggaggccaaggcagguggaucacuugaagucaggaguucaagaccagccuggcucacagggugaaacccggucucuacuaaaaauacaaaaauuagccaagcguaguggcguacaccuguaaucccagcuacgugagaggcugaggcacgaaaaucgcuugaacccagaggcugcagugagccaagaucgcaccgcugcacuccagccagggugacagagugagacucugucuuaaaagaaaaaaaagguaaaaauaaaauaaaacaaaaugcuccaaucauuacauggucugguguauaugucccgaugaccugaaucccuugguacauucaaguugcuauaagaugcucaucucggccgggugugguggcucacgccuguaaucccaguacuuugggaggccgaggcaggcagaucacgaagucaggaguucaagacccgccugaccaacgugaugaaaccccgucucuacuaaaaauagaaaaauuagcuugguaugguggcacgugccuauaaucccagcuacucaggaggcugagguaggagaaucgcuuggaccugggaggcagagguugcagugagcugagaccgcgccacugcacucuagccugggugacagagcgagacuccgucucgaaaaaaaaaaaaaaaaaagauuaucaucucuugguacuucucacagcaaagcccaagcacuuugauaugcccuacugucucagugaacuccccaccuguaucucucacagucuacaugguccaccucucaacacaguccaacaagguccaaaggcauuguugacauacccuguucucgucauaaggccucccucucuaucuuagcacaaucaaggcaagggucuccuauacacacagccagacugaguauggucuuggugauacagaaaugcccuaauuuucagaccaaccucccaucucagggccucaccgugcuggggagcugcaguccuguggugccuccgggcagauagcugagcauuucaucauuguaacuggacuccaggcugaugaucucaucaaugacaucaucaaucuaggggaagaaguaaauauuauacagguuuagaagaauuugggaggggaaugugggaggagguuuggcuguagccucuuaccuccuucucugagcuggacccgauggugagcagcgccauggggcuguugggcgcacugccuguggggccgguagugugggcagccucaggggcaggcaguggcugggcacuugcgggccccggcgguggggugagggccugggaagccagcuugggcccgagugugguggacagguacuguuucaccugcugccggcgcgccugcugcaggugguagcgcguuggguucuccagaugggucugcaccugugaaauaagguagacaaggaaagagaggggacaaggcagaacaggacucaaaggggugaauucugagccccagccugacccuccuaacucauuggugccuagacucacgcagacaagcugggcccagaaucugagaacaccccaaaaauauuagcgagucucccccaggacccaaacucucuuucucagaaauccuucacagcugccaagauccacccaugacugacaggaucccucguaguuucuggaaaacccugucacaguccccaagauuccccaccuagucucugacaccaccuaauagaccugggaaccauacaaugcuucccaagacccccuaauggccaaagaacuaauguaucccacacacaugaagcucuuccuacaaagccagggcccacuuggggcacucaugagccuccaugguccaccaagacauccucauggcccccacgaacuccucgcaauuucacaagaucaucucagaaacccaaaacacaugagacaugaacacagauaauuuaaacaguaccagggaccuuccuuagagccccuaagaccuugcccccaaaucaccagugcaucgaggccaucccuagcuccuaggaucacuccucagucaccaggagcccccucccagggccucuggaucucaccuuaccuugagcaccucccugggcaccugagcaggggguggacggcucaauguguggcccccagcagagacgccaaccacagagauggcaggagaggcaggugcaggacuggggaagggagccgcggcggccuguucccgacgcucacgccucuccugcuccugcgccugggcccgcauuagcugcugccgcagcaagacccucgaugaagaagaugacgacauggcagggguccuggagcccccugcagaagacgaugcagagaguguagcugggguggcugguguggccugcagugauauugggaggcuguggaaugggaaauauggggccauauuuuagguaagcuaaaagucucaucccaagccuaaagggucuuagcgugacggagcagacacaggaaccaggccuguucucugccuuccgaggccacaauguagaagcagagacacaggaaccaggcuuggugauggcucucaggggucacagucugaugggggacacacuggaggucagucuggugggggaguuuuagccuuugguccuuauggugaagccuagauuugagccuguucacauauuaaguggagaugcuauuguucagcucugcaaggggggguuuguccuauuuacaggagagcagaagaagcagaauugaggcuuuggcagcagaauguggauacagagggcuccuaagcccaaugugaggcuagagaagcucucugagcuccugggggugggcgucaggugauaggagaagccccagguuccucuucuuccccugccugggccucuggucccaggagcuagucagucuugaaaaccucggagauuucacaauacucucuuccugccccucuucccccuccccuccccucucucagagcccgggccgaugacucagcacauuuagacuuccaagcuuggggaaagaagagaccagcaggggcuccucaagggcugagggugggugaguugguagugugggaagggacugaguuggggcuagaggcauguccccgcccacccggggacaugaguuuaagcaggccacgcccuaucucugagcacuccaggccggcuggaacaccugaggcugaaacacuugcauaugaaugggugugcaggugggcugggggcaggcaggggaggucuugacagagauacuggaauccuagcuuggccaccuacuuuccugugugacaugcucuuucuggucccuaauuuuaccaccacuagaaaacgcaggcuggugaaagaauggguugggcugguacugagggccucugcccaucaagaggggagaggagggcugaggaauugggaggggaaucagauagacaagucauacauaccuugagcgaagggguaaggguuggcuuuugagcucguagaagcugucaggaucaaggacguuuucuaauucuaugucagcaacaaucccggauuccggaagcaaagaguucaggcugagggggagguggagugguggucagugauugaaugaaggaccuuauuccccagcccuccccugagacagagaaagagacagagagcgggggagaacgaagaggaggguacaagccccucauauuuggccaccuugcuggguaccacaccaccaugaauucccaccuccuucccccaucccccuuucccuuccccacuguguuacucauagucccuuaggagucagaauaauaagaacgccugcaucccaacccccacacuguaacaaccuggguuugaggaaaacagaauuuaggaauaacaauucacuuuauagaaggauuccugacuuccuauucagaguucucccagcccccauacccccuacuuuuuuuuuuuuuuugagacagaguaucgcucugucaccaggcuggaguacaguggugcgaucucagcucacugcaagcucugccuccuggguucaagugauucucacgccucagccucccgaguagcugggauuacaggcacacgccaccacguccggcuaauuuuuguauuuuuaguagagacgggguuucaccauauuagccaggauggucucgaucuccugaccucaagauccgcuugccucggccucccaaagugcugggauuacaggugugagccacugcgcccggccaacccccugcuauuuucuuuacagcugaaugugagcccagguauauguguguacacacacacacacacagagcaaguaggggcaucccucagcauaacagucccuuguaacacaaacugaaugcaucacaaagagaacuggaaauaauucacuugacguaaagaucuaccauuucacaaaugaguuucucccagccccagccagaguucaugggaugccaacacaugccuaaauauaaaauagaaauaucaaaggcuccccucgcuccaacagacuggauuuacaagagggagaauuugggugguugauccacuuuauacaagcauucuuuucuuaccggaggagccugcccagccuucuccuguuuuuuuggauagaucaaaacacacacacacccccaacacuaacacccacuggcgcacaaaauaagaagccauauacacccaucccuuuaacuauguccacuacugcgaugaucuagguuguuacagaggaauuagaagauggugaaucgauauacagaaaggcucugcucagccccagagagcaagggacaguuaacacacacguggaugaauaugcauccuucaauuuagcuaaacauuuagaaugcugagagauugcuggugacuucacuugacaagaauccucuccccuccccaaggaucugucuuccuuccucuccucacccucagauggagcccuaaaaccacccaggaaguugggaagaggaagcucgggcaagccacugagcucagcacaaucccaggcacaaaggaggcaaagaccccccccacccagggcucacacacccauugcacagaaguuggaagagaugggcacuggggugagcagggagggcuggggcuccaaagcccauugaugaaaguaaggaugagaagaggccagaggggauccacccaggcagggauggugcaaucuguacucguuccagcucuauggacagauucaagauuacccccaggagcucggagaucgaaaagaagauaaaaagaaaagggguguggggcuagggagugggaagggcugagaggcuagagcgaguagcagcaugaacaagagccuccucuggguucccaaacaaggucugaggccucugagcuaagagguaacaucaucgcccucugccuggcugucuaucuuccauucaggcccuuaacaggugugggaagagggcuuuuccacuauccuugggaucugccccagcuggguaggcgggcagaggggaaaggauuauucuggucaagucuugcugaauguugcuucucuuguucauucacacgcacucacaaggcuggucccaggcagcauaucugagauaccuccaaaucccuccagauucauguuauccccaaacacagcaaccagucacugagaggcaccaagcucccaagacagcacuucugucccucaggaccccuucucccacacugagggaaaaaagauucuaggauucccuuaaaaccagugccucaccugacaguguccccucaaauucauuccccucauguccgacugaaaauccccgaauucagccucuaaucagagacccugucuaccaaguucagcuaucucagaccaguuucuggauacuccagaauaggccccgcuagacgcagucaagggcuccccaaaccugacccagaccccgcuuaaugcacucccacgacuccuuuaauaaagccacaauccaagcaggccacugccggauuccuuaggugcccccccaagacgggcgccccgacguccuccaaggcuaggccgagggccuccaaucccaguccggggcccccgcugcccccgagaucaggccccugggagccccagucggcacucccagccccaggcggccccgcaccugagcagcugagccgagucggccggccugcgcuccuccaacagcacgaacacggcucgagggcccuccgcgcuggccucuacgccaucccgagcugguucggccgcaugagacaugacgcccggccccgggcgagcccugccaggccggucgggccucggcccggucccccuaacaaaauaagaguccccccuccccccagcucgccacugccgccuccuccgcuaagccauggagcuagcacugcgcgggcgggcggcgucugggagaugggaugggcugugagucaucccccgcccagaacggaccgacgcccccccucaaccuaaccccggacgaccgcccuccucccccucgucuucuucccccuccucccuccucccagggauggggaaacuccacaggaagugaccgcacuggggauggauggcccgucuggccacgacccauuagcgaggcggccaaucgcugaacggcgauucgagggcccacccuaagcgacgccuccgacgcggag

SEQ ID NO: 18906 - RNA, 28775 nt, Homo sapiens
agucagugggugggcccgucuggccagaugguauuuuggcugcauagccuuuacacacacacacacacacguguugcuagaacgcugaacauggaccacacacccacccagcauccccaaucccaaaugcagaguagccaggcuccagacauaaauuaaaaaauaaaauaaaauaaaauaaaaaagaguuggucucugggaaggagagcucaugcagagaugaagacagaagcccuugggagccaggaccaagaagaaggagaaaucccugccccuucccucaggauccccacucccugguggccucugcccuaagacaggaucauuaacacuaaccaucaggccucuagccccuuuaauguccagucucccaagcuauuugauuuuggcuccagcccucauuuuuccaccacagcccaagggaauagcauccuaggggguaggaaggggaggaggugggugcagccugcaggucuuuagcugguuucuccuggcucuaggucugggucaggaggccccacgcacuccuugcugagccgcacaauuuccugggacagaacuuccauauccuaagaaacaaaugaaccaucaggggccagagaaggggacaggcugcucccuugccaaacguaggguaucaucugugauuucccucacacccuuucauuaaucaaugcucagcugugucuggccugggaugagaagguacuuggagaagcucacagcacccccaacagugggcagggcucagaaaagucaugaggauggguggggagcuacagauaaugggagugggaugccuccuguggcauggugcugcugcaggauacaccaccacucuggccaccugcucuucuaagugugagcuugcuucucaaaggcaggagcugggucugaccccuuucuaacucucagagauggggaaaguccuuggguggcaguuugggcagaaagauguguguguggacccaugggcaugggggaucuaugguagacaaauugguggacgaaugaauuguccagaggacagauggagaucaacaggugggcaggcagguaacugggugggugaaagguaacacaaggggcaauugaugaguagauaagagaaugauaugucaagaaauggguggcaggacaugggguagacaaugagauaaguaaguaguagauuggguagauggacagaugggcaaaugguugggugaauguguagauaaauggaugagcggguacauggaaggaaugaauggauaauaaguugaugagaggguggaagaugagagcaugauggaguaguugaugaguggguaggaggauagcugggaggacaggcugggugggugggcaaggggacuggcagaugacccaggggcuauguggcuggguaggcagguggcugggugaacagauggguaggcuggcaggccacacuugccuugugcaagugcauauucuuggugagcugcuccuccagcauguucugcagcuucuuguucaucucccgaagguucucgucgccuggcuucacuaggucucucaggacgcugcccagcccgcugcggucuguguggccugcugccacagacacaucugcaagggcccaggcugaaaaccacccccucggcagagccagaggagagccaggcagagccagaggagaaaagagggagacgaauaccaggggagaaggcagcaggaaaagccaugucauguaggacagaggcuuugacauacaaaaccuagcucugucacucacuagcucuauggccccgagaaaugaggauaacuaacuuguggaacuggaaagaugcacaugacuguaugugaagcacagagcacacagaaaguccucagcacauguuggucaguaugauucugauuaauaaagaaaaaucugugaaggagaaaguuugaaagaaagcaaaagcaaugaagauacagagaaggaaaacaauauagacagcgagacaagaugaaggaguggggugaaaaagagaaacggagaagagagaagggagagagagaggagaggaagaugaggcacagggagaggaaaggagaaaguggacagagagacacaauggagaauggagaguggagagaugacagagaaagagagaagagggaggaggcgagaucaagagacagugcuuuccuguucuccccuccacaggccauggucuugucaguagcuucgcugaguuccgagaggagaggagagaagccgcagcacagaauggagagggagggccaggugaaggcuggaccagggcugagggccggggaggggacacugaccgauccggcuguccaugacguaggucucaaugauggcgcucuuccggcagagguccucugccauggaagcacugcucacuuccaggugcuucaccugcaagauggcccagcccaccugagaccccucuacuguacauguucacacaugaggcgggcccgggcagaccccacacccacaagggcacuucaaguggggaugggcaggcaggcaggcaggcagcaccuucuccuccagcauccauuucuccugcugugucucugccagccgcugaaagagcucagccacuuccucaucugacagcucugcuggccgagggggcugggcuugagggcugcuggauaaggacugcaggaaagagaaggggagaggccagccccgggcucagcaccaccgaccccagacaggugucagggacuggggaggagaaccaggccagaggugggugagagaacaugggcccugaagcugggacuguuggcccaucuugguacccucagacucuguuuucuccucugccuaaauggggguagagaguaaccacaucagagccuuguggagaggauugaaggaagaucccaaagcaaaugagaucuaacuuucagcugacaggaaaacuggaagagagggacauguuaaaucauaccaccaggaagccagcagaaaaacccaaaagguagcauacuuccuguggggugacugggcuggccucuucaacaaauuggucucaggaaaaaagggaccgcacuaaagagauuuaagggccauaaaacaaccagauguaacaugugcucugaaucugaaugcuaguuuucauaaaaccagcaagaaaggacauucuggggccaacuagagaaaucugguuaaggucaaaguaucagacgacaugaauuuuuuuuuuuuuuuugagacagaauuucacucuuguugcccaggcuggagugcaauggcaagaucuuggcucacugcaaccuccaacucccaggaucaagcgauucuccugccucagccucccgaguagauggaauuacaggcacgcgccacuacgcccagcuaauuuuuguauuuuuaguagagaugggguuucaccauguuggccaggcuggucuugaacuccugaccucaagugaucugcccgccucggccucccaaaguacugggauuauaggcaggagccaccgcacccagccaaugacaugaaaauugaucaaauugggaagguagagacaacaguugaauaaaaaacagguuaaucucaucuagguuuuaaaaagagagagaauucuggaaggguaugaacuaagaauuuauuuuauuuauuuauuuuuugagauggaguuucacuguugcccaggcuggagugcaguggugugaucucggcucauugcaaccuccaccucccagguucaagcgauucucuugccucaaccuuucgaguagcugggacuacaggcacgcaccaccacgcccggcuaauuuuuguauuuuaguagagaugagguuuugcuauguuggccaggccaguucucaaacuccuaaccucaagugaucugcccgccucagccucccaaagugcuaggguuacaggcaugagccaccgcgcccagcccugaacuaagaauuuauaauggugacgucuggauggugaaaauauuauuuuuuuuugacauuuaagguuuuuuuguuuuuguuuuuuuuuuaaauagagucggaguuuuaccacauuucccaggcuggucuuaaacuccugagcucaagugauccgcccaccuuggccucccaaaguguaggauuauagggaugagccaccacacccggccagacauuuaagguuuuaaaaaaaucuuugcucauuugugguuuuuaaaaaauguacuacaaugagcacauacuauuuguggaacaauaaaaaaguuauuuccaaaggaaaguggcugguaaggaggcugacaugacagccggcaauaauaauuagugaucauuacaaguuggaaaaagggaccuucuccuuggauggugcaccuacuaugagccacauaauuuauggcaccagagaagggggaauuagcccacagaugauuaaacagaaagucagagagagagaaugacuggccuguccugcaugucgcaaucugaauccaaguuggugggcuuggggaaaaguugacaagaaaauaugugugcugcgcccaaaguaggagauggguuuaggugaggagaaaaggggagggguucucagauuuuuggguugagagaagcuggagcuguagguucuuccuuuccccuuacccuggcuggaacagccgagcucuccuuuucccgcaagaucucccgguagcugaaggaggagaugcuacugcuguccccugucuggguccggcuuggugaguucaucucugagagaaccagcuccucaaggccugggugguggagggaagagaaacuugagccccaguaccccugagucccagggcagcaaccagcaggaagaggcagaaauagauuuaacagagauggaaagagagacaccugggcauggggaaaggcagaagcagacaggaggacagggagagacagagacagaaaaaagagcugaggcugggcgcacuggcucacaccuguaaucccagcacuuugggaggcugaggugggcugaucacuugacgucaggaguucgagaacagccuggccaacaugaagaaaccccgucucuacuaaaaauacaaaaauuagccaggugugguugugugugccuguaauuccagcgauucaggaggcugaggcaggagaaucgcuugaacccaagcaggcggagguuacagugagccgaaaucgcaccauugcacuccagccugggugacagagugagacucuugucucaaaaaaaaaaaaacaaaaaacagaaagaaaagaaagagcugccuuucuggagaaacacauacaaaaugagagggagaaaauggaagagguuggagaaagagaacgacauggguacacaugggucucaaguggcagacacacuuggacacaggguucagagaaaggaagacagcuagagagggcacagggcacauccacuugcagaaagaaaaugccagagauggaaagccagagcagaugauagaaacugagacccuggugaaagaagugagccagagcagagacagagagaaaaaaagaugccgggcgcgguggcucacgccuguaaucccagcacuuugggaggccgaggcgggcagaucacgaggucaggagaucgagaccauccuggcuaaaacggugaaaccccgucucuacuaaaaauacaaaaaauuaggugggcgugguggcgggugccuguagucccagcuacuugggaggcugaggcaggagaauggugugaacccgggaggcggagguugcagugagccgagaucgcgccacugcacuccagccugggcgacagagcgagacuccgucucaaaaaaaaaaaaaaaaaaaaaaaaaaaaaaaagaugcaagcaggcucucguacccacgcaccuaaaucucaguuuaaucuaauggacaaggugaauguauugaauguaugguauacgauuguaacguuucccaagauuauuauuauuauuauuuuuuagacagaguuucagucuugucgcccaggcuggaguacaauggcgcaaucucggcucacugcaaccccugccuccuggguucaggcaauucuccugacucagccucccgaaguagcugggauuacaggcgcccgccaccacacccagcuaauuuuuuuguauuuuuaguugagacgggguuucaccguguuggccaggcuggucuugaaccccugaccucaggugauccacccaccuuggccucccaaagugcugggauuacaccuuucccaagauucuuacauucaucugugauaaaacagaaacaaaacuccuuuuuaaagaaagguuacuucaggagaccgagugccucagagagaaauugauuuggugagagauacacaucuguuuugccacaucacuuaaagcccucgaggaucucuggcaaggguggggugacugaguggggauccguagguaucccgagugggggaauaagggaccaaguuuucucugagucuguaaucuaagagaugcaccagagccaucacugcauuuuacuuacuuaaauguauuuauaggccauccccgucuuaaaaaaggcugaagcaacuaaaguugugugugugugugugugugugugugugugugugugucuucugcuugaaguggcagaaauaacagauuggauuagcuguauaaugaaaacaccacagcguugcugacuauguauaagucugucuccguagcucaacugggggcuucuagagggcagagacucagggaguuuuauaucagggacccuguacuugagcagggagauuuauagaaugagagauuguauacaauagauuuagaaaugccaagugaggugugggaguguguaauguaguacauacagugaggagacagacagagauauaaacagaagagacgaagaggacacagaguggcgggaagagauaaagggacagagaaaagaaagggcgggggccgggcccaguggcucaugccuauaaucccaacacuuugggaggcugaggcgggcggaucaccugaggucgggaguucgggaccagccugaccaacauggagaaaccccgucucuacuaaaaauacaaaauuagcugggcgugguggugcaugccuguaaucccagcuacucaggaggcugaggcaggagaauugcuugaauccaggaggcagagguugcggugagccgagaucacaccauugcacuccagccugggcaacaagagcgaaacucugucucaaaaaaaaaaaagagagagaaaaggagaaaacuagagaaagaaagcaaggagauaaaggcaaacauagaggaaagagagagaacaaacugagacagaggcagagacagaaacagagaagagacagggcaaaaacgagagaaagauagaaauaaagagagaaugcagagaaagaaucagaggagagacagagaaaagguaaaagauggaguuccagagcgacagaagcaggaaagcacagcugaggaagaggcaggacuaaccugcagccugcaggcccaggcccuaccucccccaugccucagccuccucucccuguccuagucccucaccugagcggcucuugcuguuagugaggauguccugcagucgcuccugcagcuuaucugcccguuuccgcuccaaaugcagcugccgcuugagguccuugagcugugggggacagggguaacaugaggacugaggcccagugggcccauaggagggaggcuacagguaggagggagccgugcuugggcaccgcucugucuuaccgcagcacugcccuucuucuccaggauccucugcccauccacuguguccuucaccuccugugggagaaagcaggcauggcugguagaugccggaagggcugccugaagcaugcucccucccugccccuccuguacgcugaggaucaggggugugucuggggcugugcagugaccacugaccugcuucaggcugcuaauggucuucagguggcagucccgcuccuccugggccugcucgagcugaucccguacauccuguagcuccuccuccuugcccugcaaagcagaaagcagcuuaggcauuggcuugggaagccucuguccucccaggagggcccgucacugucuggagagaggaacaccaucaugcgagaggcaccuucagcucggcagcgugcugcucccgacacugcuugagggcuuccucuuguuccugcugcugcugcugcagggauuccuacaagacaagucccaggucuggccacagccccccagaagguaucaugcccaguuagggguaugagggacugcaaugggggcccagagguaugcagaaaugacccuccugcagggaaccccacacgcccuuaggcaauaugcugaagugucacaucuaaaguugcaccauucgcaugguugacuuagauuugcauuuacauuuuauuuuauuuaacaaaacauagcgcuuacuacaugccaagaauguucuaagaguuuuacauauauuaacucauuuucuauaauccucccguaauaccuagaugguagauauuauuguuacccccuuuuuaccauugaugaaaacaggccacagagaggucagauaacuugcccaaggucacacagcuaggaaauggcccagccaggauucaaaccuagacaaacaacuggcuccagccugugcucuucacugcuacaugacaaugccuuucaguguauuaugagauuuccagaaaauggcaacaaagguucuuuuuccgagacagagucucacuccgucacccaggcuggaguacaguacacgauaucagcucacugcgaccucugccuccuggguucaagugauucuucugccucagccuccugaguagcuggaauuacaggcgccagccaccaugcccggcuaauuuuuguauuuuuaguagagacaggguuucaccauguuggccaggcuggucuugaacuccugaccucaagugauccgcccaccucggccuuccaaagugcugagauuacaggcgugagccaccgcacccagcagguucuuguucaauaacaucaguguauugcauuaauuuccugacagaaguacaguuucaggagaaagaggugccuuuccaaauuugcacaaaggcagggcagccuuaacacgugacagucuguccuaucugauggccauccccugauccacuccagagggcugcuauugagccaggggacuguggggauaucccuaaguccagaaaaucucgggaaguuccagggccugaccacuccugcuucugugguuugacaugagggccccaaucagccucuguuccucaccaggcaucaccaacucaccucggcuuccuucaagcgccguucaaaccagcccuuggcuccauccauggaauguaccugagcuugaaguucuuccacugucugcuggagagucuccagcucccguguccgggccugggauggggcagacugucaugggccaggaaggcagaggagcgggcaccugaugcaugccacccacuggccuaucagcaacgcugugguucccagguuuuagaggaagaagggcaucaucaucuacccacccaccuucuccucccggaucugcccacggagcuccuccuccugacgcuucuugucuucaugcagcucucggagcucacgcucauagcgggcacgcacccccagcaccuccuucucaugccguagacgaacugcucccagcucuuccuugugcugggacuucucuugcagcguuuccauugcuagcucauccagcauggccuuccgcuucuccgcacucugggggccaggacgauggcagucaacuuccuuccacaacaucgaaaaaaggccuccaacccucuucccaugcccaaggaacuagccaaacuccacucccucccauccccacugaacuggcuaaggcacucacccauccuuauagaacuggucacuuucuuucuuuccccucccacucucauggauuuggccaagaaacuggucaaccagaaaccagucaauuuuccuuucccuccuauccccacauguuugguuauaucaccuccucccauccccauggacugagccaauuccuaccccccauccucucccuucaacccucauguuccccuaccuuccgagccuccuguaauuccugggucaacugcuccuucuccugcccuauuucuugaaguuguuccagcagucgacuauuggcccguaaugacuccuaaugcagacaccaaagggaaagaguuugauaaagagcauccaguaggugcuagucacccaggaccaucugguagaccaucucccuucucccugguaaaguugguauugugaucucaauuucuggauaggaaauauagcagagacugcuaguugcuccccaguauucauucuuccuuacuucccuagcaauaaaauuuaucaucgggcauacagcugucuagcagauguuuccccuccucccuuaugguuagguguggccaugugauuuauuucuguauguggaaguggugaguguaauuuagguuaugcucuuaaaggaaaggggcacacucuucccugccccuuuccuccuuccuuccagauagaauacaaacaugauggucggggaguuucagcaaccgucuuggaugccaagauaaaagucuuguguugaagguggaggaacagcaauggagaaagaaccugggucacagaugacuggaaagccaucauuccaucccugaauaaccuaccuggacuuuuaaugagagggaacuaaauuuguaucuuauuuaaucuacuauuauucugguuucuauuauggaaucagaauggauauugcuugggaggcugagccggguagaucuccugaggucaggaguuugagaagccugaccaacaugguaaaaccccgucucuacuaaaaauacaaaauuagcugggcguggugccaggcgccuguaaucccagcuacuccggaggcugaggcaggagaaucgcuugaacccaggaggcggagguugcagugagcugagaucgcgcuacugcacuccagccugggcaacagagugagacuccaucucaaaaaaaaaaaaaaaaaaaaaaaaggaggccgggcgugguggcucacgccuguaauaccagcacuucgggaggccgaggcgggcagaucacgaggucaggagaucgaaaccauccugguuaacacggugaaaccccgucucuacuaaaaauacaaaaaauuagccgggcaugguggcaggcgccuauagucccagcuacucgggaggcugaggcaggagaauggcgagaacacgggaggcggagcuugcagugagccgagaucacgccacugcacuccagacuaggugacagagcaagacuccaucucaaaaaaaaauuaaauuaaauuaaaauuuaaaaaaugaaaaagaauugauauccuaacuaacugaagaggcucaguuucagagaagugaaaugacuugucccagaacacacaggugcuaauaaguuagggagccagacuggaaccuagguccuccugacuccagucuucccacuccaccuuacuggggacuucacugggccauuacuagggaacuaggaagagacaggccagagccaaagguguuaccuggagcugggaguugaggucaucuuucugucccauaagguccucguacucagccugcugcugcugcaacucagcugccagcccaguggucuguucccggagcauauucaguucuugggucuuugcuguuuggaucuggagaaaguaguggugaugagaaguagagugaaagggaccccaggggccagggacaggguaugagcccccuaguuccagggaaacagggagggaggugggaagagaaccaggaagagagaggaaauuucaaacagaaaaacaaugaagagaauggguaaaugugguauguucauacaauggaauaccacacaacaguaagagaacagaucugugcugccacguggauaaacuuacauagugcugccagaaagaagucagagacaaagagcagcugauuccauuuauaugaaguuaaagaacaagcgaaaugaaucuuauguugcuagagaucagaauaaugguuacuucugggggaguacugacuuugaagggguaaaggggaccuucugggguacuaaaagugcuuuauacuuugaucugggugguggcuaugguggcggggagagagagagaaaaaaaagagagagacgaagagaggauucacugaguguacacuuaagauuaguacauuucaugcacuuuacuagagagaaacuagaaacaaagaaaagcagaagccgggcgcgguggcucaugccuguaaucccagcacucugggaggccgaggcggguggaucaugaggucaggaguucgagaccagccuggccaagauggugaaaccccgucucuacuaaaaauacaaaaauuagcugggcaugguggcacacggcuguagucccagcuauuugggagggcugaggcaggagaaucgcuugaaccugggaggcggagguugcagugagccgagaucgugccauagcacuccagccuggacaacaagaccgaaacuccgucuacaaaaaaaaaaaaaaagcagagauaggccaagcacaguggcucacaccuauaaucccagcacuuuggaaggccgaggugggaagauagcuugaggccagaaguuuaagccagucuggguaacauagugagacccugucucuacaaaauaauuuuguuuucucuuuuuugagauggagucuuacucugucacccaggcuggggugcaguggcacaaucucggcucacuauaaccuccaccucccagguucaagcaauucuccugccucagccucccgaguagcugggauuacaggugugcgccaccaugcccagcuauuuuuuuuuguauuuuuaguagagacgggguuucaccauauuggccaggcuggucucgaacuccgaaccccaggugauccgcccgucucagccuuccaaagugcugggauuauaggcgugagccacugcgccuggccuaauuuuuguauuuuuaguagagacaagguuuugccauguuggcuaggcuggucucaaacuccugaugucaggugauccgcccaccucugccucccaaagugcugggauuacaggugugagccaucaugcccggccaauaaguuuuuuuucguuuuguuuuuuguuuuuuugagacagaguuucacucuuguugcccaggcuugagugcaauggcacgaucucggcucaccgcacccuccaccuccugggcucaagcaauucucccaccucagccucccgaguagcuuggauuacaggugcccaccaccacacccagcuaauuuuguauuuuuaguagagacgggguuucucuauguuggucaggcuggucucgaacuccugaccucaggugauccgcccuccucggccucccaaagugcuaggauuacagaauugagccaccaugcccggcuuuuuuuuuuuuuuuuuuuuuagacggagucucgcucuguugcccaggcuggagugcaauggcacgaucucggcuuacugcaaccuccgccuccuggguucaagagauucuccugucucagccucccgaguagcugggauuacaggcacacaccgccacacccagcuaauuuuuuguauuuuaguagagaugggguuucaccguguugcccaggcuggucuugaacugagcucaggccauccacacaucuuuggccucccaaagugcuaggauuacaggcaugagccaccacgcccuuuuuuuuuuuuuuuuuuuuuugagacagaguauugcucugucgcccaggcuggaguacaguggugcgaucucggcucacugaaaccucugccuccuggguccugguucaagcaauucuccugccucagccuccccaauaaaauuuuuaaaaguuaaaaaaaaaaaaaaguagggauggauggccagagagaagagggcuggacgccaacagaaaggagcaacagaaacaaagacaggagaacagcaugggguccagaccacccuacccugauguggaccagaagcagauggagaugggggaacuggagagggaucagcaagggcccccagguguucuuuaccugcuccagggcagccaggcuaguccucaaggcauuguucucagccaaaagcccuuccacuuguuccugugcaucugcacucuggauggauaccuggccccacguccacagcaggugagaguggguccagaacagggggacaggaccuacccacgaccaagaaagaaaggacacacacacacacacacacacacacacacacacacacacacacacacacacacgaaggccugggggaagcaggaucccugggaccuugccugacuauguaguacccacucaggcugcccccauccugaaccccagcucccugagcccacgcaguacaauauaccugaucuuguagggcccgcaaagcugcugcauguuccaggcgcucccccugccgcugaucucucagcucugccaagcucuguggagaccaggggagcccauuuuacaccucagccucuccuggggugcauauaaccguacagacucucuguuugaccacccagcagcauguucucagcaccugugggucucagacuauccagccaacagcaaucucagguucacccagacgccaggucacuacccucaggggccucagacacagucaaccccucuaucccagcguacaagaucucaggcacgacuagacuccuggcccuagcugcuacgcgguucaaacucacucagcucccauccauaagaagucucauacucacccagauucuagcuugggagcuccaggauucucagacacagucagccccauggaucucagauguagucagcacccaaggaugacaguuucacccagccucccaaucccaaccaccagggguuucagacacacucaucucccacgucccuacuucccaggugagauccacccaaacucauagucccagauccuagaggucucaaacucacaaccuccuaguuuccagguccuggugaacucucagacugaccccuucaccugucacucugcuccccagucucuuggaaucuucagacccaguuaaccaccaguuccugggggucucagcuuuacccagacucccgucucagaccccauguucccaguuucuagggacuucagaaccacaagccaccauauccuccauuccaagggaccucagacucaccuuuucuagaaggaaacccagaggcuucagaaccauccagcccccaguccucaggagccucagacccaccuaaacuucugcuccagccccuggaggucucagacugaccagcuuuuuguucacagcccucaaggaucucaggacuaccuagcccauaugaucccacuuccuaggugucuuaggcccaagccagcgcccagauccugaggaucucaaaugcacucagccuucagccccaacuaucucacccuugaaaguuguauaucuacccagccauguccucagcccuugggagucccaaauuuacugacaucccagccccuaaagauuucaaagucacccagcacccagggaguucagacuuaccccaguuccugguccuaggcccuagugaccacagauucauccagacuguggucucaaaccuccaggaguuucagauuuacacaaacuuauagcacacagcccccuaaguccuuagcccccugagaucuuacacucaugaagacuccuauaacaauuccuagggcucuccaauucccauuuuccuagcuccuggggggccccagaacccauuuccaacacaggaaaucucagacuccccagccagccuccauggaccucagaccucuccaggcucccaguccuggccccuaccccagggaucucagaacccaguccccaucaccugauuggcagccucaaguuccugcugcagcuucuggguucgagccaacugggcuuugugaucagcuuccuuccguuguuguaauuccucaaucuuguuccuaggagugauggggaggggguguguuggacauggcuugaggcccagucuccuagcucugccccuguaaucuucacugggcacugucccaauuguccaccaauacccgcaaaucuggcaguuaccugcugucauuaaacagagucuccuuuucugucugcagacggcaaaaacugggcacagaaggacagauguagaugggucaguuccguaaguuaauuccccccucggcccccaguacccuugggaaaaagaaauuuaccuuucuuguuucuuuuucaguuucucggagagcuggggagagagguacagacaagugauaacauugagaauaauauaaagacaaaccuaaaauuaauaaauauagacacuucuuauuaagucauuuuuggaagccaggauuuacuuauguugucuuguggaauccucaaaauagcccugacaagugaguaguaccaguuuuacaaauggggaaacagagucuuggaaagguuaaguaauuugguugcucagcgggucagcaacaacaauauuaucuccacccagauccuucagguuccaaagcccgguauuuaugcucccaacauaguggccaauggccauguuauagauuggcuaggcugggaggccuggaaagcaggauaucaugacugggugccgcaccccugggucuccagguccuaagauaagagccaggagucuguaaaugcuugcaugaaugaaugaaugagugaaugggcaaagcugagagauggaugggaugaaacuuaucaugcacaagauauagugggaccacauuaacucauuccauacugaaaguaacucugagacauaggugugagucucuccauuucacagaugaugaaaccuaggcuuugaugggguacaaugccccuucugcccuaggauugggaauggaaugggaaagaauccagcagauugggagcagaaugggaaagagccaagcagccgcaccuuagcaaguuccuccugcagccuggauguuucggccugcuuugagcucugcagggaaggaugagggaugggaggguuguuguuagcaaggacaaggagaagccuuccccugcccuccugccucccucaccccaucagcccacaagauggugaugucacagccaucuccgugggacuauagacagagguagaacaucugcccugccuucuggcauuccagcuccaacagacucagauucaccucuaagccuugcagcuguucccagagcaaucucuucuccucuuucuccauuucccauuucagcuccaccucugccaacggcaugggggccaggacggugggggccgggcccccugggggaucccccuggcccucacugacagcugagaacuucccggcuucuuucccauagcguuccugcagggcuggugaguagaacagggauauaugauggaugagguggucucugaagucccuugccaugccucgaauagagggagaacuggccuucaaccccucagguggcagagucccugugccaaaugaccacaugccuaaaagacgaagguucagcucuauccaugccucucacauuuuuuucuuuuuuuuuuugagacagggacuugcucugucacccaggcuggagugcacuggaaugaucacaguucacugcaaccuugaccuccugggcucaagugauucucccaccucacucucccaaguagcugggaucagaggugugugccaucaugccgggcuaauuuuuugauuuuuuuguagagacaaggucucgcuacauugcccagacuggucuugaacuccugagcucaagcaauccucccaccucagccucccccaaaaaucuuuuuccguggcugggcacgguggcucacgccuguaucccagcacuuugggaggccaaggcagguggaucaugaggucaggaguucaagaccagccugaccaauauggugaaaccccgucucuacuaaaaauacaaaaauuagcugggcgugguggcgcacgcgcuuguaaucccagcuacucguggggcugaggcaggagaaucgcuugaacccaggaggcagagguugcagugagccgcgaucgagccauugcacuccagccugggugacagagugagacuccgucucaaaaaaaucuuuuucccuagacagucuugcucuguugcccaggcuggugugcaguggugcaaucauagcucacugcaaccucaaacuccugggcucaagcgauccucccaaguagcugggacuacaagugcacaccaugcccaguuaauuuuauuuuauuauuuauuuauuuguuuauuuucuugagacugagucuuucucugucacccaggcuggaguacaguggugugaucucggcucacugcaaccucugccucccagguucaagugauucuccugccucagccucccaaguagcuggaauuacaggcauuugccaucaaaccuggcuaauuauuguauuuuuaauagaaaugggguuuugccauguuggccaggcuggucuugaacuccugaccucaggcgaucugcccaccuuggccucccaaagugcuaggauuacaggugugaaacaccgugccuggccuaauuauuuuauuuuuaguacacacaaguuccugcuauguugccuaggcuggucuuaaacuccuagccucaagagauccuucugccucagccucccagagugcuggaaucaagguaugagccacugugcccaggcucucacaaauauuuuaagcccuaucaaccacuaagauucuguuuacuauuaaauuagcccaagcugguuucacaaaucccauucucaauccuugaagccccacccauagcccuugaaggccaugcccaccauaugcuaccacugacuuacagcugaaucccuccuagagccuccuaauuccuacucacauucuacuaagucucccuccuggucauggaaccagcauccaucaccacagaagucccagcugcucuccaaaguuccacacaccacaugcucccacacucuaucaagcuuucuuucagcuuucaucccagaccccacuuacaaucugggcucagaaucuucccaacacuccauucacuuuuucacuuagcaaauaucuccuuuuuuuuuuugagauggagucucgcucugucacccaggcuggagugcaguggugugaucucggcucacugcaagcuccaccucccagguucacaccauucuccugccucagccuccagaguagcugggacuacaggcgcccgccaccgugcccggccaauuuucuguauuucuaguagagacgggguuucaccauguuagccaggauggucuugaucugcugaccucgcaauccgcccgccucagccucccaaagugcugggauuacaggcgugagccaccgcgcccggccgcaaauaucuccuuuuugacauucaagcugcuaaucuguaacaucugcuagguaccagacacugaacuaaugcagaaugauaucaccuuuuaucucuacuacaaucuucugggugacagacaucacuacaugcacuguguagaugauaaggcuuuggcucagagaggugaaauggcuuguccaaagccacacagggcaugggccaacccuauuucugaagcccuucuccuuccccugagaggaugacggccuuccuugcccuacucaagccccaaugucuccgcauccccaggagggccucuaugcaccugccacguucuucugcaaggcuguguuuucagccuguagccucagcagcuccccauccacgaggggcccagcuugggcaaccccugcuccugcagcccccuccuucaguugcugguucucuugcuccagcuguuccaucuggcugcagagcugaacagaggaagagaaggggcagagaagcagagaaucagagcaguauuugcugaaaccuacauagcauuuguccauguacuuuacaauucacuuaauucccauaaugacccuaugauauaggugcccucccacuuuacaaauaaggacauugaggcacagagauguuaaacaaguucaaauucacacaucuuuuaaguggcagagucagagaauaccaagagcauaccaaguaugaggacaccaaaaaccauuuuccucuuccuacucccaaccucagagaugcaauccaagaccucaggcuccucuggaaguuguuagugcuacagacagccucacugcaaccccucuucuguggagggcuggauccugggcccagagauagcucccucucauccuaagcaccacaaagagcucgcagggcauuuccagggccaacacugaugacagcuccugcauugccagccguuagucuuggagagguauacaaugccaauacaacuaagccagcccccugcccaacuccuggcugaaguacacuucucaaagcaguccugagaaaauuccuuguccccauuuucagaugagaauaucgaggccuacagagaauuuuuauuuuauugccugcaauauuuucuuucuuucuuuuuuuuuuuuuuuuuugagauggagucucgcucugucacccagccuggaguacaguggcacgauuucagcccacugcaaccuccgccacccggguucaagugauucuccugccucagccuccugaguagcugggacuacaggcaugcgccaccgugcccggcuaauuuuuguauucuuauuagagacgggguuucgccauguuggccaggcuggucuugaacuccugaccucaggugauccaccugccucggccucccaaagugcugggauuacaggcaugagccaccgcacccggccugcuugcaauauuuucuacccagaacaccaauccucucauccaguucuucaccuaacuggcuucuuugcaucccucagugcucugcucagauguugccuuuaaaguaguaucccucaacacagaaaauuccaguacucucugucacagcacuguucauuucuuucuuaccuaguacuaaucaaaauuuucuuuuguaacaagcacagauucugaaaccagacugcuugaaugugaauuucugcucugccauuuacuagcugugugacaaauuacuuaaucucccuggaacucaguuuuccucaucugucagauagggauacuaauaucucacaggcuuauuucaaagauuaaaugagugaauaauguagaguacuucaaacaggacuuggcacacaguaagcaccauauaaaugucagcuaucacuacuaguauuauuuguuuacuguuaucaucuuucuccucaucccacccccagaauguaagcuacccaagaguggagaucauucugugcugcuuacaacuguauuuccagaacauagagcaugugguggguacucaguaacuauuugucgaaggaacaauuaagcugaaaugucuugaugaauaaggggugguggcagguuuaacguagcucucucugagagcacuuccaguuccugggaggaguuggaggaggaaggggacuauguaggaagucucuacgacuagcccagugcuggcccagggcagaugcagggaaacaagcuggauuuauggaagaaugucugccccugccucacucugcaagaaucaugauaccauggaggcuggaggcaggaagcagugaggagucagucagugaagccagcaguuaugugaauaccaggggcucugaacuaggagcaggacuggggcacuggaauguauuaaguaaaggagugaugucauaagaucugcaggucagaacagccucuguggugugaacuaaguagaagaaacuagaagugaagagaccagggaggcggcuguagaaacagcagaugauaagugguagaggcuaaggcaaagcagggccacaggguggauauaaaacuuuuuuuuuuuaaauugagacagagucuugcucugucgcccaggcuggagugcaguggugcaaucuuggcucacuacaaccuccgccucccggguucaagcgauucuccugccucagccucccgaguagcugggacuacaggcacgugccaccacacccggcuaauuuuuuguauuuuuaguagagacgggguuuuaccacguuagccaggauggucuccaucuccugaccucaugaucugccugccuuggccucccaaagugcugggauuacaggccugagccaccacgcccggccauaaaacuuuuaaaaagucaaauauuuuagagggaagaugaguuaauagaaggauaauauuauaacuaaugcuuccauagcugauacuaugugcaaggcucuguuuuaagugauuuacguacauuuauucauuuaauccucacaaaagcccugugaagaggcagguacuguuauuaucaugacuuccauuuuaaacauuugggaaccaagaaccaggcaaguuaaguaacuuccucaagguuacaguuaguaaaagguagagccaagauuuuaaucuaggccuucugguuccagagucccugcugguaccuacuacuugcucaacugccucuccugguauuguaccugcuuaaagguuauuuucgguuuuguuuuuuuaaggucauaggcacuauauucucagauggagccuuagaaauaccauuuuugggccgggcgcgguggcucacgccuuuaaucccaacacuuugggaggccaagacggguggaucaccugaagucgggaguucaggaccagccugaccaacauggucauuuucucuacuaaauguccucucccacccaugucauuuucucucaucucuacuaaaaauacaaaguuagccaggcaugguggcauaugccuguacuuccagcuacuugggaggcugaggcaggagaaucgcuugaacccaggaggcagagguugcagugagcugagaucaugccauugcacuccagccuggacaaugagagugaaacuccaucucaaaaaaauuugcugccaugagacuuuuuuccuuaaaacacacuaaaaacauagacaauuaucaacuguggauacagaagauagaugagggaacaaaagacaaugucuccaacugcccaguagauuuagaaacagacaggacacuaaaaucaauggggagauagaauuaguagcuccaggaugaauuaucuggaagagguagaaccccaggcucaugucagaugaagagaagaaagagaaaagggaagaagcucgaacacuuuuccauccuauauuaagcauaagaacucugccuaaaaccccccaacaccuuggagcaccacagcaucaaccccacauuauacacauggagacuugaagcucaaauaaaaggagugacuuggccaggaaccaggugaccucagggcucaaagccuucuaaucccagcagagugagcggccccaucugucaaauuacugccccccagcagcaauccaggaccuguuucagcaccacggacagugcuccagggccagacccuguccaaucacucucugccgcuguuagguuucagcccagaugaccccuaccccucauuuccccuuugacuaucccaggcaccagcaccuugcugaacucggccauuagugugcuguucugcaaacggaaguccuccuccuggcugugcagcuuugccugcagcaucucauuuucacucagcaauaccucgacuuccugcaguggcagacaagggccaggacuccagcaagggcaaaaaggauagggagguagggcaaagaaacagagagagggagaaaaugacaugggugggagaggacauaggguacagagaaugaggugauauaggagaaagagacauggggagggauaaaaugagagacagggaaaggaagauaaagacaugggaagguagagagaagggaauacagggaggaagagagcggaggaaaagacaggaagauaaugauuggggagagaggaaguagagauggggaaagggggagagauagaaaaggggagagggauugggagggagagagugaaaaagacggagagaagaacaaacagaaaucaacagggagagaacagaacagggagaagaggaggggucaggaaaagaaaugaguuaggaagagagaggaaugggguggaagaaacaaggaguuagagagagaaagcagaaaaaagagaaaucaccgagacaggaacaggagggggagagacaaagagaagauugggaagagaaaugagucagagagacaggaacaggaaaacagacagagacagaaagagacucagagaaaagaauggaaagagagagaaggaaagagacacagaguuaggacaaauacagggaaacaaggacagauacagcaacacauggcagugagguaguagcagauguaaaggcacacaaagaaagaaaggccaguacaaggaaauaucagcauacagaaauagcccaccaagacaucucccagucacacucacccacaagggauccccuuaccugagcuuucuugcucuugcucagugccuaaagugggggugggugggaagagagcuaaagugaacagagauggacugccuuacuaggauauggagacaauugugccaagcguuuugggaggacaaggaugacagggguugcaggaugggagcaucuucaaccacagaacaugugugacaauuuggagcccaaaggaaugauggaaugagugugugagugagugaaugaaugcaagucuugcccuggggccccagcacacauaaaucauccuuucuuggaagcucuugaggcugguggggggacaggggagguagggagaugcccugguauuuaaccauuuaugggcuggaucuccagacucagaaacuguggcuucauugcuacaucuguccauacaugucucugugggucccucccacgcaguguggaaacugucgcuccccuacugggcagccaagagcauugccagcuuaggggaaucagcauccuaccaaagagaagugcagcuuccugacugucggauuuucugcauacuguauucguucauccaacaaauauuuauugagcacauauuauguauuaacauugugcuagguauggcuagauauggggacagagcagugacaaaggagcaccucgaaugucuugaggggccacaauagguuauauccuaucucaucuuuagaggaucugagagguggguuugcucucauuuucccaacuggaccaggacagagaugggaaguaggagcacaaggcaggagugugaguagaggaugggaggcagauucgagguagauuuacugauagauuugaauauuuaauuaaaagucagugaaugagaaugaguaacugaaauuagaaaugaauuaaaaguaaauuaaaauuaaucacuaaauuaagcaggauuagguaaaauuagcaacuaaagagaauuccauugagaauccuuuaaaugacuacgugaaaacagcaugcaacauuaggucugguucacuguaggugcucacuggagggaugaaugagucagauagguagaagcaaggguggauggguagguggauggguggguggagggagguaccuucugagcuuugcugaacuccuuauccaaguaggcgaccuucugucgaagacuggugaguucuggugucgggaaagcagggaaacucagccucagccaguggcaagaaacugaaaggccuuccugccaggccucugagggaaaaccucggacaccauuccccaaagccacccccaucuaauaaggcccuccuggcucaccaacaccauucuugcguaguucaucugaaagcugguaguuguuuguccggaguuccaggagcugagccuuugggggaggcaggaagggaaaagacuuggucaggaaagcgccccuaccccuaccaugagggaaccaagccccuaagcuccacagaccuuacgcccuccaugugccucuguagcuacuccuuaagaccuguaugugcuacacccaaagugaccuuccaggcccucagacccuggcucaccuuuuccagcuccacuuauaaccccagccagccucaccccuccaucucacacuacaauccacgcugcacucaggccaucccagagcacugcccccagucagggucuugcuugugugaguucccuggcucuccaugcccacaggauaaaguuccuccuccucauccuggcugaccucuccacacacugaacacacacugucagggguguuguccauauuucugaccagaccugggggccucugauggcaggggguuaagggccugucuuccucccucuuuccuaagggaaaagggucaaguauucugcccaacuuucauugagucagggggcuuuccaggguccccccaccuccaaggcucucaaaauacauccaggcccccuucaauaauuaagggaggaccaggugcgguggcucacaccugucaucccagcacuuugggaggccaaggcgggugggucacgagguaaggaauucaaaaucagccugcccaauauggugaaaccccgucuccacuaaaaauauaaaaaauuagccgggugugguggcgcacaccuguagucccagcuacucgggaggcugaggcaggagaaucgcuugaaccugggagguggagguugcagugagccgagauugugccacugcacuccagccugggugacagagugagacucugucucaaaaaaaaaaaaaaaaaaaaaaaaaaaaagaauuaagggaaagugccaggcgcaguggcugacaccuguaauccaaacacuuucggaggccaaagugggcagaucacuugaggucaggaguucaagaccagccuggccaacauggugaaaccucaucucuacuaaaaauacaaaaauuagcugggcguggugguacgcaccuguaaucccagcuacuagggaagcugagauaggagaaucacuugaacccgggagguggagguugcagugagcugagaucgugccacugcacacuauagccugggugacagagaaagacucugucucaaaaaaaaagaaaaagaaaaagaauuaagcauccuccucccuaccagcccuauaggacccugaggcugguucuacccagcaaggccgguuccuucccauuaaggaacuuacuguuccuuccccuaccaggacuuuucccucccucccacgccaccagccuccacucacuguucucugguagucugcucaaggucagagggcuuggccuucacagaaucuuuccuacuccuguccucuccaggacccagugaucugucucuccaaguacugguccaaguggaauauccuuuguaccccccgagacuugccccccaacaaagcccaguaguucucccucauucauggcccagugggaucaauguuccucauucaaggguauucccacuccccucaagaucuccccagucaugauccauugggaauggcccuacacccuucaggguaggccucuacaaggccuuggguaggccaguuggaugacucuuacucacuuagaaucccuuucagaugacaguggucuuccccauucauggguuaaucaacucgcccuuccauucucagugucccucacacagggacagcugguuucccucauucaaggaccaauuggauuaccuguccucccucagaguuccuccccuccccaugcaggacccuguucagaccccccccccagugaggaacccucucaacaagggcccauucauagugcaaugcuauggccuuucauugcaucucagaguccccccaaaagaaucaaguggggguaccuccccaaagcccagugaucuucccuccuuguaguccaagguaucaaucuuuuaccccucugguccuccccccaguuaaugggauuaaugguauuacccauucauggccuucuucaccccaggccuaaugggaucacccuuaaucauccaauggugccgcccccucuuaggaugcacuaccaaccaccaauggcacaggaucuccaccucccaggaacaaugacaacaucuggggucuuuccccaauccccgggcacagugguaucucccccaaaacuuaccaccucccacccgcuaaugguucugcccucucaagggcucccaccaccaugacgcaaacgacccaacacccgcuuccuuccucuccagacaaaaugguuucgccuucucaggaucuccuucccucaaagcccauuaucaucacccgccgacgguguccccugcacgggcccaaaagucucguccccuccaggucugaguaagguaccgccuacuuaauggcgcucucccagcccacaaugcuaacagaguccaaccuucaaagccgcagaguaucucggaauccaauagucucaccacuccgagccucaguuucccuucuccagacccaccccauaaacucaggguccaucccaaccaaccccuucucagagcugauagcacgaccucucgcuaccccgcccccggucgccuagccggguggucuuucccaccgcgagcggcaccugcauccgcugaaacuccuccucagacagagcuugcgccauguuccuccccccacccccccgccagcuuucugcgcagacgcagcucgcgccuccuggcaguauuaaggucggaccaaaccacuggccaggaauggaggggguagaaccuaauuccgaagggcagcauuuuggagacgcagagaagagaacgaaaccgacgagucaggugaacuguaauacaacguucuacccgaauguaagucaucugauuggcuuuuggacucuucuaggccacccauugugauacgacauuauuacauccc

SEQ ID NO: 18907 - RNA, 1614 nt, Homo sapiens
gaugacgcgacugaggcccaaccagcuuuguaggaggcggagucuccccagggucccucucuggcuguccuaggggagggggcucagggagccacgaggccccucccugccucuccaucucccggcaagcucagaggggcggggagagagagccagaggaggaggagaacucaggcagcucugcagagggggccaggagcucggguguuugguacccccagccccaccgcuguugcugcuccugcagcggggacacaggugaggacgccccgagagagagggggagggggaccaccacuagcgcuguccucauccuucccugguccagcccccacgcccuaacccauccugggauaguccccaggggucccacuggaccuugcccuucccaggccuccuuccagggaccccgcacccucccccugccuaugccaccuucucuccuaugccuggcugugguugcuucucuuccuccugcugccgcugcugcuacugccacugcccaguacacaccgccagccccucggggugugguuuccccagaccugcccccaacggugggacccagccuucucccggcgucuccugccagcuuccugcaaagcccaggagccccccucccuggagacacacccaacucccuuucaacaccccaccccccucuuaaucccauuuugggguuaacccccuuccucuuauuuagucuucauagauccccugggugcucugggauugugcccaacuuccuaacauuugagucccggcccuuggaauuccccaggccccuuuuuccucccuguagaacuccugagagugucgaccaggcuuuguuggcccgucuagauacccaccucccccagauaacucucagccucucaaaaaauaacccagcccccugucuaccccuuuagauaaccccuuccccucuccagcccuacuaggaggcucuggccucuccuuucuuccccagaacuccuguagaguauagacacccccccgggcuauucuuggcaacucuaggcagucccaagacaccuuucagccucuuuacaaccuccuggauccacagccaccccucaagaugcaccagcucccuuuccagauccaugaggggggucuaacccucuuaugcuuccccuagaagucuugaggguguggacaacccuccucaccugucucagccccucuagaacccccacuuccaggcacucucagucucuuucaagcaccucuggucccauuucuaccccucuggaugccccagucuccucuccaccacugcaaaggaauuccaggcucuucugccuucccugagacucuugagagugcagagaauuccccacguguuucuuggccccucuagacgcccccagacaccucucaggcacaggcugacuccuuuagaaucaucucagucucucuaaacccucccucagcuccuucuuggccccauccccacaccccuuuucugcucuucuccauguccccaaggcccuucucagucccucagaacauugcccaggccccuccuagguucuguaaaugucccccagacuccuucccaucucuuuaguucuuccuccugguuccucuuggccucucuagacaccccca

SEQ ID NO: 18908 - RNA, 1614 nt, Homo sapiens
ugggggugucuagagaggccaagaggaaccaggaggaagaacuaaagagaugggaaggagucugggggacauuuacagaaccuaggaggggccugggcaauguucugagggacugagaagggccuuggggacauggagaagagcagaaaagggguguggggauggggccaagaaggagcugagggaggguuuagagagacugagaugauucuaaaggagucagccugugccugagaggugucugggggcgucuagaggggccaagaaacacguggggaauucucugcacucucaagagucucagggaaggcagaagagccuggaauuccuuugcagugguggagaggagacuggggcauccagagggguagaaaugggaccagaggugcuugaaagagacugagagugccuggaaguggggguucuagaggggcugagacaggugaggaggguuguccacacccucaagacuucuaggggaagcauaagaggguuagaccccccucauggaucuggaaagggagcuggugcaucuugagggguggcuguggauccaggagguuguaaagaggcugaaaggugucuugggacugccuagaguugccaagaauagcccgggggggugucuauacucuacaggaguucuggggaagaaaggagaggccagagccuccuaguagggcuggagaggggaagggguuaucuaaagggguagacagggggcuggguuauuuuuugagaggcugagaguuaucugggggagguggguaucuagacgggccaacaaagccuggucgacacucucaggaguucuacagggaggaaaaaggggccuggggaauuccaagggccgggacucaaauguuaggaaguugggcacaaucccagagcacccaggggaucuaugaagacuaaauaagaggaaggggguuaaccccaaaaugggauuaagaggggggugggguguugaaagggaguugggugugucuccagggaggggggcuccugggcuuugcaggaagcuggcaggagacgccgggagaaggcugggucccaccguugggggcaggucuggggaaaccacaccccgaggggcuggcgguguguacugggcaguggcaguagcagcagcggcagcaggaggaagagaagcaaccacagccaggcauaggagagaagguggcauaggcagggggagggugcggggucccuggaaggaggccugggaagggcaagguccagugggaccccuggggacuaucccaggauggguuagggcgugggggcuggaccagggaaggaugaggacagcgcuagugguggucccccucccccucucucucggggcguccucaccuguguccccgcugcaggagcagcaacagcgguggggcuggggguaccaaacacccgagcuccuggcccccucugcagagcugccugaguucuccuccuccucuggcucucucuccccgccccucugagcuugccgggagauggagaggcagggaggggccucguggcucccugagcccccuccccuaggacagccagagagggacccuggggagacuccgccuccuacaaagcugguugggccucagucgcgucauc

SEQ ID NO: 18909 - RNA, 5237 nt, Homo sapiens
ggcaggaucaccagaaagcuuuuauuuuaacccagggccagggaggccgaagcuucaauccugcugcuugguucgggaggccucugcauuggcccggagcacagccccuggggauggauacggccgcugcuggaagaggggcccagcugcuguggugucagcgccagucuuggccucauuccgcuuggggaguccuguugaccacgugccccugccggugaaagagucaggggauggggaugggugauguggcggacacagcccaccuggucccaaugaggaauggaggaaggaggccggaggaugguguccacguacugagucaagagggguugucacuuaccggggggcgucugaguaugagcuaggguccauggggucuaacucuucauccuuucggcuuacugcuguggaaguggcagggcaaagucuucaauagaggcaccaggagccccugaucacugagccccaccccacaagaagaaaugaagccccuggcugccauguaccacagcacccuccucuagccccagguccaggcaucuuuuugagggaaggcuuccucacgcagugcacccugcaccuuguuggucucaccgagccccauucugcccagcuuacccuucuugcucuugggauagggagccagcuccucccggcgaugguggcgccguucuuugcccucuucccggucugccuugucauacccgcggucccgaucccguucccugucucgcucucucucucugucuaccuugucauagccacgcucucgaucccugucagacuugucguggccccggucugacuugucguggccccugucuaguuucucauggcugcgguccgacuugucauggccccuguccgacuugucauggcuccgguccaacuuuucuucagcaucuggggacacaagucuugaagugaccucuugccaccccaggacccagcagccucugccuucaacaaccucccuugccugaggcugggcccgccuggucucaccugccccucugauccacuaucauucuacuuggccucuccgugagaacugcuaagaucacucaaggcacgcuuguaccugccaacucaccugcauuacugcuucugagcuucuuggccgauuugguaaccacggaguuggggucauguggggagagccaggauacaaggucugugucugcauuccaguaguaagggagcccgcuguggggccgcaggaaagaagugucagcacagauguccuugccuuggauccucaacucuugucuccccagucucugccuauaccugccccaugucaggaccccacaggcaggauccccagaaucucuucuccugaagagaaaacacugucagcugggcgugguggcucaugccuguaaucccagcacuuugggaggccgaggcaggcggaucaccugaggucaggaguucgggaccagccugaccaauaugaugaaaccccaucucuacaaaaaauacaaaaauuagcugggugugguggugugcaccuguaaucccagcuaccugggaggcugagacaggagaaucgcuugaacccacgaggcggagguugccauaagccgagaucacaccauugcacuccagcccgggcuacaagagugaaacuccguuucaaaaaagagagaaaagacagucuuccaaccccagaggagccaggccccagcaggcagcaacuugaguccugcagauaccuaaugccaacacccuccacccgaggcucccucccuugugucccccuaaaccucacaaccaaggucagcacaggaagggugaagccagaaguuagcucccccucacccaggcucaccaggaagggucgaacaccuuguaccagcuuggugguaggcccuccaaccugguggccucguaguccacaggaucaucgucauaguccucggcaaugaucucuuccucugguucugguagaacaagguggggaugaggagagcagauaaggaccaggggaccucauccuacauguagagccuagagacacgcacucacauucacacaagccacacauaaaagacacgugugugugugugccgggaagaauaugaaguaucuuucacauuccaaauccaacucucuauauuaggagguuuacaaaaaaagguuaccuaaaucugugucuggguucagaugaugaguucuacuguuagccaaagcuaucugguuucagaguugauagggauucaucaaaaaauuuacucaucuuggccaggcgugauggcucaugccuguaaucccagcacuuuaggaggccaaaguggguggaucacgaggucaggaguucaagaccagccuggccaagauggugaaaacccgucugugagacuagccuggucaacauagugagaccccugucucuacaaaaaaaaaaaauuagcugggcacaguggcacacgucuguagucccaacuacucaggaggcugaggcaggaggcucauuugagcccaggacuuugagcuugcagugagcuauuaucgugccacugcacuccagccugggcaacagagugagacccugucucuaaacaaauaauaaauaauauauauaccauaggcacaggucauucaauaggcuuaaaagaaaauccagccuggccaacauggugaaaccccaucucuacuaaaaaauacaaaaauuagccaggcacaguggagcacgccugugguccuagcuacucgggaggcugaggcaggagaaucgcuugaacccgggaggcagagguugcagugggccaagacugcaccacugcacuccagccuaggugacagagcgagacucucucaaaaaaaaaaaaaaaaaaaaaaaaaaaaaguaaaucaaugaucauugccaguuuuauuuuuuugagauggagucuuucucuguugcccaggcuggagugcaguggcaugaucucggcucacugcaagcuccgccuuccggguucacaccauucuccugccucagccucccgaguagcugggacuacaggcaucuggcaccacgcccggcuaaguuuuuuguauuuuuauuagagaugggguuucacccuguuagccagaauggucucgaucuccugaccucgugauccguccaccuccgccucccaaagcgcugagauuacaggcaugaggcacccugcccggccugggaucauugacaauuuuauuaaccacaaggucuauaccuugcacacaguaggcuuguaauagaugucaguuaucaauaaggagaagauauauuuuccagugccuggcacacuauagccccaaauagaugccaguuuuuaguauuacugauaauaaggugugauuugcagccagagcacaguaggccuaaaugauagauccucacugcaacuacgcuuggcacacaggagacagcaguagagguuagcaguacuuccuauuagauacuaugucaucacccccauagaguaauccaugggauuuaacuuggcauacaguaggccccaaauaggcauuagguggucaguauuauuuuguuguuuuuuuuggauuuuuuucagacagggucuccaugugucggccaggcuggagugcaguggcacaaucucggcucacugcacccuugacauccuaggcucaagagauccucucaccucagccucccaaguagcugggacuacaggcaugcaccacaacacacgauuaauuuuuguauuuuuuguaaagacgggguuuugccauguugcucaggcuaaucucuuaaucccuaaacucaagcaaucuacccgccucagccuccuaaagugcugggaaugccagcuugagccgccacgcccagccagucaguauuguuaagaaugaaauaucugccgggcacaguggcuuaugccuguaaucccaacccuuuggaaagccaagggugggggguggaucaccugaggucaggaguuagaggccagccuagccaacauggugaaacccgucucuacuaaaaaugcaaaaaucagccgggugugguaucacgugccuguaaucccagcuacuugggaggcugagacaggaaaaucgcuugagcccgggaggcggagguugcagugagacgagaucacgccacagcacuccagccugggcgacagaccgagacucugucucaaaaaaaaaaaaaaaaaaauugccaggugugguggggcggggcgugccuguagucccaacuacucgggaaguuaaggcaggagaaucgcuugaaccuggaaggcggagguuuuagugagccgagaucgcgccacugcacuccagccugggugcacaauaagacucugccucaaaaaaaaaaaaaaaaaaaaaaaaaaaaaaaaagaaugaaauaucuauucccccaacccccuccacuugacacgcgguagggauggaugucaggaauccacauuguuaacaacgaaaaaugccugccaccccauugcuuggugcacaguuggcccaugcuagguaucaagcgucaguaucaacaacaaaagugccugucgaggcuggcacguguuaggaccaucugcuuuuagcugucucaccaggcuccagauguuugaggaugccucucuuggccaagcgggucugcagcgcaacgggcagcggcauagcugauagcagacagaccuagggacagacgaacaaacugacaagcagcucagauaaagauuccuaucuggaucccguaaccaagcgccucccguaaacauguacucaucugacuccgaucuacucaaaugaaccaguagcuggguggacagaacauacgcacuaaaagauguaagagguagguggcaauaucaucgcaacucccaccaacccuacuguccccgaaaccaggugcuccagggcccuguuccucucccaggcccaggcuccgcccacagccuaagaagcccggccccuccgcacuucagaaaugggcucauccagcguccccaugacugccgggugggagaaaccaaagcgcugggaugggggagcagagggcagcacuuccuccagcuccaaaagagugcacccaccccaacguuaccaauacacucgugcagguaguggaaggcugucacaccgcccgucucucucgugucgccgcuacgauaccugggcccacacgacucucuucccaaaacaccgaaugagaccuucucucaacgaggccuucacuccccgagccugaaaguaacuggacuacgcucaggaggcaaugaacaaauggcaga

SEQ ID NO: 18910 - RNA, 3678 nt, Homo sapiens
ggcauggaggcagcuuugaaacccaaaacaccauuuauuuaauuuugcacaaaaucuuucaacuugacauaacaaaagcaacauuaggcacucccauguuaccaaaaagccccucaccaagugaaaacaagagagauguccaucuuucccuaguauaccugaugugucccucaaagcuaguugccucaggggucucaugucaaaugaacaaucacccuggccuggggaaaggucuacauuucuuggccaagaccuucaggccacagagcagccacaguggcagguggccuucuggugccgggucuucucccuacaggaccuugccaugggcuccuucgccauggccuccuggacccucuggaucucauggaccagcagggaaaaggccuccuccacgccuugccguguuuuggccgaggucuccacgaagugggccccccagcugugugcgagggcugcagcagcggcaugagcaucuccagcaguggucacaaggucacacuuguugcccacgaggacaaggggcugggcggggugagggccccagguggcccauaucugcugcagcuggaucagagacgaggggucaucgagagcgaagacgcccagcacaccaucacagacagccaggcacuggucacgcagggcccuauggauggccugcccugcuguguccagcacauucagaaugcaguccccacuguccagggucaacuccuuccaguaggaauccuggaugguggggucgugguccuccacgaagcacuggugguucagcuggauggucagcgcacucuugcccacgccacuggcgcccaccaccacagccuuguacucaggcagcugccugccaacaucccugcggcgugccugagcccgguggguuucccccuggaaggaagggcuccauguggccaggcccaggucgaaggugccaggcuuuguuggcagcuccaugaccccagcaggcagcucagggaagagacgugggcagcaggcucugcaagugggaagagaagaagcaagacaacaggggauacguuaggggagaccauuugagggcaaggagacaguggggugucauuauuucaacauuuauugaaugccuauugugugcugaucaccuuccaauuugcaugcuauauauauaugauuuauguuguuuucucccugucccacguccccccaucucuccuucccuccucacgcgaaucaacaacugugaaggcuggauuucccaaacagcuuuauugagauguaauuuacaucccaucaaguucagccagcuaguguccaauuuaacggguuuuagcauauucacgaaguugugcaacuaucaccauaaguaaauuuuagaacauuuuccucacccagaaaagaauccccaugcccauuagcaguuccuccccaugacagagggagggcaggauuuugccgguuuuggucaccauugaacccuagcccagcacagugccugccagacaguagggacccaacauucccacccccagaagguuuauguucuaaaaggcagaggcagauaauauaauaaaccaaauaaauauguaaaucacguggucuguuagccauuaucauuagaauguagucuuuauuaauuauucaacauacauuuauugggaaccuacuguguggcaaggacauggaguugggcaauaaauagacaacaaacuguagcccucaugaagguuauauucuggucggggugagagacaacaaacuagguuaaaaagggggcggggcacaauggcucacgccuguaaucccagcacuuuggaggccgagucggguggaucaccugaggucaggaguucgagaccagccugcccaacauugcgaaacccugucucuaauaaaaacacaaaaaaauuagccaggaguggugguggacgccuguaaucccagcuacucgggaggcugaggcagaagaaucgcuugaacccgggaggcggagguugcagugagcugagaucacaccacuugcacuccagccugggagauaagagcaaaacuccgucucaaaaaaaaaaaaaaaaaaaaagugaacuauaugucaguagcgggugauaagcaugcagaaggugcucaguucaugccaggcuuuuaaauuauaauuuaaucuccauucauuaauucaagaaucuuccuucgugccaggcauugugauauggcaguuaacaaaacagaccccagucccugcccuugugaggauuggauucuggcagagagaaagagacaguaacaagauaaggaacaaggaaguugcauguucgaagaggaugggcacacggcagguggucaauuaguguuaguuauuagcagcacauccccauucacucagugaaugccccucgguguccuugggcucaggaagugcccugcuuagugcauccuaauggcuguugccacgacuccccuccgaaagccuggcgcagcggcaguuugggggcggaugguggcuucgagguuugguggagcuggagauccggaggucggagucggggcaaggucccaaauggggaugcggccgcggcguccucagcucugagggaucccugggaauagucacuggcggcguuggcccagaaggagcgggggcgggauaaagagagcaggaagcggaggacggagcuuggggguccccgacgguuggggacaggaagaagaccuggaggacugcggggaggggcgaggcggcggcgcacguggagggagaggucggcuucuggggguccuguaggggugcccggccaucuuuagggaugggucagaaggcagaggcggggucgaggcugccucuuaagucggggucugagcggcuggagucugggggcgccgacggugaggaaggaaagcccggggccuggccgaguggcggagcgcagcuuccaccccaggugccuggcgggacggggccacacucgcccaguccccgcgacgcgcagggaggccgcggcccugguccccaaggcuccgcucccgggaggagcccgaggcgcagaggcacgugccgagggcacuggcccggggccucagcccgcgggaggcgccggagauugggggcucgguccucucaaguggcgcggagcccccggcggguccccguggccgcgcgcucagagccgcugggaccagguuggggggcuucgcccagcucaccaaggcuggcgcgcuaaggggccgggaccugggguuagggcggccucgccaggucgugcuuucccggacgaggccgggugaggugcaaagcucggagugcggaaggguccccgaaaccaggacuccacuucgggcucggugugagcagcgucgcccgggcauccugucaagacccaucccgacuccgggugaggcggccccgcuuccagccaagcgccgacaccccucccggccggcccgagugaggggccgcucgcccgggagaaggcuuggcgcuugggggacgaucccccaaagccggcgcggggauacccccaggccuggcagggccaggggcaccggcgccucgcucaccuguguccguggggaggcgggcgcgcugggacgcucugacaggccuggcggggggcgacgcugcuccccggggcaccccggcggcgguugggggaguggacaugcgcagccgcccucccucggcuccucaggccgcccaccccccug

SEQ ID NO: 18911 - RNA, 3678 nt, Homo sapiens
caggggggugggcggccugaggagccgagggagggcggcugcgcauguccacucccccaaccgccgccggggugccccggggagcagcgucgccccccgccaggccugucagagcgucccagcgcgcccgccuccccacggacacaggugagcgaggcgccggugccccuggcccugccaggccuggggguauccccgcgccggcuuugggggaucgucccccaagcgccaagccuucucccgggcgagcggccccucacucgggccggccgggaggggugucggcgcuuggcuggaagcggggccgccucacccggagucgggaugggucuugacaggaugcccgggcgacgcugcucacaccgagcccgaaguggaguccugguuucggggacccuuccgcacuccgagcuuugcaccucacccggccucguccgggaaagcacgaccuggcgaggccgcccuaaccccaggucccggccccuuagcgcgccagccuuggugagcugggcgaagccccccaaccuggucccagcggcucugagcgcgcggccacggggacccgccgggggcuccgcgccacuugagaggaccgagcccccaaucuccggcgccucccgcgggcugaggccccgggccagugcccucggcacgugccucugcgccucgggcuccucccgggagcggagccuuggggaccagggccgcggccucccugcgcgucgcggggacugggcgaguguggccccgucccgccaggcaccugggguggaagcugcgcuccgccacucggccaggccccgggcuuuccuuccucaccgucggcgcccccagacuccagccgcucagaccccgacuuaagaggcagccucgaccccgccucugccuucugacccaucccuaaagauggccgggcaccccuacaggacccccagaagccgaccucucccuccacgugcgccgccgccucgccccuccccgcaguccuccaggucuucuuccuguccccaaccgucggggacccccaagcuccguccuccgcuuccugcucucuuuaucccgcccccgcuccuucugggccaacgccgccagugacuauucccagggaucccucagagcugaggacgccgcggccgcauccccauuugggaccuugccccgacuccgaccuccggaucuccagcuccaccaaaccucgaagccaccauccgcccccaaacugccgcugcgccaggcuuucggaggggagucguggcaacagccauuaggaugcacuaagcagggcacuuccugagcccaaggacaccgaggggcauucacugagugaauggggaugugcugcuaauaacuaacacuaauugaccaccugccgugugcccauccucuucgaacaugcaacuuccuuguuccuuaucuuguuacugucucuuucucucugccagaauccaauccucacaagggcagggacuggggucuguuuuguuaacugccauaucacaaugccuggcacgaaggaagauucuugaauuaaugaauggagauuaaauuauaauuuaaaagccuggcaugaacugagcaccuucugcaugcuuaucacccgcuacugacauauaguucacuuuuuuuuuuuuuuuuuuuuugagacggaguuuugcucuuaucucccaggcuggagugcaaguggugugaucucagcucacugcaaccuccgccucccggguucaagcgauucuucugccucagccucccgaguagcugggauuacaggcguccaccaccacuccuggcuaauuuuuuuguguuuuuauuagagacaggguuucgcaauguugggcaggcuggucucgaacuccugaccucaggugauccacccgacucggccuccaaagugcugggauuacaggcgugagccauugugccccgcccccuuuuuaaccuaguuuguugucucucaccccgaccagaauauaaccuucaugagggcuacaguuuguugucuauuuauugcccaacuccauguccuugccacacaguagguucccaauaaauguauguugaauaauuaauaaagacuacauucuaaugauaauggcuaacagaccacgugauuuacauauuuauuugguuuauuauauuaucugccucugccuuuuagaacauaaaccuucugggggugggaauguugggucccuacugucuggcaggcacugugcugggcuaggguucaauggugaccaaaaccggcaaaauccugcccucccucugucauggggaggaacugcuaaugggcauggggauucuuuucugggugaggaaaauguucuaaaauuuacuuauggugauaguugcacaacuucgugaauaugcuaaaacccguuaaauuggacacuagcuggcugaacuugaugggauguaaauuacaucucaauaaagcuguuugggaaauccagccuucacaguuguugauucgcgugaggagggaaggagagauggggggacgugggacagggagaaaacaacauaaaucauauauauauagcaugcaaauuggaaggugaucagcacacaauaggcauucaauaaauguugaaauaaugacaccccacugucuccuugcccucaaauggucuccccuaacguauccccuguugucuugcuucuucucuucccacuugcagagccugcugcccacgucucuucccugagcugccugcuggggucauggagcugccaacaaagccuggcaccuucgaccugggccuggccacauggagcccuuccuuccagggggaaacccaccgggcucaggcacgccgcagggauguuggcaggcagcugccugaguacaaggcugugguggugggcgccaguggcgugggcaagagugcgcugaccauccagcugaaccaccagugcuucguggaggaccacgaccccaccauccaggauuccuacuggaaggaguugacccuggacaguggggacugcauucugaaugugcuggacacagcagggcaggccauccauagggcccugcgugaccagugccuggcugucugugauggugugcugggcgucuucgcucucgaugaccccucgucucugauccagcugcagcagauaugggccaccuggggcccucaccccgcccagccccuuguccucgugggcaacaagugugaccuugugaccacugcuggagaugcucaugccgcugcugcagcccucgcacacagcuggggggcccacuucguggagaccucggccaaaacacggcaaggcguggaggaggccuuuucccugcugguccaugagauccagaggguccaggaggccauggcgaaggagcccauggcaagguccuguagggagaagacccggcaccagaaggccaccugccacuguggcugcucuguggccugaaggucuuggccaagaaauguagaccuuuccccaggccagggugauuguucauuugacaugagaccccugaggcaacuagcuuugagggacacaucagguauacuagggaaagauggacaucucucuuguuuucacuuggugaggggcuuuuugguaacaugggagugccuaauguugcuuuuguuaugucaaguugaaagauuuugugcaaaauuaaauaaaugguguuuuggguuucaaagcugccuccaugcc

SEQ ID NO: 18912 - RNA, 23008 nt, Homo sapiens
cuccagguuuuuuaacagcuuguacuuuauuacauaugcaaccuugccaugccugccaguuaacuccccucccgccaauguuauccucaugauaucagcucccucuuggggccacugagcugccccccuuuccuucugggcuggaguaguggugccccucaagcaggcaaugggcagggggagauccacaauuaaucgucgcaguucucuuaaaaguauuaacacuuaaauaagcacucuuggggaguugcaaaggauauucaggaugggaugcagugggaggcuaccccucauccaagguacaggcuggaaugagcuacagcuggucuaucgugggccucagaaggugaagagggaccguauucuggggcuuaguguggguggggcauauccuccccaaacuuguucuggugggcgauguucuucacaucuaggagagccugaggaggaggcaagaauagggcaggugagagagagugaggaccccucuaccucggcugcagggcugcccccacuccagcccucaaccacucugucuucuggacuaucccacagcccccgccccaugcaaaauaaucacaugaggcagccaugcagaggggccuguggucucccuuuacccaaucacagaagggguguguguguggggggugagugugcacgugucgaagggucuacccagggcccaccuggugguggacauaggccugacaguaguaacaccaggcugacaggucgauguagcugaggaccagcggguguccagaauuuccaugguguuggagcauguggccauugauguaacgaccacaguagaccugagguugggggugugagugucaggugggggucagcaucccccugcaguuugcucccgggccaaccuccgccccauccccuuccucugcuccauaccugauagcaagagagacacacccaauucucuuggauuguuccacaguccccacaagguugggucacgucuaggccugcugcagguauggggcauacugccaccaaauggggacaccagggcaguggugucacagcauaaaauauggccuggagugggugggugaaacuagguaagcugaagaccccaucuccccauuauauguuuauucaucacaugcuccuaccuggagacacaaauuggcaagagaaggaagccacagucccagccucucccugagcucaccugaucagugaggccccuagaucccugcaucagcaucgaaucagccauguccugaccuccagcugccucuccuaguagguucuccucuccuggggccugagauucugaggcccccuggacacgcagaaguaagagauguaucagagaagcccgauucuugccccuucuugccccuaccuggguguggugagccuuaccugagauucgcugccuagcuccaagguccugagacucccaaucaguguacugggagauaucugggguguaguucccugcacaggugagguugggggggucugguggucugugcucgaggcuagaggaguuuggaucagcucggugcccccuggagccuccucugacguagucugguccaguguggcucccuccauggcugccuccgagguggucugggccaguguagcuccuccuacagccuccucugagguagucuggcccagcguggcucccccaacagcauccucugagguggucugguccagaauggcuccucccacagucuccucugagguggucugguccggaguggcucccccgacagccuccucugagguggucuggcccagcauggcucccccaauggcugccucagaaauggucugggccagaguggcucccccuguggcugccucugagggcugguccugagugagggccaccacagcugucucugaguuagucuggccuggaguggacucuuccccaaaugaugccgaggugacuuuccccaugccugcuuccagaaccuucuuuucucguguggucauccgcucagcuaaccuagguuuggcugguuggggugccuucuuggugaccaacuuagaacuggaggguccuucucugucuucuaccucuggaaccagggagggagauccuugaguguggguacugucacccuuccugccucugaucucugccccucagcccccuccuucccuggguuccccccaucacccccaaauccacucacucaugacccguaagcugcgccaguaucugcgauggacuuggauggucucagugauugaggccagggccccugauagugggggccguggcagggucagcagggguggugggucuccaaggagggagcgagugcaggcagccauggacucugagauggaugucagguuauagccacccuuuguuaaggaaaaggggagggaaagguaugguggggguucauuggggaauuuggaggacaacauguccugccuccccaauccucccuacugagcccugcaagucuggagagggagggggaguacugagaacaagugaacagaacccacaccuuuaagauaggcagcacccacuguguaaggugguuguuguggggaguaaauugugauguaaagugcaagauaacaauacugauaaaagcauuaguaacagcugacauuuauuguuugcugugugccagacccgauuuuaaguacuucaugcauauuaacucaauccucacaaccacaggcgcucaaucuauacaggaacuugccuucaugccauacagaaauccgucuucacacuguccaggaaccccuggccucacaucauacaguaaccacugaccugaccugcacaagacgacugcugugaacccauacaaaagccccugcccugaccuaguacaggaacaacuggacucuuucuccacauggacuccuguauugacuuuuuuuacacucuacaggaaucccaguugcuauucuuuuuacagauaaagaaacugaggcucagagugguuagaugacuuguccgaggucauaacagcugaagaggcagcacugggguuugaacuugggcucucugauggagucaucuguguucuuaacucccaccguguccugucacaagcaguacugggcacauaguaagugcgacuuuuugcaagccaauuaauuucucagugacuuauuuuccucaucuguaaaguggugaaaauaacagcacaggcugggcgcgguggcucaccccuauaaucccagcacuuugggaggccgaggcgggaagguuaccugaggucaggaguuugaggccagccuggccaacauggugaaacccccgucucuacuaaaaauacaaaaauuagccaggcgugguggcaugcgccuguagucccagcuacucgggaggcugaggcaugagaauugcuugcucgagccugggagauagaggcugcagugagccgagauagcgccauugcacuccagccugggugacacggcgagacucugucucaaaaggaaaaaaaaaaaaaaaaaaaaaaagaggcagguaugguagcucaugccuguaaucccaacacuuugggaggcugaggcagguggaucacgaggucaggaguucaacaccagccuggccaacauggugaaaccccgucucuacuaaaaauacaaaaaaauuagcugggugugguggcaggcaccuguaauccuagcuacucaggaggcugaggcagagaacugcuugaacccagugagccacaaucgcaccacugcacucuagccugggcgacagagcaagacaacgucucaaaaaaaaaaagaaaaagaaaaagaaaauaagagcacagaagguugcugaguggguuaauaucugaacaacgcauaacaguaaccaggggccaggugcgguggcucaugccuguaauuccagcacucugggaggcuaagguggguggauuucuugaggccaggagcucaagaccagccugaccaacauggugaaaccccaucucuacuaaaaauacaaaaauuagcugggcgugguggcgggugccuguaaucccagcgacucaggaggcugaggugggaggaucacuugaagccgggagguggaggcugcagugagcugagaucaugccacugcagacuagccugggugacagagcgagacucuugucucacaaacaacaacaacaacaacaacaacaaaaaaccagauccaaaagauccagcauuuaccauaugccaggcauuccuccaugauuagccugccucauaaagaugaggaaacugaggcacagggcguggggauacugagucauuuacaaaggucagugaauuuccuuugucccaggaacuuguuagaggcaguucagguagaguaaaaagcacaaacccuggagccaggcugcauggguucaaguccugguucugccaucaguaaaugugccaucucaggcuagucaucacaccucuuugugccucaguuucccugaucuucagagaggaaaauaaugagguaagcuuacccuaccucauaaggcugcuuugccaaguaacugaaugaauaagacacaugaggugcucagaagagugcucugcacauagugagcacucaauuaaggcuguuaauguugcuguuauucuuauuacuacccaguaugugccaacaaucccaggcagggacacucaaaggagauuucaggaaacuguccugagugauggugccaacauuuccaaacuacccucccacugugggaagagggaccaagagaaaguuaccucuaggauaaggauaaugcggccacuggcaaggcccaucagcaggugggugaggugggcauaacccucaggugacaccuggcagccccccagcggauccccccgugcagcaucaaagccagcugagaccagcaccaguucuggguuaaacugaggcagggagagaagagauguauaagcaugaggguaggggcuuuugguaggcaguaagugauggcgacccagagacauggagaaaaggacaaaugaagacauggagaugcaagucagagagauggagacacagaaccuggagacuaggagacacaaaagcagagacugaaaaugaagaagggaagaaaagaaauacagacucagagguagaagaaauagaugcagacuuagagacauggagauggcagaaagggacagaugggggccgggcaugguggcucaggccuguaaucccagcacuuugggaggccgaggcgggcagaucaugaggucagauugagaccauccuggcuaacacagugaaacccugucucuacuaaaaauacaaaaaauuagccagacgugguggcgggagccuguagucccagcuacgcaggaggcugaggcaggagaauggcaugaacccaggaggcggagcuggcagugagccgagauugcaccacugcacucuagccugggugacagagcaagacuccauuucaaaaaaaaaaaaaaagggacagauggggacaugagacagacugacacgucaagagagugacaugaaaaacagagagacagagacauguccucacacacacauaccccagggucaaacgugggacacacauacacaagauacaggguuuuauauacauagugccaaagagaggugcuugcacacuuccaaaacagaagauggcaacgcaagaaccacauacagagaagauggucacacagagccacacguacugccacacagacaguaccauauagaucaguacuauauaucugcacuagucauguacacacacacaguuucucaaagaggacaauaacccacagccauccugcacagucacauacacaugccaucaccacacagccacaacggcgacaugcacucugguauguccacaagagcugguuauuugcacauacaguuguacacacacagaaggcuguccuggcuacccaugcacagucagaugcacaugcagauccaaagaugcacaccggcgcccagggugacagagcggugcucacacccuuucccucccucccagagucagccauacacaagccaccagccuccuagcucacacagagggaaggcagcuaccucccagucagagacauacacacaaacagccagggcagacagccagacagugacugcugucacacacagccuuccacauccagaaggucccacacaggcugucacagagaugguugcauuuagugacauacaguaucacacccaucacacagagaaaaggugagaaauaccugccugcacagagucgcacacgcacauacucaagcacuugugauggcacgcacauacaacacagauccagccaggacacgggccauuggugcauagucagaaggcccucacacacacagccaagacagucacucacacagugucacacagagaaggcagucauguacagccaucugugcacaaauacacaaggugaucacagccaccaacugcccugguagccucauuaaacacccaugcgcugucucauaucaucagccacaugguagucacacacacacaugccaaggaggcagguccaggcugccaccugcacaggcgugucacauacguccugcgaucuauccugagcuguaccucguaggcaaugggaagcaccaggcgaugccaggcagcuagguagucagcaucacccaugcggggcccguuccaugccacguugacggugaagccugugcccgcagcccggccgaucuggcugcuggcacccucaucccccauggggaagaaggugccaugaucauagcggugcagggacacauauagcacacugccagggagggggugggaagcggaccauggcugguuaggggcuccaguaccccugaggugcucacccgccucccugaucacacugcggccccugacugcagcccuuaccuggggucauccucaaacaugugcugaguuccauuaccgugguggacaucccaauccacaaucaggauccuggggaggagacagcaccucaguaaccgacgauacucacgcccuggaagagggcugggcuagaccccuggggucugcaggggcauuuagugcugaguggcaggacccuggguccuaucaguuaaggagaaaagucugauccugguucccaagggcugcccgguaggccugagcaagugcucggggcugggcccugggcucuucugggucauugcuagggaacuggacccugggccuugggcagcuaaugcugggggcugguucgugggucuucuggaguaugcaucaggagccuagaccuggguucugucgaggcagcugcuauaggccagaaaugcuggggugggacccuggauccuguuuuguaagugcccagguaacaugaucuggggguccuaucuaaauaagcacugagaggcuccauccucgguccuucucuggguaaggacugcacccuuacuucuuucuggggaaggaaguccugggagcuggaccauggggcaugaguaaacaaugggcuggggggagcauccagguccccacaaggaucaggauuugggggguccccagggaguccuuaccguagggcaugcccacugauagucugggcauggcgagcagccacagccacagaguugaaaaagcaaaaaccgcaagcugcauccugcucugcgugguguccugggggacgcaccacagcagcaccauucagaaccugggaagcagcagggugcuaagaucggacagccugcccucaccuuccuuucuuccuuuuuuuuuuuuuuuuuugagacggagucucgcucugucgcccaggcuggaaugcaguggcgccaucucggcucacugcaagcgccgccugccagguucccgccauucuccugccucagccuccugaguagcuaggacuacaggcgcuugcugccacgcccggcuaauuuuuuguauguuuuuuaguagagacgggguuucaccauguuauccaggauggucucgaucuccugaccucgugaucugcccaccucggccucccaaagugcugggauuacaggugugagccaucacgcccggaccuuuuuuuuuuuuugacacagggucucacucuguugcccaggcuagagugcaguggugcaaucauggcuuacugcagccuugaccuccugagcucaccucagcuucucaaagcgcuaggauuacagacgugagccacugcacuuggccacccuucccuuucuccaguuccuuccauuauucccccagccucuaggcccacccccucccgugccccuccccauggccccuuuccucaggcccugcuugacucucucagagccuccagaaacagcagauggcucucuuuuuccauuccccccagguccuccucuccccagcccacagaggacacaccucuccugagagcacagccuccaccaggcggcaggcagcgccaguggcaagcugugcacaggcgaagguacuggggcagauauagauggagucaaaguuggaacucucacggugcagcucccggguuuucauuuucucuguggcccggagaugacccacguacucagcacuggaagcacagagaggagcacccgcaggacagugaggagggucuguccccucccugguccccaccccuaagacagggacuucagccccucucaaguccugcagcagcuccccaggaggggaaacccaaguuccagccccugagaccucauccacaguccugggaauccacccaccccaggcaccggggucugaccugugacaggugagcagcucagccucuguggcagggcgcggugucagggugaggcagcgcccggcaaggcccagcuccuccagacggcacaugauccgcaagaugcgcugggguaccucagggugguggcuagcaguggggaaacgagagguagaggcuuagugccugagggggagggacccccaacaccuacucauccagcccuccaaaugccuaccugucccacaaguugcagugauucaucauauuuuggucauagaccagcccugugcgagacuguagcacuggccaugucaggauugggagcacagggggcucccaggguccuuccuccucgcucuccucuacauuguccuccuccauguugucccucuccacggucucagcuaaaagggggaggccacguuuguccuacccucucaaucugaauccccgucauacucuggaacucaggugacccaaacagaaaaaggggugggaggccugaaaccagggcccagggagagagagagggccugacccucucccaccaaggcagcccaguaaagucagaggaagucugaagacagucucccccagggcucaucccacguccaccccacaccaggcccacaccccacuuccuacuugaucucacaagaaccucccagaagggcucaagggcuuccagagcacaggaaacugaagccugggcacugcagggcagggagaaaauaugaugucaaggaaugugggcgggcagugaggcucccgcuuuccccuccuccaccggggcucaccuccggcagggggcaccaggugacuccagcauggggcaagggucucccagaaggguguggagcgaagcacugacgccuucagccagggcgcggagguuguagccacccuggggcaaggaguugugaagggggaucaggaaaggaccagacaugaccagggaauaauaauaaugaugauaauaagagagugcauaccacaugucaagcaacaaggaacuuagaagggugccucacugaauucacuggacaaugauaugaggugauuacauuaugcucguuuuauagaaggaaagcggaggcacaaagaagugaagugacuuaugcaagguuguccagcuaguaagugaauuccugggccaggaacuccuguuggacuugaaagcuucguucuuaagcccuccaggauccacaggcugagggacgaaggugagucacucaccuccagagacaggaucagcuugccuccugccagacccaugagcagguggguuagcugggcgaacccugccggaguggcggccaucucacccuggggggacauggagggucagccuggcuccaugcaacccaccugccgccccagggagccugccuuaccuugggguccccuugcagggcaucaaauccagcagccaccaggaccagcugaggcuggaacugaagggggaacagacuccaugaggcuaccuacccucacagccuaaccuucaaggccacuccuccucccaacacaccccagauccccaggaccucgagggcgacuggcagcaggacgugcaggaaagcagcaauguagucagcaucccgcauccccaccugcagacacaggagugugaugggggauguucagccaccugucccgagccgcugacagaagggcggggcugggccucacuuugggggcagagguggguagaugcugaccugguuccaaggcacauugaugguauauccuuggccuuggccgaaaccugugguggaccaguuagaggccuucagguggggccagaaccuacccugcucguagcgguggauggagaaauagaggacacugggggcagaagaaaaagagguaagagaguuggagaagucaauccccauagacacccccaacccaacaguugccaguuuccucuaccacucauuuccccauucaaccacucguucauucucucauucauuaauuuccccauuaauuauuuaauccaugaauccauucuuccauuaauuuacccuuacauucagucaccaauuuaaucaucuuaccauuuuuucauucuuaucuuuauuuauccauuaccucacucgcucauucauuuagucucucaccagaaccucucccucagcaaacaucgcugcccccucagugcccacccaauuucaggcucagcucuagggucuaucucagaucaugggggcuccugacucugugggguacucuagaucauguccgcccacuaccugccccuaugacaaagguaguaguaacagcaggucaaacccugugacacuggaggcccaaauggagcauggggcucuuagcugcggggagccagcuaaggcugaaaagagccucaagccaggcuggggagcugggugauucucuagcaggaaguggagagaccugggggguaggggugagacuugcuucuguggguggaacuagagcgggggugcuggcuggggcugucaugaggccagugaaagggcaguuccuccuccccaaugccuuacaggccaccucuacuacuucuucuauuuuauaggcgagagaaugagcacucagaggggugaguaugaccgacacgcaaaacagauacugaaaagaugcgaugcacguguuuugacagaaagcccagcaaggggccaugggagggcuuaauucugacuggggaaagcaaaaugaauaaucuaucauccauccauccuucuaucuggucauuuacccccugcuuuguuccagagaggaucuaaggcagcuuuuuuagggaaaugcaagaaauagugguaugcauugaaucuagacaaacuuaagagucacauuuuaauggguugauaauguaguugugaaauuuaaugcaagugauauagaaagauucuuaaaauugagggaaaagagcuuggaauuggggaauaaaaacaagcaaaagcucugguguugaguagguggaggaugauuguuuuauuuuugacauugauagauaaaucuugguucuaaacuuuuaguaaguuaaucauuagaggaagagaaacacaguaggacauaaaaauuaucaccagagggcugggcgcagugguucacaccuguaaucccagcacuuugggaggccaaggugggcggaucacuagaggccagaaguucgagaccagcauggccaacauggcgaaacccugucucuacuaaaaauacaaaaaauuugcugggcgugguggcgcgugccuguaauccuagcuacuugggagguggagguaggagaauugcuugaacccaggaggcggagguugcagugagccgagaucgggccacugcacuccagccugggcgacagagcaugacucugucucaaaaaaaaagaaaggaaaagaaaaaaauaucauuggggaagacaggaagaaagaaaagaucugaagaaagcugacucuaaaagagagccaucaaagucaauaaacagcagaacuagcacucaagcuaaguuuaaaaagaaaacagaagggaaauucaaaauaaguucaaccaccuucaaguuaaaugguggauugauagcacagguuuacuuccucaaccuccuacuaccccauucaaaauacaguaaagaaauuguaaacaaacagcaacccagaaagagagaguggaaaggaugucagagaauaagagacuucaaugaauuucuagaaaguagacuuugagauuccaggggccccagggugcucugucucaugcugagcaggauaagggggcacccaagauaagcugaaguuuccuuucuggagaaauccaguacagauccaggucaaugcacacaaaaucccuucugaagagccaacucacugaaucaccaauacaacaaaguuacuuguuucuuuuaacuacuuaguuuuagaucaucugcuuuccuugucuucacaacaguauuuuaaggauuauccaguuugucucccugcugcuggaguucagagacugagagauggggagcugggagauccaagggcauggacauguucuuuuuguuuguuuguuuacacacguuuguuaauaaggaagaaugcacugaauauauucacaguguuucacaucuguguguguaaucaauaguguacccaugaaagaacacacagcuauagccuccuaugcauuuauucaaacaaaaagaaugauuaaugauauuaaagaauucuuugaaugacagacccuuggcagauuaaaaaaauaauuauuguuaauuuucagguauugauacuaagguaaugcuuuucuaaaaaaguguacuuauguuuuagagaugcauucugaaauauuuacaggagaaauuauaugguaucugggauuagcuuugaaggaaaacaggaagagggcaguggguacagguauagaugaaaugagaucggccaaugaguugauaaauguugaagcauuaaauuccagaagccagaaaugaacaaaauaaagaacgucggaggaaaacauuaauaaagauaaaaccagaaaaauuaaugaaguauuaaaaacccaccauaauaaaacaguagagaugaccaacaaagcccaaagcuacacuggaaaagauaaguacaacagauacacuuuggaaaggcugagggaaaaaagagauguuaccccaaagaagaggccuccuuuguucugacaucuggcaggaucccaucuaaugcccggguccuugcccacacucgcuaaaguugcaaccugucaguggacauucccuguccccauucuggggaaaugccuuucaggaaaacagaccuacaaacacugcagcagaguaguccucugacagcccccuacaaugggccuucauucuuggguauaaauagccaaauaaggauugcuagacauuugaggaaaaccaucagcauaaaagagaaggaccaagaaaaaaauaauucaaccagccucagaauaaagagacauaacucagacaacagaagaaacuuaaggcacuuccuuuuuugagacagggucucccucuaucgcccaggcuggagugcaguggcaugaucuugucucacugcaaccuccgccuccuggguucaagcgauucuccugccucagccuccugaguagcugggauuacaggugcgcaccaucacgucuggguaauuuuuguauuuuuaguagagaugggguuucaccauguuggccagacuggucucgaacuccuggccucaagugauccacucaccucggccucccaaagugcugggauuacaggcaugagccaccgcacccagccggcacuucuaauccauacucuauaaaaacaagaucagguaugagaggacauagaaacagagaggaagaaagagcuuuuggaguuuaacaggauaucuaaauacauaauucaacagaagggcuugaagauaaaguugacaaaaucucccaggucacagcaaaagaaaaaagagacagaaaacauaagauaaaaaauaagaagccugggcaacauggugagaccccaucucuacaaaagauuaaaaaauuagcuggguaugcuggugugcaccuguggucccagcuacucaggaggcugaggcaugaggauugcuugagcccgggaggucgaggcugcagugagucguauuugugccacuguacuccagucugggcaacagagcaagaccuugucucaaaaaaaauaaauaaauaaauaaauaaauaaauaauaaaaaagagagagacauagaggaucaacccaggaagucuaacaucugacuaacagaaguccuagaaagagaacagagaaaacaaagaagaaauuaucaaagaucuaauagaaaauaauuuccaagaguuuaagaaaagcaugaaucuucagauguaaaaugucuaccuacuauuaaacagagugaaaaggccaggguaaaaguuuagaacaucaaggcuagguacaguggcucaugccuguaaucucagugcuuugagaggcugcagugggaggacacuugaggucaggaguucgagaccagucugggcaauauagugagacccugucucuacaaauaauuuaaaaaauuagcugggugugguggcacaugccugcaguccuagcuacuugggaggcugaggcaggaggauugcuugagcccaggaguuugagguuacagugggcuaugaucaugcuacuauacuccagccugggugacacagugauacccugucuaauaauuuaaaaaaaaaaaaaaaagaacaccaagauaaccuugcagagaggaaaguagauuacuuggaaaggaaugaaaagcagacaccugucaggaacacugaaugcugcaaaauaauaaagcaaugucuagagaacaaccaaccuaaauuggauucuucagaucuuggauaaguggauucucuguagucagcuaggaagaaggcuagauaaaacuacuacagguugagcaucccuaaucuagaaaucugaaaucugaaaugcuguaaaauccuaaacuuuuuuuuuuuuuuuagauggggucucagucuaucacccaggcuggagugcaguggugcgaucucagcucacugcaaccucugccuccuggguucaagugauucuccugccucagccuccugaguagcuggaaauacaggugugugccaccacgccuggcuaauuuuucuguauuuuuguagagacgggguuucaccauguuggccaagcugaucuugaacuccugaccucaggugauccgccucggccucccaaaguacugggauuacaggagugagcuacuucacccggcccuaaaauccuaaacuuuuugaaggccaacaugaugcucaaaggaaaugcucauugggguauuucggauuuuggguuuucagauuaaggaugcucaaccacuaaguauaauauaaauauuucaaaaucugaaaaaaucugaaaugugaaauacuucugguuccaagcacuucauauaagggauacucgacauguacuuaguaaugucuccuacugacaaggacuugcucaaucacuuucugcaggaaggguaagcugguccccuccuggagggaagucuggcaguguauaccagacuuuaaaguaugcugacucucuggcccaagcaacccacuguuagaaauucauccuacagauagacucagagaagugcagaauuacauauuuacuagacuauucacaguagaagugccuguaauagcaaaaacuggcaggcaucuuaaaaguccugggguuaaauaaccagagguacagucauaaaauugaauacuacaaagaacgagauacuuuaagagguacuaacauggagaaaugucccagauaugcuguuaaaugaauaaagcaaguugucgaagaacauguggagaauuauuccauuaggcaguguguuauuaauaauuauaacaauaauaauaaaaauucagacaucuauagagaaaaucuguaaggauauaaccuaaacugucaacacuuauuuuugagguaauggaaauuagaggagacucacugcuucagacacuucuguauuauuuaauuucuuuaaacaaauaguuuguuauuuauuuauuuauauuuguuuuuuacuaucuacugaaaggauaaacaaacacuuugaagcauuauccuaaucagaaaaaauaaagcaguaauuugagguucacucuaacccaacgguuaaucagugaauaagaucuucaaauauuugugggucaaaucccgucucucccaguucuucucugugugaccucuuaacguauaagccucagucccccuaucuguaaaauagggaacccaacagucccugccucagagugaaauuaggagagauggcagacacacaaaaguagcacagauccugaucccaggauaggccccaugaaugugaaugccuuuuccuccuucuggaccccuucuggcugggccuguaagggugggagguggcugggagucuagcaccuaggugggagucgggguauaccugggguccuggucgaaggugaacuguguuccuugaccguggugcacaucccaaucuacgauaaggacccuaggagcagcagagagaggggacucugugcaaggagaucaaggugaaucugggggaagagcccagaccaggacaccccaccccaugccacccccaucacaucugcccucuguugcugaccuccggaugcgguguuucuguugagcauagcgggcugccacagccacgugguugaacaugcaauagccauccauaagacugugcugggcgugauguccaggaggccugggcaagacaaggaaauaacagcuuggaguaugugagggguccuccucugcagagacagacuguccccugcucucuaauccuggaccaccaauuccuuuaaugcugaugccuaaaaaucugccgggaacugaguaauggaggcccucaaacucucacccccugccaaucuaccccucugucuccaaaggagauuugaaaauguucacuaaaaugauaaaggccgggugcgguggcucaggccuguaaucccagcacuuugggaggccgagguggguggaccacgaggucaagagaucaagaccauccuggccaacacggugaaaccccgucucuacuaaaaauacaaaaaauuagcugggugugguggcgggcgacuguagucccagcuacuugggaggcugaggcaggagaaucacuugaaccugggaggcagagguugcagugagccaagauugcaucacugcacuccagccuggugacagagcgagacuccgucucaaaauaaauaaauaaauaaaaauaaaaauaaaaugaucaacgcauucauucucauacccagucauucugcugcaggaacuuagcccacaaccuguguuuuaaaaagggugaaguaacauuuuuauuuuauguuaguguaaaauaaaauuuuauuuuuauaaagguacuagcauauuugcuguagcauuuuuuuaaaacagcaaaugacuggggagaaccaaaaugcccauuagucggggacugauuaacauagagugcauuuacacaaugguguucuaccgggcuccaagauacauacuguuagagaaagguuuccaagauguguaagugaaaagaugguacgaagggaguaugucauguuacuaccauuugugguuaaaaacaggggagggaggagaaagcuuuugcauuucaucaguucugggaugccaaugaugauaagauguaccaugauuuuacaugccaaaaacgaagcagaaaauacugccaauggaauucugagaugucacuguuuguaagaugcaucuggauuucaagauguuacaaauaugaaaaaauguacaccuuagaaucaaugaaauaugguauuuauuucuugaauaagacuuugugggaggacacaugagucagugguuccaaugacuaccucccaugagaggaggcaggugucugggugacaaggaugggagacagauuuuuaauuauauucucuuuuuuaccuuuggauucuugaaucacaugaauauauuacccauaucaauacauuuuacacuugaaggaaggacuuuaaaacaauguaaaaagucaaaugcuguagaguccuaccuaaugauggccaugccauuccggaucucagcccccaggaccgcauccaccagccugaggacagagccugaggccaggcaggcacaggaguaugaguucuggagagacaguggggagccagaaagggaguaagggagagaacagcccuauccacucagcugcuucccccaggguggggugggcauagggauggggaccccaagauugccaccauucccugcccgcagaguucucauccauaccggaugcagauaaacugagucguaggugucugcuaggacacggaguucucccucauucauguacuggguuguuuccaucagaucaauauauucuaggcuagacacagaugggagaugagauucagggcccugucucuuccccaacugagcuguccauacaccaacccccuggucaaauuagggcuuggcucccccaacugucaaccugaaggaauagccaggauauaagacacauucuguuucuucccuagcccgccucaguucagguaauguucucugcuccccugcaguagccacaccaaauccuacuuucaggccuuuggccacacugguucagcugucuguucuucccuucccucagucacccucuucaucugacucacucuuuuucuccucuuaaaguucagcucagauaccugcucuggaagcuagcuuuccucaagccacauagcacuaggccucuaaaucuggaagccccugggggaaccccgaucacucuguccacacauccaccaucuauucacacaaucagaucaugauaacaguaauagcucaucaugggcugauuauauaucaggcccuguucuaagcaccugacacacaucaaacucuccugaggaacuuauguuuacugguccccuuguuacaggcgaugacacagauucagaaaggcucagcgacuugcccaaggcuggcugcagagaccaugacauugcuucccaaagcguuuagcuugcccugguuuguccagggcaggcuccuccccaucccuacaaggcucccaagccuucaccugugaaccaacaucagcucuuccuuuucagcaaaccgggccuggggagagaugaggaauaaagugggguaaaggguuaaggcaugggcugcacccaggucaggucagcucccugcccuucacccagaguguuggcuugggggccuuaccugaaaggacacgcagcgaucuaggaggcccuccuggaucaguugcuccuugauggcauggagccgcucagggccuuccgggaagcuggggagauggagucacagucacagaugcaugaggacacuggggagcuccacaucuguucucuccacaucuccccauccacccuuccacagcugcuuaccccaaaacuguggugucaguccugccucccaucagcucuggugugugacccucuccucaccacugccacugcuauuaccauacccucccgccugggcuguggcggcaucuccucggccucccugcuucgacccucgccaccucaacgguccuuucugugcauagcagcuagacacugguuaaaacccuaaucaguucaugucccuucgaggcucccaucccauucugaguaaaagccaaaguauuacccaugcccagaaggcccuaaacaaucuguccuccaucaccucucugaccccaucuccuaccccucccucuuuccuuugcuucgcuucaccuacacuggucucuucccugguucucaguugaaccaaauacucuucagccagcccuagaacuuuacucuagcuggcccccccacccccgccuagaauacucuuccuccaacugucuccaugacuuacuccuucaccucuucagaucccugcucaaauagugaggccuucccugaccagccuauuuaaaauugaagucuccuccacuguacuuucuccuacuauccucccuuuacugcuucuucauaacacugcucuuucuaccacagugcaucauuuacuuuuuguuuauuuauugucugucuucccccuuuacccugaagacacaggcuuuuguuuguuuuguuuacugcuguaucccuagcuccucaauagaugguaaauagguauuccauaaaagaagucuuuuucccauaguaaguuagucuuagguugggauaagggauauagauauuaauugguaaacacacaaguaugauaauuagcaaacaaugucaugggcuaggaaaauaagaucagguauugggguaggguuuggccaggcaaaaccuucucugagaaagucucauugggaugugaaaggcagcuggaagaguagaagaccgaaaagaaucucugggaaagggguuggucaggguacagaccagaggcaagagggugccuggcauguuggaagaacaaggggaguagugugggcgagaaggauuggcugaugaggucacaaagugauguggagccagaucauguggaaccuuugaggccaggaugaaaaauuuggacuuuaccuugagggcaacaguuugcccuuaaaguacuuuuuuuuuuuuuauuuuuacuuuuugagacagaguuuugcucuuguugcccaggcuggggugcaauggcacaaucucggcucacugcaaccuccgccucccagaucaagcgauucuccugccucagccucccaaguagcuaggauuacaggugugugccaccacgcccaacuaauuuuuguauuuuuaguagagacaguguuucaucgcguuggucagaccggucucgaacuccugaccucaagugauccaccugccuuggcccccccaaagugcugggauuauaggcgugagccaccaugccuggccuccuuaaaguauuuuaacaaagacaucaacucauacauauuuuuuuagguugcugcaugaacagauaauagaggugagguuggaaguaggggaccagggaggaggccucugcaagucuaggugagugaugaugaugguggcaguggagguggugaggagaggucagauggugaauauauuuugaacauauagccaaaaggauuugcugauucuuuuugaaaaguaaagcaaacgggagguuucauccuucuguuucaguacaaacgucucuuccucuauaaaggcuucugggaagcccggauacuaguuuaggauccucuauuauacacccuugaauccccuggucuuaagucugucuucauuaaacaccucauacugcuguuggcuguuuaaugaucugcccuccuacucaucaauccgcuccuagagaaggaccccugucuguuguuugguacauuuguaucaccaacucuuggcacacaauaggcacucaauaaauguuuguuagcuacauaaaagaacccuuucaagugugagcccuaccuccccaaaucaucugcuuccaguauccaggcugggguaagaaaagauuuauucuugcuaaugggcucuaaguguguguauuuuugugguuuggagacagccuggaggacccagccucaccugucaucccagaggcaauggaauucauuuaacugcucauccaacaccaagccagugccagccagugcuucagccucaagguucagauccugcagaggaaaaaaaaaaggagacacagauccauuuuaggcccugagucagagggaacuguccaggguggggaaccuuuggguuuugauugucauacgaggcuaaacugcagccaggcccugcucaccaucccuugcagucccacgauuaggucuucuuccauugcuuggccgagcuucuucauuuugccuuucuucuuuaccuccgcuagauuggggauagagcggggaacggcucccuuuuuaauauuucgcuucugugaaucagagagaagggucagaguccagggcaugaccaacuugcucccucucccccucaucagggcgggucuagggccucaccgaagugacacuggaguccugagggggcgacuggggguucugccuacuucuucgcugccugguugugguggaauccuggccgguugaggucauaguugaggaggcuuggccccugccgcgguucuggggguggggggaggagcguggguaugugagggggcuagugugcccugaggaccccaccucucugcccuuuuccaggcuccgcccccucuauuagauuccauuccuuacgcgaucugauucuccacagccuuccaaacuccgccucucucaggccuucucccuccacucagguggccauucuacccggccccgcccggcccgcuagacuccaccccuuuuacacgauucucuuucccuggucuugcccuuucacggagcaaugagcccccgggcucacacaguccgucuuagggccugcccuuuccaaccaaucaccgccccuucuacucuccuaagccccauucccagacccucuaagcccagcccagaccccauuccuucacgaaccugcccuuucggccuaucucccgggauaaucacccacccuuucacucagccggccccggccccgaccccgguuucgacuccacccuuaacgauucacuuaacuccaccccuuaucgggccggaccgguaccuuccacuccgccagaucccgccccuagcguuucaaccagccccgcuccucaggggacugccccguuccuucaaccagcuccacccccugcccagacccgaccgcuaacguuucgcuaacccucuucagccagucccuagccgccuucggucggccuccgcccc

SEQ ID NO: 18913 - RNA, 423 nt, Homo sapiens
auacaaaauauuccagauaaaugaaauuuaauccucuucuucauccugguuaaucuagaaguaauguaauucguaacucucuuugcuguuagcaaguaugcgcaaccagucacauagauuauuuuucuucaaauuuuuuuggugagauacuucaaauaccuuuuggagaaagucaccuuggaugucacagugaucuugcucuugcuccuuucguuggucaccaccccuccaccaagguucccagcuuuuccauucacuuugauccuuucuugcaaaaacugcucaaaauuggcagcauccaugauuccaucuucuacagggugggugcaaucaagagugaacuucagaaccuucuucuuuuuuuugucccccuucgccacaagcuuuuucacaggagcuaugguggcagcggaguuagaaagg

SEQ ID NO: 18914 - RNA, 11438 nt, Homo sapiens
augugacugauaacacuauuuuuauucuuucuucauuauuuauucccccuuagguggugagucaagaaaagugccaccaagaugaguuuaaaguagaaugucaaaucugccaccucaaaauuucacaaggaggaaacccccaaaaucaugcacaacaauauucacaaucaaucaucuugaauccagacucaauagacaaugugaagaguguaaacaaaagaagaaaguguuagcgaaaaaggagguuccucaaaauuauccugccauccacagaccuugguagaaacugggcaucugugugguguugcacacugugcagaaaaacaguaacagagcaggccucaacugcgauccuuggaaaggccugcuucaagguuggcccuuggguggugucuaagaacauagacuccaggaggguucccaccauucccuaagagauaagaauggcucacucgggccgggugugguggcucacaccuguaacgccagcacuuugguaggccaaggugagaggaucacuugagcccaggaguucaaggccagccugggcaacauggcaaaacccaucucugcaaaaaucagcuggggucaugguggugcaugucuguggucccagcuacuuuggaggaugaggcagcaggaccgcuugagccugggagguugaggcugcagcgaaccauguuugagccacugcacuccagccugggcaacaaagugagacccugucucaaaaaaaaaaaaaaagaaagaaagaaaaaaaagaauggcuuacucuaccuaagcuguuuguauaaaaaagugggccaggagcgguggcucaugccuguaaucccagcacuuugggaggucgaggcaggcggaucacaaggucaagagauggagaccagccuggccaauauggugaaaccccgucucuacuaaaaauacaaaaauuagcugggcguggugguggcaggcgccuguagucccagcuauucaggaagcugaggcaggagaauugcuugaacccaggaggcggagguuacaguaagccgagaucacgccacugcacuccagccuggcgacaaagcgagacuccgucucaauuaaaaaaaaaaaaaaaaaggugguuuaugcugagccccugcuuuccuuuugggagccugggauuuggguaggugccaggcagggggugccuaugugaccaugccccaauaaaaacuugauaccagccaggugcucacgccuguaaucccagcaguuugggaggcugaggugggaggaucacuugaggucaggaguucaagaucagccuggccaacauggugaaaccccaucccuacuaaaaauacaaaaauuagccgagcuugcuggugcgcgccuguaguuccagcuauucgggaagcugaggcccgaggaucgcuugaacccaggagguggaggcugcagugagccaagaucaugccacugcauuccagccugggcgucagagcaagacccccccccccccgccaaaaaaaaaccaaaacaacaacaacaacaaaaaaaaccucugggugcugagucucuaauugagcuuccuuggucagcaacauuucgcauguauugucacaacccauuacugugaaccgagcacaucuugugugacuccaaugagagagaagcccuggaaacuugugccugggucucucugggaguugguccugcacaccauuucuuuuugcugauuuugcuccauaucuuuuuguuguaauaagucaaucguagccaugaauacaaccacauacugagucuugggaguccuccuagcaaaucacugggcuuggggcugguauugaggaccaugacacacacacacauacaugaccuuuaccaugggaacaauccagcucacugaugucccuaucucaccaccauguacccugaggucuauuagauggaagugccaguuagaaaugcuuggggugcaaguaaccacacugucaaauaacuggacugaacaaacgggagauuauuucccuccaacaagacuguuggugcgaguucagcagcucagcaaugcugggccaagcuggagucucuaccacgcuguggacugacccuaaggucccaagaugucagucgcaguuccagucaacgcauauguggcaacaaauggagcugagaaggaagggaggggccggagcaagagccucuuugcugcuucagguaacuuugacauuuucuggugacgcaggccacugauaagugauuuugguuauuuacccccaucaauacucaaagcuuuuucuccucucuuggggcuccccucaaauacuuaacaucacuuuuuggucucugagcuguuccagggcuggaauuuguacccuggauggggcugggaggagacagggguggucugagggauggagauuccgccacacagcaggaggccccaggucagccuuaacuucccguugcuccugcaccagcuuggggcuccaggacucaacaccucugcucccugcuuuuaauaaacaacacaaugcacagaaggguugggaauaucgcccccugaggaggcagcagaguccugcagccuaacauagugaacccccuggggguccgacccaacauucccccgccaacuccuccacugucacuacccuggugcaaguccccaucacugcgcucagaggggucuccugcuggguccccugcuucuacccccacccccaaucuguccccuucagcagccagagggagccucuaugaccaagucagaucauguuccuccucugcuugacaccuucuggucacccccacucagaaaaaaagccaaaguccuaacuguggcccaugaagcaucuggccugucugaccucauguacugucacacucugguccagcaagacucuggcauacacaaugauccuucuggagcgcuccagccucagugccuuuaggcuggcuuucucucugccuggaauguucucccccuacacuaugacucccacucacuucauucaggucuuuaaaugucacccugagccaggcguggugguucaugccuguaaucccagcacuuugggaggcugaggcgaguggaucgcuugagcccaggaguucaagaccagccugagcaacauggcgagaccccgucucuacuaaaaauacaaaaauuacccgagugugguggcacacaccuguagucccagcuacuugggaggcuuaagugaggaucacuugagcccuggagguugaggcugcagugagcuauggucaugccacugcauuccaaccugggugacagagugagacccugucucaaaaacaaaaaagucacccugucaggaucaucuucccugaugcugucaccauaaagagcccacucccccaacuucugcagcucugucucccauccuugcuuuauuuucuucauaccacucaucauuagcuggccuguuccauguuuuuaucuacugucuccgcuaugaugcaagcccaaugaaggcaggcauuuccaucaguuuaggucagagcaguauccccagugccuagaacaguuccuggcacacggucagggcucacuaaugucuaucgaaugcauaaguguguaaaacaguuaaggcagggccuguaacccagcagacauucaaucaaugcuuguggaaugaaugaauccgucgaugcaugaaugcacaaaugagucaaugaaccccguuccaccguguuccuggagcugcccgcugcccucugcccuguccguccccggcagagcugggagccggcccucagcaugaccaccgaaacuuuauuuacaacacgaggcuggaguaagaggggugggauggaggacagcagcagggccgacaggacccuacuucugcucccgccuccagacgaugaccaugccgcuggcgucacuggaggccaguaggcucucgucgcaguugaagcugacaucaagcacaggugcacuguggcccugcagcuuguugacagcagccuuggccgcccgcuccacaucaaagaagugcacgcacauguccucacugcccgucacugucggggugagagggagaggccaucgggaggcgccuggggugccccuggugggaagucccugaggugucugagguguugaaggguguauguccgaggugugagguccuagcauggcuuggggagguuugagggggccccaucccuagaugggaggucaccuggcuguuuugguacugugugcagaaugcgaggucucugggcuguuuggggaguuagugcguucaaagugugaguuuucaucacuucucggccuuuuggccgagaucaagugcaaacugugaguucucugagcuguuuggagcugugaguuccacagugaggcuguuggggcaggaggggucaugagguccaggaagucagggcaucggugucgugaugucugagccagguuggcaccagcccugguuccugccccuccccagccacccagauccccugucccuacaggacucacccacgcaggcccccuggcggaaggacaugaggggacagaagaugcugcgcacaggaugugagcucugcucgauggggaagcuucucuucagcugcaggguccccucguugucuaccacccugagaggaugagagagugggucaaaacacagccccagcccuagcagggagacaaguugugggccuguguccccaccccugugccuaaguucuuuacaggguucaugaaacccauauuuuuuuuuuuguuuuugagacaggaucucacucugucacccaggcuggaguguaguggugcgaucacggcucacugcagccucaaccuccuaggcucaagugauccucccgccucagucucccgaguagccgggacuaccuauaggcacacaccacacccagcuuaugaaacccaauucugagaugacuacauaaacuauaaguaggggcugaugugugaguuacugaugguucagaaacugucucuguugauauaaaugggagccucugcaguuucauucacuaguuuuucuuuguaagggucucuaaaagauccugguauuaagauaagcacaaagagaggaaaugaacacaccaugguaugcccacacuguggaaaacugcacagcccuuagagagaauaaaacacuguccccacagguaaccuggggggguuuccacaaggcauugccuggugagaaacucgaaauguaggaaaggccauuucuuuuuucuuucuuuuuuuaagagauggagucuggcucugucacccaggcuggagugcaauggcacgaucucgccucgcugcaaccuccgccucccaaguucaagcaauucuccagccucagccucccaaguagcugggauuauaggcgccugccaccaugcccagcuaauuuuuguauuuuuaguagagacggggauucaccauguuggccaggcuggucuugaacuccugaccucaggugauccacccgccuuggccucccaaagugcugagauuacaggagugcgccacugugccuggccggaaaaggccauuucuuuaaaacgucuuucuuucaaaacuguggugggagcuaggcaagguggcucacgucuguaaucccagcacuuugggaggccaagguacaaggaucacuugaggccaagaguuuaagaccagacugaguaacacagcaaaaccucaucucuacaaaaaauagauuaaaaagguuggccgagcaugguggcgugugccuguaaucucagcuacuuaggcugaggugggagaaucgcaugagcccaggaguuggagguugcagugagccaugaucaugccacugcacuccaaucuggguaacagcaaaacccugucucacaaacaaacaaaaacauacauggauauauguacacgccuaggauuuguggaaagagaaggauauguggaaagauguggaucauuaaugggcuuuacuguggcaggaggaggccagagguggcaggaggaagaaaggagaggcugugggaaaugggcaaacuuaaggguacgcuuaaauuaaaaaauuguuaaguauauauacagaaauuguuuaaaaaggaggagagaaauaaagggguagaauaaaaagcauccuguuaggcagugguuuucaggacuggccagacauugcuuagggaauuucucaaucuaccaaugcccaggcccaucccaaagcuucugaaauuacuggccuguagaggggcccagacaggaguuuuugaagcucuucaggucauuccaauguguggcccaggcugagaacugcauuuggguaacaugacagaugugaguggggacaguaacccccacacuacuccccgcaaaaaaaaaaaaaaaaaaaggaaggaaggaagaaaggaaaacaggucucugcuuuaaguagcccuaaucuauuuuaugcuucaguuugcucaccugcaaaauggagauaauaacagcaccuaccucacaggucggugcaaggauugaauguggugauacguggaaacugcuucgaacagggccuggccacagugauggcuguaaacgcgcucacuacugcuauuacuguuacugcuacuacugcucccucaauuaaauuaaccugauggaggagaugagcuacugucccagugugcuggaggaggcagguccuccgucuccaggaggcccugaugggggacccaccuguagagcagcaacuuguugaggcaagcauugaugagcagugagggaucccgggccucgcggcugacccaggaccgggcugagaugcuggucacagggcuccccucaugcaccaccaaacgcuuggcuuuggucagcuucccugcagcagcagagggagggaaggcaaaggugagggugagggcugugcccugggagggcuggagggcgagcacccagaugcaggccugcugucugccuaccuguggccauaucaaagaggaaagagaagacacugccauggucaucacccgcccagagcagccggccaggggcaucaaaggacagagcaaggacacggccugucagcuugcuggagccccccuucacuuucuugccuguggagauguucaugacaugcacguugugcuuggcguuccccaccuguggggagaaugcacagaccaucauccugcuuccagccaggcccuccuugagucugaccacaguggggcugcuguugaugcgacuggcuggucccuauuagagucuauucacaauagggcuguggcagguagacaaggugaccaggcaugaauccaccucccuagccagccccuuuugcaaucugcccagaguaggccaccugccuacgggacuaaagggccuucagagccaucaugcugccccuuggccaguccuccuacagugugagaaccauagggccugccuaggccugugaucccagcuuuccccugcucccuggcugcuccuuucuggaacuuguggggcugcugcuaaugcggggaggaucccggcccacaagcucacucuuggucuguuccucugcaguucaccccacuacaccccgggccacaccagacuuucuaauguccuuccccugcucucugaccaaucuacccuggagucugacacgguggggccacugacagaccagacgaggcucagccucaucauccugcuccucagagguagccccugcaguuggaaaacuguaggacuguagcugaugggaccaaaggggcuccagagccagaacccugacccuggcccgugcucccuggaguguaccacagcaaggccaacccagaucaagaacggcauuccccuuuuuauggggggugggggcggagucucgcucugucgcccaguggugccaucucggcucacugcaagcuccaccucccagguucacaccauucuccugccucagccucccaaguagcugagacuauaggcgcccgccaccaugcccggcuaauuuuuuguauuuuuaguagagaugggguuucaccguguuagccaggauggucucaaucuccugaccucgugauccgcccgccuccgccucccaaagugcugggauuacaggcgugagccacugcgccuggcccacucccgucuucugaucugcuucccuuuuaagucugaccacacuaggacugcucugacgagauugggugggggguggggggguccuaggcccccccuggcugucccuccuuauacucugauucccucagauagccuuccugacccagcccaccagcccuuggugaguggguguccuggagccugaccacagugagguuguuguugacaggcuggaaggugcagcagagcaguucagcgcuaucggggucagggaucucucggaugcagcgaccauccucagaggcccagaugcgcaugguggcauccagugagguggacacgaggaugucauuggagagggaccaggcgaagucggagacaccacggguguggccccguagcacgcgaagcacuguggguggggcaggcaccagcuggcacagggagaugcugccgucgagugagcagcaggccaggcggugucggucaucauuggcgaagcgcacccuugggacugcaaugccaagaagccauuagugggaaucugcacacucacugggcacuuuucucucuaaaaggcucugacgugugugccuggggcuggggccccacugcaugaggaacaguggccucagcaaagggcuuuccuuggcugacaaagggaacuguaaccccugaagacccucugccaaagcucccuaagucuuagcagcuccuuugcagauugcaaaagucuucugcaacaugaaaaaguuccugucuuagcgaacacuuuauaaucaaggucuuggcaauuugcaaaacccuugacacuguagcccacucugcccucugcaaggggauuuaucaucagcaaaggcuuugaacucuuccaagugacucaggaacccaggcagccugcugcaaagggcucucucuuaggcuucugaggcccuuuccaguagacgaagcacugaccacuuugcagagggauuuucagucuacaaaaggcuuuauggauggucauuccuccuuuggagugugccaggggccuuggauucagaaaaggaugccuugguugguugucacaguuugggcaaacgcuuggugauggaacccgcuacccacuggcucaccugccucauccacgugcuggucaaaaacaugauacaugcccgcaaaggcauaguucucgcucagugacguguccccggccauggcccgacuugccucugcugcugacgugggcaccacgcugccagggggccugggccccaauaggaagugaggggugacaggagguagaugcgagaguguucagucugccauugccccagggccccucuccuccucgcaacccgccccccgccuuggcugccucuggugcauaccuguccucauagacggcacgguucaucugcgccugcagcugguaggagccucugcugacagaacgacggugcccacgggcccccagggcccgaggaucauccucaaaguccugcaaauggagagggucagggugggugcaucuugcaaaaagcccgagaaccuuugagguguggagcccugaaaaucuaccuagagucagaucacuucucacuguguccccugccaccaccaccgcugcccacuuguacuacugcaguggcuuccucacgaguucugcuguuccugcccucccccugcucagcagauacuaaagacagggcuugcuauauguuuacugaccuguuuacaaaguuuguguguuuacugguuuacuuggcauauuaucuuuuuguccucugcugaugcagaacagugcccagcaaagagcaggugcuugaugaaagucaguggagugaaugugugcaggcaggguaugcccgggggugaauguggccagaagcucaccuccaugcggucaagaguagugcggcuacugcggacgaugcuguugcuauaggcacgagcacugccuggcucggagaggggcccguagcgcuggcccagcagcugcccccgaagccucagguacugccgacgcagcgcuggggggugcccagccuuggcauucucccgcagcagcuggcugcgccggcggauauacugcguccgaaacuguggaaacguuggugugcgguacgcguuguaccugcagggucaggaugcagggcaggcagcaggcacaggacagagggaaucaaucagcucggggggggggguacggcaggagagugagguguguggcagugacuggggccuaggugguaagaaugacuagcaguggugaugagggaccucuugguccuguggugggagugagucugcaguaauaaugagcauggucaugaggucaguuugcagacaacagagucagucugcugccgugcuggggucccuacggggugacugggucagcgcagacaauaauuagggucaguauaccagggcgacagaaaucagacugacauuaugggggucagcguugggaggugauggggucagaauggggaagugaugauguaaaaaaaaaaaagucuaggggacacccauaggggauaggaugucaccugccugagccccaccucccucucacagguagccgcuuugcgcaugcccacaucugaccacauuuucccagcuugcuguuuagaauccucuccggcgcagccaacucaccgcgggcgugcccgcccccgcuacugcgcaugcucaccuccggcaugcccacgcagccgcauaaggcaaguucuccgcccagccucacuuaucgccauugcgcaugcaccacaguaaguucugcucccaugggcuuugaccccacgccucaccucgcguccacugcuaagacuugcugccacaccgcggccauuccccggccuccuccucuggcguguccgcccgcggcagccugcaggacaagggccuggaaugugagcgucccgagcgaagggaucuaguuccgucccuuccaccaggcgaccauugccauagacaucgagucccuccgcgccggagaugucacgaacucccccccggguguuaccauggucaucaccccagcccugcccuuccugggcagcgcccgggugacacacagcgauucagaacagacaccgccccuccccagucgccauagcaacgccccucccccgccuagcauuccuugcuugacauucuccacccaucuuguccccgccgcccuccgccuucccuucucagauccaagagcauagcccgggaucggggaccaccuccggggcugccuccgguucuugaggccccccggagcggcccugagaccacugucgccgguuccuucugucucuccucccuuucucaggcuccaggcaagauggcugccugcuaucagaaagaacugccgagcccagagcgaaucgauaggcauccuucccagggcgugggagucucgcag

SEQ ID NO: 18915 - RNA, 1855 nt, Homo sapiens
agugcggccuguccuguccuugccaugaggcugcggcaggcaccagaguccagaaagguguucauucagcgagacuacagcaguggcacaggcugccaguuccagaccauguucuccauggagcuggagaaccagauugauaggcagcaguuugaagaaauaguucaaacucuaaauaaccuuuaugcagaagcagagaagcuugguggccaaucauaucucgaagguuguuuggcuuguuuaacagcauauaccaucuuccuaugcuuggaaacucauuaccagaagcuucugaagaaagucuccaaaugcauucaagagcagaaugagaagaucuauguuccacaaggccuucuccugacagacuccauugaguaaggacugcgaguuauugaaauuaccauuuaugaaggcagaggcaugagccauggaagauaaaccauagaauuaaagauccuacuucuagcugggccccucauguauccauuggccgacugcagagugucucuaccuccucuccagaguaucauuccuaucugcugccagagccacacugccauuuacuccaaggacuuuguaaaauuccacaccuggaaagaccuuuaguugcucaguauccacuuugugucuccaaauuguguaggacucuguaaucuuuugacuaguuucugagaaaacacaaugaagcauuucacuuuuuuuauugaaggccauuuaauaaaacacagcuggucagcccagugcaaaccuuauuaucugccaccaguauguaccauugguucuccucauuccuugggccagcuucucagguagcuuuagaccucaacaaguuguaucuuugccaguguuccaucuuguuccccuaaauuaauaaaaugcuuuucuccaggauuuuggcaaagguugguguggcugugguuuugcuaaugcaccuccuagauuucaaagauuuaccaguuuuaccaugacucauauauuaagaucuguuucuacuauucaguuccucaaacugaagcucauugaaaaaauaauguauaauguuauuuguuuuauuauagcaauuauuccucauuaaagcaguauuuaaugcaauuuccaguuauuucuuuggagaauguuauguccuuguugcauuaccuuaaagguugugaagaugugauguguguugcuuguucaucacaaaaaucaguaagcacaauaaaguggaugccaaaccaucaaacacauagauguuccugcugggucccuggauauguaauaagcagguauaaaaauauuuuaauuauaguuuucuuacaaauauaacuuacgagaaaaaaauuugauuggaauaauacuguauauuacuaauuuuuaacuaucccuacccaaaccuuaugacucacagaauuuucucauauacaguauucagugcacagaaaacuuaugacuggcucaaguacaguaaguuacuucuaaguaaaacucucaagucugaguccauauuuguagcucugcuuuugguuguacguuucuaggaucagggccgcuuaugccuuuucguucauccuugggguuugagagcacuguaugagggagagaguuuaaaaauacauuaggagacagaaaccauuaaaaguuuaacugucagagauauuguaggugcuaauacuggauuucgucuuucagauuuaauuucuuuuaugggucuguuaaucauucaauaaaucccauaaguauguguaauauuucaauuguguaaaacucguuugucacuuuaaagccuguaacaguguguuuguguuuucaacccauugcaauaacuuugcugaaauauuaacacauuaauaaaacuuuucuuaaaaaaaaaauaaaa

SEQ ID NO: 18916 - RNA, 533 nt, Homo sapiens
gcacugguaccuggagaggcucaggcuagugggaaaaucgacgagggcugaucaaaacaaaacucaccaagaccaugugaaggcaaaaaggagccuuagaaaggagauucuucccugcuccacaaaagccuagcugcaguuuccuguuagccacauggacggcuuucugcgaggucaguaugcccagugccugagcucauccacaccuguuuuccugguuguuauucucuaguaucugauggccaacauccuggagcaggcaggcaagaaggcccagaacaauugcagggugcgcaucacaccagaacacauagagagggccaugcacaaggauaagcagcucagaugccucuuggaggauguacccaccaucagguugaugaggugccccagcccgagaaggagggaugcuugggucugagaaccuggcaggacuucaucaacaauuucauccagccucaaaaauucccauagaugagagaccccaggcugcugccaucagcccaugcuauuaaagucuuuaaugacagugc

SEQ ID NO: 18917 - RNA, 179165 nt, Homo sapiens
cacaagggcgcggacuccacagcaucacugcgcggcguggccgccucucugcuccaggccgccagagggcgcguggucucuacugccccuccgcugugccugagccugccccuuaccagccacccggccuccguuccccuccccaacggcgccugucccgccuugcauucccaagcuccgcccccguugcccguagcggcuguuuguugacuuccgggagcgcgguuguaguugaucuccggaguuucgccaugcggaacuugggggcuuucgcggcccgcgucggugcggaguagcugcuuuagccccgaccaaaccguccucuacagccuccuggccccggcgcaggcugcccguacugcccguggcaugagggagccggaagagcugaugcccggugaguugcgcccgcgccgguggcggaaggccgggagggaggguccgcgggcggccgggccccgccuccggaucggcccuguagggggacaggccccaggcuuggcagccggacuggggcgggaucgcugguugcgcucccgcgaaugacugagggcagaggaccggacgggaagaacaggaugggggagaacgggaaagagggugccugucuuucguaugcuuuuuaaauaagcucuugaugagcuucuugaaggcagggacacuuuuuuuuuuuuuuuaugagacggaguuucacucuuguugcccaggcuggagugcaauggcgcaaucucggcucaccgcaaccuccgcaucccggguucaggcgauucuccugccuuagccuccgaguagcugcgauuacaggcaugcgccaccacgcccggcuaauuuuauauuuuuaguagagacgggguuccuccauguuggucaggcugaucucgaacucccgaccucaggugaucagcccaccucggccucccaaauugcugggauuacagucgugagccaccgcgcccggccagggagggacacuuucuguaaacuccccaaagugcggacuccagacuugugcacuuuggagguccugagcucccgguuauguauugaaugcaguaaagagugagugaucagggcugugggguaaaaggggauacaggaaauaaauuggacaaagagggagaagagggacccuuuagcgaguguuuuuuagccuuuuuuuuccugagcuccauaguuagaaauacuuuugacauugugacccgauacuccauauauaccguguaacagaaauagaugucuggugaagcaguccuuguucuauccacuuagauuccacacacaccuuuuugauaaugcauucuuuuaaaaugcugaucgugauccacugaauugauuuucuggcccacuaauaggucacgaccauuuugaaaaaacacuggguuugagcagaaucauaccuucacugaaauauguauguuuucuuccaugcuccuggccggaacugacauuccuggccugcaguucacaauuuagugagacauacaggaaaguaaacaaaaugaccauauaaauugacaguagauauuacagggccagagcagagccaccaaaccuuggcuugggaugaggguaucagggaagccaggggagccaagacaaaacaguuaaaauguuaaaguaauucauucuggggaaacucagagucuguucuagauccuagucucccaacucaauuauuaguuggaacugagaugccucacagugguucucaaaaaguuguccacaguggcuagucucuugcguauuaauauuuauuauuaauacuuauauucgcuauguuuuccuuucugguacgaauuaguuuaugugugaucacccaccuugggauuuccccaaaagcuggaccuggccuacuauuugguguauguguguguuuaaaugguuauugggaaaugguagggguuuuuagucuuucuucaaaaugacgcugugccacaacaguuugugaauacuacucagaucagguaaugacuugauguaagaauguuaaaaucucaacauccccauguacuccucucccaaucuccuaggaccguggcauuuugugaugauguuuuggggggaaagauaaaccguccuuucccauguacuguuucuggaaagagaaaaagacaucucuauaacuaacuauagugcaugaguaagaugagaauuagaaacuuccugaguagcuguguugagaggaucuuuucauuuuauaacuggaucccuaaacauucugaauucucagaaaucaggaaaagcuaaagugcuccuuuguugacgacuugguaaccugucuuuuauauuaacaauguugaaaguuauauuugacuacaaacucuccauuaugaugaauugguaaacaaaacauucaacaguuacgaauauacauguguguaagggggaccuuuucugugugaaaaguagaacacacaagggcuacuuugugcuaggcaauauggguagugcauacccucuguaaccuuagaaaauaguuggaaaaaaacaacauuugggguaacaaauggugaacucuguguuucaacacagaaaagcagugacuuuuuuuuuuuuuuuuuuugagacggagucacagucacacugucgcccaggcuugagugcaaugaugcuaucuuggcucacugcaaccuccgccucugggguucaugcaauuguccugccucagccccccgaguagcugggauuacaggcgcccaccaccacgcccggcuaauuuuugcauuuuuagucgacacgggguuucaccacguuggccaggcuggucucgaacuccugaccucaaaugauccaccugccucggccucccaaagugcugugauuacaggcgugagccaccacucccggccgacauuuuuaaaguauagcuuuuuauugcuuugugaugaccucaucuuacauauugugcuaccuaccaaucucucuaaucaaacuguuacacaaaucuugcugauuuguguaacaguuugauuagagagauugcuagguagcacaauuauuugccauauaaauucuacagaucacguaguucagagaagccagugaucauuuccaacucuuaugguagaggaagaguuuacagagguagcuauugagcuaacacuuugaggaugcuaggcucugggcuaaguucuuuauacaugucaucucauuuaauccuuacaacaaccuuugaauaccuaauugccuuuaaagccuaugguuuuuuuucuagcugcuuucccuuaguucgaaugaaagagauagugguggaguaauuuguuucucucugugcugucuccgguuuuauggguauucauugggauuaccaacagagaaauuaagaguucaccauuuuggccgggugucaugguucacgccugcaaucccagcacuuagggaggccgaggcaggagcccaggaguuugagaccugagccugagaccaggaguuugagaccagccugaacaacaugcuaaaacccagucugugcaaaaauuacaaaauuuagcuggacaugguggcacacgccuauaguccuagcuacuccagaggcugaggcgggaggauugcuugggcccaggaggucgaggcagcaguuagccgugauugugccacugcgcuucaagcugggugacagagugagacccugucucaacaaaaauaaaaagaguucaccauuugggcuaacauuguuucccuuacaugagaacacuggagguuccuuggaaaaacuggaccaaagaaaauccaaauugacugauagagacucuccccauggauagccugaugauguuaaugaggaaacgaaauacuguccuguuucuguguguggagaaaagcucucagucagaggccagaccaugagguguuaacuagaacaagaauagcacagauugugccauuucauuccagggaauagacaucuacuuggugacagcagaacuauuaguaauagaugacugccuuccuugugauaguauauuucuuacuuuauaccaguauaugaguaauacauguucaauuuaguagauuucauagauaaaacuagaauggagucugaggaauaagaaagacugaauuaagguggaagaaggaaggcuuaaacauugccagagugggggcaaagcugucaugagacaagggguuuguauggauaaauuacucaaaaguuauuuuaauaacaggcaacauaguaaaaguuauaaaauaaagaccgucuuauauuugcagauucgggugcuguguuuacauuugggaaaaguaaauuugcugaaaauaaucccgguaaauucugguuuaaaaaugaugucccuguacaucuuucauguggagaugaacauucugcuguuguuaccgguuaguauuacaauccugaauaaggacaguaauacuuagaaaauucuaaauauuuuguuauagauaugcugcuguguuuuaaacauguugaaaauauuaucaaaaguguuguuuuuuacuuugcuggagaauucuucacaaaauaagucaucaagagcaucuuuuaaauuuuaaguuuccuuaguauauuuaaguaugauuuucuauacacacaacuuucuuggaaugaaucuauuucaauauaauuuuuuaaaaaaaccuguuaccguauaauuuuagaaacucuuuuccaccuaauagaaacugguuauacauagaugaacaagguaacuuauuucaacacagaaaagcagugacauuuuaaaaguauagcuuuuuauugcuuuguggugaccucaucuuacauuaugugaaaaaugcuucaauugauuauuucuuuuucccuccuaccaggaaauaauaaacuuuacauguuuggcaguaacaacuggggucaguuaggauuaggaucaaagucagccaucagcaagccaacaugugucaaagguuugggaucuuuuuaucuuuucacaaacuguauaaaguauuuuuauguugacuguguaguucuuuaaugucauaaauaauaaagcuuuuaguucuuuauuuucugacauuugcuugaauauuauuagcauuuaacuuaucuuuuauaugauauucagaacugcuuuuauauguuagggucuaaaaaucagauugauuuuaaauccagggaccacaaaggaaguaaugauuuuacaguauugcauuugaauaucccccaucuuuuuuuguuuguuuguuaguuuguaaaacuacuuacauauuacuguuauuguauauacagagaacaaacauauguuagaauuuugagcuuuucucauuuaauacaguuguggacauuaugcuucuauuugguugcugguuuuauaaaacauacuuauccugcuuuauauagugacuaggugaaguaaacgaaacaucgagacuagggauugauuaguacuaguguaaaagaacaacaggacaaaauauuugaaaucaggaguguuccagaaaauauuagauauauaauacccuuacaaagcuuucuggauguuauaugcaaaaccucuguuuggguauaaccugugaacaucagcuaaacuugaaaggaugauggagauuccuugagaagcaauaagagcaguauuuuuuaucuuccuggcuaaauuuuaauuucagcucaaaauuucaguguagcuuaucauauucaugcuguuuaugggaauuguuauggaacuuuuaaaguauuccauguguucaaaaaguauuuauugagcauagucuaaacaccugaggauagucacagugaccaugacccuuacucucaaauaucuuaucuaauagacaagcuaacaggauuguuuagacuaugggauccuugagaccagggauucuaucuuagucaucuuuuugcagccccuaugccaagcacguaggagauguucuuuaaauguuuuuugaauauguagaugaaugaaugaacaacuuugacugauagguguaugccuaucaauauuggucuucgguuuuucauugaaugugguagaaggugagcuugauaauggugauggcagguuagguaauggaucagauuggugaggaggcagcauaauagaauacagugggucucagcacauauuaauuaccugugaaguuguuguuuuuuuuuuuuugagacagggucuugcucugucacccaagcuggagugcaguggugugaucucugcuuacugcagccucgaccuccugggcuccagccauucucccaccucagcacccccuccccgaauagcugcaacuacaggcaugcaucaccacacccagcuaauuuuuguauuuuuuuguagagaagggguuucaccauguugcccagguuggucuggaacuccugagcucaagccaucugccuguccuggccucccaaagugcuggggagccaccacacccggccuaccuguggaguuuauaauuauauauauaaaugccuagccgcugcuucagacccacugacucagauuccauagggguggggcuaagauaucuauauuguauucaaagcuccacuuguuaugaugguacacaaccaguucugaaaaccucugguuugcucguuaagaacauugacuuuggaaucagacaagcccgcuauuaaaucucgguucuaucacuuaguuaccauuuguccuggacuacuguucauuuucauugcuauaaaauaauugucccauuuuaaauauuuuuagcucuaaaaccugaaaaagugaaauuagcugccuguggaaggaaccacacccuggugucaacagguauagugcucaaccuguaugauuuccugccugacuuugagaacugaggucucauuccaguaacguggcuuuguaaaauuaauagagauuauacuuuggcaacaguaaaauuaggguuuuuuaaaaugucaauggcuaguacacguuugccuuugcaaauauacacguaaaugucaaauggcugaagaaaaagcuucuuuucuuggauucuaucaugggacagcaucuccuaaccuguguguccaccuuaagggcugguuauuccuguucuugcucuucucucuuccuuacuaagggugaguggaaggcacccagaaggcuguugaugugagugagcauaauucccaucaaaauccauaugagcuuuuguguguguguguguguguuuguagaaauuaacaaagugcuucugaaauuuauauggaaaagcaaaugacguagaagagccaaaacaauuuugaaaaauaacagaggacuggcacuaccugguuucaagacucgcuguaaagcuacuguaaucaagacugagguauuggcaaaaagauagacaaagauuaaugaaacagaauagagucuacaauuagacccauauguauaugcccacuugauuuuuggcaaagaugccaaggaaauucaauagagaaaggauaguaucuucagcaaaugcugcuguaacauuuagaccuccaggaccugaccacugagcaguacuuccuaccaccuucccccugccccugccccuugccccgccccucccccaccaccacuuauucugucuucaggauguuuucacugccucagcuccucuccaccucuccauaccuuucccuuucugaagugucuuuucucuuucucuuagccuuuuaagauuauuucuugagaucccauuaaguguuaacuucuuucauggaacauuuugugacuguguguucauuuauuuguuugaauuauuucagcaucucaccaacucugguuugcuccaugugugugaaauugugcacuccaauugcaugugaccuuguauuuuccauuugaaagcuagucuuguuuccccaauuagguuucgucuuuuccuaaaaacaaaaaauaaaaauaacaauaacuuuaaaauuuuuacuaacucaggcugauuuugcccucauuucaccuuauaauuuagcaaggcuuuaacuucauuuauauauuuaugacauaacuaauuuauguguuacaaaucuucauuaauuuacaacuuacuggaaauguuuauaaucuaggcaugauguacuuuuuauuuaauuaacagaguaauuaacaaacauuuuuacauacuuuaaaugagccaaaugcuguucuaagaauuuuacaaaucucaacuaauucaaucuucauaacaacucuaugaaguagguacuauuauuauccucauuuuauagaugaggaaaaugaggcacacagagguuauggcuugcccaaggucccacagcuuugguaagugguaagccagaauuugcacccaagcagucuggcucuggagucuuuccugcuaaacagagugcuauagugccuuccuauuuagcuaggaaguuaaaauaaauacaaagaauuaucauguuucuaauuagauucuucuuggauuugccuuguuuuacuuauuuguacuauuauaucuuagcuuuaaugguuacagaaguuaaaauuaauggacacaucucuuuuaaaauagauuugcauuuuaaacuaguuuggaaguuacuuuccuuguuuuuacucugaauuaauaaagugcuauauuagcaagaaauaaauacguuccaugcauucuguucauuucaguugcuaguuacauucuagauugauuucuaaaaucucacaaaaauauguggccuugcuuguuuugcuuuauuuugacgaugaaaugaaguugucucccaaauaauaggauagugauagcuuucaacuuucuucacuguuaauagaggaaaucgcugcuauacacugaccugucucauaaaaagggggacucuauagucuauugacguuuucuuuuccaugugcagaaggaggcaauguauaugcaacugguggaaauaaugaaggacaguuggggcuuggugacaccgaagaaagaaacacuuuucauguaauuagcuuuuuuacauccgagcauaagauuaagcagcugucugcuggaucuaauacuucagcugcccuaacuggugagacuuguuucuuuuucagucugggacacauuccuuuccuguagaucaauauaugccaacucaguaaaccgaagggagcauugcuguuuaguuuucuuucaucgacuaucuaugugcuuucagaaaacauuuaaaauauaacuuuaaaucuugacauacugcaauuuuaugcuuauuuaugcuuauuuuaugcuuauuugugcuuauuuaaauauacauuuaaaaaguaauuggcaaauaagcucuaagcuaugccgucugucuacuccuuuagauauucuuaaauauuauuuuuguugugugcucuuaaaguuauacuugcaguuuuaacugaaguugcugucagaaacauccacagaaaucuguugcagcauauguuguuaaaaugugguuugcaacggucauuguaccucucugcccucccuaccaaaagcccauaugagacauuucuuuaaaauuuggagccaagaucagcuugaucuuacugaagcugcugguuagcugcuuuguuucaagcaggagacuguguaacauccgguguuacucuaucaggaaagucagaguugucucugaggcucaguccuuuagauuuugucagcccuuaaguuagcauuuugacauccuucuuucaguucuuauuuucauuuauuuguuuugcauuauuaaaauacuucaaaaauguaaauuauuuaaaauauauaaauaaauaagucuuaauaauuccuuucuaaaauauuuuuccuagauuaacuuuuucugacaucaaaacccuuaucagaaauuauauguuaccuauuuuugagaugcuguacaugcuauuguaucuucauucucugaggcuagauucuguguuuucagguuuaaauuauaaggaaaaaaaauguagugaaauacguuucuucuguucuuuuuucaaaacaucauuuccacagugcucccaagagcaaggucuuccaggcuuuuuugaccugcaggugucuaaugugaccugugcugucuuucaguucaguugcagguaggcugcuuggaaggaggagaacauuucuguuuagaaacaucagaaugggaaagggugauuguaggaaagggcauucugucuuugcuaucgagauaaaaauauggucaggacuuaagugauuuacaaucaggcuguucuguguucuuuaucauuauagaagcauuucacaauauaaauugaacucuuaaguagcuagcugguguaaaugucuuaguaguacuuuauuguuaagauacauaauuuuuaugaacuaauaaaauaaauggucuuuuggaaguauaauagcuucagagccuggcuaccuuuuaaaaccuuuucucccccuuuuauuuuucuuuauagaggauggaagacuuuuuauguggggugacaauuccgaagggcaaauugguuuaaaaaauguaaguaaugucugugucccucagcaagugaccauugggaaaccugucuccuggaucucuuguggauauuaccauucagcuuuuguaacaaguaagacacauuuugaagucaucauguuaucucccacuucuauguuguuauuaaauuaauaaugaaaugauauagucucugguucuauagaaauaaugccaugguuguccauguaaugaaauuauuuuggucuguuuuaggucacaguauuuccccauuuauauaauaagaguucauaauuucaaacucugucugacaugaucacuuuuuaggugaauauagagagcucagcaugggauauaguuuccuuuggugggacuuucucagcauucccaacuucucccuuuccuggacccacuggcaaccuuuucugucuuaguuaaaauauuggaaauguugggcucuagcuguuauagucuauaucuaucuacacuaguaauaauagaggaagugugauuaugacuuuccaucuaauugaugggauuuuucaacaguaaaaacaccuagaggaaauaguuuauggacccucuuagacaaaucuuuaaauauuuauuuuauacauuuacucuuuauuccauauaccacaggcucaggguuagaaagugguaauucacccauuucacugcccccuaaaguuaccaaugaauugguagcagcaugauaccaagagagaguaaaccugacuuugucaguauuuuucaccacugcaucccuggugucuugaacaaacugauaaucaauaaauauuauugaaugagggagaaagugaauaaaugaugaauugauugcauuccuugaggcaacacuaccuaccaacuuauuggcaacuuuuggcuccugggguugguauagucuguacucgcuuuguucaugaaacaaaaacacaaaugggaaaauaagccaaccaaacaacaaaaauaccaaguaaaagcauuguaucauauuugggcuuuaagaaaacugccugaaugaauugugugaaugaacucugcauuagccguuaggugaacaaguggaauaguucaucuuaaccaacaggcauuacauugagcuuuuuuuugguuuguuuuuaugccuuuuuuuaauuaaaaaaagcucagcuuuauugagauauaauucacauacccuacaauucacccauuuaagguguacaauggaaugucuuuuagcauauucacagguuuguacauaaaaugaacuuuuauacuaagcauuuugcugagauucauuuacaucagcugauaugaacugucaguaauuuucacacuagccauuauuuuaugacuuuaaucacuuaaagcaacuuuuuauaaauuuuggaaauaacucaaguauaagggguuuuacuuaauauguauuucaugauagaggaaaauguuguauagaaaagcauuauuuuuuucucuuuguauguugaauuuguagaucagaaaaaauggauuauuuuuaauuuuuaauauuuguggguacauaauauauauauaguggguacuacagauauauguuuaguggguacucucucucucucucucucucuauauauauauauauauauguauauauauggaauaccugagauguuuuuaugcaggcaugugaugggcaauaaucacaucauggagaaugggguauccauccccucaagcauuuauccuuuguguuauaaacaauccaaugauacugucuuaguuauuuuaaaauguacaauuauuuugauuguaaucauccuguugugcuaucaaauacuagaaauuauuauuucuaauuuuuggacccauuaaccucccuccuacacacaccccacuacccuuucuagccuuugguaacaauccuucuacucuuuauuuccaugaguuucuuuugauuuuuacaucccacaaauaagugagaacacgcaguguaugucuuucugugccuguuuuauuucauuuaacguaaugacuuccaguuccauccacguuauugcaaaugaccggaucucauucuuuuucauggcugaauaguacucuauugugcauaaguaccacauuuuuucuuguuuuuugagacagagucuugcucuguugcccaggcuggaguacaguaguauagucccggcucacugcaaccucugccucccagguucaagcgauucucuugccucagccuccugaguagcuggaauuacaggcgcccaccaucaugcccagcuauuuuuuuuguauuuuuaauagcgacaggguuucaccauguuggucaggcuggucuugaacuucugaccucagguaaucuacccuccuuggccucccaaagugcugggauuacaggugugagccaccgcgucuggccccacauuuucuuuauucagucaucuauugaugaacacuuagguugcuuccaaaucuuggcuauugugaacagugcugcaacaaacaugggagugcagauaucucuuugauauacugguuucucuucuuuuggguauauacccagcagugggauugcuggaucauaugguaacucuguuuuuaguuuuuugaggaaccuccaaacagaauaguuuauuuccuaauaaaaauacagaacauauuacuaagauaguuauguuuaagacuuccuacagauuuuucaccuacuaauauguuuaaaugcucauguucguguuuuaaauucauguucucaauucaaguucauauuauaaauuauauaaaauauucaauuuuuagaucuuauagauaaauaaaaucuauggaguuuucagguauuaucccugauugcugugucuuuucaucugauauguuaaugguugggucugagcauuuuaaccagugauucacugaauuagguguaguacaauaggggauauaaguaaaugaguugggguuaugggaacugggggcaggaauuuguggagcaaucuucagauacuggagaauagagacuuggcagugugcuuaagaucagaauccuggggaagguagcugucagagccagguagagaguuugaggaauccagauuuuauaaaaauuaauaggccuaagugaaguagauauaauugauaugaaaugaccuauuuauucuuugugauaaauguuauuuuauuuuuuauauauaaauaagaaaaauaccuuggaauuaaauaaaacauuuuauauggauuaaaagcacucaccuuccccuuuaaggaagguccuacugauagcuacaggaaauaucuuuucuaacccuuuacagcaagcucguccaacccgcagccuaggauggcuuagaaugccgcccaucacaaauuguaaaccuucuuaaaacaugagauuuaugcacagaccuuuucuuuuuuuagcucaucagcuaucguuaguauuaguguauuuuaugugugaccaaagacaauucuuccaguguggcccagggaagccaaaagauuggacaccccugcuuuauagguaaaacauuuuacuuuaaaaagucgacacugugagaaacuucaucaacuuacuauguaaaagucauuuuaaaugauauuucuuacaauaccaaguugauuaaaauguaguaccuacccuucugaaguuuacagucaaacuauaggauguauaguuuuuccauguacaaagcauuuucaaguacgaauauauuucauuuaaucucccaaccacucugggagagagguggugguaucugagauuccauauaugcaggcagguuuagaacacaguuuuauucaaggugaugcugcgauugaguugcagaaucagaauucgaacuccagucuuccaguucuaaaagccugaacaauuucuacugacaugcaguuucucuccauauacaagaggaagaggaggaugugguagcaacuaauaaugaccaggcacugauuauguguucuaugugccuuugaaugcauuaauucgguuauuccuaugaaacaacccuaucacauaggcacuuuuauccccauguuacaggcccagugauugaacaacuugcucaguaugacucaguaaguggcagaauccacaugcaaacaaggcagucugacucuguagcacauacuuuuugcuacugugcuagaccaauaacugcaauauacagcagaccaugauugguaacguaagacauuugauagcagagucuuacgugagaacaagaaagaaaaaauauuauuucuuguuaggggcgucaggacauauuucagagaaagggugguauuugagauuaaccaugaaagauggaaacaacucugagagagacagagaugagggaagaacaauccaggcagagacaaaaacaugugcagagauauagagacagaaaaguaaaucauguauuuggagauuauugcauaguugaguuuguuuagagguuguuuguuuagagguuagggaucauggauccuaaaggaauguaaaccccugaaaugauaugcuaaauuugguaggugcauuuuuuuuuuugagcuaggucucacucuguugcccaggcuggagugcaguggcauaaucacggcucacuguagccuagaccuucugggcucaagugauccucccaccucauuccuccgaguagcuaggacaaagaugcgugccaccacacucggcuaauuuuuguauucuuuguagagacuggguuucaccauguugcccagacugguuucaaacuccuagacucaagccauccaccagccucggccucccaaacugcugggauuacaggcaugagccaucacacccugcugggauguguacuuuuuuuauagagcugucaucaaauucccaagggaggaugugacucaaaagagagucaccagguuggggaguagauagaaauaugacugguuaguaguccgggaaccuaauauggaaggucucuuguaacagucugcaguuuguacuugauacauguauuuuuuuuuuauuuggaagugucauaauuagagccuuguuuuuggaagaugcaucugauauuguguggguauguuagacuagagguaggaaagacauuuggaaaacuugauccaggugaaaauucauguuaagguguaaagggaaucaggaaucuauagacagaaauggagagagacucaucaggacuuaggaaccaguuuccuaugggaggcaacaagcaugggaaaauggaagggugcuaacuuacugggcaccacuuuugugccaguguuugcuaaauacuucauagaaaacugugguccauaaaacuucauuuucugugcagaucaauucagaaaaucaauauagcuguguuuacaguauuugagcaaguucuaaguggugcauaucuugugcauuggcugucccacaccuuccugaaguucugugauuuucuagaaggacucacagucuucaauagcgauuauacuuacgaauaagauuuauuacagcaaaggauacaaagcaaaaagaaaaagugggaaaaagauaagcaucugcaguggaguccagagaagucaagcuugggcuuccuaguacuuucucuuaggaaaccacacagggcauguuuucuuagcagugaacuacagggacauguguggaaugucucugcccagggaagcccauucuguugcuucuaggggauuuagggggcuggucauguaggcaccuccugcuagcaacuggccacagcagcugaaacucaggacccucaauaaugaagccaggugcacaucaucaauguugauguuugugcaagcagcccugacaaaccuaaucuggcauaguucauugcucugguauauauaacaaaaucauuaaucauucacauaaagaacacuccaggggccaccuucucagggguugggcaaggaucaaucaugguucucucagagacuugcaaagaauaagcaagcagaucugcucuguugucucuuugcuuauaccaauggugauauguuccaugucauucuucagauuggaucauauacuuacacaagguuuuuaaauucuacuuuauagaacucaguuaauugcauagaaaugaauaagaaaguucuugcuuucaagaaguucacagucauaauacagugugauaaauguaauaaagaagcaaauuaauagcguuaguauggacagggcagugauuaagugucaggaacuccuugguaagagucuuuggaggaagugccaucuaaauggguaaaaucugcuaucuuaagauuuacuuaacauauuuacugcacacauaagugaguuuucuaaaaccaguuucauauaaagcaauuauucauucauuuauuccacaaauauuaagugcuuguucuagacacugcuagguuuuggggauaccauagggagcaagacaaaauucauguuuuuaugggagcuuuaaguaaguaaaagacacaagauauucuucacuuuugugaaagcacuaaaguaauuuucuaguuguuuauuaguagugguagucaugaauuuuucaugaaaaugauuggauuaaaauaaucaaggggaaaagaaaaucuagcuuuauuucuuuaucauacaguaaaaauaucucaagaaaggucaaauguauuaagugauccuugucaaaacuuuuuuuugacgguaagaccagcuuuuuguucauauguaugucaucacuaaucacuauacuuuuccuucaauagcagauggugagcuauauguguuuggagaaccugagaaugggaaguuaggucuucccaaucagcuccugggcaaucacagaacaccccagcuggugucugaaauuccggagaaggugauccaaguagccugugguggagagcauacugugguucucacggguauguguggaguccacuguucuguucccugcguucugugguggcuaaugaaauuuuuuuaauguucauuuuuuuuauguucauuuuuuuauugugguaagaauacuaugagaacuaccuucuuaauagauuuuuaagaguauaauaaaguauuuuuauguauaggcacgaccauuguacagcagaucucugaaacuuaucuugaguaacugaaacuucacgcccacuguacggcaacucgucuuuccggccuccccucaauuccuggcgaccaccauuuuauuauuagccucuaugaguuugacucuuagauaccucgugucagguggccuuugcaucucuuuccauuaagauucucacuuuuuggaccuggugcaauggcugacaccuguaauccuagcauuuugggaggccaggagaucucuugagcccaggaguucgagaccagccugagcaacaugacgaaaccccaucuuuacuaauauuagccagguguggucucagguauucaggaggcugaggugggaggaucaccugagccaggggagguugagcuugaggugagcugugauugucccacugcacucaagccugggcaacagagcaagaccucgucucaaaacaaaaagaaaaacaaacaaaaaaaagauucucacccuuuauuccuguacuuaauauacauuucuggucuauggaauauuuuuuuuaaguagaaaaaaaaugaaucuuguugaauuguuucugcuaacauaauuuacauuuucaugaccuuaacuguuuuuuuuugagacggaguuucgcucuugucauguaggcugcagugcaauggccugaucuuggcucacugcagccucugccuccugaguucaagcgauucuccugccucagccuccugaguagcugggauuacaggugcccacuaccaugcccagcuaauuuuuguauuuuuaguagugaugggguuucgccauguuggcaaggcuggucucaaacuccugaccucaggugauucaccagccucggccucccaaagugcugggauuacaggcgugagccaccacaccuggccugaccuuaacauuuuuaauggcaacauauuacauuauuuuuagcucauuuucagggacaaacaauuuuucucauguauauguuuucuauauuuaucuaaaauugacauuuuuccugaaaugccuucuuuuggagaagcuuuuuguucaagcuauuuucuauaugucauugauaauucuuuucuuugugacauuuacaauguguagcuuggggauuucuuuguaguuguauguucuguuauaguaauucauuaaaaagugguaugguuuuaaauuacagauaauaaaagaaaguuaggaccuuaauguuacuuuugggaucugaauuucauauuuguuaugacaugucauuucucaggauucuaaucacuguauugaaauauacucacuacuugcuaauauguuuacuaaauugaugcuuccaaauuuuuucaacauuagauuuauuuuagaugaguaauguacauaauacaauuagguagugaauuauuauuauauuuuuugcacaaaaaaauuaacaguuugugaagucaccacuuaaucuuuaguagcccaaaguuagaaauguuguagacaaauuuugaauaauauccaauucuaagaugauaugccuaauguugccagguaagugaauaauauuuuaucuuuauguuuuuuucucugauguuacuuuuccucagcuuccuguucuagccccagucgugguuauuaagcuuuaguuucuagauggaaucuuuucuaaguuagaaauaauuuuuuuucaaaacuuauacucuaaauuuggaaauaauucugagguuuaagauguuuuugaauuccugcugaaaaagugaauuuuauauaauuucgaaaauauucuaaaaauuaaacuuugaaauuaauuuuuacacauuaucugaaaauucauucuauaggcagaaaugcaacuuuauguguuauauauuuucucuaguuuauacaaagacuauagaaagaauuaauuuaauaggucauucaggguuauuuuaacagauacaaauguugauuguauaauagugucuuuaaccauucauuauaaaacauuuuucuauaaagagcaacaagauaaucuaugauacuuuuaaugaaagcucaauucuuaauuuuaaauucuuaauuuaaaauaaaugcacuuaaggaugauauuuucgugugguuuuaaagacauuuaacuuucuguggacuuuguucugagcuuaaguauaauguuuccagaaauugauugcucucuccagauuuuugcaagcuuacggaucucacacaccaguaaaguuuuuuaaauuaugagaugcaucuauuugacagaccuggaacaguuauuuuuugccacuaagauuucuacuacagaugcaagaaagaaguguccuugcauuuccuuucugauuguggcagccaacauugaaugggggaauacaggagaaaaacuugguaauacagggaaaaaaacauggagagauaauuuuuacaguucauaaauaacuuuguaaacagugaagagcuuguguuacaauccagagaauaaucuaaaauuugaguuuaaaaaauuaugagaaccaauagaugguugucagcuucugauucacguuugcuuaaauaugggcauugaaaaacaugacugcacuaucauaucauaaaauaaggaacauuuucaaaauaaaaaacucuuaauuguauauaauaaagggcaccuccuuaaacuguauaaauguauauguaugaaaauuucacuacuuugccuguuuuucacauuucuccauggaccugugagagcuuuauuaugagccagcccuggugaggaaccugguucuggagcacaguauaggcagaauuuuaaaaauauuuaguccuagcugaugaagaaauggaccugaagaguauauugaucaucagugugacuaaauacuaaacuggauugcuaagagaguuauggaauauuuuguaagaccuuaaggaaagaauagcuaaucaccuguuccaauuucuuucacuaaagaaaagcacuuggauuagguguuucugugaaggaccuucccagccuuguuuuucaaaagucuauaacucuuaucuuaaaaaucuauuagaggaucauucauuaaacuauuuuaaaaacaauuuaguucauuucugaugaauuuauuuaaaacauaauauuugcacaugaccgugauagauuagaaaauaaaacugguuguagugauagggugauuauaguuucuccuugggaucagggaaaccauggaccacuguggaaaaagucugaggcuggaacuugggacacacuaagugaggcagagugauauuuguaguuuuguaaaucguccacagcaguuaccaacacacaagaaaggccaguugugagaugggguucacaaugaagucuggguccugaggcaaaugagaauuuaucuuaacuucucagauuauguuuggauaaaccuaaguuuucuacagguuaacaaauuauuaguucugaaaucaaauauauucugugaaauuacaguaauauuaaucugaagcuaacugaucaaaucuauuuuccuaauguaauauuauuuauuaacauuaaauuauguuguuaaaugucacaaaggugauauggccaaaaauucuauugguuguuaaauauaauguccuuaaauaagagcgccuucaaucauuuuuauaaaauagaaacugcugucaucacuaauauccaagcaccugaaugggaaccuaccaggauacugaacaaaacuucuguaacaugauucagacugccuaaacagccucauuucacaggcuaauuaaaaucagacagccuaagaaauguagaguaauuguuggucagcuagagauagauaauugcuuuaauuuacccaauauucuacuguuaagcugaacauuuagaacuggaaauaugccaugugauuauuauuuaaacuaagaugguuuuuuaauauuaaaauaaagaucuguuuugccauugccucaauauggcuucauaucuuugauacagcauauuuucuuaaaggaguaguaucuauaugucuuauuuaugaagcaaacauuuuuauuagaaaaaauuguaaaaccacaugacaauagacaguuauguuuucauuuguaacccccauugauagaaugaguugauuagauacuuuuuagaaaaauguucuuuacaacaguaugucauauuauguuuucaaaucugccugaauguuuucucuuuuaauccugucagcaccucuguuagauagggauuauaacaucagagaaucuaaguaacucaccugcuugccacagcuaguaauaaugaauguuuggguucuggccugaauaacaagcucuugcccuuccugcuguaauaggagaaacucaauguacuaaacucaaaguacaaaacucaguguacuaaggagaagugacuaauauaaucgacacugcgcuuccuaaugcagcagccaggagcaugaugucucuaaaaggacccuuucaucaccacucauguauccuguuuuuguacuuuuucauuucuagaaaacauaugacguaguauuuacugaguuacuggaaguccuuuggaaucacuucaaaauaucaauauaaagaaaagcuuuuccccuccuauuauaguugcauuuccuagugaagaagcuuuacuugugaauaaaucuagcauaugcccuaucaguuuuaauucucaagacaauucucugaaauuggguuuuauaagauagauuauuaaacuacuuuuauuuuauuuuauuuuauuuuauuuuauuuuauuuuauuuuauuuuauuuuugagauggagucuugcucuguugcccaggcuggagugcaguggcgugaucuuggcucacugcaaccuccaccuccuggguucaagcgauucuccugccucagccucccuaguagcugggauuacagguguacgccaccaugccuggcuaauuuuuguauuuuuaguagagacaggguuucaccacguuggccagacucuucuccaacuccugaccuuaggugaugcauaaacugcuuuuaaaaggaagaaguuuuucuguaggagacacuauucacuuuuuuauuugacguagugaguuagcuuaaugacaguugguucuuuuuuauuuuuugagauggagugucgcucugucacccaggcuggagugcaguggugcaaucuuggcccacugcaaccucugccaccuggguucaagcgauucuugugccucagccucccuauguagcuggaauuacagaugcaugccaucaugcucaacuaauuuuuguaauuuuaguagagaugggguuucaccauguuggccaggccagucucaaaccuggccucaagcaguccacccgccucguccucccaaagugcugggauuacaggugugagccguugcgaccggccaacaguugguacuuuuugagccgacguaauuauggggacauuucagguaguucccugacuuaugugccuuguaucauaccuguuacuuaccuaacuaugguuauguauaaaagauaaaaucauacccaugucauaauuuuuauaaugauguaccuuuucauuuuucucuuccuucaucauugaaagauuuauacuucaauauuaaguauucuuaaauguuuuuuuuuccccagaggcacuuaaccuucacuauaaaagguugaacgugacaguuuuuccagauaugaugguaacagugucugcuuccauaauccuugucuuguauuugccccuuuccuuucagagaaugcuguguauaccuuugggcugggacaauuuggucagcugggucuuggcacuuuucuuuuugaaacuucagaacccaaagucauugagaauauuagggaucaaacaauaaguuauauuucuuguggagaaaaucacacagcuuugauaacagguauggauuagaauuucuguuauauauuuauagaacuggguauauuuuauuacaaaauaaauuauaugugaaaugaauguaucuaacuuaaguaaaggaauuaauggcugagaaaaauggaauuccauguuuacuauuccaaaguauaaaguugugaacuuuuuauuauuuuaauucaauuuagaauaaauguaaaugauccaaagauuuagaaccucacaauaggccgaugaugucagaaguuagaccauaguauuauucuuugucagaaaacaggaaucuuuuugaaauuauaucauuuugaaggcucuuaauucuacucaggccaaaaggaaaaaucccacaagcaaaaacuuauuuuaaaacauucuuccuauucagucugacagagcugcauucaggccgagucaguuguuauguuuuugccaccuggaggcguuuucaggaaugacuccuuuccuucucuuucuacguguuagagagaagggacccucagagaccacuaaguggauaccuucuuccacucugugguaucuccuucaugcagggaaauguuccuuugagcccacuucucagccucaaaacuaugugcugcuaauaauauaggacucaguaaagauucuccccuaaaugauucagucacauauauguagguaauugauauaguccacaguuuucaaugcuuugugacaaacggguauauaauuucacuauuucugucuaaauaugaagugaagcauuggaaagucagaaaucaucuaguguauugacguaauccauguacuaguauuucuacuuuuuuuccuucuuuuugaaaaagcuacugcuaugaaaaagcuccugaaaaaacuacugcucaucuaaugguaucuggcuagggaaacuaggaaucagcaaaugcaagauauacuguuucuucuuccccaaagaagcuuucagagaagaugaccugcccaugaucaaguaucaguguucuugagaauguaucaugaaauagcauuauauagaauaugaaaaguauuauucauucaucauccacuaagaguuguuguguaucccuuaacuauaggguccuaaugucacuuuaucuguccuuacugucauuuuucaucaacucuaaucuuccacuaauaguagauacauacuauuuuuaaucugucaucuaacauacaauucgaauauuuaguuaaauuuucauaguaccuuuacuccugauaaaaagaguuauagcacaaauaauugaacauuaacuuuguuugccuuuuuguucaucaaucgucccuggagggcaagugguguggaauuuuuuuuuuuuuuccuccaggacuaaugagaaguauguaguggguuaucugcaagcucuugccaguuccccauuauagccaguggcucauauuuuuaaaagcucucugagguugaaagugccaucaggcagcuuggaucaggguuuauauuuucaggcaaaagacaaucaaauuuaaaaggcaaaccuuaaaaaacauuuggguaaagaaaucagguugaaaagaaggaggaagaagggauaaaggugauaaggagcagauauaaaagaaggacauaaauacuuaauaguaagaauuguaagagucuacagcuuggucaacauggugaaaccccaucucuacuauauucaaaaauuagccagcauggcagcgcgugccuguaauaucagcuauugaggaggcugaggcaggagaaucacuugaacccgggaggcagagguugcagugagcugagaucgcaccacugcacuccagccugggugacagagcgagaccccaucucaaaaaaaaaaagaaaaaaaaaaaaagguagucuaaagaguccaaacacugaauagcacuuacuuacauauuuacagggaaucuacuuauuuuuguaaaucgauuuuuauacuugccaccuuacugaauuauauuauucuuucugaugauuuuucaguucucuuggauuugcuuaguaugcagucacuuugccgucuuaaaccagaaguccccaaaggugacccaguuguuucccagcuuaaaaccauucauuuuccuucuaaauguccuuaagauaaaacuucaaaaauccuucaucugaacuaauaggacacucuguguagucccuuuucaccucuucagacucaucuccuaccacucuccccuuagugcuucagggguauuaguugccuuucagcuucuugcccgagccacguuugcucuugauucagaggcuuucuauguacugcugacucugccuggaagauucuuugcucccuucuucaugcagcuaagcccuacucauccuuuagguuucccuuugaaagccuucccuaauccccagacuagaggaaaauuccccuccuuugaaccauauuaacaccccuuacuucugcuucccuggcacuuaccccaguugagauggagcggcuugaagaaaggagugugaagguucguaauagcugcuauggcaguaagcaaaaggacuaacuggcgagaagugacaagauuacucaucaucauugugggcccaguuucagaggggacccagguuuugguauaggaauuaguuagcauuuuuggcuuauggcauuuacuucaacaguauuccacagcccaggagccagauuaguuaagcuaagccaguaguagagauuuugugcaucccccacuccccaagucacaugacaacguuuggagacauuuuuuaauggucaugacugcagaauggaguuguccuacuggcauuuaguggguggaggccaaggaugcugcugaacauccuacagugcacaggacagacccacacgaccaugaauuaucuggccccaaaugucaauaaugccaagguugagaaacucugaucuaucagugaccucagggaaaaggaaaauagacuguguugggauguaggggucagaauacaagcaucuccuucuccuucccuuggaauauaugauguguaucucaaauucucauucuguauugcugcugcuccacacacugccuugcgugacaggucaucaacuucacaaaccaccaagguuaauugauuuauucucagaauauuuauugccugauguuacaugcaggaccacagagaccauagagaguguggaaagaucaauagaguaaauucaaggcagaauuugagggggauaauuauaauugcaguaugaguuaacauguuuaucuguuuacaaauagauccauacaaguaacacuuuuauaauucucuucauuauuuuugcauuuuagauaucggccuuauguauacuuuuggagauggucgccacggaaaauuaggacuuggacuggagaauuuuaccaaucacuucauuccuacuuugugcucuaauuuuuugagguuuauaguuaaauugguaagggcaucacauuucccuguuuauauuuucauauuacuguauuugagucuuucaguauuucauagaaaauaaguaauuuuauguuuguauggaagaguaucauauauauaucuaauaaauauacuuguuuccuaaaagccaaaugucagacauuaugccauucagaaaauguguugcuccuaauuuuccuccuuuagccucuuccuuuuugcugaaaucuugucucuucugcuucauucucauauaucuguugaaagcugggacugugccaugcccgcaggcuuuguaucuuguguagcacccagcagaguaccuugcucacaauagucuuuaauaaauauuugcugaauuaaauguuagacucucaaauccugcacaacagaaagucugauaauaaacaaagcguuuuggcagggcacgguggcucacuccuguaaucccagcacuuugggaggccaaggcgggcggaucaccugagaucgggaguuuaagaacagccuggccaacauggugaaacccugucacuaaugaaaauacaaaaauuagccagguaugauggcacacgccuguaaucccaacuacuugggaggcugaggcacgagaauugcuugaacccagaagguggagguugcagugagcugaggucgugucacugcacuccagcccaggugacagugagacucugucucaaaaaaaauaaaaaauaaagaguuuugaagauacgguuuuuuggcuaaauuuucuuagguuaaggauguauuauuucagugucacgucaccaucacgcaucauaccuguauuguuucuuaauauuuuugccaguuaaguuuagacuuuugaaaauucuauuuacuugaugauaauacugaaauuuguccuccagagacucagugucucauaauauggaacacuuugauuuauugauuugacagucauuuaaugaaagccuacuauggguaagauagugugcuaaguauaagaaauacaaaguacuggucgggcgcgguggcucacgccuguaauccuagcacuuugggaggccgaggcgugcagaucaacugaggucaggaguucaagaccagccuggcuaacauggugaaaccccaucucuacuaaaaauacaaaaauuagcugggcgugguggcaggugccuguaaucccagcuucuugggauccugaggcaaaauaauugcuugaauccgggaggcagagguugcagugagccgagauugugccauugcacuccagccugggcgagaagaguaaaacuccaucucaaaaaaaaagaaaaaaaagaaauacaaaguauuguauacagugaugaacgaaauaaccaggaccucauucauugaggacuuauucauuacagucuuauaauuuuuaaaagggauauacaaaaauauauauaaauuuaaaauuuuaaaguauuaugaaggaaaaauagaacauuauaaaguaucuagaaccuauguacggaaaauacugcacuauggguuuuuuuuuuagcauuuucuugaaaaugauuuauuucucaaaauucuuugaaugcugauuucauuuuuuauuguucugucaucacccaaguaaucacgcauacuugcauuuauuuuccucuaaggacuuuuaagcauuaaacuuagaaaauguucauauaaagaaggcuuagagacauaauuagcucaagagacugauuuauacuuuaaaaaaaaucuucuaguagaacuucucugaguaauuuuucacauuuuuaauguucuucccagauuaaaauacaacauuuucuaacuguaaggagaaauguaauuugccaaguauuuuuuucucuauauuauuuuaaauugaaaguaaaaugguggauuaaacuuguucuaauuuucaaucacaauguuuaaagaauauguaugguaauuguguaccuauuguauacauauuguguacacauucucauugugcacacacauacguauagacagagagauucaccaagccagucugucuaggaagccuaccacuaaauaaaugucuuacagcugauaacuguuaaaaacucauuuguguuugaagccaauguugaugaguuuuucuguggauuuaugcugcagguugcuugugguggaugucacaugguaguuuuugcugcuccucaucgugguguggcaaaagaaauugaauucgaugaaauaaaugauacuugcuuaucuguggcgacuuuucugccguauagcaguuuaaccucaggaaauguacugcagaggacucuaucagcacguaugcggcgaagagagaggguacaauuguggccuauucuguauaauaguauuaucuagcacugcaaagaaaacuagaagaaaaaaaucuguuuucuuuuuaaaucaaagggucuucucagauaaauuugcuacauaaaauuauuagaguugagugcuaacaaacuuuuagaguuaauucagaaaaauucagaaaagcuuaaugcuuuuuuuaaagacacaaauuagaaaauuuaaauuauagaaaacuuuugcauauagacaauggugcuauaaaagcauccuuuuauaguccuauuuuaucaccucacauugaaugcugaauuguuuuuucaacugcauguggacugacuuucacuuuguuauaugcuuuuuuuuauuaugguaguaaaaauacaacaaauauacccccuuaacagauuuuuaagugugcaauacgguauuguugacuauaggcacaauguuauguuguucagaaaucuguagaacuuaauuaucuuauauaaugcuacauucuuuugucuuucaguuaagccucaugagcagugggagcuuauauacuauaaacaaugaaaugggaaaacaaaggaauaaggacuucaauuagagagaggaaauauucucucaauuaaauuuagagauuuuccuucuguguuuuaaaauuauuguuccaaugacauauauauauauguguuuuuuuuuuuuuugagacagagucucacucuguugcccaggcuggggugcaguggcgcaaucuuggcucacugcaaccuccaccuccuggguucaagccauucuccugccucagccucccaaguagcugggacuacaggcgugcaccaccaugcccggcuaauuuuuuuguauuuuuaggagagacgggguuucaccaugcuggccaggcuggucucgaacuccugaccucaagugauccaccagccucggccucccaaccugcugggauuacaggcaugagccaccaagcccggccccaaugacauaccuguuuuuuaaaguaaauggcaaauaauuuuugaagguaacauuccuuuuuugaaaauuacuauaaguuucaaaacauguuuuuuugaagguucauagcaguuuuauuuguaauagccagcauauuucuuuugaaguaaaaagguuaaaucugguguuuuauuaugaaaaagcauauauggaaaaguugagaaauaccccaucaguguuuuguaguuguuguuaauuuacaucuccuaaguaauuuuuuguuucuuagggaguguagagaaaaugcacacacacuuuucccuggucaugugaaaaauaaagcuuccaaauugaaauuuagagcaacuaagauacagagacaacagagcaaaauguuuuugagccuuuggggauuauuaagaaguaaauguuguggaguguuggcauacuuugaacuuucucuuaaauauuuuagcaacuuuuaggaaaguuuauaucaauauuaaauauauaacaucaugaaauaguuuguuuaaccugcuuauuuuaaaggagaggucuccagauucuuuuucaaugaggagaacacuaccuccaauagaagggacucuuggccuuucugcuuguuuucuccccaauucagucuuuccacgauguucugagagaaaccuccaagagagugucuuaucugaacaggaccucaugcagccagaggaaccagguaacauuugcuacucugucugcucucaggauaaaugugccuuuuauuccuguaguuuuuauguuuaucuuaagauguuuucuccaguuauuuaaauuguucucucccugguuagagccuaacaucacucauuugaacucaaauccgggaauauccuuacaaguagaaagcaccaucagugcuccuaagacugccauguaaccacagcagcauaucuuuauagagcaguggauaacaguuauaguacauuccuuaacuuuauccccuuuaaacccugaaaccacuugaugaacuuaggagggaguuauagucuucauuuuagagaugagaaaagcaaggcuugaagagaucaagugacuugcccaaggucacucagcuuauaaacgaaguggucagaauuugaauacaggucuucuggaucuaugugaaauucuguauuuaggcaguauaacauagcgguuaagagcauggacuauggaguuaaacuggggucaaaagccaguuuugacauuuacuagcuguguggcugacuuugggaaaguuacuuaaccucucuaagccucaguuuccuugucuuugaaauuuauuuaauaauacugacuucagaaagugauugugaggauucagugagaucaggcauauaaaauaauuagcauugagcccagcaccucuagaaacaccucaguaaauguuguuaugauuaauauuaauaccuuugcgucacuaccuauuagauacagauuucauguuuuaauuuguaaucccagcucuuucacuauucuauaccuauucuaaguaauuuucuuuagagauauuuguguaucuuaggagugucuguauguuacugcaggacaucuagagagggaauauucucucuuaauuaaauuuagggauucuccuguguuuuaaaauuauuguuccaaugacacauauauuuuuuaaaguaaauggcaaauaauuuuuuuuuuugagacggauucucgcuuugucgcccaagcuggagugcaguggcgcaaucugggcucacugcaagcucugccuccuggguucaagccauucuccugccucagucuccugaguagcugggacuacaggugcccgccaccaugcccggcuaauuuuuuguauuuuuuuuguagacaugcgguuucaccguguuagccaggauggucucgaucuccugaccuugugaucugcccaccucggccucccaaagugcugggauuacaggcaugagccaccacgcccggccaauggcaaauaauuuuugaaggagacauuucuuuucugaaaauuacuguaaguuucaaaacauauuucuuuuuuugaagguucauagcaguuuuauuuguaauagccaacauauuucucuauuugauagggguaggacaagaaaccaggaccaggagaucagaaaguaagcaguaaauuugaaauuaagaagauaaaccugucaucagggacuaagaaucagggacuaggaacagauaauuuguguaucuuugagaucaggaagcuaggcaaaggguugagguaauaaaggauugggaacucagguaagaauugugggccaugggaaugggauauuauauauaacuaggaccuugauaaugagcugauuucuugcaccugacccacaacuuuuguauguuuucuuuugaaauaagaucaaugucuaaugguacucuucagcccuggacauggaaaaaguaguagauucuggcaagcaguauguaguguguacaaggaaaaaauacauuuaugguuuagggaaaauuguuucucagucccagagauuugaaugugaaaauaugcaugauuuuguagcuagaucaaaaggaaaugccaucucuugucuuuuugugacugcuaacacucucuuaagaaaacauuuuggaaguuguaucuaacauauacuuuaacuuuuucuaaaucauucacagacuucaaucuuuauaauggaggaaaguggaucaggauauaucuuacuaaggaguugucauuuaagcuaaaggauaagaaagagauggcuacacagggagacuagauguauuucaggcaaagaaaauaauauagacaaagguuuggaggcaguuaagaagaaaaggacaaccaguggggcuagaaagugagggaaaggguaagauaaagcaguauuggagaaagagauggugaaaaauuauuuacgguuuuauaggccgugagagaccuacgugauaugaauguuuuucuuaagugagauagaaagucauuaaaagauuuuaagcaguagacugauguguuccaauccuauuucuacuuugagaugauuaugaucacuucuaccuccauauagauuauacagaggccagacuagaaauaggaagaauacuugugagcccuuugcaggagaugauaguguauggaccaagguguuugcaguggagauggagaaaagaaaaagaaaagagggaagaugugaaauacauuauagacauaaaaaccaaccggacuugcuaaacuuauuaaugcaccacacauacgugugaauuaaagugaggaaucaaggaugauuccuaagcaagaggaagcuugacacauuugaggaagaaauuuaagaacuaagccucaaacuaagaacacguuugaggaagaaauuugagaucugugaggcauccaaguagaaauaucaagcugauuguugaaacacaagccuaaaguuuagaagagagcccuggacuagaaauauaaauuuggaagccaucaacauagagaugguauuuaaaagagaugggcaugguaacuuaugccuauaaucccaguauuuugagaggcugagguaggaggauugcuugaagcuaggaguuugagaccagccugggcaacacagcaagacccccucucucuauuuaaaauaauaauaaaauccauggauguuggugaaaucaccugcuagaggguagagucagaagagaagagggcccagaauguaucccuaagaacaucuaacauuugagggguagagaaggaagagccagcaaagaagccuuccucagcuuuuucagccaguaaggcaggaggugggaaauuagggcagcguagugucgugaaugcaaaguaccgcucaaagaucaagggaaaauagcucaaagaaguauccaauggauuugguauaauggaguuuacuggugaccucgacaagagcaguucuaggggaagaucagggaagaagccagaguguuaagaguugaguuaugaauggggaaugagggauugaagaggagauaagaugagcagauaauuccuuugucuauuugcugauaaaguggagcagagaaauggucuggcagcuagagggggaugugggcucaauagaaaauauuggagcacauuuauaugguaaugaaugagccaguaguccuggagagagagcacagaagagagaaaguauaaggaaaguugcaaagcucuugcaaaacaggaggggccggcauagagaguggucuuugguaacaggaaaaacacauccuacauuuuaacaggcaaaugagaacuuggguacaaauauagguaguuguguauguuuguuggugagaagaucaaguggaucggauaugaucacuucuguuuucucagucaaaucugaggcaaggccaucagcuuaaauaaucugcuauguauuuuccaaaccuauauucucugccuucuccagucuauccugcauaacacuuuccacauugaucuuccucaggugcaauucaguuuccaugugcuccagugucuucagugaauuccuaauauuuaugaaaauaauuguuaauuuucccauauaauuccaaauucuagcuuuaucucucaguagucuuuuccuuacaaucuucauuugguaauagguaguauuaugguaguaauguauuaugguagucuacaaauaauggcucgugggccaaaucuagcuggccaccuguuuuuauaaauaaaguuuuauuggaacccagccauacccauuccuuuauguauugucuguggcugcuuucugcuacaaugucauagguuaguuaggacagagaccauauggcccaggaagccuaagauguuuacuauauggccguuuagagaaaaaguuugcugacucuuaauuuugaucagacugaucucuucagucuaacuuaguggaaagaacaagagcuguggagucagacagaccuaagauugacacuggauaccaacggucacugaaacuuaauuucuauauuuacaaaaugaggauauaauacuuaaccuuccuuguugucguagggucaauauaacauauauaaaagcauauguuucugggauuugguaagccuucaagacaagcuucuuuccucuacucauuugcugagacuacuguucugcugcuuuauuaggaaugggcuucauugucuuccccuuacaccuccaucucugccccucagaauucuaauucuacucaucuuucuauguaccucuguagugaaacuuuuccugauugccaacauacggauguaauuucucauagacuauaacuucauuaagaaauagcaauuacaauuuuuuaacagcaaacaacaaaauugcaauugcuaauacuuaaugaacuuauuaguauauguauacccaaacauguuuuauaccuuaaauauagacgauaaaaaauaaaaaagaauuagcaauuacuuauguugcuauucugcagauuaccacacauggaauaaauaccaaauaguuauuugcucauucaauucaguggauuuaaaggggagggaucaguguggacugucauuuuuuagugaagacuucauuaaggagcuacguccaaauguauuggugaucaaugagggcauagugagaaacugagaaaaauguaaagucaaguagagccuaugacuuuuaauuaucuacuuuaugauguaauaaccuugcaguuuucugugaaagguucuaggugcuuauacuaguuaucuguugcuacauuuaaaaaaugacccuaaaacuuaguagguuaaaacaaaaagcauuuauuauuucacacaguuucugagagucaggaguccagcagcagcuuagcugggugguucuggcccagguucuuucauaggguugcagucacacugucagauggggcugcaguuaucugaaggcuugacugaggcuggaagauccacuuccaagcucauucacauggccauuggcaggaggccucacuuccuugagaugcucacaacauggacuccuacagagcaagugauuagagagaaagagagggagugcacgaguguagcuggggguggagggggagagagagagagcaagagagccagagcgagcacaagugcgcauacguguauaaccaaaacagaagccauaaugcuaucacaauuacaucugcuuuauuuuacuggcugugcacauacggaccaaccugguauaaugggcaagggaacuacacaagaguaugaacaccaggacguuguaggucauuggggcccuucuuaggacuagcuauuacagugcuugauaccuggguaguuauuuaucccaagggaauaguguuugccuguucauaugaaugaaacaauuguaaucuaauuggugucaauguuuuuaaacuuucacaaagauuuuaaaaccuaugucauugugaaugaauucuuuucaauuucccugacaugagguuaaaggacuuuuaguaaaauuauaccuacacuuuauauuauagaauaauuucuguuuucuguccaguugccuuucacuuuucuguugaaaucuggauuuccuuuuucccauuuaaucauucagauuauuugcuagaugaaaugaccaaagaagcagagauagauaauucuucaacuguagaaagccuuggagaaacuacugauaucuuaaacaugguaaugauuuccuaucuauuuaucuaaauaugaguuugaauuuuaguucauuguguaugugaauguguguauacuuccuauacucuuauaugcaugaaagcgucuuucucguuucuuacuuuauuuuuuaaccaacuauauugagguauaauucacauacaauaaaauuuguuuugauccucacauuauuaguauggcaauugagagcggauucuauuacuaucugaacuguuuucccuucauuuuauauauauauauauauaaaaaaauauauauaauugaaaauauacuauauauuuguacuauauacaaauauauaguauauauacuguauucuuuuuauaauauauauuuuuuauuuauuucagacacacaucaugagccugaauuccaaugaaaagucauuaaaauuaucaccaguucagaaacaaaagguauaauaugaagauuuauuuucguuauuguuggugagagcaguuuaaguuaauuuuuuggaugguuuuuggaaagaacacaagaaacguaagcauuuacuuacuuuagaauuuaaaagacagagggauacaauguagauaaccuccauuuugccuuguucugaugguauguauuuucuguaaagaaacaagaguggaagcauuuuauugcugaaauuugcucuuugggaucauuaacuuaaguuauaauagccauacuuuuccuucugucaagccauagguuaugauugcaguucuuauguauaggaaaagacuaccauuuauugauagaguggcccucugacuuugguugaguaugacuuugaauuaauuacuaugcugacuuuacugaaugauauuaauaucuuuuuuaguuuuaaaauuuugugauuuuagugaaaaucuuugauaaccuuuuccaauauuugguugggcuuuaauuuaucaagaaauugauagcauaaaaauaaaauuaaacauuuggaaauuagagacuguucauggguaggaaagagagacuuuuaaugaauaacaaauugcaaaagaagggaauaggcugugguuuucacaaccauagagagauaaaggccugcccugaaauccuuugcuuuuccuggcuuuaaggacuagugcaaugaaugaaugagggauuagaggauuaggaaaguaaauuggagaaauguaaguugagggaagaagucuauaaaaaauauuuaguuucuauuuauagugucuuugacauguuuucaaguuuaaaacucuuaaaauugaagucacugaagugcaagagaaucauacuaaauuguuaaaauuuagagcuaguccucauucguucuaucuauaauacugaaaggcauggugaauaacagcauuccuuugaauaugggagagcuguucgaacacaguuguagaagcucaaugaauauugacugauuuuugacugaccauacuuccaagcagacaccuuucuugugucuuuccuuccucuucccuuagacuccaggcucucccucuucugggcugcuuuauugugcuagggaaagaaaggcaugugccuuuagaaaucaguucuggcaacugggccuuccucucuuagggcucuuaaaagaaucaugacuuuuuaaagagcaauagcaagaacagccagaaacggaaagcaauuccuuuuaagcugacauauauuuuauacuuucuauagucuuuuuaaguuuaggcccuaccaggccuacuuuaguaaaugagaaaagauuuauuauacuauuucuguguauuaacuuguuaauuuuuaacuugucauguuuuaauaauuucuuuggcacaauaggaaccucuuccuaggccuaacucaucacaauuuauaaaauuugaauuagugagguuuuacuauccagagacccaaauucauuagauauuugcauccauuagcuuguuuguagaauuuagaucaacaauuugguuuugccuuauuuuguccagcaggaaauuaauuuuguauuguuaauguauuauucaaaugucaguguuugauuucauaguuuuuguacaaaucuuacauuuuacacuuaauauucuuuccuuaguguucuuucauuuauagaaauuauuguaauuaaauaauauaaucaaugcaaggaagaaggucaaaaauuugaaaacucaugaagauuuuguuuagaaaagaaaaauauauucauuauuauuuaguuuauagauaaaaaacaucucaugugcaguuucuucaguucuaggaguggacuauucauuuuuuucaaauuuuacauuuuuauuuauuuugugaauuuuguggacucaaaagacaaaugaaaauuugaaaauuaggccaggcaugguggcucaugccuguaaucccagcacuuugggcggccaagaugggcagaucacuugaggucagaaguucgagacuagccuggccaucauggugaaaccucaucucuacuaaaaauaaaaaaguuagcuggaugugguggcaugcacccauagucccagcuacucaggaagcugaggugggagaaucgcuggaacccaggaggcagaggcugcagugagcugagaucaugccacugagcuccagccuaggugacagaaugaaacuccgucucaagaaaaaaaaauugaaaauuaaagaugaucgggaaagugggaaaaauauacuaagcuguacuauguauaagaaaaguguacauuuuuuucuuugaaauggaauuucgcucuuguugcccaggcuggagugcaguggcacaaucuuggcucacugcaaccucugccucccggguucaagcaauucuccugccucagccucccgaguagcugggauuacaggcaugugccaccacuccuggcuaauuuuuguacuuuuaguagagacggguuuucaccagguuggccaggcuagucuugaacuccugaccuuagguaauccacccgccucggccucuuaaaguacugggauuacaggugugagccacugugccaggccaagaaguguacauuuuuaaauagcaucuugcaaaauuaaucucgaaguuuuauguaaggauugauucggauugagaaaagaggcagagaguaaauauugaugguauugugauuaauggcaaaauuauggcagguaguaagaaucgaaaauuaaacacagauacauguuacuaaaucaaaauuagauguaucacagacuagagaguggcacaaaugauccuuaaagaaaacaaaacuuuagcaaaauaucugguaaaacuugcuauuuugauucuccuaaacuuauaaaaauguaaaaucuuggcaguauuuaaaguagauaaguuguccuugucaacuaauaguaguaugacauaugauaauuacuucaaaaaauuuacagaaacaacaaacaauuggggaacugacgcaggauacagcucuuacugaaaacgaugauagugaugaauaugaagaaaugucagaaaugaaagaagggaaagcauguaaacaacaugugucacaagggauuuucaugacgcagccagcuacgacuaucgaagcauuuucagaugaggaaguagguaaugacacaggccaggugggaccucaggcugacacugauggagaggguuuacaaaaagagguauauagacaugaaaauaauaaugguguugaucaacuugaugcuaaggaaauagaaaaggaaagugauggaggacacagucagaaggaaucagaagcagaagaaauagacagugagaaggaaacuaaacuggcagaaauagcagguaugaaggauuuaagagaaagggaaaagaguacaaaaaagaugaguccuuucuuuggcaacuuaccagauagagguaugaauacugagagugaagaaaauaaagauuuuguuaagaaaagggaaaguugcaagcaagaugugaucuuugacagugaaagagaaucaguagaaaagccagacaguuacauggaaggugcaagugagagucaacaggguauagcugauggauuccagcagccugaggcaauagaauuuaguaguggagagaaagaggaugaugaaguggaaacugaccaaaacauacgguauggcaggaaauugauugaacaaggaaaugaaaaagagacuaaacccauaauauccaaauccauggcaaaguaugauuuuaaaugugaucgcuugucagagaucccagaggagaaggaaggagcagaggauucaaaaggaaauggaauagaggagcaagagguagaagcaaaugaggaaaaugugaaggugcauggaggaagaaaggagaaaacagagauccuaucagaugaccuuacagacaaagcagaggugagugaaggcaaggcaaaaucagugggagaagcagaggaugggccugaagguagaggggauggaaccugugaggaagguaguucaggagcagaacacuggcaagaugaggagagggagaagggggagaaagacaaggguagaggagaaauggagaggccaggagagggagagaaggaacuagcagagaaggaagaauggaagaagagggauggggaagagcaggagcaaaaggagagggagcagggccaucagaaggaaagaaaccaagagauggaggagggaggggaggaggagcauggagaaggagaagaagaggagggagacagagaagaggaagaagagaaggagggagaagggaaagaggaaggagaaggggaagaaguggagggagaacgugaaaaggaggaaggagagaggaaaaaggaggaaagagcggggaaggaggagaaaggagaggaagaaggagaccaaggagagggggaagaggaggaaacagaggggagaggggaggaaaaagaggagggaggggaaguagagggaggggaaguagaggaggggaaaggagagagggaagaggaagaggaggagggugagggggaagaggaggaaggggagggggaagaggaggaaggggagggggaagaggaggaaggagaagggaaaggggaggaagaaggggaagaaggagaaggggaggaagaaggggaggaaggagaaggggagggggaagaggaggaaggagaaggggagggagaagaggaaggagaaggggagggagaagaggaggaaggagaaggggagggagaagaggaaggagaaggggagggagaagaggaggaaggagaagggaaaggggaggaggaaggagaggaaggagaaggggagggggaagaggaggaaggagaaggggaaggggaggauggagaaggggagggggaagaggaggaaggagaaugggagggggaagaggaggaaggagaaggggagggggaagaggaaggagaaggggaaggggaggaaggagaaggggagggggaagaggaggaaggagaaggggagggggaagaggaggaaggggaagaagaaggggaggaagaaggagagggagaggaagaaggggagggagaaggggaggaagaagaggaaggggaaguggaaggggagguggaaggggaggaaggagagggggaaggagaggaagaggaaggagaggaggaaggagaagaaagggaaaaggagggggaaggagaagaaaacaggaggaacagagaagaggaggaggaagaagaggggaaguaucaggagacaggcgaagaagagaaugaaaggcaggauggagaggaguacaaaaaagugagcaaaauaaaaggaucugugaaauauggcaaacauaaaacauaucaaaaaaagucaguuacuaacacacagggaaaugggaaagagcagagguccaaaaugccaguccagucaaaacgacuuuuaaaaaacgggccaucagguuccaaaaaguucuggaauaauguauuaccacauuacuuggaauugaaguaacaaaccuuaaaugugacccgauuauggccagucagacaauuuaaaugccuugcauauaacgggcacucauuacguguuauuaaauugauuuuaugucaauuauuuuauguguaguaaaaaaaaaagcaacugaugcagcuguguuaaggagccaaagacaauaggaggcacugguaaauuuuggccucucucaaacuaaaauuuucguguauuucccccccaaauuauaaaaacauaacuagaaaauauuaaaaggucauaucagauuauuaacauuauauauucauuaaaggcagcuuuaggaaacaggaauauacuacaagaguguuuuguuuguguauacaaaucauuccauuuuuaaauggcacagaugcuuaagggcuauaaaaacuucuaauuucuuauaaauauguuagcacuuuuuuuaaguuagugauuacaguuuaccuacuguauagaauaauuuucuaauaauggaugguauucuaaaacucaauugaggcauucacauuuuaaagaaaguauugucuuucaccuuuuauguguucuuuuugcaaaaaucuacaaagugacagcuguguucagagcuuagaucccaaaaacgugaucucuuuuaguuacuaucugggcagaugguaguauaucuaaugaaauggugauuaauuuaaauguauaaucuggaaauauguaaaacuugaaguauuuuuuguccaggcaaagguacucauugggccucaguuucuucaucucuaaaauggaguggaugagaugaugugauaacugcagucccuucuaacucuuaaauucuuuucauucucacagauucacucuaucauuauuguuauucauguaagaaacguuuuagggagaaaaauuacacuuuaaaauuaauuuaguuuucuauacaguuguuuucuuuacucuugaaaaguuaugacagcuuuaacgucucuugucuucuguaauuuuuuauuucuaaacuccuaucauuuccaagcuuuaacuguacuuuaucagagccuucauuucugguauguguuauaugcccucaauguauucacugacuguucuguaauuucaguuugucuguuccuugucagaauguuucaaguaaaauaaaaaauuaaauguauauagucagaaauucuuuaugaaaagauaaacugucuaguauuagauacugaauuuuagagaggcuagauuuccacuagaguaauuucaauugucccuuaaaauuuuccguguacauaaugcagcuaauuuaucugauaguuuauuuguggcuccuuuuucaacuaauuuccuuucauagucccuuuuauauccugggcaugagagauuucuuauacuuaguuuuauuaaggaggauuuugaugagaaacuuccugugaguuuuguguaguugaguucuuuugcacaguugauucucugagugagaaagaauaugaggaaaaagucuagaaucguaugaaguaaaggauuuccuaggagcaauuguaaguuuugccuuagcugcaaggaucucuggcagcuuccccuaacuaaccaaauguacugauuuggcauugcauugcuuuaccgaauucgaccacauucauuaagggauaguagaaaagaauuaauacuaugauaaaaauauaugugccgaacaugauuauuuaaaaaguagauuuaaaauaauuaagauggaugacacagaauucauaaagaaaaaaaccuccagggaaaugagaaacucuuaaacucaaguuauuaauguaauagcuaugagcauucaucuucuacugaagagauaaucagccaguaauacagaaacaacguucuaaaauacacccaucucaguauuaaaccuggucuauauguccacguuuaaauagcauuucuucacauuucccuggccaaaaacauuuugugcucuuuagaagugguaguucaugcaagcauuguuuucuaguggagaacacuggccucccuagucacuuugagaccaaagcccuucuucugguuuuguacuuuugagcugucugaacuugggcuagucucuuagcuuugcaguccucaauuucuucaucuggaaaauuauagaaugagaaugagugaccuaagggauucuauaggaacagcaguuguucauuaccagcuagagcucugucacacccagauuuucugcaauuccuuuuuccucaauaaaaaaucuuaagucucgucaccaaagcgaccccacauucaaacuaacuaguaguuauacuaaaguaaacaguuauccuaaacuacuaagcacacacuaacuuucugugcccacuguugggcgaacauuuauuuaaucacauguggcaggucuaguacccucaaaaaguuuauggagaggaguguauuguggguuagggguggguugggguacaaaagacccaggucuauccaggcuuucaucgacagaagugauuuacauguuuguaaauuuuauauaucuuaggagaaaaaaaaggaagcuuaagaaugagaccacuuugucccucaugaauuaacacuugguuauauagauuaaaauaacugguuccuucuuuauuguucccaucugcugguuguucaggcuuuuauaguaguuuauuacugaucauuauugagggaagugugaguaguauauauagaauccauugaguuacauuuccuaaugaggacucuggcugaaaaagacuuuaagguaagcugcaaaggauuaccuaccacagaaacugcugcugcugcugcugcugcugcugcugaacagcagcagucaaggugagugcaacugaaaugucuucuauuauuucacuauagagaaacuugcuauacacuuacauagcaaaaauaaaaugugaccauggaagaaggaaaggccaagcuuuucuuguuucugaccuggagaacugaguagaaagaguacuauucagcaagaucgagaauaagggagcagaagcauguuugggagacaguuuuuuacuguugauuuuagauuguaggagauguucaggaggcagauaccuguauggaucuggagcucacggagacugcugaguaucgccagcucauagauguaguuaaaacuggauuugacugaaaggaaguguuccuaaugugaauggaggagaguugaagacagaauucagagaaaugucaguagguaagggagagguugagaaagugaagucugagaaggaggugugggagcauacuuacuaggaaagagagauaccacccaagccaaagaagggguuucagagaggaaggagugguaguagcugcagagagagccucuaggaggcagccuaguagagggccaggggcagaacccacauugccaggaaagaaugagcuccgggaaaucugcucugcagaggaauagaaucagaacugugaaaauuaaauaucagauauagauauuuaauuuuuaaaauauuuaauuuuuuaagcauauuucucaauuuaggaagggagauguguacuccagagacuuugguuuucuggggaaaagaugauaaauuuuguucauaauuaauauauacauaagaauagaguguuauugaugugagcuuaugaaccaaaagaaaaaucugcaaugcuuuaaacauuagugaggcggagaaaaaaaacaucugugagaacagccauuauuauccucaaauuaaaugagcagguuuggaaacaaacaugggcuccaaaguccaguagaacugaguuaaaaucccagcccuccacugaugagcuguguggacaccuagaaaaguugugguggugguggugguggugguuguuauuugaccuuucugagucuuauuucccucauuugauaaaggaagggacuuuugacgauuaaauuaccuaacacaugaaacauguuauaggcacucagcaaaugguaaccuguaucacucuaauuauacucugugaucacaccaagguaggugcaaagcuacacucaugaaucuccaggucacugacugaugugcgugaguuuagucaugugaaccugacuuuuguuuaaauguaacauaauagcaaaauauaaauuggcuuauagaaauagaucugugggaauaaaguagauugcaauaaugaucaugcuuaaguauaagguggagugaaacuauuacacaccauacauuagucaauaaaugccccuaaauauuuaaaguguguugaaacgcugaucacacucaugugguuagccgaaaauuuagguguguuuucugucacugaacauuucccucuguguccuaaccuuguuaucaaaauaaauaaaaauaauuagcacauaagguauagucguggaucaugcauuuguuuauggacaacaagaaaaucuucuaaggaaaaagaguagagauaguaaagaauaaaucugaaaaugagaauaaaaaugcucgccagcaagauauucuauacucugaacauuuauuucuguaggccugccuaucaaacuggaauguauucaguggugagaauacaggauuaggaaugacauaagggaguggugccuagaaagaaggaagaguuuaagagauuauaaaguaguaugaucagccaagaauuuggagaucacaacuggcagcccaugggugcagucuggccugcagacuuauuuuguuuggugcaguuuuuuuuuauuuaaaucauauugguugccaacauugaaaugucaggagauuuuacauuuaaaaaguuucucagccaggcauggugacucacaccuguaaucgcagaacuuugggaggcugaggcuggaggauugcuugaggccaggaguucaagaccagccugggcaagaugauaaaaaccugucucuacaaaaaaauuaaaagauuaguuaggcaugguggugugcgcccuguagucccagcuacucaggaggcugaagugggaagaucgcuugagcccugaaggucaaggcuguaguaagcugugauugugccacugcacuccagcuugagugacagagugaggcccugucucaaauaauaauaauguuucuuggacuuuuggaaagccugggucugggagcaucacacuguggcaacacugaccugaagcugagcugaggcuggcaccccucuccccaguucccauggcuccuucccucacuggccuugaugcuaggcuccuggcucacaauaaaaggauguauagaggacacaaaaauaaguggacguuuuaaaugaacuauuuuccagugauaagaucugggacauuaugggaaaaaaaaguccaaacuuacuguuuuucgacaguccucaaugcacacuaagaauucuaucuuacuuuuuauggaggggccucuacaaaauuauuuauacuuauauacaaauauauaguauaugcucauguuauuuuucucuguaaauaaucuuuuuaaucuuuacacaaacccucugagguagguauugcuaauguuauuuuuccauuuuacagguagacuauaaaauacauucacugggugccaugcucaggccaugagugauuagauuaaggcuuggaaagcagugcuuagggcuuuguauuuaaugcccuucccaccccauacugcuguuuccaugauuuucaguguaguuaaaacaugaacuuacagguuaacuuuuccuguccaaaaaaaaaauauauacuugaaauuuugauuuuucuaccugauauaacuuaaauacaaaguuuuaugcuauauuaaccuaucugggaaacauuuucuacccuacaugacauugaagcaugucagaaauucugaauuauagcacaaaauuuuauacuuuauagcucugguuuguuuuauuacuuuuaaaaaacuauaauacccacggacaaaagugccuaucucauacaugugucccucaauauauuuuucacaaagugaauacacccaucacaaacugaucagcauccaaaucaaggaaaaacacaguaccagcucccucagaagcuucacuuuaaccccuuucagucauuucccacucucagccccaccccccagcccccaucccagcauucuccuuaaagcaugcgauguaauuguguucuuaaguaaacagaaaccucaguaggaaccuuugcucucuuguucuguuccuuaagaaauaugaaaaguguugccuugggccagaccagagucugcaccugacugugccaugccugaccaaugaaacaaaggguccuuuugugagaggucaggcccauucacuucuuuacugugauccuaacgcaagacacagacauauacugaccauuucagacuaccuguuuacaucuucuuagaugguucuagugccaagaauguacuuaaacuuuacucuuucuuuuuauaaaaugacaguauucugccagucacucccaaauuguuucaguuuaaaagguaagugcuuucugugacuucaaguagucguccagauguguuuagaauaauuuuaaaugugcuuagucugugagugcuaugaugugauuucuagugaaaaugucauuuucuaauagcuuucucaaauuuagaaaaugauauaguuccaaaaguucuucauuguuauagauuguuuaaaguuaaugaguaaaauuguaguuuguuaugaguguuuuacuuauuucuaaaauaagguaaaacucccacgugucuuuuuauaauagcaugacauuauccugugguuacaugaauaccucaguuaacaagcccaguuggaguugacccaggugcuagguuagccaagcuucccaaguaauugaggauuaugcugggaacacagcucacugaucccucccucugugaaaagaggggcauagucugaaauuccuugucucaggagcacuguucuuuuuaguuaaccuuucauuuauguauauuuaugcagacaacuaucagucauaagucuuaaaucuaguaaucuucccauucccuuucaaagugaaguuguuucugauaauuuuagcuacccauaauguauaccuggcuaggcaugauacacaauauaagucacucaaaaggggaaaucaggcugggcgugguggcucacgcuuguaauccuagcacuuugggaggccaaggcgggaggaucaccugaagucaggaguuugaggccagccuggccaacauggcgaaaccccgucuuuacuaaaaguacaaaaaucagcugggugugguggugggugccuguaaucccagcuacucgggaggcugaggcaggagaaucgcuucaacccgggagguggagguugcagugagccaagauugugccacugcacuccagccugggugacagagugagacccugucucaaacaaaagcaaaaaacaggcgguuggaaucaugcagacaaaaacaaagcuuaaaaguaaaugauaacuaccucauguuaacccuacccagucuaaucaaucaucauuugaaauagcugucugcccugguaccauguuccuuucucccacauuccucucuugcauacauugccucaugaccuuggauuaaccuaaaucuaauucuuccugaguagcuucugaaacucuuuuuaaaaucucaaagcuuuauuuacuuagggcuuccuguccucagugggaaugcuauuaggccacgccuuugcaauuggccugaggaugacacuaauguuuacuauuaagguguacuguauaaacauccucuuccuagccuggacucucgcauuuuauauuuuuaccagaagaaaggugaguuaaauuuuagaggcauuauuuuccaaccaccuacuaaagauucuguugaguaucagucaggcuuuauccuuagccagacagcuacuagaaagcugaccaucaaaagcuaauuacaguguugaaggggauauggucugaagcaaauauugccaaggugaacuuuguacaaauguuauuugaaggaguaaauggcacugauaacugcuucacauauuuuagaagcaguuauaauaaacuuaauuauaauaaacuauaaaguuauaacuuuagugaaguguguaaaugaaaaguaugggggggaaucuaaugagaaaccuaauaucuuaaugacaaucagaguauuucacccaaaauuagaaaguuaaaaaaaaaaaagaaaucucaguguagaauaaaggcugaaacuaauauuuucugccuauacuuaauaagcauuccaugauuuacuaucagucuaucaaauccauagacagccucuuuuaucguuuggauuagcuggccaguagccagacagaacaaguucugccucuguuugguuuuccuucugcuuuuaauaaccaugagcaaaccauuuaaacugucuauguuccuuuaucuuuuuuccuggaauguaaauaauuauacuuaucuuccucaugacugucagugaaucguacuucugaagugauucuaaaucccuauauuuuggaaaaugaauauaauauauagauaugauuauguuauaaugcuacaguagacagaacgcuuuuuaaacuuuucucaagguugaaagcauugugagacaaccaagaaagaguauuuauuuuuuuuuuccauuguaaccuugccaugggugcuaguaagaauuuuggaaauccuagucauugaaauagaguggcaugcguaaaauccuuguuaauacaguaacuugauauucagcauggacuguacaguauuuuuuucuucggcuucaauauuugaauuaauauuuuccugguuuuuuuagaugacacaaauuauuuaugacagcaauaucaaaucccucguuuuuuaacaagaaaaucuuacucuucucugauggucaauuuugucacaggaucaugaauuuucuaaaacugaggaacuaaaacuagaagauguggaugaggaaauuaaugcugaaaauguggaaagcaagaagaaaacugugggagaugaugaaaguguuccuacagguuaucacaguaaaacagaaggagcagaaagaaccaaugaugauagcucagcugaaacuauugaaaagguaugaugauagaugcuuaaauccugagauccugggagaaaacauauggguucucuaguuucugcagaggacagauuccaguugccuuugggaucagaaauacucccaugaauacaugaauacaugaauucaugugccauaagagaaaggcuuuggcuuauuugugaacuaagcaaacuuugucucuagcacacuuucuagaaugcugcuugguagcauucugccucccgcaugaguggaaguagaaugguaugggccaggauaguacaccguugggaaauuaaccaagaaguucagcacucaguccuugaaaugcugaaagugcaaaguuaggagcccuggcacugguggcagaaaugggguguguauguguacacacaccuguguauguuuacaugugugaaugauugaaaguuggucacagcaguauuugaaguugugaucaguucuucaaaggugcagucuagacaaaauuauguauagaaggaauaggagaagauaucacuaaggaagcaaaaaucacccugaaaguggagcuagagaagcccaaaacauaaucucuuccauuggcaguuuugacugagagugaccuugcuaggagauaguuuguagguuugaaaucauuuguuugcuaacacuacucuggauuaacuucagaaguauggaauuccgcaacccaaagugaaugacguuguacugauucaucuuuauuuucauuuuuugaaccucucaugcagaacacugagucauaccuucuaguaugaaacacucucaucauuggucuguugcaaggcucuucucauguaaauguauucucuuuuagcuccauuccccuuccccuuuuucccuaacauagacaaccacugaaacauauuugucauuuuauuugaauguguacuugugaaacauguuuugugugcauacauuuuuaauuuacaaauugguauugugguaaaggucauucuuuugcuugguuccuucuuuauccaagacuccuuucucucacuaagaaaaaaaauauucuagcaguuacuguuuuauuucagaaggagaaaaugauucuguuuauagggaacauuuaugaauucagguuagggugguccuuaagauuauuuaacauagaaaucauuaaauaccaauuugacauuguaaaauguugagacaaguuguaugccaauuagcguucaugaaucuucuuugaggagaauucuugagucauacaguuuuuuuaaucacacaauuuuaagcuaggaggacauuugcaaucagucagcaucuaaggccccucacuuuacaagagcucagcaaagugaaguaauugucacauguuuaugucauuagcuagaggcagacucuagaaccugcuuaaagauucagacuuaaguuuucuagaacagcacaaaaauauuuuuuguuauauugcuuuguuauuguuuauagaaagaaaaagccaaccuagaggaacgggccauuugugaguacaaugaaaacccaaaagguaugagcacauuugauaacauacauauauacauacauacauacacacauauauauguguauguaugccauaauuggguaauuauaagcuuacauauaaguuuacauauaugcuauaauuuuuacugucacaugauccucauaacaagcuaugaaauaugugauacagacuuaucuguucuuauauauaaccaccacagcuucuucacauacaaauauugcauuauucauggcuacuuaugugucaauguuaaggaauuuuuuauuuuuuuuugagacagaguuucgcucuuguugcccaggauggagugcaauggcacgaucucagcucauugcaaucuccaccucccagguucaagugauucuccugccucagccucccgaguagcugggauuacaggcgugugccacuacaccuggcuaauuuuuauauuuuuaguagagaugugguuuugccauauuguccaggcgagucucaaacuccugaccucaggugauccucccgccucggccucccaaagugcugggauuacaggcaugagccaccacacccggcugguguuaaggaauuuaaguagccuuuuuacuaccuuuuuucucucuauuaaaucaguauuauuaaaucaagcuuuugccccaaauuccaauuuauaucucuagugcacacugcuagacuccauugcccaaccaaguugggacuacugggcuggccuaaagccacaauggccacccaguuauuuacccccgagggcucagaccugagugucuuaccguagauacugaagagaaguccuuucccaagccuaccuaucagugucagagagcaggugcuguggaauagaggagacugugauugcccuugagaucuacauaaucuagacacaaaucaucuguguuucuguaguaugacucccacauuguuuccacaccaucacacggcaguaugauuguguucucauaaaaaaauaacuaucuguaauacuggauaucugaucuaaacuuaagcugaagaaugaauaguuuccuuaauccuguuccuuuuaacuucugccauaagaguaguaaguuuuagaauauuuuaggcaaguguuaaaaaauguaucaccuauaaguauucuuaacauauagccuaaagcacuacaaagaaauuaaauauaagcuuaaaaguaguugauaauauaaaauuaaaacaaugcauaugcuucacaaguauacuuugaagauaauuauucagauauagaacauguggauuaauuugaaacaccaaaaaauagcauguccauuugaguacaaagaauguaauuauaacuagguuaauuuuuaaaguaauuuguauuuuacagaagucuucucuaacauugacuauuaccuuuguagcuauauuuggauacuggucaucuaaacauuuacaacuuuggugaggucauucugggcuuuucacuuuaacucaacuuuucaggaaauaugcaguguagauguuguccacuacuccaggggugagcucuuuucguauuaccccacaacucaggguucauagaguuucacugagagcaucaggucuugucuuuuuccuauuaguuaaaacuaguauuucugaaugauccaauuguaggauacaugcuugaugaugcagauagcaguucauuagaaauccuagaaaacagugaaacaacaccaagcaaagacaugaaaaaaacaaagaagguaagugaaaugaauugucuuuuuugauccuuuugaauucaauuguuuguuuuacuuuucauauggcaauccacauaauuuaacucucuuaauaugaguuuucauggccccaaaaccugaagaauuucaggugaugucgcauauuuuuaauauacuaccuuuccuuugguuagcauuugaaugaugaucuucuuuucauccuuuuacuuuagcuuauguuuuagaugugucucuuguaaauggccuauacagcuggauuuugucuuugacauuuuuaacaugcauaccuaaaaucuaaagcucaucaauguuccuaucuuuuucccaaauaaugccaggaccuuagaagaauuuucuugccuaucaccucuucuuucuuauuuuagaaguuaugguacccaguauuuaaaauuuuuuaacaucacaaaucguauguuuuuaguauuuuuuauacuacuuuuuuacucagauguccccucuggaauucuuauucuuccugaagaaauauuuuggaaguuccuaucacagaugucuguugacaguuaaaacuuuuaguuucuguucacuugaaaaugucuuuauuuuaccauaguucuugaaugauaguguggcucguugacaguuauuuucucuuaguaucugcucccauuauugcugucuauaauuuugcuuuaguauaauugcugauaacuuuguauauaaccugccauuucucuauggcugcuuuuuagauugucuuugguguguuucaguucacuaugagaugcuuaaguauggauuuuuuuuuuuuuuugagauggaguuucgcucuuguugcccaggcuggagugcaauggcgcgaucuuggcucaccacaauccugccucccagguucaagcgauucuccugccucagccucccaaguagcugagauuacaggcaugugccaccaugccuggcugauuuuguacuuuuaguagagacgggguuucuccauguuggucaggcuggucucaaacuccugaccucaggugauccgccugucuuggccucccaaagugcugggauuacaggcgugagccaccaugcccagcagguauggaauuuuuaauuuuaacuuacuuggaauuuauuaugacucuugaaucugagaauucaugucauuugucaauuuuuuuaaaauucucauccauuauauauuugaauauuuucucuccccucuuucaaauucugauauaaaacuuuuuauuuuauggguacaugucuuuuaauaucaccuucuuguuuucuauguguaagugauauucuggguaauuucagggccuucaucaauuucauaguuucucuucagcugagacuacuuggcuauuuaaccuaccuauuuaaaguuuuaauuucagugauaacaucuuucacauuuuaagugaaguuguauuuuuguucuuuuucaaaucaaucuggucuuuuaaaaucaguaucuuguuuuaugcuuacuuuuuuuauucuagucuuuuaauuuaagcacacuuaguuuacauucuguauuuaguaauuccagugucauccuuagcagucuaaauguguguugcuuuggcugacuugcuaauggugauuaguuuccauauguguuuugaaauuuguauugugaguucauguuucacugguacuuuuuuuguggaaauccuuuaaggccucuguuagaguaagucuaucuauagagaguuugcauuagccuuuauuagcucuggagugacugaaggaccacuuuaaguucauuucucauuuaaggguagaccacaauguuuguagguagacuuauauuaagggcauaguacuuagaagguccucacauuauguaggggucucaguuccaguuccccucauuuugugagaucaaauuguuucaaaguuaaaagucuaaguuaugagucagcagaugcuauuucaguucuuaaugaccucugaggcuuccuguuccuucuuucuuuuuuggucuacaaggauuucccuuaguuuuuggggagauuaccugcacauuauaaaauuauauuuuuuauacuuaaucagcauuucuugguauuuuauaguggcagucuuuuugaaguuguguauuucuucaccauagcaggaacaggaguucuuccauuuuaauccauagauccuuuuucuagauucuuacuuuuuggauuaucacuuuuuacccuaguuucuccacucuuuaaagcuagaaguaagcuauuauuauuagcaccauuuuuauuucuggaagagccaaauuuucaccugguuuuuguuuccugcuuuuuguuuuggcaucuugucaaaaccauuauuuguguuaccacucuucaauaauccuauuuucuuccuggcuacauucucaaagggccuaaaucaaaugaaacuuuuaucaccuucaucucuucugcauacaugcccuguuggccacucccuucuugauguauuuuucucuccugacuucugagcugccuaguuuucccaauuuugcaccuacaaaccuugguccucaguucuagcuccucuucugccugccucucacucugcucuuuuugccucuuuucuuauauucuguuuucuaccugccuggaaucucuggguuaucggggcuacuuucaucucucagcuauuaucuauauucuacauaucugcagccccagccuccccugagcagcagcucuguauauuugacugccuacucagacccacacacagggcucacacagccaucauuuggcagcacugacuuuuuuuuuuuuuuuuuuggggacagagucucgcucugucgcccaagcuggagugcaguggcgcgaucuuggcucacugcaagcuccgccucccggguucacgccauucuccugccucagccucccaaguagcugggacuacaggugccugccaccacgcccggcuaauuuuuuuuuuuuuuuguauuuguaguagagacaggguuucacuguguuagccagaacagucucgaucuccugaccuugugaucugcccgccucggccucccaaagugcugggauuacaggcaugggcuaccgcgccuggccaagcagcauuaacuuuuuugccagaaguucucaucuacaggaauggggagguacaucguccuucuucagaauauuacaauagaaauucacuguagcugcgauacacugagaaucacagacauguccugaaaaugaccccuccuggauacauuuaaaaguuacaauagguaacuuuaaauagguuuuuauauauuuuuucucuuacaacuuaacaaagugaaacauuaaauuuguucuuugaagaaaaagauaucaccaagguguugaugguguugaauguuagacccugagaggucuuguuuuaggguggaauccugacugccuuuuggugaaaggaaaaacucuaacagaugcuaagaaugcaccauaguacauguggugccccauaaagagaugacaaaaucauguucuuacguguugaaaaugauauccccuaaauacuguuaagugaauguuucacuuauggaaaugaauauuugugugugugguuuuuuuccuagauuuuucuguucaaaagaguccccucaauaaaucaaaagauugucaagaauaacaaugagccgcucccagagauaaaauccauaggagaccagaucauuuuaaaaagugauaauaaagaugccgaccagaaccacaugagucagaaucaucagaauaucccaccaacaaauacagagagaagaucaaaauccuguacaauacuauaaauauauauuuauguuuucacagucaccaaguguauuguaauguauacuugaaaaauguuauaacuuaugaaguaaaguuucugauaguagucuuuaaaagauauaagacuuaauauguuuuauucagcuucuauaagugugaccaguuuugauauuuauuuaugcuaauauuuuuaacaagucauuucaaaauauguguaucucaaauucucccuaaaguguuguggccuuaacuguucaguauugcaauaaaaaauauauuuuuauauguggaaaauugaaauaagauauuuccuaguuuuuacuaaacaauuuuacuucuuuauaauuuuauaaggcaauauuugcaaucuuacgacacuguaacaguuuuugauguauuuacaauuuuuacaaaacugagguaaaauuguuuauaaugaacauauuuuaauaaacuauaucuggucaguuccacuguuaacauugauaaguauuaauaaaauuaggagguacuuggcauuagcaauugacaaaaugggggcaaaaauaauuuuaaaauauagaaguaugcaaaaugcauuuaccccugaguaaagaaaauuucagugcaacuguauaaaugguacaucuguggaaaacugagugcagaaguuucuuugcuucccagcacuccuuucuuuuuuuggagauggaagcucucucuguugcccaggcuggagugcaguggcauaaucucggcucacugcaaccucugccuuccggguucaagcaauucuucugccucagccucccgaguagcugggauuacaggcacacaccaccacacucggcuaauuuuuguauuuuuaguagaaacaagguuucaccauauuggccaggcuggugucaaacuccugaccucgggaucugcuugccugggccucccaaagugcugggauuacaggcgugagccaccgugcccagccccuacuccuuuccuuagggaaaugacuugccaugaaaacauugcagauuauuugguaucaucuggaguguuugaccauuccaccgaucaccaccauaggagaggugaacauagcuaggcuugcucauuucagcuuuuccuggcauugacagugguaaccacauuugguucagucacacagugcucugccacaaagaauaggaaggauaaagcugcuaagucuugugucaguccauuuuuauguugcuauaaggaauuaccugaggcuggguaauuuauaaagaaaagagguuuaauuggcucaugguucuguaggcucuacagggagcuuaguggcaucugcucagcuucuggugaggcuucaguuagcuuuuacucauggcagaaagcaaagcgggagcaggcacgucacauggaaggcgaaagaggaagcaagagggagaggguggaagugccacauucuuuuaaccaaccagaugucacaugaacucugagugagaacucagucauuaugggagaggaaagcacccaggcauucaugaggaaucugcucccaugaccuaaauaccucccaccaggccccaccuccaacacuggggauuacauuucaagaugagauuuagagggaacaaacauccaaacccuaucaagucuacucugauagaaacauuguuugcuuaugcucucagguacuacuuauucaacaaagcaaaguaucuucauuuuccccauucuagcuuguaaauagaacacuuuauucuucagucacagugaccauugccccauuuaaacaaagaaaaagaaacuucaucuuugcguuucgugcacagggguuguaaggauguuaguucagaauagaugugauuuugaaaucuuaaaaaauagucuucuguguaaauguuacauuuaguagaauuuuaauuuuauuaaagguaaauauaauaaaaaguggcuguugcaaugauaguacaguauugcaaaaauacuaaaauauaaacuaucagagucaaguggaaguaaagcucacaagugguaguaagauaugccagucgugguaggcagaauucuaagaugaaccccaaguuucucaccugcuggugccacaugcucucaauaaucccuuccucaugaguguggguuggaccagugaauaugacggcaugucacgucuuugcuucguuacauuauguggaaaagauaaaagauuuugcagauguaauuaaaauuccuuguuaguugacuugaaguuaagcaaauaagagauaguccuaaguggccaugaccuaaucagauuagcccuuucuaagaggcucuaaaaguuugacauggaagaagucagagagauucaaaacagcagagaugcucuccuguugggcuugaagaagccagcugccauauuuagggagagggccaugugccagggagugguggacagccuuuaggaucggaaguccucaguccuacaacugcaagaaauuuaauucugcuagcacccagugagccuggaagaggaaccugauccucagauuggaccacagcccuggcuggcaccuugauuacaacuuugcgagacccugagcagaggacccaguugagcaguacucagacuacugauccauaaaaacugugagauaauaaauacauguaguauuugucugcuaaauuuaugguaauuuauugugcagcaguaaaaacuaauagcacuuguauuaugggaaagaaccugucuguaugguggcuuccuucaucauagccagcaaggaagagucaauagagucugcuaacaagacagaggucauaauuuuagguuacaugaucaugaaagugacauccaucuuugccaaauucugcuggcuagaagcaagucacaggucccacccacacucaaaguaaagugaggagauagcacaagggcaugaauaccagaaggcaagggucauaaagaccgucagaaccuccccacuguacugaucauugggccggucauucaaaaggagaaagggacagcuuagagaccaaggaaaucaaauagcuuuuaggcaaauagcuuauuuccaaagaaaggauuaagucaaaacacuuggaggaggugcaugagacaaaccuuaccaagcagaugaaguaucccugcuuuguuagaggucucaaaacaauuuauacuuuuuaauaaggugguuuguugaaaaucaucaacaccaagagauaauuuuaauaauaaggguaaauacuucuauaaaaacauaccagccaucugcccuugggcuuugaauacuuguauuauauuucuuuucuaaauuugguucccuaucuggcauuuacauugaagaaauacuuaccaaguaccuccuauaugccagauguuaugccagaaacuaagaaaacacaguuacaguuacaugugaguaaaaugaagaaaauggggugugacucugaugaugaauaggagauauuauggcaguuuuaaaaccuauuuucuaagugaauggaaaggagauuaauggacacuaaacuugaaaaacaaacuaauaucugagaacucuuuaaaaacacagaagagauaaucaauagaauugaauauaaugaucaauuuuacuaguuucaaaaauaaauggaguugcauuuacugauaacuuauuuauuuauuugagacagggucuugcucugucacucaggcuagaguguaguggcaugaucucggcucacugcaaccucuaccucccaggcucaagugauccucccaccucagccucugaaguagcugggauuacaggcacacacuaccaugagcagcuaauuuuuguauuuuuuuguagagaugggguuucgccauguugcccagaauggucuugaacuccugggcucaagccaucugucugccugggccucccaaagugcugggauuacaggcgugagccaccauuccuggccgcccuuacugauaacuuuauagcuuuacaaaaaguuaaaugauuucuucuaauccucaaacuacucauauuuguuauguuuccuauucauuccuuucuccucucuauaaugauacuacguaaggcuuucuuacugaccuuaaugggaccugaaaaauagaauccauugacuugagcauuagggagucauugacauuguucacuuauauuauggaucaaauguuaaauagguauuaauuuuuuaaauaucagcagugguaagauuuuuaggucuuauaaaagagcaugcaaauccaugucaaaacauuuaagauaaagaaaauuuggcauuuaaaaagacccuccuuauauaauaagaaaauguaguuuugaaaggugcuuuuauguaauaucaguuucccagggcugccuuaacaaaguacuacaaacuggguggcuuaaaacagcagauauguguugccucgcaguucuggaggccagaagucugaagucaugguguuggcagagccaugcucccucugaagggaccugggaaggaucugucccaggucucucuccuaacuucugguagucucaggcauuccauggcuuguaaauguaucacuggaguccuuugucuucauaccaucuuucuguguguaauuguguccacauuuccucuuuuuauaaggacaccagucguaauggguuagaacccacccuaaguauuccuuuuaacuugauuaccucucuaaagacccuguuuccaaauaagauuacauucugagucacugggaguuaggacuucaacauaucuuuuugggggaacaaaauucagcccguaucggugcuucaguuugacagcuacacaucauaccaagaaaacccuucaguuguuuauagugucuagucuccuaaauuauuucucuagagacucuugcugaauccuagauuuuuaaugauaugucuccaguggaggcucuuugugauguuaaaacuuucauuuaauguaucuccaguuacaucaaagcaggaauuuucagggcuaucuuuuucaguauccuagacacaaugagcaaguauuaaauguuaaaugaugacuaaacaaaugaucacaucuacacuuguaguguucagacaaggauuuguuucucagaaauuuguacgcacaugcuuuaagguuaaacuccauuuuuuaaaauacuugccauaugcuucauugcaguacaauucuguuacccauaugcuauuauaaauccauaaagggaaaacaaagucuuuccaugagcagggaagacccugucucuuccaacagaacaccgucagaagcauccaaaaggggaacauuuggucaacuaguauuauaaucaucaagguuggcaacaagaaagaaguuauugucauagaccucuacccacaggagacccaaguggcaacaggauuagagauaagaugcagaauaauuauuaugggacagagccauacugauuucuguauuacguuccucaacuugaauuccgagauuuucugcccacuuugauucugugaggcaaccaaaaucgaaaguauuuccauacuuaauauuuccuuuugccggggccugugauuuaaagauuucucaucugauaguaguuguuuaaaaagcuuagaguaccggccaggcuugguggcucacgccuguaaucccagcacuuugggaggccaaggcgggugaauuacuugagcccagcaguuugagaccagucuggccaacauggcaaaacuccaucucuaugaaaaguacaaaaauuagcuaggcaugguggugcucgccuguaaucccagcuacucaggaagcugagacaggagaauugcuugaaccugggaggcagagauuguagugagccaaagucacaccacugcgcuccagccugagugacagacuguuucaaaaaaaaaaaaaaaaaaaaaggcuuagaguaucuuuuuagacagaacuuuaacaugugcuuuacuuuuuuaccuuguaagaauaagaaacuagcaaguaaaaacaggaggcaaaucaaaagguuggaaaaucuucaucucaggaaugagggagauacuuuauugaauugaacaaacaaugcauguaaaccaggagucacauaacuaaauuguuuucaguggcugggcagguaagcacauuggagcugcugccagucuguucuagcuggcaauugcucuguuucccaguauugugcucugauugccagccccucagcuguuuuaaaaagaagcuggaaaucuggguuuuuauauggauaacucauucacauacacacgugugcaugcacgcgcgcgcgcguguguguguguguguguaaacuuagaaagggccaagccauaacugcaggcuaaauuuggcucucaaggggccaaguugugaccucuauuuuaaacaaaguacauuauuuuggcaagagaaacuaguuuacaaggaaaacauguugaaauaggcccuggauuuaucuuaguuguaaucuuuccuaauuugaucugagauuuuaagcaugaaaugagaguuaaagaauugacuagaaaagugaucauucuacuaagguaauugaaguuuccuguugcauacagaugcauacuaagccuucuuuugaguguggggagucaggaucaugagguagugcaacuguauuaaacagugaaguagaauguuucuguuggaagaagcuacaauaaaguucagagacagcagacagacuugauaagcagucccucuaacaauugugacagagaacuacuuuggcauaguguuacuguacaauacuaaucaccgaaaacaucaggaaauguuauccuaacccuaaaaauauucacuaaaacuacaacaugaaaacuucucuggcacggcaagcugcauucccaaauaguuccacuugcuucuauuuucaucugguauguauacuauguauauuauaauagaugagaugucuuaaguagcagugggcuagagaacuguaucuaauuuuaaggaauguguaagugacaauaagacacuuuuuauuuuuacuuaagaaagaucuuaucugguucagugguaaaaaucugucccauccuggcuaacauggugaaaccccaucucuacuaaaaauacaaaaaauuagcugagugugguggcaggcaccuguagucccagcuacucaggaggcugaggcaggagaauggugugaaccugggaggcagagcuugcagugagccgagaucgcgccacugcacuccagccuggcugacagagcgagacuccgucucaaaaaaaaaaaaaaaaaaaaucugucccaaggugaacaccuuuuuaauauucuagaaaaucuuuugagguuuaaaagcagucuguccaaguaauuuguucagaaccugucaaaauaguauuacacuacuuuuaaaguuuuuacagaauuuccccuguggacacaaagguuauuacaacagcaaaguuuucuauuguauuguuuuuagccuauaauuacuuaaaaaucauuaaaacucugugcauaugaacauuugauuuuauauuuuuagguaacauauguuacaacuugccaucagauuuauauuaacuccuuaauuauugcaauuauuuaauuuacugcauauagcaauuaauuagaaaauuaauauaaaaguuuaaaccaauuggagaaaacuuuaagcaaaagauagacguauaaguugguuuccucaguaauuacuagauaagacuuuagaaaugaaagcuggaaaauuuacucuaaauaugaaacuuguuuauuuaaaauuaaucuguugugguuuuuaaaaacuuuuuuauuuugaaauauuucaaauauacaagaaaguauaauauaauaaauacccaugaacccaucacauagaucuuucacucauacuuugcuauguuugcuucauguuuuagcuagacauccugacauuccaacccuaaauauaucaggaugcauuucaacaaaugacauuuugugcauuguccuguguaaccacagugcucguaucuugccuaacaaauuuagcaauaauuuucuaaugucaacugcuacccaaucucauauucacauuucccuugcuuuucucaaaaugucuuuuacaagcugguucauuuaaacuggaaaucaaucaagguccaugcccugcauuuguuuguuagucuuuuaagucucuuucaaucuaaaagagcucuucccauauuuuuuucauggcauugacauuuuacaaacagggacaguugucuuguaaaauguaaucaugcauuuaaaagcaagugucuagguuucuaguaauucccaguaagugacucagaccauccuaccacugggaacagauagaaaauuuggacuaaaguauauauauuaaaacaaauuugaaaguaucugaaugcuaucaggacaguaaagaauuaugagguucagaucaccugaggucaggaguucgagaccagucuggccaacauggugaaaccccgucucuauuaaaaauacaaaaaaauuagccaagugugguggcaugcgccugcaaucccagcuaauugggaagcugaggcaagagaaucgccugaaccugagaggcggagguugcagugaaccgagaucgagccacugcacuccaaccugagcaacagagcgagacucugucuaaaaaaauaaauaaaauaagaauuaugaggucaaaauuugggagagaaaugaagcccaaauagaugugcuuggcacauggggcuguuuuucaccaagagguauugguuguuucugaaguuuaauauuuucaaggaauuaauacaaaagagugaggauuuuaguagaaaauggaagcugugaaaaaaauaaugaauuuuaaauucuagaacuaaauacaaacaguaaaauuaagacaucaguguguggauuuacugauacauugauggaaagaaaguaaacugaaagaguccagaagaaaauaugaugugagagacaaaaugaugcaaaauacaaaagauaguuguugagauauuuguaguaguaugacaaggucaaauauauguguaauuagaaucccaaaaagagaagagagaauagaacaaaagcaauaguugaagaaaaauuucugagaacuuuucagaaugaaaggccacagcccaaagacucaagaggcacuaaaaaccccaagcaagaaaaauauaaaacaacacuaauucauaauaaaauuacuuaacaccuguacuagagugugacuccauuggugauguucguugacaacuuuuaagcccacuccuccguuucccucugcccuacaucugggcaagcuaacaagaaagcucaggugcucccuccuuugguaguagcuggaaguucaaaacacucaagccucagccugcaugugggaaccuuuaucccagccccaccccucaacuaccauaaaaaucccaagccagucuucucuauuuucucaagacauuuuucgaccagcuuaggaugcgugcaugccugcuuuccccaguaagacucauuauguauguaauaaacauuuucauaccuucuggaugcguaugugacaucaucauaaguaaaucuuguguuggggggaaaauccauuucaccucugugaggugaccacagcaccaccaaacauaaaaauauugaaagcugucaggaagaauggcauauuuaaaggaacacuaugaagacauaacugacuucucaacagaaacugugaaagccaaaagguaauguaauuauuuuuuaauguaaugaaagaaaacaggccaugugugguggcucaugccuguaauccuaacacuuugggaggccaaagcaggaggaucacuugagcccaggaguucgagaccagccugggcaacauggcaaaaacccaucucuacaaaaaaaauacaaaaacuagccaggugugguggugugcuuuuguagucccagcuacuugggaggcugaagugagaggaucgcuugggccugggaggucaaggcugcagugagccaagaucaugccacuguacuccagccugggcaacagagugagacccugucaaaaaaaaaaaacugccaaauuagaauuucggauccagagaaaauuuauuucagaaauguagguagcagagacauuuuaaaacaaaaggugauauuucaaagggauaccugcacccccauguuuauugcagcacuauuuacaauagcaaagauaugaaaucaaccuaaauguuuauuaacagaugaauagauaaaaugugguguauauauacacaauguaauauuauuuauccaccaaaaaggaugagauccuguuauuugcagcaacauggauagaacuggaggucauuauguuaagugaaauaagcuaggcacagaaagacaaauuucacauauucucacucgugugggaacuaaaaguguugauuucauagagauagaaagucgagugauuguuaccagaagcugggacaggugcauggaacgaggaugaagagagguugguuaauggguacaaacauauagacauaagauguacaaacauauagauagaaggaacaaguucuaauauucaauaguagaguagggugacuauauaauuaacaacaauguauuguauauuucaguaucguuagaagggaggacuugaaauguuuccaacacauagaaaugauaaauacuuaaggugauagauccccuaaaucugacuugaucauuacacguucuaggcauguaauaaaauaccacacguaucucauaaauauguacaaauauguaucauaaaaauuuuaaagacaaaaggugauauuugucacuagcagucucacacuaaaguaauauuagauguuucaauuccuuuaaggcaguauuccucaaccagggagauuuucccucuccccaccccagcggacguuugacaaugucuggagacauauuugguugucacaacuuggaguggggagguggcgaggagaaugcuacuggcauguagugaguagaggccagcgauacuauauccuacaaugcacaggauaacccugaaaacgaauuuuccauuccaaaguguuaauaaugcugaaguuaaaaagcccugcccucaagaaaggaaaacuuagguucacacaaaaacuuguauucaaauguuuuauagaagcucuauucacaaucuccaacaccuggaaacaacacaaauaucuuucaauaguaauuggaaagcaaacuguauuaggucuguauaauggaaugcuacuuagccuuaaaagaaauaaauuguugauaucugcagcaacuugaauaaaucucaaaagcacuaugcugagugaaagaaaccagucucaacaguuuaccuacuguaugauuucauuucuaugagagucucgaaaacacaaaacuguuaaugauggauaacagaucagugguuucaagggguuaagggugugaauucaaauggguauuaugagguaguguuuugaaaugauggaaugguuuguguccuaauuuuugugauaaagcaugaaacuuuaaauguguaaaauuuauaaaacuguagaacuguuuacacaaaaagaucaguguuauuacauguuaauuuuuuaaguacaaucaaacuauacuuuaaaacaacccaauccaggaaaauaaauuauauggccccaaaacaaugaggucagauaaucuggcuucaucuaaagauaaaauuuggguuaucuuagaguagugguuccuagccaaggguauauguaaaacacaaggaaguuuuucaaauauaacugccuaugucuuaucuacuucugauucgcuaggucaaggcuagucuuuugggauauguaucuuuuaaaauagcuuccuagguaauucugacacaacacuaagaauugagaauaacugaucugaacuuacaaauuacuauacaccuucagaauguuauuugucacaaauaagcuucuaguaauaauuagcagaaauuuccagguuauauucucugaaagucacuggcuguauuagccugggaguuuaacugcuauaacaaagacacuccaauuaugaguuauuaaacaugauaaauguuuauuucuuguucacaugauaguacacuaagggugaguaguuggcuuugcuccacacauucagggaccuuagcaucuaucaucugauggcuuuagcauuuuccuugagccuuggcauuuuccaggccugaaaguggcauguaucacucugcucacauuccacuggcguucgaugacaugugcccaacuuacuacaagggaaacuggaaaguguaggcuaguugugaucccagaaaaacaaggaaacuaccacaauggaauauaccuacuauaugugccagugaagagucaauccaugugcuuucacaauuaacugagugaaggaauaugacauauuuauuuuaauacuuuuuauaauuuaaaacucauuuuuagaagacaauucaaacagcauaaaacagucaaguuuucuccaaagcauaaauguguuuugauuuuccucuaauucagucuucaggaaucucucuggggaguggcuauaaauuuuagcccugcccugacagaacucccggggaagcuuacaaacugcuuuucaugggacaccacuuuuuauuuuauuuuauuuuuuauuuuauuuuauuuuauuuuuuuacaugagagcauuuuacugggucaagaaagacacaaaaaggaucgugggucaggggugguguucacaggguuugaaaaucugauuccuuccagcccagaggauuuagagaccaggcucuucagggaaaaagccaggagacuacauguggucacagcguugccaggccaggcguguguggagcgggagaggugcugaucuaggaugacaagaugucagggagguagguaccgagauggugggacugaucagaaagcagguguacaugugcugggggcuagggggcaggccuagauagagucacauuggccucagauguccccaggucaggugggugugaagggaaggggagacaucacuugagcacaggugacaaagucgccgggcugacugggggucgaugugcauuucuggagaggucagacacacacucaccaagaugguggcagugaaacuggucacagggguuugagggggccuggugcauguggaaggcgggucugcugagcccaaugccaaggucauugccagguuggggaaaagggacaaccccccuaccccucgccagacacugucacagggagagcgagcgggagaauccucgggucagaagagauggggagggguucuauguggucaggugaccucagguguccccaggccagacgugcguguguacauggauugucugcugcacuggcaugacaagcucccaagccgggggaggggggcgcuggacagucucugagaugaugggaguggaaucaucaggucagaagggacguguguguguuuuugggggaccuggauguggucacggucgcguggagucggggguccccggccccgaggaucacggcgaugggggcgggucauaagcugggggccucgccuggguccgauaacugggcucccaguccccgaggaugcgaaccucccggagcucgccggccccaugccccccaggucaccaugacccucacugcgcgagcccacagcgagggggcggagaggaggagcgcgagcgccccggaagcggggacggggccucgggacacuucuuuauccuggcagacagccucauuccuaagugcucaacccaugaccaggugucccucucacaggaaaguuguuuauagucgcaggcgcccuuguggcucuugucugaccugugucgagucuauuccugccaagagggccacucucuaggagaacgccaaccgggaaagaaguuagguccggguguguggguggggugagacacagagaggcagcuccacagaacgugugaaauaccagaggcagcaucuucuuuacagauuccucucagggccagcaagaaggaaggaacccucugggccauccaugcuuagccagcagguggggagcaagauagagagugagggaccugugggccuaggccuuuaucgggguccaggcauucccaggccgcuuucccguggggaguucucaucgguggguugaaagccagcaggcaggaguuccauggaggcacgcugugacugagaaggggucgcuguggcagauccgugcggcccauguagaguguggggggucaguggggccagucaaguagguuguaucuagcugucccauagggagguggucaccagcaggugacuguauaagguagauaucuggaucgaccacauuaaggaacagggaggagauggagaacaggaaacugugucaagggugacuaagcccugcuucugguaugagaaaguccaauauauucaaaaugaugcugagacaacauauuauaaaaauucacuacauguguaguccuaagaauacuagaaaaauauguaaaagagcuuaacugagucccaaauucccuuucgcuaauauaaguacacucuagcuucauaugaugacacaacuuggcaagacucuuugacccuuucccuucucauucccaguaaguuuccuccauuugaccucuaauagcccaggauuuggucuuccuguauauucaaagacuggugccauagcuauaacucucuuuuuaaaaucuuuugggcuuuagaagccucccucuccauucuugcuucugaucacaaggacuugcuaacaucaccccgauuguuucucuuguacccgagugaaugauuuuguucuccauacuuuguucaucagcucuuccccuucuccagaguauacagugaagauccaaacacauguguuuucucuccaccucccacacugauaauaguguggacuccaaaaaaauccacgcagugcacauucauuauuacaguauguacaaauauuaucccuaaccguaacauguguacuccaagucuuaucacauacaguaaauuggaugugggcagugggauggguaucacagagcuacuccaagaaaacggcacacacauggaauacccuuuaucccauucuucaugcuccacuuuagugcuacaaaaaaugauucuuuggcuguuaggauagugguggcagcaacauuugcaguggguaugugugggaaggcauagguagaggaggaaacagaauaauggaaauugucuacgauuuacuaaggcaugaauuuaucaccauuuucuuagaugggccuaaacaucaaauaaauggaauaaucaaugcauucuguuuguucccuaaggcuguaacagacuauguuugaauuuauuugaaagcaaguuuuguuuccaagauuagaugacuugcaaaagauuuuaugccuccuuccugagaaccugaauagagcauuauauuugggugauauuuuagucauuuuucacaaucauuagcaaagggauuacucuggccacgaauauauccaagucagugauuucaggagucagaagagaaaugcuccaaaagacuacaccccagucuucagcauggggucagugucaggacuauaagauuaugacuucuuagugacaggauuucauauuuauaaaaccagcaaaguuuacuuucaucaaggauugaaauauaagacacagggcucagacagugugugggugaagcaaugcggaaaggaguaagaagguacauguguaaacugauaaaauugauaucaacuagacaguggguguauaauuuacaugccuauauguuacuuauucucuaaaauucccccaugauguaaauuuugcauucuugagaccuagcagagcacuuuccucaggguugguauccgauaccaagggaaauaaccauaaaagagaaaugugagggguugggagaaauuagacaucaaguaaaccauaggacacauuaaaaagagaccuugaagggauugaaauggccaagguugaaagaaauggaaauccaaacaacacagagaaacauggaccucccucugaacuauuugcauuugagcacagcugaaaaagcugaagaaacuugguuuuuuaaagcaagcauaguacacuuugcuuaaagcaacugccugccaugaccaaguagcugaaaauaauaugaauuauguuaucaauaauaauuccagaguaaaaauaugaccuuccaaaaacaacugaaggaaacauuguucuuguauuuguguaaggcucaauggaguuggcaaauaguuuuuauguuucuuuuucuuuuuuuugagacagaguuucacucuuuuugcccagacuagagugcaauggcaccaucuugaucucggcucacugcaaccuccaccucccagguucaagugauucuucugccucagccuccugaguagcugggauuacaggcaacugccaccacacccagcaauuuuuuuuguauuuuuaguagagaugggguuucaccauguuggccaagcuggucucaaacuccugaccucaggugauccacuggccucggccucccaaagugcugggauuacaggggugagccaccgcaccuggcucauguuucaacacuuaguuguuaaccacaaaaaacuuuuuagaaaggaagcagaaacauaauaacauuugaaaauaauuauuuucucugccuuuuaugaauagucucuguuucagagaucaacagugugucauugauuaaguaauuuacucuuuacagcugccaaaaaaauaaaauggggcucaaauaaauugaccaaacugacauguuaaacagcuuuguuaaaauuuucauuacaagaaugcccucucucaccacucguauucaacauaguauuggaaguucuggccaggacaaugaggcagggaaagaaauaaaagauauucaaauaggaauagaggaagucaaauugucucuguuugcagacaacaugauucuauauuuagaaaaucccaucgucucagcccaaaaaauccuuaagcugauaagcaacuucagccaagucucaggauacaaaaucaaugugcaaaaaucacaagcauuccuauacaccaacagcagacaagcagagagccaaaucacgaaugaaugaacuauucacaacugcuacaaagauaauaaaauaccuaguauuacagcuaacaagugacgugaaggaccucuucaaggagaacuacaaaccacugcucaaggaaauaagagacgacacaaacaaauggaaaaacuuuccauccucguagauaggaagaaucaauauuguguaaauggccauacugcccaaagcaauuuauagauucaaugcuauucccaucaaacuaccauugacauucuucacagaauuagaaaaaaaccacuuuaaauuucauauggaaccaaaaaagagcccacauagccaagacaauccuaaguaaaaauaacaaaacuggaggcaucauacuaccugacuucaaacuauacuacaaggcugcaguaaccaaaacagacauauaggccaauggaacagaacagagaccucagaaauaacaccacacaucuacaaucaucugaucuucaacaaacccaacaaaaaagaugcaauggggaaaggauucccuauuuaauaaaugguacugggaaaauuggcuagccauaugcagaaaacugaaacuggaccccuuccuuaugucuuauacaaaaauuaacucaagauggauuaaggacuuaaauguaaaaccccaaaccauaaaaacccuagaagaaagccuaggcaauaucauucaggacauaggugugggcagagauuucaugaugaaaaugccaaaagcaauugcaacaaaagcuaaaauugacaaaugggaucuaauuaagcuaaagagcuucuacacagcaaagaaacuaucaucagaaugaacaggcaaccuacagaaugggagaaaauuuuugcaaucuacccauuugauaaaggucuaauauccagaaucuaugaggaacuuaaacaaauuuacaagaaaaacaaacccaucaaaaagugggcaaaggauaugaacagacauuucucaaaagaagacauuuauucagccaacaaacaugugaaaaaaagcucaacaucacugaucauuagagaaaugcaaaucaaaaccacaaugagacacgaucucaugccagucagaauggugauuacuaaaaagucaagaaacaauagaugcuggcgaggcuguggagaaauaggaaugcuuuuacacuguuggugggaauguaaacuagcuuaauuuacauuguggaagacagaguggugauuccucaaggaucuagaaccagaaauaccagcaaucccauuacuggguauauacccaaaggaauauaaaucauucuacuauaaagacacaugcacauguauguuuauuacagcacuauuuacaagagcaaagacauggaaccaacccaaaugcccaucaaugauagacuggauaaagaaaaugugguacauauacaccauggaauacuauucagccauaaaaaggaaugagauccuguccuuugcggggacauggaugaagccagaagccaucauccucagcagacuaacacaggaacagaaaaccaaaugccgcauguucucacucauaagugggaguugaacaaugagaacacauggacacagggaggggaacaaaacgcacaggggccugucggggggugggggaaggagagcauuaagacaaauaccuaauucaugcagggcuuaaaaccuagauaauggguugauagaugcagcaaaccaccauggcacacguauaccuguguaacaaaucugcacauucugcacauguaucccagaaauuaaaguaaaauaaaaaauaaaaaauuucauuucaguuauugugcuuuuuuaacucuagaauuaguuuuuuuauuucacuauuaagauucucuauuuguuaacucacuauuaacauauuuccuuuuaauuuaucaaacauaguuuucuuuaauuucuuugacaaauuuauaauaccugcuuugaaggcagucucugcuaaauccaacauuugaguucaaucagagucagugucuauugacuacuuuucccucugaguuuagguuacacuuuccaguuucuuuauaugucuaucaauuuuuaguugagaauugaacacuucaggcuacucucggcacacugccuauaggguaacccugcucugcaaggagcaguauuuaaaaaaaagagagaaaaaaagaaaauugaacacuucagauaacauuuuauagaauauauuguaauaauucucgauuguuuuauuuuucugaagccuuuuuguuuauuuugcuuguuugguguuuaauaccuuuucugaacuuaaacugcagaaucugcuucacucaccucacuccuaguaugcagccacugaugucucugcucacauuuuuaauucuuauuuuaacauuucagcccaacuuucuaaagauugcccccaucucugaauagcuuaguuauugccaaucaauuuggcugagguuguguugaaacaguuugagcuuauaaggcuucuacccucugcugauugaacugugugugguuaaaaaauguauucaaaguugcagccaguuuucauguuucccuuggcuuucacuuuuccccaggaucuuuugggucucucccauguguuuaguuuggccauccaccagggaaguauagagagcuuaucucagcacuucuaugguucucugacuuccagacucuucccguuaaauaucuggcuguaaucaccauucaccucgaaccaggaccucagccuuggggaacaagcaaagcugggguuuuccccaucuauaacaaacuaaguccaccacuuauaucuggaaaaucuaugggauuucaccuuccucuuuaucauuuacauguguuacucuuaauguaucuccuguacaucuaacuccauauuggcaucugcuuuccagaggaccuaaacugacaugacacaguuggugucauaguuaaaugggccaucaacucugcaguugucacugauaggauguguaaacuagaauggaugaugcacauuaucaucauuuauaaaaccaggauugugcuggagccaccagcuagucucuguccaggccuauuggcugaaaucaaagacacugcuuaaugcuuuaaggaaccccagggugaaguuccuccuguagaaaggaaugaggcaaucauaugggggagaauucaauggucauuugaauuugggcaguugucaccaaccugaggugggaaacuagauuuggaacugaaggaggauccacaggagauaccauucuggcaaagaaaaauguuucuaaaaaccuuccaggacuuccugauuguauuaauaauuguauucagcuaguuguaacagagacuugaauacaguggcuaaaaacacaauaguuuauucucuugcauaaaacaagcucauagguauacagacgacaauugguaugacaacuucacaaagucaucaggaaucuaugaucaucccaacuuuuugcccagccauucuuaccauguaacuucuguccuuuaggucaucccacaucccagggugaaugcuggagcucagccauuauaucuguauuccaccuaggaaagaacagggaagaaaagcaaaaagcccuccacugaguuagcuccuuuaaacagccuucccaaagguugcauacaccaccuccacuuaaucccauuggccagaacuugaucacauuucuacaacaagguaagccagaaaauguaguccuuuauucuuagaagcaauaugccuagcuaaaaaucaggauucucuuauuaaacagaauuauuugccacacauccuucaguuuaaaaaaaucuacauugaucugguuuaaguugaacagcauggucagagagagaggaauguggguaacuuuuuuccauauggguccccuagacacaagaaggcugauggcacggaaucaaccaugaccaucagggagagcccacucacuacccuagagaccuugaaaagaacgcagacauaagucucaaugaaugcaacucuaugauuuuuuaaagagacggguuuugcuguguugcccaggcuagagugcaaagaagcagucguagaucacugcagcuucaaauucccgggcucaggcaauccuccugcugaguaaacugagcaugguggcacauucccauagucacagcuacugcuaauuuuuuuuuuuuuuuuuuguagagucggcagucuugccauguugcccaggcugaucuugaacuccuagccucaagugauccuccugccucugccucccaaaguucugggauuacaggugugagccacuacaccuaaccaucucuaugauuuuuuuuacuugucacugaauaccuuuucucuuuuugauaagagaaauuggaaaagcccagucauaccuguuaacaaaauacaaucaaccaaauuggcugugaacaucuacuaauacaaacucugauuugauaauagccucucaugcacagacacauacacacaaauacauacagauguucuagugagaauuaucaccagaucuagaauugagucugauaaaccacaauuguacuugcuugaauaccuuggcuuuauuuaccuaagaggaugccuuaacagaagacacaggaaaaauuuuagaagucuauuuuuuuaaguagauggucucugcuuucucucuaauuauucacagaaugugaauauaucauugaucuaggucagaagucccaugucaaugacacacguaaacauauaugcacauaaggucagugcaaaaguaauugcggcuuugcaauuacuuuuaacggcaaaaccgcaguuacuuuugcaccaacuuaauauauaagugauaauaauucauguuacugagcuauagauuauaucagacaucuuuuugcaagggaaguauucugcaagagagacuacagacuugguuuuccccauucuggacaacagcaucuugccuacaacucucagguagggguccccauuccaaguagcuaucugccauaacacauggaggaaacuuuucaccuggaacuucauaaagacaaccuagaaauuuaccgagcauuauaaguguguaucuuauauaaaguuaaagcaugguuauacauaauagugaaaauauuaacauuuaauaaacacuuaugcaccaaacacaguuacaugggcuuuauuuuuauuaacucuuuuaaucuucacaacaacccuaugagaaaaguuuuacuauccccauuuuauagauuuagaaaugagucacagagaaaaaaaaguaacuguguaagaucauacagcuuguaaguggauuuuugacuuuacaaaaucugugcucuuaaucacuauacuuuaaauugugugcagcauuaacuauaauuauuugauuuccuacauuuauuuuuuaauuuuuucucuaugaauugaugaauaucuuuagccaaguguggcugagagaauugucuucacuuugauuuuuucuuacuuuguuguguuacucaaguucuggguauaacccugccaucacuuuucugagucuguauuacguuaggcuacguguaguggcuuuguaggucaacuuagcuaacuuggaacuguguuucucagaauuucuuucccugugugguucucuuuuguggugggccacaagagaauuuagaagguaaaggugaaguaguacccauuauucucugcagcucaguguaaggagccaggcaauccugcaggcuguacauauugcugcagauaugcugggucacuuuguugauaugggacaagagcugggcccacagauucuuugccuccuuccugaccuccuucaguuucuuuaaguucugagccagaugcauaugcagcuccguggcaaaagaugucaacuucugcaggucacgcacaucauugaaacuggagacagucaguaauggaugguuuccaguuuguccuuaugggcuccaguuuggccuugcuuucucccacuuuauauucaacuuuucuuucugauuucuggcccugcuaccuacagugacuucacacucaucauuguaugcagaggccacaacucuuuuuuuuuggcuaugauuuuauuuauuaguuauuaauguauuuauuuucaauuucuauuuuagguucaggggguacacugcagguuuuuuacguggguaaauugcauguuggggguuugguguacagauaauuuuguuacccagguagugagaauaguaccugauacguaguuuuucaacccucacucuccucccacccuucacccucaaggaggucccuguaucuauuguuuccuucuuuguguacucaauggacaacagcuuucuauaugguuccucaccagcuuccacaacuccuuugucagaaauuaauugaucuuauaugcgugggucuauuucuggacuuucucuucuguuucauugaucuguuugucuaccuuuaugccaacaccacauuaucuucauuaacauagcuuuuuaauaaaucuugaagucagggagcguuauuucuccacauuuauuuucuuuuucaaagugguuuuugcugcucuaguucuuugcauuucaauauucauuuuagaauuugucuguuaauuuccaugacaaaagccuacugagauuuugauuuggacugaguugaauguaaagaucaguucagggagacuugacaucuuaaaguaauccuuaucauaaauucaaaauuccauaucacuuacaguaucucugcuuuccuaaucaaacuugaauggauaaaccaauucauaauauaacaaauaaacaugcaaacaagcggcuuaacacaacaaagguuuauucugagcucaggauauaaguucaaugugagccaacaaggugagcuuuggggguagcucuguuccacauagcgacacaggcugauggagacgcugauaucuuuguuuuuguuuguuuguuuguuuuuugagauggagucuugcuuugucgcccaggcgacacugcaaccucuacuccccagguucaagcgauucuccugccucagccuccugaguagcugggauuacaggcaugcuccacuguaccuugcuaauuuuuauauuuuuaguagagaccaggguuggccauauuagccaagcuggucuugaacuccugaccucaggugauccacgcgcuucggucucccaaagugcugggauuacaggcgugagccaccacgccgacacugauaucuuaacauuugagcuucaugauugcugaggcaggaaaagagaagaacuaggagacucuuaaaugcuuugccucaaaagugacaaauuuuacuucuucaagcacuuuggccacaugaccccauuuauuuguaaagagggcuuggaaauguggagaaacacauggauauucaaugugcacuagaugccucugccacgguccacacuucuguuuaccaaauauccccuugcuuccauucacccuguaguagaugcuauuggugcccccaccuugaugacuuucaccaggcaggugcacacaucucccagcugcuguuaauguuggccaguggcucacagcugcuuccucuucuggaaaguugccuuuagccaaaaggaaauuuccuccugaucuaaauacauucccauguauagaauacccuccaccauuccccaagggaggccacccaaagucccauguaaucuauuaauauagcuuauaauucugcaucucugggcaaugcacgauagccuucaccucuggaccaguccugguucuucuugguccaaaagccuaaugaaaacaacgaauugucuggccuccccuuccaacacacaccuaacauauaaugguggaaauaaacauucucauuuggaaagggaaagaaagagacacacagcaguuacuggauguagcaguuccaaaacugcucugugugaguggaggccccuauccugagagugaagaacauucugaaucaggcccugauuuucucucuggaagaaacucucuuguccauuguucuugguggucccuggccugcccucuagcagcucuccuuuuucuauuccgcuucuugccauaacuaaaguaguuauugaagaacauauaugcccuccuugagucuaucuaguguugucugcugcccuuagaagacuggggacccaaagaugguuuauuucauuaaaaaaaaauuugauugauuaaauaaagguuguauauacucaagguccuuggaggauuuuaaggcuugaauagucgucuuauuuuauuccauuuguuauugcccagacuuguggcuucucuagcaguacgagacuuuuuuuuuuuuuuuuuugagacagggucucacucucuugcccagacuggagugcaguggccugaucugggcucaccgcaaccuccaccucccaggcucaagcgauucuccugucucagccucccgaguagguaggauuacaggcucgugccacuacuucuaggcuaauuuuuguauuuuuaguagagacaggguuucaccauguuagcuaggcugggcucgaacuccugaccucaaaugauccacccuccucugucuuccaaaaugaugggauuacaggccugagccaccgcgcccagccacaagacucuuaaaaacuuguuagacugaacaauggguaaacugauuaauaaaaauggcacaccuauguaauggaauauuauuuauccauaaaaaggaaugaagcagugacacaugcuacaacacggaugacccuuaaaaacauuaugcuaaaugacagaagacaaaugcgaaagaccauguuuuauauaauacaauuuacaugaaauauccgaaauaggcaaauccauagagacagaaaguagacuaguuuccagggguuagcaggagggaggaaugaaaagugagugcuaauuagguaugaugugucuuuuggggcugaugaaacugcucuggaauuagcgauauugguuguacaacuuugugacuauacuaaaaccacugaauuugacacuuuaaaaauaaacuuaauaaagccuuauuagacuucuuaaaauaugauuguagucaaugccauguaacagccacacccauaguucuuuugaggacauaauuaacagaucuggcacacuuuuugcuguuuuguaaaucccacaucuuucucucucuauugauuuaauaaugaaagaaucuagaagagggcagagaaggccaucaucuuaauuacauuuuuuuuccugaguaauuuuguacaaguaagagauuuuauugagggcuacacccuuaaucugaucuucaccuuacagcacuuuugacaaaaugguuuuacugaaguauaauugaaauacaauaaccugcauauauuuaaaguguacaguuugacaaauuuuaacauguauauauaccauuaccacauucaauauaaugaacauauccaucacccccaaaguuuguuuauacccccuuguaacuucucuuuccgcccuucuccauccccucccccaggcuaucacuaauguuuucucacuauacauuaauuugucuacaauuuauagaauucgaauaauaacaguagguacccuuuguuuugccuucauucauucagcauaauucugauuuggcucauaugauagguguaugguuaacuuuuaaauaaacugccuaacuauuuuccaagucuuuguaccauuugauauuccuaccagcagggaaugagaauuuaauuucuucauauuuuccccaacauuugguauauauaaccagccuuuuaaauuucaaccauucucauagguauguaguaauaucacauuaugguuuuaacuggaauuucccuaaugauguugagcaucuuuuugugcuuauuugucauccguauaucuacuuuugugaagugucuauuccaaauuuugggugcuuauuuauuuucuuaugauugauuuuggaguucuucauauauucugaacauauaauuuacaaauauuuucucuucaccuguggcucgucuuuuaguuuguuaacaucaucauuugagaagcauaccuuuuucauuuugaugaaguucauuucacauuauuuuccucuuuuauagauugugcuuuuggugucauaucuaggaaagcuuugccuaguccaagaucacaaagauuucuuguguuuucuucuagacguggaucaaagugcucuuuuuauuggcauauagaugugugaugguuacauuaucauuuguugauaauacuaucuuuuugccacuguauugccuuggcaccuuugucagaauuuaauugaucuuauaugcaugggucuauuucuggacuuucucuucuguuucauugaucuguuugucuaccuuuaugccaacaccacauuaucuucauuaacauagcuuuuuaauaaaucuugaagucagggaguguuauuucuccaaauuuauuuuucuuuuucaaagugguuuuugcugcucuaguucuuugcauuucaauauucauuuuagaauuugucugucaauuuccaugacaaaagucuacugagauuuugauuuggacugaguugaauguaaagaucaguucagggagacuugacaucuuaaaaauauugagucuucagauccaugaaauuuaauuuuucucaauauuuuaauguuuguaguauacaggucaugcacagcuuuugccagauuuaucuacagaucucucauauuuuuaaugcuauugcaaauagcauuacuuuaaaaauuucaauucugauugcuuguauaguaaaugguauauauaacuuacuuauuaguucuaacaacuuuuuguaaauucuauuggauuuggauuuuuuuaauagacagggucucgccauguugcccaggcuggucucagacuccuggccucaagugauccuccugccuuggccuccaaaacugcugggauuauaggcaugagccacugcacccaaccuggauuuccuauauagacaaucaugccaucuuugaauagacaguuucauuuuuuucuuccuaaucugaauauauuuuauuuucucuucuggccugauuucauugacuagaacuuccaguaaaauauugaauagaaguggcaagagcacacauccuuaggggaaaaguauucuaccuucaccauuaaguaugauauuaacugcgguuauuuugaaacguucuuuaaugguuugaggaaguuuccuuccagucuuaguuuguggaaagcuuuuaccacgaauagauguugaauuuuugucaaaugcuuucucugcaucuaucaagaugauaauauuauuuuucuuuuuugaucuguuaaugugauaaauuacauugauugaauuuugaauguuaaaacuacuuuguauuccuaggauaaacucuacuugguugugauauauuauacuuuuuguguuauauauugcuugauucaauuuacuaaaauuuaaagaauuuuuacaucuauguucaagaggaaaauugggcuguaguuuucuuuuuuuguagucuuugucugguuuugcuaucagaguaauucuggccucauagacuacauaggaacauauucccuccucuucaauuuucucuaagguuuuaugagaauugguaugauuucucccuuaaauguuagguagaauucacuagugaagucaacugggccugggguuuucuuugugggagguuuuaacuacauauguuggcucuuaaaugcuuaagcuuaggaacaauauaucacacuuuucacagccauaaccagccauaugguucuaccuaauugcaagaaggcuagaaaacguagagaagcacauagguauuugguggucaguaaaugucuacgcuguagggucuuucugaaaauguauagaaaacugucuacaugaguaacugcucaaaaauuacuuuaaaguuuugagauguagcaacuauauuacuaggcuaguucaucuccuccaacauucuacaaaaaucccauugcuuuuauuguacaacucuggaaauaaaaucuuauucucugugcugugucucuguccucuguucuauggaaacucaguuuucuccuccuauggcuucugcuucacauuugugaaggagaggauuuuauccaaguuaggcuuuggcaggaaaaaaauaauuucuagauuggauccaagguggaaaugguuccucaguguuauggaaacacaaauaccacgauucuuacugucuuacacuauaaauauuccagugucugcacagcuucucuuggcuacggaaucauuuaaauauuucaugucugccaauauuugaacuacaaaacccccuaaaguuuuaauuuuguuaauauuuucauauuauuaacacuaauugauuaggcaugucagauaaguuuguucaaaaauuaagaacuuauuagaaguuauauuauucaggguagaugccaagaugcugugacagagacccacuguagauuggcugauucaggguacauguuucuuucucagaucacaguccagaaaugugcaauccaagacuagugaagccacucugcaauccucaacaugcuuccauuucaugguucaagauggcugcccaguuuucaucuccuagccaagauuaaagggagaggcucaggauagcaugugaaccuuccauuaucaaggaacaacuuggaaguuagcauacauuacuuccacuuacauuccgugacagaacuuagucuuaggacuauaucaaauugcaagggagggugaaauacccugagcugggaauucaugugccuagcuaaagcucagggguuguauuauuaaagagagacuggauauuggugaaacgugagcaggauuucaggaguaugcaauguugacaggaaggcagaagaaaagguuuggaagcaggcaaaagaggggcagcuuugagugggcagggguggagcacugggaaauaggcauuguaggaacagucagggugcugcuauugaaauuuuuaaaaauacaaccauuuugucacuuauucugucucuucuucuaauucaaggucaagauggccaagaaaaggugccugccuuacacuauaucagggaaauaaagaagaaucagguggaugcuacuuccugaaacucuugggcuuucauaguuggacggggagacaucuggauuucccauuccacuagauuuuucacaauagggaaagguaguuccccagaaagaaauugagguacgauuuguucugggcuaucacaaaacacaaacagaccacaucaaccacuuaaaauauuugccagaauauugauuccaucauuuaauucauuuggccauuccaaaaacaaggaaguuugugacuauuauaaaaaugaagucaccauuguaccucauagugccaggccuuagguuuuacugaugcuuucuuugcaauauuucuuguaccugugccuucuuucccauucuuuguauguuuuucaagccuuaucgucuguugccugaaguauccauccuuggcuaggaugcuugggguucaaguaagagaaaagccuaacucaacugaugcaaacaguaacaacauuuuuaccaccuauaugaaggaguccagaaccccagguaggcuccaggcaacauggauacaggcucugguucuauuucucuugucguucucuucauucuccucaucuuccuguguugacuccagucucagucugguugugaaauggcuauuguauuccaggcauacauucaugcauaaugucaguggaacaagagggacuuucucuugucuguaugauuauuuuaggaguauaguggaugcugaaaugugcuaccuauauuccucuuuaggauugaaggaccuauucucucagcugcuggagguguuuuuagcagagagccugcagcugucaguccuuuuuggaaaugcccuuuacugaagauacuugccuugcugaaauucacuuucccuuccugggagcagccaauauccaauaacuguuugucaccaguacauaaagguccagcuuccucaccucagcucagaacgacuccgcaggaccauccuuagaguucuuuguugggcuggcugaggcauucacugaaacuacaucacagcugaaagucucucucacccacuccugcugucuucucuuuccucccacaggcaucaaucucaaaugcacucccucaugaaauucccgcaugcucauugccuucucagagucuguuuuuucagagaacccgauaugcaacaagaagugaagauaccuuucacaggccccccuuacaucucaguguccuacugugccacaugcacacuccuaauuugauucuugguaggaggaacaggacugucaugauuggcuuacaccaaguaccgcuuuuccccuagagcugggaauggagucaagcuccccuaauucuuguagagcaaggaggggaacugaucaaaacugggucucugcuagcagugaaaaagcaggcaaugaauguuggguugacaaccaacauugucugaggcaucaacuuccugccucaagauuuuccuucuugcucauugcaaccacugcgauggucaucuucuccagagacuguuuuacucauaucgcuuuuauguuuuaaaaaaaucuccguggauacccacagaucauauuauacauaauuucaaucuuuuuguuuuauuuucuuuuugauauaacccacccagagaaacaacauaugcucaucagucacaagggcguguugcuuacuauuucaauacagaagggaucuuagaaaagcaggaaagaaggagaagggcaccccagguaggacagugcaaauuaggcucuccagaagcauguguuuuugacaacccaggaagccauauugcauucuccuggagaaucacucaccuauagguucuaggcuucagaaucaaguagauuuuagccugaucaucaaagauccagguaacuuagcuccaauuuuucuuuccagcugccucucucacuauucuccuacaugaccauucugcucuaucuuacauugcugucucugcuuucauucuucaaacccugccuuaagccucaccaccuccauaauagcuuuucugagcccugcaguccacuuuaacuucucauuuaccauaccacccauagugucagccaacagaugauguccggcauucacaaaguccuucaaaacuacuaagacaucauagguagauauuucuguauguauucccagccuuuucucuaaucacauuucaguacagucaagugauuccuggaugugaccacacuacaacugccacgaagacacagaggcucaaucauuuuaagaacgcugaacagacagaaaauuacucagucauuucucauacacacaaaaauaaacacacgucuuaguccauuagggcugcuauaacaaaauaccauaaacuggauauuuuauaaacaacagaaauuuauuuuucacagcucuggaggcggggaaguccaggaucaaggcaccagcagauucugugucuggugagggcuugguuucugauucauagauggcaacuucucgcuacauucucagauggugagagaagaaaggguucucuuucagggccucuuuuauaaggccacuaauuucauucaugagggcuccacucucaugaucuaaauuaccuacaaaaggcuucaucccuuaauaccaucgccuuaaagguuaggauuucaacauaugaauuuugggggaacacaaacauucagaucauagcaacagaaaauguggaauucuuaaaugccaauggucucugguaaauucuugaagcauuccaugugugagcaacuggagugaagaaacccugugauaacucuugguauucccaaagugacuuugcacauggucaacaaauguuugaugaauuaaugagaaucaucauucacugugcuuugagucauuaauuuuuuagugagaaaugucacaucaaauaagccuuaagagguuacacaauuagauaaauugaaguguuaauucaagcuuucauaugggaaaauucaaacuuucauaugggaaaguuuuacaaacuugucccaacaauaggaauucauucauuuauuaauuuacucaaaaaguguuuuuugaguacccaccaugugcucuuugcuagugcuauaaauacagugaugagcaaaucagacaccguuccugugucaaagagauuuaaagucuaucugggaauauauauauuauucaaauacuuuacauaaauagacaaauguuauaugguuucaaacaaguuguucaacuagauacaugcuauaaaguacauguuucaguuaucuauuguugcuucauaaugaaucaucucaaaauuuauuggcucaaaacaacaacuauuauuucuuauuauaucucauaggucuaagguuaacguggcucagcugggcauuucucacuuaggguguuucauguauuugcaguucaacagugacugggguugaaguaaccuugaaggcuuccuaacugucaugucagcaguugaugcuagcuguugacugagaucucaaugaccccuccauguggcuucaucccagugugguugcuggcuuccaauagucagcaucucaaagaaaagaccaggccaaagcuacauuaccuuuuaugaccuagcuuuagaagucacacagugucacuucugacagucacauagccaccuuaagaggaagaaauauggaguuuccuucauaggaggagugucaaugucacacuguuaagaagagcauaauggauggaagguauuguuacagccaucuuggaaaauaugcagcacauaagacaggcaggcaaacuuaucuacuagggagucagggagaacuucuccgaagaauagucacuuaagauaagaucugaaaauauggagcuguuaccuggaauaaggaguaggaaaugcaagcaaauggaauauuauguguaaaaacccugaggcagaaaggaacaguacacagacugaaagaaguguggccacaauauggaaugaggggaagcauggaggacagaguugaagcuagauagguagacaggauccagaucaaacagggccuuuuuggcuguagucagaaucuuguucuuuagucuguagcaccaguaauucaucaaagaguuuuaagcuggugagugacaguuuguuccuaguacagcaaguagagaauaaacugagguugcaggagggacaggaguggaugcaugggacuacuuacaaggcuguuguugggagcccaauugacaagugaugggaucuagcacuggcuaaguggguggcaauaaagauggagagacagggcuggauucaaccaccauaaacaggaaaaucaacagcacuuacggauggguugggugggguggggcaugguggaagaaaagugucaaggaugaacaguggugccaacuauagagacacauaagacaauuagguugcagaguagagguccugaauuuauucaguagaccuggaguuggggaugcauuugaacaaugaaaagaagauacauagaguuaagaacacagacaaggaccuaaaaauacagauuuacgggaucucaguguuuagcugacaauuaaagcuguuaaguauggauaagaucaucuugggagagaguauagagauucucauggaauccaauauucaaugguugcccagaagcagauggauagcuagaaacugagaagcauccagagauguuggaggcaggauaauauuauguccuggaaacuaaagguuguuagugcuacuagaagugauaagugguuauuaguguugaaugcuucugagaggugugcaaagaugaggacuaaaauauuucuguaggugacaauaacacgcaggucaugacagcaagaguuauuucagaggagucaugugggcagacaucagauuggacuaggauauuggagauagaagguuuaggcaacauuuuugaaaggaagaaaguuguaggaaacgauauaauaugaccgucaugcaauggcauccauuugagaauaagauauaccaaacauuggauuucauauaccagaucauauacucaagagacacaucacugcauguucuccuuuugagagaagggaacaugaggcaaaugggggaaaguguugauaacuuauguguuccagaugaccacaaauugaauccacuccagcagagagagaaaagaaccagagcaggaaagcaggaaaagcuucaaacagcugcaugaaaaauauuacuauagaaccccaaugcugauagcucagaaucugcauuuaguguggacguguucaacucucaugggucucugugcaagucuuguaaccuuuccaugcauugacuuuucuuuggcuauuuaccauggucagagaaaggccgauccuuggaaagcacuuggaacaaaaaguccaacaggauuugacuaaaugaagcauuugauuaguuaucacuaacagaaugaugcaacccaggaaggacuacuaauucauuguuucuaaacuuugccauuuuuuuuguacuuggcuccagccuuaagagcucuugccaaacagcaggguuucugcaugugcuuuggccucccugaggaccucauaaugagccagaaacucucaccauccaggagaggucuuuaggaaaagaaggggaaagggcaugggcacaaccacagggagaggcagcuuagagugagcacacacauagagagaguggggaggacagaggacagaguccaacaggggauguacauuagcuguucuugcagcuggaaacccuucucuagccuccaggacaaauuuuccagucuaaguccuggcagugaugcugaccuuuggguugcuuacaagagaguaaaugaaagcuuucccucuccuccaacacauccuucuuugacuugaaacaugugacaaggcuguuaccuccagcagaugcuugcuggaugaaucagcauucuaaaagaccaaggccccaggaugugccaaagcagcaacagaaucaguaaggauuaagaagcgaguagggagagacaguucaaugaaugcagccuucugcaagggggcaguugcaccaucuuugaagugggcaguccaaaaaucuuauugagaauaaaggauaaaagggugagaacuaugugugcaggacccggagcagacccaauugggccuaaaaugggucuuguugggggaaucaauaugauaauaguugaauggaagcauuaucucugaggauagucucuguauauuaaaaaguccuaguccuacaccaguuauuuuccuuuucaaacacauagccucagggauacaaauuggggguuuccuuuucaaaugcauugccucggggauacaaaugaggguuuccucacuaccacauuaaagcauuccugccucagaaguguuguggccuccuuuuucucuguugcuguguuaggcagaaaggguaguuucacaaacuccauuaaaacccacagugagggcuuuaagguuauggagcucaauccucauaggaaaaagauugagccacaaaauguaacugauguguccucauguuguuccauuuuucagucugcuucuaguccugggucaugugcccuuguguauauucccucggguccuaucuggcaaaaaauaaaggccuuuccuccuugggauuuggauguccucuaucaagauccagaagcugauguuugcuauggcuuccuucacuccccucuguucuaauuguauauugucuuuuuuccuuucuuccuuuuucaccaauguucccaagaaucuuauccacuguagugacuucagcguuuaccuccaugaaagcauuucaaaucuauauucucuccucaucuuuccuacugaauuccaaauuaucuuaccuguagacauuuuuacauuguuguuucacuugcauuguaaucuuaacauguuuaaacucaauucucuccacacuggcuccucaccuguauccguccaagaccaaucaaagaagcagaaucaguaggggauaugaauugcauacagccaauauggauuuguuacagggaauugccuuuauggaauugugagaguuggauaagcagucucuguaugguuauuguuucugauucugaugauggagcuugaaguccauggggcaggcaguagggaaagaaagacagguaaaguggggagaucaagaacagguuggaaccaacaagcacaagcuagaaccccaugaagaagaacuggaauacauguuaguucuuguugccucugaccuuggugauaaggguaucuagcagaagugggacuuuuugucacagagcuagauacacauaccuggccuaagagucacagaaaccaaaaggcaaucagggcaaaaguagagcaguuacaggcccagcuguugccucaaaccaacgaagugagucagcagaucgacaacaacauguaugagcugaaauaauggccacuguuucucuuccagccuucaaaucucccaagaaucucccauguggccaacccuaacuggaaacaaacaagagagugaauucugggaaguguagcucagccuaggcaaguugauaacauuacaaagccauuaaaauccaccccuagacaacuuggcauccauauauaucuccuuaaaguauacuuaaucacugaauaaugauaaugccaaaggcaugccucugccuagugugauauaacuaucucucauacaacugaaaaaaaaaaaugcuaacccuuuucccaaguuucuuuuuuuguccuugggugacguuuauuauuuuccaggcugcuucacauauaucauuuuauagcuuguaacuuaagugcuaagauauaaaguaaacuauuauuaagacaacuuguguuagaugauaaggggccaugaaagcgaaaaaaaauaaaaugucugguuaauauauaaaaacauauuuauauuaaaauaaggaagaaauacuuacaacucuuauaguccuuguuucugcaagggucauauggucauaguuaauaucaaucacuaccuuuuucccauauucuaucuauugcuauucuuuuugcccucagcaagcaccucagcuggucauaguucuuugcuugguggagugacacaaaacuucauucuugaaagcucugggguauuagcaguccugccugaauugaauuguuacaguuuuuuguugacuuuaaucuaggacauggaaguauuaagaggcacucuugaagauuuccugcauuccauauaugauuguuacucuauuguguuacuaguaacaauuguguugcuacuggucacacaauuuuucccugauagaacugaacacccuagccagaaaauaaucucauuuucugccuguuaauucaauggcauaagguauccagaguagacaggcagcagucucaucuuccauuucaguggaauuaauguuggguccccuuuugaaaguauuacucccuuagaacuacgaucucuagacuaguagagccuacaacauagggauaggaagcaacauuuuguuaauggauuaguagagguaauagugagugcugcuacuccuauuuucaccgcuggcuuuuuaaauguaugaccauauauauauauauauguuuuuuuguuuuuuuuuuuugagaugagucuugcuuuguugcccaggcuggagugcaguggcgcgaucucggcucacugcaagcucugccucccagguucaugccauucuccugccucagccucccauguagcugggacuacaggugcccaccaccacgccuggcuaauuuuuuguauuuuuaguagagauaggguuucaccauguuagccaggauggucucgaucuccugaucuugugauccacccgccucguucuccuaaagugcugggauuacaggcgugagccaccgcgcccagcagaucuaugaauauugacuaugggagaaacagcaccauauaguggacucugacucaaagcauccuggaagacauugcccaacccugcaagguguuuucaaaaggccauaacagcauuuucaaaagaccacucuguuucuaucaagccagcugcuucaggaugauggggagcaugguacgaccaguaaagucugugagcacgggcccauugccauguuucauuugccgugauguggguuccuuguuuggaagcagucuaguaucaugauaguagauaagguaaguuuauggaugguaguuuuggaagaagcuuuguggacagagaagguaaauccauauccaguauaaguguccauucaaguacccagguagacuacucaaaauccugcccacugugaggaugauuuuccccucaucccugucuuucaaggcuguuauugagcaacacuguagaugcugccacuaucugcuuucauguagugucuucaugucaugcagcaucaccaguaaaccaaaucugagguuuuucuuccuuccccuugucauagggaacuccccaccagaccaucgauacaaguuggaaaagugaaauuauauagcagaaguaggggccaugagaauuugggcuacuucuuuuuuuuuuuuuuuucagauggagucucgcucugucgcccaggcuggagugcaguggcacgaucucggcucacugcaagcucugcgucugggguucacaccauucuccugccucagccuuccaaguagcugggauuacaggcacccacccccacucccggcuaauauuugcauuuuuagucgagacggaguuucaccacauuggccaugcugguuucgaacuccugaccucaaaugauccacccgccucggccucccaaagugcugggauuacaggcgugagccaccgcaccuggccugggcuacuucuucaugcaacuuacuuguggcuucaaggccugaucaagucugaucacauauacaccucuuccauuugauaauggagugcuucuuugcacacacaacuuuauggcuuaucuaguugaacaaccucaaacucacgauggggagcucagauuccauggugaguuaguggcucaugguuaagcauccagucucuacaaaggcucaguagcaaggcaaaaguuguuucugaaaaagagagcaguuaucugcagaguauggcagugguuagcuccaaaauucuaaggguccaguuuugugucacuuauaggggcuugccaaagacuucaaaaugcauccuucucugucacugacacuuuaagcaccacuggagcuccugggucauaugucccaaguagcagagcaguucgcacagcagccuagacaaaagccuucucuuauucugggcuccaaucaaaacuagcaguucuuaagucaaauucauacaauggccaaccaaagaggaaaauaagaggcauucucucaaucagcuucugucuuaaaauucccuaagcaagugucuuauuggccugccugggaccugugccagucccucuaauugcaaugucuugggaguaaaguucuacuacugacacagccucauucacgcaaccacaccccauuacuagaguuugagguaucugugguuguuaggcccccuccaaaaccauauuaguuccccaaaugauguucugggaaaacaaaucaaggucuaccccuggaaggauuaagcucuuuauggccuucacugucuucauucaugaagauagcauaucuucccauuuaauuauuuucucuauggcucuuaguuacaauuuuuagaauauguguauauguacaugugguguaucauacauuuguuuuacagcuuaaaccuuuauuaucuaguuauuuuggguaauaagcuauuaaucuucauacauuuucuauuuauauacuuuacugaacucucuguggcaggcagaauucugagauggcccccacgaccauuacuuccugaugcuacucccaugauuacauuagguugcauugcaagagaaaauuucuagauguauuaagguuacuagucuugacccuaagguaaagaaauuucugggugggccuaacuuaaucacuaguccuucuaaaguaaagucuucucuagcuggugguagaagaaaaagucagagagagauucaaagugugagagagauuugaugcaagggagguucucuguugcuaacauggaaggaucugcaggucaaagggaccugggagugauaucuaauugcugacaguagucccugacuaguauucauuaagaaaacggaacuucagucuuauaacugcaaggaccuggcaggcuagaauuugugcuguauuugauguuugcuauauguaucacgugaaagacuaaaucugcuaaucacaguuggugccagagaccucacauuccucuagugcguuuuuuuuuguuuguuuuuuguuuuuuuguuuuuuuuuuuuuuuugucucccugcuugacuuugggauuccuuaauacucccccucagggagaaucuggaucuuucugcucuuucagcuggaauucacugucauuaugcuggagcccuguuggugucguaguaggguguggggaggaaaaguguucuauaauauuaugaugaaaucucagccuuuuagugagcaugugaccuucggcuaugaccuucgcagauauuucuuaguuuuuuaaaacuuccccucuuaggugagacaggaaggcuaaggaggcugaaguacaggaaaugcacuucuguuaggugggauaagccucugguaaaguaauuccccuuaguaaaguaguccuuuuuuauggagaagucucugggcauauuucaaaugauuagauuaaucuuccccucccgcugccagcacaggaagggucuuucuuggaccuucaucaugaaaacguggcaggguucuuggagguaaagcccacaacagugugggggucccagcuaugacuucagcucccaugggucuuucaaugucauauuagucgacacucagccuccagcaauuuuuccaaacugccauuuaaguuuaugguuccagcaugucuucugcuccagguaagcagagcuugacugugacucucuggacuucuuugucuuuccagaugaugaugguggcaauuugcccugaaaacucaguucucuguugggucagagaaaagacauugauuuucaguguguccagauuuuucuuguaagggcaggaaugauggcuuguaagcacaugcaggugaaacagaaagucauuaacuuuaauuuuuauuucugcauucuuauauuucucaguucucuuuaugaccaccuauuccuacuuuaaaaaagaauuuuucaugaaucuuuuauugaaagcaccaauagauauucucuaaaauugcuuuucauuuuuguaguuuauuuucauaauagagaucuguuuugcuuugaaccuuuaguaaaaauauuccuuuucuugugcuguagaaguuuuucaaccccaggagcuuguguuguuuccuucugaauauuuacgcuagaaaaagaagaaaucucuuuaagccaaaggauuguaaacagacacuauucuuauacugucuuuaucuucuuugaucuugaccuugaacauucuuacuuuaacccccucagagcuagauuuuucauuuuuuaauuuucuauuuuaauuucugaaauacaugugcagaacuugcagguuuguuacauagguauacaugugccauggugguuugcugcaccuaucaaccugucaucuagguuuuaagccccgcaugcauuagguauuuguccuaauucucucccuccccuuguccgcccccuacucccgacagacccugguaugugauguuccccucccgguguccaugcguucucagagcuagauuuuuaauauauaugcaugagcacaagcaucaacccaacacacccuacucgucuggcauucguuucacaugauuucaauagacucaggucaaaucaucuugcccuucuauucuugaauucuugaaaagucugauacauacuguaguuuguacugacguauuaugugaaagaguaaauccacgauaacugugcuacucacaauguguucccuggacuggugcugcuuucugaacuguuuuguacugguccacaauuagauacguacagaaauggagaguaugaccuuagagacugugauaacaauuugauaaaauaauuuuacuucugcugggcaugguggcucacgccuguaaucucaggacuuugggaggccgaggcggguggaucaccugaggucaggaguuugagaccagccuggccaacauggugaaaccccgucucuacuaaaaauacaaaaaauagccaggcgugguggugggugccuguaaucccagcuucuuggggggcugaggcaggagaaucacuugaaccugggaggcggagguugcagugagccgagacugcaccacugcacuccagccugggcaauagagcgagacuccaucucaaaaaaaaaaaaaaaaaaagaaagaaagaaauaauuuuacaaauuauuauuauuauuuacaaauaauagauuuguggaaucuaaugagagaaccuugaacuuuugcuuuguguaugucuuuggcuuguuuucucuuuuauuuuucuacuuagucaucuuuacugauuuuaccaaagcauggaucaaugauggauuggacauuaaaaaaaaaaaaaguccuuugccacagguaguuugagaagaacugccuuagaaugaagcacuccuaaauaucucuuugacuuuuacucuacuggcaauccauuucccaagguacagugagccaccacauuuccccuuaaacuuccaucacuuuacugugaaaggauacagaaagaaaagaacuggguuuauuagggaagcagaaguagaguaggaaagccagacuaaugccauuuuaaguuaaccuccaucuugagacuaacaaggcacauuccuugccagucaugacccauggucauguuuauauuuaaagaaacagcuuaaugauaucugcaaggacauauuccuacagcaacagaguaucccuaugucccaauauccauaacaguauaugauuucaaguucauuauaguuaugcuuuaauguacuuaugucaauuaugauguauuuauuuauuuaugcuuuuauguauuuauaguauugcuuugguguauuuaugccaauuaugauguauuuauuuaagauguauuuauccuuggcauccuaagugccaaggauaguuuuauuuaaaucagcgaaguaauacauuuugucauacuuucagcccacccacauguagacauaacuuagcuuagcuuuuacauagauaagaccccuaaacaagaaaaacuuaaaacaaagaugaggcauuccucuucuugauuucugaggacacccuaaucuguaacugaguagcuuuuuauaaacugucucuucucacuguacucugcgacuuccuuuuaacucuuuccugcugaagauccaagaacccauucuuggggaucccuuuuccggcaacagcuugagagggcugggagaaugaggaggcaugggaaaaugggaggggcauaacggggcuuugauucuuagaaaauaccucuccugcaguacguagauggcugccagggucucuuucaaugcugucucugagucgacaagcucaaggaagaaaguugggggcagggaggugacucuugagaauccuuuuccuuccuugucuccuggggcucacucugcucugacucaggggacaagacuguuuuguugacuacaaccuccucaacacugcacagaguggaaagauaccucccuccuccugccagacuuugaugucuguguucucuucuucucaccucugguacuuugcccaguacucaggaaugcuucagaugacaagacagacacugucugcaugcaccugaggugccuuggagacuuagcuuauaggcaaauagauugcacugucguagguuguacugugaagccacuacuggcaacuccuacucuguaucggugugauuuuuuuuuuuaagaaaacauuuucaaugaucuguuuaauuuaaauaagaaauaucauuacaugcuuacauauuuaaacaguacaaaggauuguacaguaauaaaaaauuauuucuccuacugacuuccccauacccugauacaguaucaugccuuccccauaccacaaaugguagcaagauauguguauuauuuugcuuguuauuucauuaaacaaaauaugugagacuaccuuuccuacugaugcauaugcaucuuguucauucuuuuuaauggccacauaguauuucguuacauagguaugcauaauuaauaaaauaauuccccauuaauggauauuuacauuuacaaaaaugucaccaaccuuuuguuacuaugagcaaugcugaauaaaaccuuauaaacacuucuuugcacagaugagccugaugcaguggggagacuacuuggcuuucuagugauucuuagauucuucaugugugauugguuuuugagaucuaacauaggacaucauauuuauccuugcugucuuuuaauguuucaauacagcaugccugccuagagagauguuuggaaucuguuucuugcccuccuaucuucauguccuuugccaaaaauaucuuuuucuaguucauaaauaguaacaucaagcaggauaggaauggugucauagcucuguggcacucccugagugacuucucuuuguuuucaucaacucauuaacccuuaaguuauuugacagauuaugaaucuauuuaacuaucugauugucuuccaagauauugugggauugggaugaauugacaaccucuuccucuaccuuaccucuacccucaucucuucuaucagagagaaaacuggaauaaaaauaauaagaaaaauaaaagucccauuggaauuuucucuauaggguagaaaagagagcaagagacuuuuuuuccucauuccaggcucuuauuuuauuuuuucauguucauauuaguucuuccaaggguuuauaucgaauacuucaagcuugucaaggaaaaauaaugguuucccaauauuauaucuaauuguguucccuauuacucuaacccacgugauuuauauaccuuauacauuuugacaacaauggcauuccuuuuaguauucccacuagguaagaauaccaccuuguucucuccccuuuaucuuuguuagguaaaaaugaaaggguuauuucgauuuauugauacaagaggcaacugaacuuggaucuguccuucaagauauccuugcacaaugaaaacaacaaauguuauuuuucucuguaaacauuauauagagauguuucuucaagucuuuuauuuuuguuuauuuuuuuaauggacacauuguaaauguacauauuuaugggacccccauaucuacaaaaaacacuuagcuggccaugguggcacaugcuuguaguccuagcuacucaggaagcugaggcaggagaauugcuugagcacagguguuugaggcugcaaugagcuaugaucaugccacugcacuccagccaggaaacagcacuccuucuggauaaacaaauucaaauucagaauaagacccugucaaagaaaaaaaaaaaaaagaaagaaagaaaagaaaaagaaaaagaaaaaaucaagucaguauuuuuuuuuuugagauggagucuagcucuguugcccagucuggagugcaguggcacaaccucugccucccagguucaagugauucuccugccuuggccucccgaguagcugggacuacaggugugugccaccacucccggcuaauuuuuguauuuuuaguagagaugggguuucacuauauuggccaggcuggucucaaacucuugaccucaagugauccgccuaccuuggccucccaaagugcugggauuacaaucaugagccacugcaccaagcgucaagucaguauuuugcgugaccaucaccucauccauuucugauuucuuucuuuguggugaggacauucaaaggccagagagcaagucaacaguaagugugguguuucuuguaauccagccagaaucaguggauagaagugagcuagaaguuccuucucagcccaguaauagaauguauacugguuguggugaagacacauugcuucagaggugacauaggaaaggaaggcugcuggccaggcuauccuggaccuggaauuuggggugcacauuaacccuuguuuacagaccuaaagaaguaguucucuauugggggcauuuuuccccugggggacauuuggcaaugucuggagacauuuuuuuggcugccauaacuggggaaagggggauugcuagugguaucuguugcauagaggccaucgaugcaucucucaacgugcaaggcagucccccuccccaagaaagaaucaucuagccccaaauaucaauagugcccaaguugagaaacuccuggucuagaauuuuuauccuauacuaaaacuuauaccguggagcuuagcggauuggggagagacaaaaauaugcaucuggucaaacuccaggucacauuccuaaagauucugauuuuauuagugugagguagagccuggauaugguauuuucaugaagcuccccaggugacccacauaaacaagguugagaaugacucccuggaaagucuggucugauggaggccacagaauagacugaccucccccauuuccuugcgacuaggggguuauuuaaggguuguugguucccugaagagguagcagcaguggagaaacccacaggagauggagcgaaguccccccaagugcuagagaggguaagauggacguucaagucuggggcuuuugugagaauugggaaauggcacuccuucuggauaaacaaauucagaacuucuaggugagugcccccagggcucuuagccuagcuaucagaccagacuacuguggcagagagaaagaugcccuucuaguggauguggccccugccaagacgcaaagcucccugaacccaaaggcauuuggauuuuggcucccacuugccccuuccucuggaugccuuuguacagugcccaaacugcacaaccuaaugcagcaacuccaacuaaaauuugccuuagcuaagaucuuucugagacagcaaaggggcaacguauugccuuacugauuuaacaagaacuaaacaaccaaaacaacaaacaaacaaacaaaacuaugagaggcuuacucaaaugccucaaagaaaccagauccguccugcgggcagccuagaaacccuguccugaugccaggauccagcgaugccaagccacagggaagaggcuccagucuggucgugguaucuuuggggugguugagaacaacccaggaaaugaggaaaucuggcugcaggaaccuacagcuggauccccauggcugugggugagacagagaacuuucugugccuugugcucucccaucagcugauccuggaaggagaaccucaagccccauccuaaaccgcagcagagcaggcacgcacccgguccaguccuugauuuauuccuuugcaaaagagaaacaaacuaacaaaaaaucuguaguauggacuuugacgucggcagaacuacacaccuaaguuccagucccugcucugccaguaacgggggugaaucugggcaaguuucuaagcgucggugucuuauuggagaaaguggacaugguaauagcgaacuuggggcauggucgugaggaucaaaacagagaacauggccauaguauccggccgcagugggccacucugaauccccucgguugccccuucuguuuccgugugacucacgcagcuuucugcacagaugguauccuucuagacgucugggauguucgaggcgguuguauugaauaccguguguguauuccgggugagggggcgcgcaaauuggggcaaagaaagcuacuucaggauauuucgcucugcuggggcuugucuccagcgcucucuggccagaaaaagcgcuggcacaaaaggaggaggugggugggucagagccccgaaccgcgcaguguuccagggggggcggagaaaggagggcaggccccaggcaggaaggagggagggaaagaggcgagaggaggaguuuuccagcccggccuucgcccgcccgcuagcacgcagucccuuggucucuucggucuccugccgcccccgggaagcgcgcugcgcugccgaggcgagcuaagcgcccgcucgccauggggagccccgcacaucggcccgcgcugcugcugcugcugccgccucugcugcugcugcugcugcugcgcgucccgcccagccgcagcuucccagguaggaucggaggcguggcugccuccucagcugggcaccaaagacccccggagucgccguugggacccuucgcucgggauagagggaggugccgggggcgcccuuuguuugcgcagaacuccucuuucgcagcccgaggguggggaugaugcggaucggggcuggugucugggcacgcgccgggaagaacugaccaucccaucuccaggcgcggggcgcccucgcggcgacgggagcccuagcaccuucugcguccgggcuuccagaguuccaaucaaacccuuuucgguguaggaggcuccacagagaaaguuuggccgcagacuaguuugcuacuuucucacccccagaauuuugccucucacaugguugcccacuggaggcuggcagcuuguccuggaaggagccucuaugcccucccacuacacgucccaggcuacccccuuggggccgcaggacacgagccacgguaaagcgacuuuuguggaaggcacgggcggggccuccccugaaucucuuaacccccccugcuggggauuccgagaaagucugcgccucugaggaagaauugccagcugagaguggugacauguggcaugcacuugauuagccccagggaaagagggcuacucgcgcaaggaucugcugggcagagggugcggcuuauuccuggagggcguggucuccggcaucuaagggggcccugguguuucuugggggcucucauggugugagcaaaauucucuuuggagaugcacuuuaaaaagcuccagcuaacuuccucacccuggagucuuagguuagcgaagagcuucaggggaguagggcaaugugccaugcacuccuguugccucggaauggagaggaaauccauggaugcguuuuaauuuaguguuaaugggaaagugggugacgucggcuauagggcgugcaaauauuuggcucugcguucaacaccgugggcagcuuaaaucuaggguaugagaaaugaaccuacugaguucugguagaaggauagaggaugcccaucuuucuagcagugugcuugggagauguagggauggcugcgggaaauucucugcacgcaccuaaauaaaugaaugaauagaacaaauuuguaaauuaauaaacaggaacauuuguguuuugagcugacucuuaaguuuuaagcugcuuuguaggaacugauucaggguaaaguggaaaggaaauuuuauccuuacugccaggcaacuguuauucccaugguguguuaauaccuccucucccacccccuuuagcaggaaucagguuaaaaugaaccuguaggggaagaggaagucauuaagcgucccagaagcagcuuucugggagcgggcaaauaaggugagaagcuagagguagcuuuuccgcacugaguugggaggugccugugagcugccugggaaccucaacuuuuaguugagccuuucucaagcuggggaccccuucuccuuuuccauccgaccucccuccguucuccuccccugcccuccccucuccuuucucucaucuuccaccuuuauauaguacagcuugcuaccagggcccagccacagaaucaugaguucgccaguuugggcauucacuaccaccugucuuuugggaccuaucccuggcuuuccuggcucccucugccagccugcaagcugcucccaacuuuuagccaccauguuccugcuugccaccaccuccacugacuccuaaccugcccuccggcucugcucagaccacaaaugagcugaagcugauuggagcugcuugauaaacacuccucuugagccuccuuuuggcauggcucaauggggucucuugggaagugugcuccgcugagguugugagauccagaggaggggauuucaguccaagccagaggcuuuggaaggcuggggaggggaaaaucucuaggcccuugggucugaaagcaaaucacauaggcugaguucacucuaagugcugggugacaaauuuuaaagaucauuucagagacacucucuuagcaaguggacaucauaucuucaguaagagagaaagugaaggacuugaaucuggaacuucugaaagaagauggagaucuagggcuccaucagcaagucgauuauguaacuaucugcacgugaauagcacaucugucagagugagaguaaaucauucucauucccacuccuagaaggucucuggaguucuuccaucuuagaauuuaaugcagcuuuucuggcucucugaucuauuuuuugcagccuagcaaagaugcagugucuauaaaaaccuacaugaaguguauggaaaauuuguagaaaaguuguuuguguuugacuguguuuguaugcuuauaacagaugagaauuuagauucuguucuuaaaauaauucuuagagcuguauuugcaugugagauaguggugguucacucugccuccuucugcaaacaaggcugaagauggagaaugaguaccauggccucuaagaaaggcuucgugaaucuuacaucuggagaaaacugguaaaguagcgugguuuuacuagucaggaaaaccaagugagguuugcuaaaagccaaaccagacuacaucagcugaagcagucuuuugaaauaccacauuuggagauaaguacuaggaauggagcaccuagcucagguuauauaauuaaggugucaccgggaacaggcuaggaauuccuauuuagauuuaaaacauguaaucagcugacaaaaguacucugcaaugaaaaggaaauaugcuggggagagcaggucauuuuccucuggcauuuucuucauugauaacacuuucaguacaguacaauguuguuuguuaguuacuacucauuucgcagauuugggagcugaaugagacaccagaaaccauuguuaaagcagcgucuucacaucuucccaccucaucaguccucguaccauaaccaaagugcugcuuuucucuuuuagauuauugcuauaacauucucacuuuuggucucucuaauucuagcucauuuuacuuucucacuuuagauaauggucuuuuaaguccauugacuuuaguacuguuuuuuaucacaucacucccuuacucaaaaacuuagggcagcaggucccuguucucacucaaguaaaaaguucucaguuguuuuuagggggcuacacaguuugcuucuagccuaauuuuccagucuuuucccccugguuuccuaaaauccuauccuuauagaaccugagucacauuuuccuucuuggcagaugcugcuuucuguaccuggaauccuucccccuugccauuuguccaaauucugcccaucauccagcaacacccccacuuugaugagaccuuuucuugaucgcuccaaugggaagcaacgugccuuccuuuuaacacccauggucucacucaugucucuuauauuuaucacauauaucacauauuugauaaugcuguauauuaucauaauuuaugcacucuucuucuuguagauuuuaagaccuuggaggcaggggccgugcuaugucuuacccuuauuuguauuucccacggugccuagcagagcacuuugugccacauggauauuugugcguaauggauuaacagugccuguaacuccagugaugggccauuggacaggaaaggagcugagggaaacaugugcacagguacacagggcuuugugccaccaugaaucuacauacauagaaacgauggcuuacuggauacagagguuccuuuuaaauauacgaacacucucuguuuaagcaauaaccuucucuguugggggcuguaagaugagagacugacugcaaccgcaagcuggaguuugcauuuauuauuuuuguuggccaccuugaucugugccuuucccaagugguugaaugguuuccuuaguaaacgcaaauaugugugcuacgucaauuccccuuucagagaacacaacugaaauuaguaauugaaagugaagagagaauuugaacagaagaagguuuaguuuugccaggcuauaacauaguaugaaauuuguagcaggcaaguuaugauuaaugcccagguuagagauucgcuuccaaaauagcagcgugaauaauaaccucucccaacuuccaauucauagggaguuucucaaaccagccccucaguucuugacugugugaugucuuaacugcuaacuuuuaugggccauuuguuuuaggaggguggucuuuuaagccugaaucucugggaaauuuggguuuaguucugaaauagaaucaguuucuaccuuuucuaauaaauccugggcucugcccagagacuuauuuuuaaagugaacacugaaugaugaagcauuuaugugcuugggagaccacgaugaagaagguaugcaauuucuucucucucguagcuuucugucuuguggggaaauagagacauaguuauuucagguggucaauguuauaauacaauuggauugacaggcccggggagcacagagaggagcuaugugggaacacuggaauugguuauugaagaaugaugcugagacuugcuggugcggagaugguggcacuaaaggcccaagaaaagugaaaguagaggaugugugggcuucucuaagaauguuuugaaauuggagacaaaaaucugugugaguguccuuuuucuggggagacggcucuaucccgauucaaaaccacuaguuacuagagcaccuucaugaauucuaugagaaaauaugcacuuaaugggcagaaaaaucaacauacagaguaagaugaaauuaccacaguagguaaacuuugauugaaccagugagcagguggccuuuccaguuacagccagcuguauaguuuccaguuauuuucauuuaaaaagcaguaccaagcaaaacagauguaaucguaaauuguaauugccuucaggccugggcugguaacuugcuguaccccccugccccacuuaguacacagugugacuugggggaggaucuuuagucaguauuuguggauuaauugauugaaguaauugugaaucaaaguauuccauuucaaaucuccccuguaggauuuaaccagaauuuccaagaugacacuuuccugagaaaacggauugcaagauagcuaaaugucaaaggaaauuuguccauuuggacaggcaacgaaucagggcauaguuaauugcgaaggcucuuggaugucaaaucaccguaagacauucuaagagacuuagaaacucaagggaguucugggggcaggaugugcagauaaagauuuagaggaaaagcuugugcaagagaaaaguccuugguagcacugcuaagcucccaaguuuuccagaugauaauugguagcaccuggaucuuacgggugucuggcacauucugaccucagaaaccucuggaguacucauucccgagcugaaugauucacucacccguaauccuuagcucacaauggaugcuucuuuaugcauuguucuccagggagaagauaaauggguuuggacauaauggcuuggauuaucccagagguuugggguuguaaauugagcauaaugauuuucaaacuuucuucugaguaauagauccaaacauagaaucuggggacagacuuucugccuuggccuugaaauaucauugcaauauuucuucugucccacucuuacagugaccuguaguguagucacauguacuagcagcucauuuccccugcuaucacuagcuguuugcaauguacauccaguaguacuuaaugagaaucuccucaaugcugauuacaccccaugaucugcuaauggaugacgcucgccugccgcuuauuguguggguggcugagcugaaugacccugccaaucccagugauccaagauuguucgcaaacacgguuaaauuagggccacagggugagaauuaagccaagguuuggcaggcccauuguggaguggugaggaagcgguggagcggcuacauccuccaccuccugagauucugcccacaaaguggcaauuccuuauaggaacucugacagacauguugguacugacucaguguuagucagaucaaggcuccaauuccuuucaauccccaacacugaaauuuuguuuccacuuagauuuuaauucagcuuuccaaggaguagggucauuguguugcaccauuaccuauucacggagcugaugcccccagccacgugaguagguugugggaucuuguucauuuuuguauucucauggucuagcagggagccugacuucugggaggcucucaguggaucuguggagugacaugugcuggggggcaugccucuggccaguucugagccucugggugggugucuuggucuuuaucuagauuucugcaggaguuucucuguuccacacccaggcucccuugcauggguugccuaauucauggaaccacggaaccucagacugggaggaugccugagaugguaacuugcccugcauuuuagggaggagccucugaggcuuagcaaguugaagggauuugucuggggucacacagagaguuaaaugcagaguugggaguagaccucagucuaguggcuauagaauuccuuucacuucauaggcaugcauugaauucaauuuuugagugaucccuacaugucaggcauccuguggggaaccagagauaggcaggcaagaaugaauggcacugagcauuugauaugguuuggaucuguguccccacccaaaucucauguugaaauguaaucuucagugcuggaggugggccuggcuggaggugauuggaucauggggggcggauuucucaugaaugguuuagcaccauccccuuugguguuauuuuugcaauaguaaguuaccauaauaccugguuguuuucaaaguguguagcaccuccuuccucucucucgcuccugcucuggccauguaagacaugccugcuucuccuucgccuucugccuugauugcaaguuuccugaggccuccucagagguagaagcuacuauacuuccuguacaaccugcagaaccgugauccaguuaaaccucuuuucuuuauaaauuacccagucucaaguauuucuucauagcagugcaaaaauggacgaauacagcauuguucacugagccccuguccaggguguaucucagggcuauucuuuauauugacacuuggcuguacucucagcaucucauaucuagagcuguuuggauguuuuucaagaguucugagaaguugcugccucagugucaguccuugcccucuuuugagguugucagagucccaaaugcuuccucucuauaccauuugcuuugagcuccccaacugauuugugauuaaauucauaacaguuuuauugagauacaauucauguaccauaccucauucauuuaaacuguacaauucaauggucuuagaauauucacagaguugugcauucaucaccacaaccaauuuuagaauguuuucauugccccccaaauaaacuccaaaccuuagccaucauuucuuaaucccccaucccuaggcaaccacuaaucuauuuucugccucuauagauuugccuacaauugaccuuccauaaaaauggaauuacacaguauuuaucauuuuguguuuggcuucuuucacuuaguauagugcuuucaagguucaacuguggcaggauacuagccagagucagccaauggugccuggccaccucucaaugcuggcugcagggccaccacuggugcauaaagcaccuuugggugaauuagaaaaagaggcccccaucuggccacauguagaucuguggacacagggcuuggucaggagacagacuuugggcaagaaaaggauagaggcaggcccaagacucaaggacuugaggccuugaguccaaggauucaagacuuggagaguggaggacaggcuugauuugagaccccacuugcucuuuuugagggugugacggugggugcuguagugcagggaacucccugaacuauaucuauguaguccuggaugucaguagcuuaacuccaaguggacaagcuauggaccccauauucuuuuagagcuugugacucuguaaaauaacaaaacagaaagcugugcuugcaugccagcagcaucuguggugaacucuugggucaccugggagcacguuaaaauugcagaagcucaggcccaaacccaagaccuacugaaucagcaucuucauuuuaacaagauccuuccaaugauucuucuacaugaugaaauuuaggaaguacuggucugaugaaugaguucagcccuuggccaagacagaguggcuugccuguuuauaacugacacacaaugguucacuuccccuccucucccuuuuccuguuggcuuugccuucaucacugaauccucugaccuuccuuuccuaaguccccagcauuccugagauaagcauguacagccuguagguuagguuuuuccucccuucucuaacucaaaaacaaaugcaaccucccuuggcuucaucuccuuuuaagccuuucugccaggaauacagccccugccuggcuuagccuugagcagcagcaaagcacaucuucaggcugauugguaacaggggccuugcauggcuuuuuccugcagcuaagauguauuaauaccugaugaauaacuuuagcugucaagaaaaccaggcuagugugaucagggccgcuccugccacuccggcaagacuccuggggcugagaauuccuggaacugaucagcucuuaaagacacagggacuucuuaucuucauaccagaaaucaaugacacugggguuagcggggaggcagcaccuugggagaugagugagagugagaccaguggguuagucaggaaaacacacagccccucacauuaagccccucaagcuccaugaauuggggaugucaggaagacugaacuguuaacagcacuuaaagagggucucucaccuuuucagggaguuggguaaguaguaguuuccaacccagcaaugguauuuuuuuucucuguucuuuuccucuuuuuuuuuugaccgagucuugcucugucacccaggcuggaaugcagugacaugaucucggcucacugcaaccuccaccuccaagguucaagagauucuccugccucagccucccgaguagcugggauuacaggcgcguaccaccacaccuaucuaauuuuuguguuuuuaguauagaugggguuucaccauguuggccaggcuggucucaaacuccugaccucaugaucugcccuccucggccucccaaaguguugggauuacaggcgugagccaccgugucuggccagcaaugguauuuguacaggcugaguaaggaucaccuggggagucugaugaaauaugguuucccuggcuccgccucuguguauuuugauuugguagaucuagguuagggaccaguaaucuagggugaaggucugcaaacaaaguccaggcaggccaaagauggcucacugccaguuuuuauaugauuaguugagcuaagaaugguuuuaacauuuuaaacugauugaaaaaaaaucaaaagaauaauaauguuuugugacaaaugaaaaugauauaaaauucaaauuuugauguuauuggaacacagccauguucauuccuuuggguauuugucuauggcuacuuggugauacgauggcaguugaauaguugugacagaguccauauggccugcaaagcugaaauauuuuccuuuacagaaaauguuugccgaaccccuaauccaaggccuuacucaaagugugguuugauaaccagccucaccugggagcuuuauagaaauguagaaucuugaacaccaucacagauaugaaauaagcaccuaccuuuuaacaagauuccuggguguuuggggcuacuucuuccccaccacgaggcucagcucaggacucaucuuggagguccaggccagcaugcuauaacuagccuuguauacgguuaauuuaucugacacauaacugggugucucauucucaagguuugaggcuugguagccuccugauaucuuagaugcucuaaaaacuagguugcuguuuuauucuugccaauucuuggcuaggauccaguguccuaaucugaggcuggagguggacuggcuuuugcuaccugcugacauauuucuuaaugcuuccuggauuucuagacagcagucuccagaugugcugcccugccaggaucuugguauguaguauggcccauagcucuccaccgucuccuacuuccuuccaugaagcacugcuucccagagacauucagaaaugguauaugggaagcaggaugcacuguaauuuaguugcaaaaggcuggguuaaauagguuucuuuauugcaggacugcucagggucauugauaugccaguauaccuuguuacucucugagagaggacaaggaggaauagugaggaccacagaaucucaaaguggggucuguagaccagcagcaacagcagcagcaucuccugggaaccuaguagauauauacauucucagaccacaccccagagcuacugaaucacaagcuggguaugugggaagugggccuagccaucuguauuuuagcagauccuccaaaugauucuuauguacacucaagugugagaaccacugguguggacguuuccaaaugguuuucuccgaacaucucacuagccuaguguuucacauuuguugauuucagugaacacuguguuuuugguuucaggacaggacauuugggaacaugacauugaauuuuuccugaagcauuuacugguggcagugaccacugcaggcuuggggagguggaaguggggaagaaaaaaaaccccaaccuuuggguagcaucaucugucccacaucugucucucuagcaauugugucuugguuaaaggaaguuuuuuugagacgaaagccaccaacuuuuggguguugccaacauguguucuuuaaaauguguuuuuguguauucaaauguaaagaaagcuggggaacagcccuugggguguuucucucuccucuucacguuacuuccuuucagaauacuuucuucuguaaaauuuccucauccaaauuccaaacucaucuuuucaggccagccaaguccaaauggcuuucauuugagugagugacccuuuucuccaugggaagccucaggacacauucagauaggagggaagcuauggcucucagcaugaggaggcugugucuuccuucucaaagcucagcucacucccucccauuccagaccuucuuccuuugccuuccauggcuaguggugucacagccaugggucugugugugaacacuuuuuaguguuuacucugugaggauauguaacugcuguguugucacuuaguuugaaauucucagugauagugaggcuugagggugaguugggaggaagcacuaaguuauucuacuuccuccaugggcuggccgcugaggagaggaaugaggguugagaaagccaugcagaccuugauuuucagugaaaauagaugagacaacugacaacuuccauuucuauguuuuuggugggcagaaaauagauauuaucguuuacuuuucuuggcuugguggucugaaugcuacacauaucuauaaaauggcccaucugauauugcagaugagcugaaaguauccucugaugaauguacuuuaacaaggcuuucaaaaauuguaggcugaccacuuuuuuuccaaaauuuuuugcaaaaaaaaaauauauauauauauaggcugagcacaguggcucacaccuguaaucccagcacuuugagaggccuaggcgagagaaucucuugagcccaggaguuugagaccagccugggcaacaucuugggacccuaucucuaaaaaaaaaaaaaaaaaaaaagaaauuagucaggugugcuggcacucaccuguagucccggcuacucaggggcugaggugggaggaucgcuugaacccagguggucaaggcugcagugagccaugaucaugcacugcacugcagacugggugauagagugagucccuuucuuuaaaauaaaauuauaaaaguaaaacaugcucauuaugaaaauauucaaauagaggcauaaaaaguugaaagcaggcccacccuucauuuuccucuugauuccauucucuuuuucugaaauugccacucaguaguuugauauaaacuucuggacacuuuucugugcuuacgauucuuaaacaaaaaagguaaaaaaggaauguauugcuacauguaacaacagggaugaaucucauacauaauguucagugaaauaaaccagacacaaaagaguacauauggcaauuccauuucuacaaaguucaacaacaaugugcaaaacuaguccaugguguuacaagucagaauagcaguugucuuuaugggguagccacugggaggggccacaagggggucuucaagggugccagcaguauucuguaucuugaucuggguugggaggucucauggguaugcacauacauagaauguauugagcuguauacacuuaagauuugugcacuuuacuauauauguuuaccucaauuauaaagaaaaaaauacccacaaauguaugugugggcggggcauaaauggauuuaagaugucuuuguuaaauuuccaugccauugccuaugggaacuuuggaaauauaugguagugauuuggguugucauaaugauagagaaggccaggccuacacaauaaagaauuggcucccuuagaaugcccauagcgcccacauugaaaaacacuguuuuaaaaguuugcagacuguucuauugggcagguguucagaacaugggguaggccuuugaaauagucuugccuggaucuuuacucugucuuuguuuaaauggaguugaagccucaagagcugauguggauggauggguucuugauuuguuuuugccuucugaaccaaauuguaaaggaguggaaucaucuccuuugccagggaacagaggcaauuugauaacccucaaaugugaacuugaugcaagagagagcucuucuccagcucaguguaucccucccaugcucauagcucucugaggccauguggccuccgccagugucuuggucuggagucuucugcugaaagucuuacugcauccuccuuuccuuucuuagauuuucucugugucccauuugaccucuauagaggagaguuaagcauuugaaggaccacaugccacaucacaaauugcuuuuguuccacugucugguuuuacuuuaaaggcuagcccucuuuuugucugucuguguugacuggggacagucaggcuacagagcuuugugaaugccccuuggugagaacaggacuuggcauuuauugagguccccugcuuugggcugaccuccucagauuuagguguuugucuuuuuucuguuucuccucucucccaucucugggcaaugggcagggacacacuuuggcccuucguaguauuaaacaauagaaggagacuaaauuggaaaaauauuauuuuccccuuggaccagaguaaugccuucauuuauaaagcuuuucuuuuaaguuuauuuuuguuggcucuguaaaguaggaccacaauugauauuucacaagccacaugcuguuuuaauugucuuugcuaaugaaagacagagggccuggggauuaugggugccauggacucugccuagggucuuccuuuuggggucugcauagaagaguuugaauaagaggauggaauauugucuaauauugccucugaugaaacagcuguggaagcaaggcugucucugagagcucaugucuggcagggaucauucucucaccagccagccauucuacugccauuuauuucuggaugaaauaaaguuaaaaugaacauuuaaguguagccucaauggggaaagaaguuauguaacgguaguauuuggaugccagagagggaggaagaguccccagcaggauggagccccaauugcccacaacagugacucacagcaguugcccagugagcaguacccuuauugucuuucuucucuucgcugucucucugcucuaguccaucgcuaugcuuccugggauugcuucccaaaugaacuacuuguacuuugucuuagagugugcuuuugggggaacucagacaauggcuaagcuggaacuuaacccaggauuuugguuucugguccagaguucuuuguacugcugaauugacuccugcugaauagaacucucuaggucacugaaugaacuguaaagaaggcuucugugauggacacuuggagguuguuucacuuaucuuuugaugcauaagaaaccacuccaaaacuuagugguuuaaauaagugacaacuauguauuuacucaugaucccgcaguuugggcaggacuuugggggacggcucaucucugguucacaugguguugucuggggugacucaucugggucuagaggauccgggaugguuccacucaugugucugugucugacacuucaucugggaugacugaaaucgcugggauggcuggucccucucucugccucucugcagucugcauaguuuagcucuuuuccaucuccccguguugccuuacucuccagcaggaagcuggcauuacaugcagcuggccucccaguggacaaaagccaaagcuaccaggacacuuaaggcauagauccagaauugucacagcaucacuucuguuacauucuauuagucaaagaaaaucacaaggcaggcccauauuugggaugguggugguaguggauggagucuaccucuuauaugcaugugcagggugggaggaauugucgguggccacugugcaggcaauccacuacagagcugguuugggacggcauauuggagaugggaguuuaauuuuccaggauguuugcugggugccuucugauuagaugcuggaccucagguugcuagccaaguguauuaggcuguuuagcuacagaauguggcauaugcagauucauugaaaguucauagaagugaguaaaucagcaucccugggaauaucaaaggcucauuuuccaaugguuauugauacuaucaaagacaaagacuuuauuaaacaaaaaugaacucaaaauagaucauagaccuaaauauaaagccuauaaauaugaaacuucuugaugacaacaugggagaaaaucuuugugaacuugaguuaggcagagauuucuugaauaugacaccaaaagcauggucuauaaaagguauaauugauaaauuuuacuuuauucaaauuaaaaacuucucuuccaaagaccccacuaagagaguaaaaagaaauauauaaagaacucucuaaacucaauaacaagaaaaaaagccaccuaauuuuuaaagcagacaaaauauuugaacagauacuuaaaccaaagauguucaauauuauuauccaccugcuaacuggauuaaacucaggcaacuucugcuuucgucugccaacugugaacaaagccaccugcucuuuuagggaagugauuuguaauauacagugcaaauguaagguaugguuauaccucccacaaaacaacuugcacacauuucugcuccuuguagagggcugacuagccauuuucucugucucucucacuggacuuuaugugacagacacccgcaaauugcuagccauggccguuaaguaaccacuggccacuggcaauuugaggcagaucauuuacuguaagcucaaguggacgugggugucuccuaccaugcuuuuccaaaccaggcugguuuuuaggccucccuaaaaaaaucucccacugccuacuuguucugcccucaaguguccugauguccuuucauuucaaggaacuugcaucauuugagccuguaacagagggcuuuuagucuucuuugguacuauugauauguaagaaauguacuuugacuuugauguuuuucuuugaauucauuuguaagcaaugguaaaguuugaaauguauuacuucauauuaucauauauuauucuucucaagaccuaauguuaaauucaaugcugagugcuuaauaaggauacugauuacaugagaaguaacagaacaguuuucaucuaguuucuaaauuuaggggaaaaaaaagcuuggaugaacgccaaauaauuucccacuuuugugaaucccaaaggccccucuucaugcauugaacauuccugaaauuucuggaauaaaaaaaauugugagaagaacacacaggguuuuuaaaaacgacuuuuuacuugagguguacuugccauguaauaaacuguacugaauugcuuucauaccauuuucaaaaauuaauuggaaauuuuuguacagaucuguuucuggguucuuuauucugauccauugguuuaugugcuuauuucuucacuaauaccaauacugucuugauuacuguaguuuuguaauaugucuuaaaauuggguagugugauuccucuaacuuuauucuucuuuccaaaauuguuuuggcuauaaauuucauauaaauuuuaggaucaguuuguuuauaucugcaaaaccuugcuaguauucugauggcaauuaugucacaccuacugaucaguuugggggagaauugauauccuuaauauuugaaucuuucaauccaugaauaugguacaucucuccauuuauuuagauauuaguugauuucuuucacaaacauuuuuuaguuuucaguauacagaucccauacauguuuuguuagauuuauaaguauuucauuuuauggggcuacuggaaauguuuuuauuuucuuaacuuuccucucuaauaguuuauugcaaguauauagaaauacaauugauuuuugugguuugacuuuguaucuugugauauugcuaaccucaaguguuauuuugucgauucuuugagauuuucuacauagacaaucaugucaucugugaauagggacagguuuuuccuuucuuccuuccugccuuccuuccuuucuuucuuucuucucuccuuuuguugcgcaggcuggaaugcaguggcacaaucucggcacacugcaaccuccaccucccagguucaagugauucuuccaccucagccuccugaguagcuggaacuacaggugugcaccaccaugccuggcuaauuucuguauuuuuaguagagaugugguuucaccacauuggccaggcuggucuugaacuccucaccucaggugauccacucgccucagccucccaaagugcugggauuacaggcgugagcuaccgggccuggccagagacagguuuauuucuuccuuuccaaucuuuguaucuuuucuuucuuucuugucuuauugcacuggcuaggauuaccuguauagugcugaauaggguagugaaauugaguguuguguuguucccagucuuagggggaaagcaccucagucuuucaucguaaaguauaauguuaauugugggcuuucuguagauccccuucaucagguugaagacauucucuucucuuccuagauugcuguaauuuuuuuuuuuaaaucacgaauggauguuaaauuucguuaaauuccuuuucuguauuaauugauaugaucaucuggauuuucuucuuuaguuuguuaaugucauggguugcauugauuaauugauuuuugaauauuaagcuaggcuuccacugucaggauacguaccauuugguguuaccauauuauucuuuuuauguaguguuguguuuuauuugguaauacuuuguuggggauuuuugcaucuguguucaugacugauauuguccuguaguuuuauuuugaugugaaguccuuaucugguuuuggcaucagaguaaugcuagccuuguaaaaugaguugggacauguguucuccacuucaauuuuguggaagacauucuguagaauucuuuuaaaaauauuugauagaauucaccagugaaaucacugugccuggagauuuauuuuuaggaagauuaucuauucaucuugagugaguuuugauaguucgugcuuuuugaagaauugguucauuucaucuaagcugucaaaguuauguguagaguuauacacaguaucugcugugauacccucuguuucauuccuaauauugguaauuuguuucuuuucuuuguuuuucuuugucagucuugcuugaguuuugucaaugauaugaauauuuucaaaaaacagcuuuugguuugauuguuuccauuguguuguuucauuaauuucuacuuuugccuuuauuauuuuuauuauguccugcugcaugcuuuggguuuguuuuguucuguaguuucuuaaaguggaagcuuaagguauuguuuugaggccuuuuccuuuuucuaauauaaacaucugaugcuguaaauuccccucugagaacuguuuuaucccacucacuguacucucucuccucuccuuuuugaacucuauugacugaaauguuaaacauauggauauugucccacagcucccugaaaaaaccaagauuaaaaagaagauugaaaaaaaaaguuuauugagcaaggggaagaccaagaaagacaaaaagucacaaggagucuuccuacccucuuaagaccacaucuucucuacagagaaaaaaaucuccauucccagaguuuuagguaucuagaguuugcuauacaauugcuguagucgccacugcugucacuccugcccacugucaccacaggguuauaugggggcugggucaugaaauaauggagaaaaugaacauaaaagaaaaccagggaauuuucuucauucucucugaagcauuacaguucuucuuuuccacucuuagagucagagauagagggcuucuccuggaacucucucuguacccagugucuacuucuguguuugggcugauuuuagucuaguccugggauaccagagcaacaccaauucaguguuaccccaaauucuuuuuuuuuuuuuuuuuugagacggagucucgcucugucacccaggcuggagugcaguggcgugaucucagcucacugcaagcuccgccuccuggguucacaccauucuccugccucagccucccgaguagcugggacuauaggcacccaccaccgcaccucgcuaauuuuuuguauuuuuaguagagacgggguuucaccguggucucgaucuccugaccucgugaucugcccaccucggccucccaaaguguugggauuacaggcgugagccaccaugcccggccccaaauucuuagucugccugcuaauguuuacuuuuucagaaucaccaaagagcuguucagaugcacuuuguucagguuuuucagcugcauucaguaggaaagacagggugaaguacgauuacugcaucuuacccagaauuggaauauugugaccuuuuuuuuuuuaacauuacauuauccuuuucaugguagucaggugguuuucuuccucccuuccuucuuucuuucucccuuuguuucuucuuuucuuuauuuucuacuuuuucuucacuaugaugccuaguauauuguuagaccuggauaaauaacuuuugacuguugcagauggugaaaagucuuuugugugagguuuuauaguuauuacaauuuagagaaaggauuggauuguuuaucauuggaaaacacuuuguuuucuaaagauauaucuacuaggaugagagaagaaaaaaucacgaucuaaaaaguggggaguaauagucuuauagagucacugugaaaguucagaggaaugauauauuuguaccaggaacaaauauguuacauuuguuccuuuaaguaaauucagucccauccaaaaacguauuuauugacauuagcucauuuuugaaagccuuuuuaaaaugagcuaauaucaauaaauauguuaauaaugaaaggaaccuaacaaugcagaaugauuaggcaucaaaugcuguauguuuacugugguuugaauguuuguccccuccaaaagucauguugagauuuaauugcuguaguaacaguauuaacaggggaccuuuaagaggugauugggccauuagggcucugccuucaugaauagauuaaugccauuauagcaggaguggguuguuaguuaucucaagaauggguuccugauaaaagggaggaguuugccuccucuuucccuuucugucucauguacucccuucugcccuucuuucaugagaugaugccgcauuaaggccucaccagauaccagugcccuguucuggggcuccucagccuccagaacugugagcugaauagacuucuccuccuuauuaauuaccuggucugugguauuuuaacaacagacaauggacuaagacaguguccuucuucugcuuuauuagauagcuuauuucaaaagugaacaagcaauccugcuuguagucugagaaauggaaauuguggaguugagggagauucaguaaaagaugaucuuucagaugaggcuauuguuaaacuuuucauuaaauugcuuuuauuuuggcccuaguauugguaucaucaaacauuaaacagucuuaaaaagugaaaugauacccagucaucuauaaaagagugaauugugagaaauuauauggcuuauuucccaguagagacaagugauuucacauucugcagcagacccaugagccacacaagucacaugaaagguggccauagcucagguguuuggcucagcuuucuauucuauccaagcuauuucuaaucacagaugaaccagccacacauucuuauuuugagcagacaucugaaauugacuucagcuuaauugcaauaacacugaggauuggaaaacauuuguguuaacaucuacauucuguucaaaacaucaacaaaagccaaaucccccaaauuaauaggcucuuuugaagacuucucuuuugaauaaacaguguugacauguaauucaucauuaacucauaaaaacacuucaguaauauaaaucaggauugaagucuaaaagccauucugcuuucaauuagagcauccaaaucugguauacgagaccuuuucuccuuuuuuuuuuuuuccagccacucuguuauuuugucaaucuaaucucaucuguauccugcucacgcucuaggaaucaagucuuucccucagaugcaaugccugcauucuaauuuuaaaaguaguuaauagaauauaccaauuccauguuuaaacaggaagaaacuaaggcuccugagaggugauggggcuagccaaagucacauggcuagcuaguagcagagcuagaugaggauucuuagcaccucacuccauuauuuuacccuagucuucuagaaagacccugugcuguucccagagucucaccucugaaauaucacacuuuuuuuauuuuuuuuaauuauuauuauuauuuuuuugagauggagucucgcucugucgcccaggcuggagugcaguggcgcgaucucggcucacugcaagcuccgccucccggguucacgccauucuccugccucagccucccgaguagcuggaacuacaggcgcccgccaccacgccuggcuaauuuuuuguauuuuuaguagagacgggguuucaccguguuagccaggauggucucgaucuccugaccucgugauccacccgccucggccucccaaagugcugggauuacaggcgugagcuacugcgcccagcccacacuaaaguuuuaaauucagucacaaauguuuuucaauaccuuauaaguauaugaaccaaaaccaacuugugaugacauuagguuggugcaaaaguaauugcgguuuuugccaauggcaaugaaaaaaaaccucaauuacuuuugcaccagccuguagacgucaggauaguggcagguuucugaccauguucuguuucuugaucugaguucucuuacauggguguguucaguuuauaacaguucauugaauugugcacuuuuuaaaaaauaaaauauuuauuacgaguggcuuaugguauuaucccugauuguugcucgggccccagaacuuaauauguuaguaauguccuuuauuaugcaacgagucaccuuucucauccagcuuaaaaaauaauuuuccucuuaacauuuuuuuauuuugcucuccaguauacuuuugcuucccagcgccugccuaauguuuguaccaucaguguuguagaauccuacuucaaaagaagcauuugcuacagcccagaaucauagcgguaaucaugcagugaucuuagcccccaccccagggugcuugcuuguuugauagucacugugaguguuccuaauaagccagggcauaucuggauucaucauuuaucauuuucugugcuccaaggcuccaacaauaugugugauaaauagccuguagcuuauuuucuaaaugacagcagugaaaccuccuguuuuucuuucuuugaauugaaucugagacacaugaaauugguauucucugaggcuucucucuucucccuccccacauuucuuuuacagcaggggaaaaggcagaaaccuaaguuugugauugguaguggauugaaagccguagauccuuuucuccucuccagagcuaaggaaaugaucuuuugugagcauucaucacucugccuuuuuauuauuucucucucuuaccuuuagagucuuauuucguccuguccuccaccuuucuguacaccacucccuccccaaagguugcuuuuucauagcguaaaaguugauccugaguaugugugcaagacauuauuugguacuacaauuucacagaaucauauaaucuuaaccuuggaaagggcuguagagccccacccuacuucccucaucucaccccucuugccagcauccuucggccucaugggaacacuuccagcuucaguaagcuuugauggaaucucaagauggucuuggagucuuagaauacccugccucacacugggcuaaaaucagcucuacaugacaucuagccauuguccuuauuucucacuuuugguacugcacaaaguaaguuucucucuauuuuuauccaugggaugaccauugagaaaucagaacacagggauucuauuuccuuuuagucccauuuucuucaggcuacaaaucuaaaguuuauucaccauucaacaaacuuuuuauuuauuuguuuacuuauuuauuugcuaugaaagcuagucucuguuggucauuuuuuguuuuuucuuucuagcaucuucuggcaugucuguguccuucucaaaguguggccccaagugauaaauauuugaggugauagauauguaaauuaccccaauuuaaucauuaugcauuguaugcauauaucaaaauaucacucuguauuccauaaauauguacaauuauaacauguccaaaaaaaagaaaggaaaaaaaaagaauuggcccaaauggucuguuauuccagugugguugcuucagucuaggauaagccagacuucuuugguuuagccucuguccucuugcaggccacuguugcucucucuuuuuuaagaaacuauuucaccugcuggcucacaaugugggcaacuagcuggcugcucuuucccaagccugccagggaagcucucccccuugcuggguguacagcuuaguguagggagagaaauacaagacuucauguuuauaaucucuauuuaauuucuccuuguagguuucaaacuagcuauggccuaugguuucaucaucuguugguuuugcccaucuguagccaacauuguugaugcccugugccaucuccccuccgcccaucucuggauucaucugcagcugagguagacaguucucaaacaugcugacaguuucucaccuuagauguccacaugucuuagaggcuuugccuuuagauuuacuccaguccugugggagcucgcucagcaagaauuucuggaagaguaggagauguaacaccccgccagcucuuagccaaaaaaaaggcaggagucuguggguaaauacccaaccuuucgugucccuggguuguguuuccucagaggcuccucagugggaaugaauccagguugcccccagaaguaaccugcucauuagcauaucuuuaugggcuuuuccccuauuccuuucucauuuccccugcuuucucacugugcuuccugggaucaccuuccaaaugaacaacagcacccaaguccuuguuucagacucugcuuugggagaaagaaaacuaagagcuuguccuccccagcuugguuaucuucuacagauuuguucuucuuaauucuuccuucacugguagaaugacacagagcccuauagcauaucuccugagaggagguuaccuguuaauggguugugaaauucuuguaguggucaugauuagcacuuuuuaaacacucaaauguaauagaauagcaaauaugagagggcaucauacuuaaauauuguuccaugaaacuuauuuuucgaucauauaaauguauguguguacugagucacaagaugaaacauuuucuguggauuguauucaaaaaagugaaaaguaauugcuuucugugaauacaauucauaaaucaguauuucucugaauggaccuuuauguaaacuagauuuacuagaggaggcauucucuuggguaaaccaaagaaaugagguuacuuuggccugauuugcuauuuuugaaccaacgcugauuccaaauugucacuauucuaaaaauuucuuccuauuuuuuuuguuaauaaucuguucuaaaauaacgcuuaggauaaaauugaaacuuuucaugucuaugguuuccauacuccauauuuuuacugauuugaaaauugucuauccacagccuuugacacuucuuugguuucccuuaauuuuucagugauuaugaagaauaauuucacguccauccuuuauauucuuuaaggcccugggauguaguuuccuuggaucuggaaauuugagcucagguaaaauugccagcugggaucucguuacucuugagcccuucuuccuaaucuguggcuuuuccccauauauaauauuaaagcaagaaagauauuuagguggacuuuaaggaagaaauuucaacuuuccuacaaguaaaauguugagaacagcuugggaguaggcugggaaggcugucuccaaacuuuugaguuuucauugggacucucucaguacuugaggcuggcgugugcaucagauugucuuccaagaguauuuccagaucuaagacucucuaauuuuauuggcaaagcauaucuuuuaguuggaggcccaaaugguaauuuuuaagaacuucuuggauaaacauguucuuaucauugcaaacaaaugagaaacaaaccuaacaagcucuuugcaucaaagauauuuuaauugcucugcuugaaaaauuuuaaauuaaacaaugaguagaaaaaaagaauauuuacauaauauggguaugguaaaaaaaaaaaaaaaaaaaccacaaacaccucuacuuaccagccaguuuaauaagaacuuaccaaaaaaagagcaaaaacuuuacccuguaguccuugcuauucuuuccuuuggauucuuuuccuuucgcuaucuccucagagguaaccaauguccuaaauuuuguauuuaucauuccuauuauuuucuuuauagaauauguuuauaucucuaaaaauacauuauuuacagccggguaaaguggcucaugccuguaaccccagcacuuugggaggccgaggcaggcagaucaccugaagucaggaguucaagaacagccuggucaacauggugaaacuccaucucuacuaaaaauacaaaaauuagcugggcgugguggcacgugccuguaauccuagcuacuugggaggcugaggcaggagaauugcuugaaccgaggaaguggauguugcagugagccaagaucgcgccacugcacuccagccugggugacagagcaagacuguaucucaaaaaaaaaaaaaaaaaaaaaaaaaaaccaaaaacaaacaaacaaaaaacauuauuuacauuugcaugcuuuugacuuguguauaaauggacacaugcugaauauagucuucuauaacuugcuugcuuuucuucacuuaacauuagauucuuaagaguugcucauguuguuacaugcaguugugauuuuuucauucacguuaucuuguaagaucccauuguguaaauaugccaucauuuauccaugcuacucuugaugugcauuuuggguuguugcuaguuuuauguucuuguaaacagugcuauugggaagauucuugucuaucucccuugaacaaugugcaggaauuucucuagacuaaguaccuaggaguugaauugcuggauaauaugcauacauaucuuugacuuuguucaauaaugccaaauuauuuacuaaggaaguuauaccaaucuaaacuucuagcaccaauguguauuuccauugcucaacauccuuguuaacacuugaucuuguuauauuuuuagaguucuuccaaacuaaugggucagaaaugguaugacugugguuuuaauuauuguuagugguauuuuaguaauaauauaauaguaauaauaauaugguuauuaauucucaggggaaggauuuuccuucuuucacucacugcugggguacaagaugagaacuuuucuuuguagucccuauacaugggauggauuuauuucacucuuuacacugagaguauaggcuguugguauaucagcuuuauguaggaggugagggugaggggauguaggcagucuccucuaaaacugaugaccuugaauagucucuggaguuugucuucuguauccaaggucucaccaguccauggaaauuaaagcucaguuuuggcaguuauccucagaauaaaaggugagccuuaauaucugguaccuaaucaggauccugcuuucacaguauuucuuacuuucuugcaagcuaaaaguggauuuuuuucauugauuuucauguaagcacagccaggcuacauggcucaccauacugccugaaauaggauccuaauugcuugacuuugaaauugauuccauuuucaaccuuuaguuacuuucaaauguauuucaugauauugugccagagcaaucuguaauuugauguuugaaggacauauguaccuccucaaauuauccucuucagauuuacaaacuagaaaauucucaguggagauggcugaccuaccacuuguucaagauuuuacaaugagacaaaaaguugccauuugcaagcauuugaggaaaauuuuuggguguucaucaagggaggagagaaaaagacugccuaggguguuucccauuugcugccugcuuuaauuuuucauuuauaauuccuugcucagaauuucauugaagaggggaauuucuaggaagcauuggcauucaugcucuaaaaaugcccugucuuaacuucccuaaugcagccuuaacaaugaugaagaucccauacccaguuugauugugcuguguaaaauuugaaugugacuugacuacuacacauagaagaacauuaaaagacccauacuaacaaaacaauuacugacagguuuuguuagggcugcaaaauaguguguuugcauuucccccccuccccaccuuucuuuuuuggauagguuucaugugaauucaugugaguaccuugauugaauuaaauaauucauguaaaucacccaaggcagugccugagguagugucuguuaacuaaauaguagguauuucuucucucuuacaagcuaggacuguaaggacuguguuaggacucacuggugucuaccuuggccaguaagaccagauaagauggugcuguacaaagcugcuccugcaugguaaaaggcuggagaaauaguugcuacuucauuuaauuuaccuuuuauuuccuucuuacccuggacuuucaucugcacaccaggaugcuggaaaauugcucagaaagacucaauuuuuggcaaaguucccuuuagggcacauacugccuuuuucacuggcccaugguuucugagaacugcccucaucgcugcaaaugaggacuucaccagccccuccagucccuucccugcagacagccugccuugguccuaggggaaggacaaagggagccugucacugcaggcccuucuccagcaagggacugggaaggggccaacaugccugcaggcuccuguauugacaaguugcagcauccuuaagagcagccaagaaauaaaaugguaauuuguguuugcaucuggaauuucugagcuucaaaaucuuggaucacagcacucucaauaacagaaaacaggacacacauauaaauauccauauccauauuagccucuuuguuaaacucugucugggucagcagcucgagacugaaaaguagcaggaugauuguacaggaaguagaaugaaccugaaugcuguguuucagggcaggggacagcgggcaugagagggacgagaauggccuccccauuuaguggacccugagccauccccccagggacaucuagaguuugacuauauuauggcuuaaaacagcucuuauggacucucuaggggaccugaucaccacugauaaugugguuuccaaggaaaagccaauuucaaauuauaagcaacugauuuauaaaugcacuuuggggaugcugccaucuguaggugagaggccacaugacuccccugucaucagugcccugauacuuuggcaggguuacaagccacgcugugccucuuuguggggcucucuuuagcugggcagugggcuaaaugugguauucguuggauagcaccagaagccuauccaugcaacauauuaucuccacuugccuguucugcugccugagguuuccccaugaggaucaggaaguuuccacaaugagaagaaagccauuuggggaacccuguaaaaaacuaguguguuaaggcauuauguaaauaugagaguggauaaaugacuuagcugauauguacagcaaagacuauucugauuaucaacuugggaguucuagauaagguguguaauacaauuguuuucaaacucuuuugauugcuaccugcaguaagaaauauguuuuauaucacaauccaaaacacacacauaccaugcacacaguaugccaucaacuccaaaacucugucagucgucagucaccauuauuuuagguaucacuaaaaaagaaaaaugauaccaauuaaacuaugccauuccauugauuauagagcucaucuuggguucagggaaauuaaaauguuaaaaaguguuguuuuagagucaauaaaauaugguauaugugugugugugugugugugugugucuguguauaauugaaacaaaagugucaugaaacaaugcucacuuuuacuauguaugguauauuauaaguaucugcuauuuuccccuauucuaaucuaauguauuuuauugcaaauaaagcuggucccacuaaauuuauggaauggcucacuaauguuuuaauuuaauuuuaaaguguuaagucugagcuauaguauuguuuugaaauagggaauuggaaaugauacacugagauugauuucuuaucucaaaccagaugucaugcuguauguuuuagucaucuauuucauucaaauguaaauugauggucuacuguuuaaguuaggacucuugauggcacaugacagaaaccaguuucgaaaaagcuuugaagaaaggaugggcuuaucaucuuauguuagggcagagguaugcuuguggggccaagcaauacuggaaccaagggcucaaauauugugggaucucucuuucucucuuucucuguuuuguuuuugcuuuucuuugauggcuucauucucucgaauuagcauucuguaugagauuuaaucuuugucguuggcagcuucagggcucacaucuuccucauuuuaccaccagagaaaaauccuuccaagauucucauugguucauguaauugguucauaugauugcuccuguagucaagggauaggauaaacucaccucuacuagaaccacauagguaugaggaauaaugcaguuuuccaaaagaaaggcucuucuuucuuugagaggaacacaauagaugucuaucacaccuaggaagugcuagcaccaggcauugugugcugggguguagccucacacaacagguauugccaaaagccugcagaugaucauuuugaaaacuagaauugccgucagcuuaguugcaccuucacuuucccacuagagcuugagucucccagugaagauaauaauaacugacaacagcuacugugugacuaucaguucaagggcaccgaauggagaaaucggugcuuucaagagagaagcuacccagaaaagaaaugauucuaccucccaacacaggcagagcuggauaaaauagccaucuguaaaaaacuucaaguaaaguccagguuuuuguucuugggugcucguguucuauucccuguuggggaaccggagaauguuuuauaaggaagaagccuuagguuucagcugagcagacugcagccugucacuuucaggcauucucaugauguucauuucaguguuucagugcuguuuucuggaaauaucuuucuucacacucucuucucucugucucucucugccauuuaauguacuauauuaaaauaucaaucuacagcuggcaauuaaaaguuugcugccuacaauucucaguacacacuguggcgauuuuauuuuauuuucuuagacucugucuucucugaauucaguuauucucaguuuugccaagaugugccagaauuuuguaaguuauacugcuggguuacugccaagaacgacguaccagucgcagcuuuauuugggcagcuuuuugugccuuaaauacaguaucuguuucuguaaguacagccuucacugagggagauggaugucucauucugauauugauggaacagcuugagcauaucaguaauguguaggcuaaagucucaaggggaagaaaacuuuugagagccuuuguuaguuucacaggggcaguaaggggaaacaaacccugaccguauucccugaagaguuugaugucuagcugggaagaaaaaacucgaaauggcuucugaaaauccaacgcaacauaaaaucagugcugauuuaaaaaugugaacagagugcaucaaugugaauggaaugguuaggaaagauaaacugggggagcuaggcuuugaaauagcuuuaaacacaagaaaggaacugagaggagggaaagggcuuucagguagguuucugagucaugaagacagaaacaaggagugaaauugcaugagauuuagaaucagaaaaguucaauccuuguucuccuauaacugauaaucacuucauucucugagcugagaauacaaucauaaacaaagugucaaagaguuguugcccuccccagguuuacauucuagucacugaaugauaccugccucauaagguugcacugaggacuuaaagaggcaauggaaaugaaagaccaggcagauuuuuaaaaugaugugccaugguaauuuguuuauugccagguguagaaggaggagggcaauuugauuugcuugacugcuguugucccagcuagagguugaggaugggaguguucuaggguaacauaauuugaaaacagguacuaugcccuucuaaacacuucuggugucccauuuuacagaugagcaaacugaggcucaggaaagaaaaguggcuucccaaaucaggauggcacuggaacuuaaucccagggcuuuuucaguugcauccuaccagagaggauggccaugagcaguugaggaaacucagugucugcuugcuguuucaugggauauaacaucuaugcccugaacaaaucagauaaaaguagacuucuaccaccgaucccccaaaggcuuucucagauuuucagauuccuucauucugagggaggaaaccgaauuaacuuaacaaauguagguuuucaaaguauuuaaaucacuguuuuucuaauacuuuugacaagacccacaggaagaaauauauucuacugugaccuauuguuagagugaauauauuauuuauuguacaaaucaggaagguuuugagugugaaagagaaugcuauuaauaauaauguuagaugguaaccaugugaggugauggauauguuaauuagcuugauuauggugauuauaucacaauggauacguauuucaaaacaucauguuguaaaccuuaaauauauauaauuuugcccauuauaccccaguaaagcugaaaaaguaaugcugggacaacaggcauaaaaugggacugugcuaugcaaacuggggauacccuaccacacauacaccuauauaaaaacaaaaauuguacaaaguaagguuuauucuuuauaugugcagugcacccugacauuuucaauucuauuucacuacaaaaauacuagucaugaccuacuaaauggggucaacaguuugaaacauacuauucuuaguugaugguugguaucgcugaggcacuuaugaugguaguaaagacagggauuugguaagcugaaugucugauauguccuauaaacuuguuucaucugaacauucuguugaaucuucugccacaagaaaagcacugguaauaaacauuuucuucaguucauuccccaugauuagcaaaagguuuagacuaaucuuucuggaucccuuuguuccauuuggaacaagaaucuuccucuguguauuuccccucuuuucuuacucuugcgcuuuuaucuauuagucugccacuuauuuagggauguaaggaauccaaggaagaaugucucauuuacagauccugguucucuguguacuuguucugagccuucaucuugggguugaagcuggugcucugaaaagcuaaaguuucuuuuucgcucuacuccuucaaacauauacaccuuuacacacaacuccuggacaucucuccucuguugaaacuuugccaagauauaacagaauagaucuugccugcuagucaggcauacggaacugacuucugggcuucuucaaaagcccccauaaauuaggacuuuccagaagagaagcuucugcagauuuagcuauggaggagagaaggguuaccacuguaccuguguccacacaagcuauggacaggcccuuuguuagcccauuucugucacuagaaauguuuguacacucaccuguguuaacaagagcuucaagaauacaagagacccggcaauagcaccuuucagcaauaaaauaacuuuuggugaguccccauuuuguaaauguuuuuaagucauaaaggcauauagggaaccacaggguuuuuccuaccucaaaguguaaacuaugguaaugucuugagccuaaaaaucacuuuuuccuaaagcaaauuuuauuaucuggaucaucugaacucauagaguaaacuugacaacaguuuacuuuucugaaaaagauugacuguauggcuuuuccuggugguuauuaagaugaauacauauacauauguuuaugaaagauuuucuaaaucacaaaucauacaggauuguuagaggaauuuuaaaaaacacacagaaaacuuuggaagcacugagauucuugaccauguuucaugcuuaaacuuuaaaaaguauaucaugccagauauaaguuugucauauuuuuacauuuuuucaagaaacucauuuacacagcagcucagggauguggaggccuucaauuuauacucacauaauuaaguagaaaaugugauuaugaacccucaaauuagaaacuuguaaaacuaaaacauauauauuaugccauuuaauuuauggcaacccuguugaggcaugccuaauugggguauuugaggcuuagagagacucaguggcucucuuagcuugguuuccuagaagcaaagcuuaugguuuguugagggaauacucucaggaaaaaaaccuauaauugaggaagggaagcaagaaagagcuaagcaaggauagagucucagguaaauucuagcaccacaggguucuuagaaacauaaauacugcaagguuguccuuccacucaccuuugggggcuagaagucuggcuucauguuccuccauaucaaucaaacauuggcugccuccaggaaacagguggggaggaagaaguggcuccuaucagcugaggacaauucucuggagaagagggcaacugugaguuauuugcagucaaaggcucccagcagcuaggagaugggcacaccagccugaguaaaggggaucugauugaggaauaagcaguaucuaccgcagugaccuaagagaagacuauuaaaccaaggcugagagguacaucagaaucuucugacuuuaaggcaaaugcccuuucuuuuucccuuccuccuuuuguacuuucuacucuuccuacaccuuuuccuccuuuuguuuuaaaaacaaauacuguuuauuauguuagaauuuuuauaagucaggaucugggcaugguuuagcuggcucaaggucucucaugagguugcaagcaaguuauuggcuuggccugcaguuucaucugauggcucgacuuguggguguuauguguguguguagcuggggagaucuucuuauaaccuuacuuauguuauuguuggcaggcuuuuggucccucaacacaugggccacuccacagggcgcccucaugacuuggcagcuaacuugacccggaaugagugauccaagagagagagugugagacaguauucaagauggacaccacagucuuuuuauaacuugacuucaaaagagauauggugucccuucugccaaaauuuauucauuagaagcaaguuaauaaauucauuccacacuuaaagugaggaguuacaaaagguuaugaaugccaggggacagggauaauugggggccaucuuagaagcugcauaucagagucuacccucuggcacccagugauuauuucccaccaacaugcaaaauauacucacuccccccccccuuuuuuuuuuuuuuagaaaaauagcaucuauucacagcuaagcagcucacugagccugcuuucugacaguauaauuguaggggaucaaagaccucuccuuauuccuuaaugucucugccuuccuaagucaagcuagugauauuucagcauauauaacucuuuuaagaauuuugugggucuccugugaaucuucuuagaauucacucuauuagacaaaaguucacccuauuagccaccuuacaaaucucauagauauagacucuucucuguuugauugagaggaacuugagauacccuuaaucucucuaaggggccuuuuguaagacugaagguacuuuaaggcacuaccuugauuuaacaaaggauuuuacagccguaauuuugccuucaucuuuaaaucauguuuuucuggcaaugccuuggauuugaucuuuguucagaagcuauucaaauguccuucauacuguaccacagcugcucuguaauccauuggcagaucauuuguuagcacuaaaucaucuggcucccacaaauaaacacccuauggcuuccaauaguacaaaauacccuuuuguaaacauccaaaucugcaguauugucacaguuuaaauuuauauacggaagcuggacugauuagaauaaaaccauccaaaauuauaagcaugaggacauaauuuaugugucacaagaaauuuaaggcagauuuuucucuuuuuucuccaacauuuuuaccaauuccaaaucauauacuggguauacaagguaaauuagacauaguucccaccccugagcaauuuauagacaugauuuaucuccauagaauacuuuuaaaaaguuaggucuaggccugugcuauccaguaugguagcuauuaaccacauguggcuauuuaaauguaaauuuaaauuaacuaaaauuaaaugaaauaaaaacauucacuucucuuguuuuacuagccacauuuuaaaugcuuaauaaccacauaggacuaguggcugccguauuugacaguacagauaaagaauauuuccaucauugcagaaaguugcauuggacagcacuaaucuagaagaaaccaguaugauaagcauuuauccuuuuuaaaaacauauuugcuucucucuccccaacacuaaaaugaguuaaauaucaaaaagaaggacacuacaugcuucuucaguaaauauucuaacaugcuuaacaauaaagaaugcuguaagaccauggcuuuuaaaauuuauuaaaaucuacugaaagcuaacaucuuuuuccccuagaaaaagcaugcuaguaccaaaaggcauguaucaaaagcauguaccaaaaaacauguucaauuacaagggguucaugggcccuccaaagcccuuucauuaauucuguaguaggccaugauccucagguuaagaaucccuacugcaaaguaaauuuuauuuucccauugacuuucaguauaaaauugauggugcaauuuacuauuaaauaugcuucuuucugacaauauuaaaauuaugucuagaauaaugaugaagggagaaacaaaauguaaagaaugaagaacugucuucaaaaugacuaaaaaauaaacccaacacuuugagcuaaaaauauaauacagagccagcaaaucuaccaauuugggucagguaucauaaucaauaaagaacuauguaguuuuagcaaauuugccaaguuuuccauuagucuuaaaucucuaccacaucccuaccuuacggugagaaaccuuauggcgugauagcaggaacacucuacuagccuucagaaaucuagucuccugauguaauuucaauacauauaauaaguauuauuuaagagugacuuuggugccucgaugaucuuaucuaccuggacauucagaaugaaugggugggguuccauaggccaggaagacccuaauuugaacuuuggaaaaaaaaagaguggcuauuucuuugaaaaucuguugaauuagagaaaguuuuugcaaggagagcaaaauuauaaaugcaguuggcuccagguauggcugagagacagaauccuacauggcucugaguuucugauuucugagccaacguacaauuuguauuuguguggaagaagcacugaagcauucuuuccagagugguaaucugaaccauauguagacugauuaauaguuaugucauaauaaaaccucaauuagcagaauucuagagggauagccuuuuauaaauaaaggaaaguuuacuaagaaaccucccuucucccauccuccccaacuucuuucucuauuuuucuuccuuuugaaaaauuuuaaugguggggaaaaucuuuccccaauguacauaaagcuccucugcugcuuuaguaaguacagucuacugaacauaagugagucugucuucgagcuuauuguaucuuucagggugucuauuuugcagacuagucaucauauuuuuauagaaguuaauauaugagcucaggcugaaaauaaacuggaaauuuucugagaguggcagcuaauacccauuuauuuucuuuucacuuaaaaaacaccuaucaaggcugagggcaguggcucaugccuguaaucccagcacuuugggaggcccaggcgggcagaucacuugaggucacuaguucgagaccagccuggccaacauggugaaacccugucucuaguaaaaauacaaaaauuagcugagcguaguggugcaugcuuguaaucccagcuacucaguaggcugaggcacgagaaucucuuggacccaggagauggaggcugcaguaagccgggaucauaccacuacacucccuccugggcaacagagcgagacccugucucaaaaaaaaaaaaaaaaucuaucaagaauaugcaguaaaguuuucauucauuuguguaucaguuuauaugcauacaguugcauguaacaaacagugcuauucacaguggcuuaaauugaaaggauauuuauuguugaccuaacaagaauuguggagguaagauguauaagguugauguuguagucuggugacaucauccaagguccuggguucuuuuuaucuauccacuuugccauccucaacugaaaaucuuuaguccugugacaucuuaccuugugguugcaaaauggcugcuccagcuucagacguuuauccuuacacaauagccuccaaagcugaaaggcagaaaagagggaaaagucuucuccuugcgcaguuuucucuuuuaucagggagaaaaaucuuucccauaagcucccucccccugccccuaagcagacuucauuuuacuugccauuguccaauauuggguuacaugcuuaucccuggagcaauuccuggcaaaggggaauuaauuuuuugacuuaagagucaucaugguucaucguuuggggagggacacauugcugcugaacacaaccugugaucuuuuaguaagaaggaaggggagaauggcugcuggacaggcaaccagcagcuucugcuacacauggauucuucauuuugcuucugugggacccacucuuggcauauuuguucucacacuacugaagaagccauuugcuguuugccuaucagugaucccaaagccagcuaucucauuucuuugaaauuguaggcgcagaaggcaguaaggccuagugaaaaaagaaugauagauuugaaggccaggcagacaggauucgaaucccugauuuaccauuuacuggcugcauaaccuuggacaaguaaagacguuagagacuugguuucccuaaugauaaaucuaaaauaguaccaaauggccaguguuauuguauagauuuaaugagauagugcauagaaauugccuagcauaguacacauaucauaggcacuuaguguguguuauuuccuuucccaugugaauucaauugcacagaaaucagauugcauuuagcuuagcagauagaccaauucggaaaaagaguaaguuugacuccaguagguuuuuuuuuucuuuuuuccuccuuacucaucuauguucacauaaaaguccccucucuuaucuacaaaagacuuguggguagaaagcagugugcccuguguuaggguaguguccaguuacuaagagaaagcuauaaaaccauauauucauuucuuaauugguuugcuuaaauaucuguuagguuuaauauaggaaacagaauccucucuagguauuuuaugcaaaaaaugauuuaaugcaggaaauaagguacucacaaaauuggaagggcuggagcaauggaagucaagaagucugcauuaaaggucaaauggcaccaugacuucaguccagaugccagaaacuccuccuaucacucaggcuaggaaacuguugcugccgugauuaucaccacugccaacgucacuauccucccuaccacacaaagcugaugaggggacaguggacacaguugacaacacucacaucugcuguagccuauuuucugcaugcacaacuguagaaaagaguuccuucccuuugauuccuuccaaaucacuaaaaguagacccuuucacaaccuagggauaagggaaucuagaaacuguacuuuucaacccaaugccaggcuuucuuccgccuuacccaugugaaagcccuccuuaucuuacuaaucugugauuccccugcugggcuaucugcccaugugcauucucucuuugccccuguuuucccucuaugcccuguuugggcucugacauccugcucuggccuaccaugccucccuguccuuucugguacagaugucugccuugcucuaaaggccuuagaacucaguuguucaagaagagaagauuaggaaaggguaagaggucuccuugcuuuguuaaaaauuaccguacauaucuuuguauuucccaacaauuuaguguuagaaguuuuugaacuuuauaaaaaaggagucguauauauaguauauagucuucugggaccaacuuugcucacaauauuauuuuaguuuuauucauccauauuguuguucucacacaugagcuuugccauauuuuaaaaucuuaaugcauuuuugcauuuuggggguuaugcuucuuucuuuauucauucagcauucuauaauauuuucccauguuaagaaaccucuucaaaaugaacauuauuauguuaugaauggaucauaauaugauugaccauuucuuguaguuggauauuuaaguuaauuccuaucuuagaaugugguagaugaagaagauagaagaaaaaaaggcugagauuuuccauguggcagaguagcuggaagaugguuauuugcugaaaugggaaacacugggggaugcacaaauuuggugauaagaaaaggaaucugguuuugagcagguugagugugaguguggagauauccagacaacaguugaagauucuagcuuggcucuuaggagacaguucaaggcuagaaacaauggauuuaucaucaguacauggggaaugguuugaggcaaguaugggagugagauggcccaggaaaauagucuggagauauguaaaggaccaauacuggacuccugggaaauacuuauguccaaauggcaggcugaucuagaugugcuguccagagagucuguuuagaaaggaggaagaaaaucgggaaacuguugucauuuggaagccacugcagaagagagcuucaugaaaugaauggguagucauucauacuaaaugcuguaaauacuguagacaaguuaaccaggaugacaaccgagggcaaaauauauguauguguguauauguguguuggagggcugggcggggggagaaagcuugcugcucauguaucuggauuuuuuuuuaauuuggaugauugaagguucacaugcagacaugcaguucaacuguuuccuuggguagauuccuagaaguggaaugacuugaucaaaggguuugagcauaggccuuugauucauguuguuagguagguuuccugguuuucauuguuuuuuguuuuguuuuguuuuugagauggguucucacuauguuauccaggcuguuuuuugaacuccugggcucaaguaauucucccacucagccucccuaguuucugagauuacaggcaugagccacugugucugguuccagugcucauuuuuuuauaugcaaugaugaauaguuuguaauuuuguacacaucugggugugcagagacaaggugaggaaaucugcagcaaaggaaaauacagaauugggcuucuguaguugcgggucuuuuccuaaugaacacaguccagcccucaucuccucuccacuuucaguuuccacacucuacaucucucauccagaacacaaguggaacagggaccauuacucauuagcugcauggggauuugaauaaccucacaguggaggauguucuugucuguuaugguggcaaguaacuacaacuaaaugcgugaccaagacagagcuaacucgagucauuaauuagacugugaagucuggagggaaguucucugaauuuaagauuacaguuuugaaguuuggcaucugcuaccacuucaaggauuaaggauuuacugcucacuggaauucaauauuuaauauuuuaaaaaccauucagcuccagcuugcaaaugaguuaaauuaaaauaauacacagacguucucucugaggccgugguuuuuauugguagcaacgcucauuaagaaauuuuacuggcugggcacgguggcucacgccuguaaucccagcacuuugugaggccgaggcgggcagaucaucugaggucgggaguucgcgaccagccugaccaacauggagaaaucccgucucuacuaaaaauacaaaauuagccaggcaugguggcacaugccuguaauuccagcuauucaggaggccgaggcaggagaaucccuugaacccaagaggcggagguugcggugagccaaaaucacaccauugcacuccagccuagcaacagagugagacuccgucucaaaaaaaaaaaaaaaaaaagaaauuuuacuugagccauacguucaugagagguucuaaauaagcacacagauagucuauuucagccuucauuuccuacaaaugcuguauauagaagcaacuuuguguuucuuuugucaagauaagacauuugauuuaccuccuuaucuugcauuuaaauuuauuucacaagauggaccuguuuucagguaccauaaacacccaguucuacuggguuuucuuugacugcuggggaaacuguggacugugucugaugcacacauuuuauugcaucuccccuggcaugagauucauauacauuggcaucuucucagagugaaguugacucucucuguuucccuauuccagaauuucacuuggcauauggugauuccaaaacaguuugaggcucauuuugcuugguuuuuggcaaucucagcucagccgguuucacucugagagaucuccuguuuguuccuucaugaauggccacagaagcuuuugcucuuggcucugcauucuaauagcaccuccugcauggucuguggcaaaggaaugcuuugaaauaugcguccauacuauguggcuuuucuugcugcaguuucuguucuuuuuuauuguaggaucgggagacucaccacuagaagacgaugaagucggguauucacacccuagauauaaaggugaaugcuuugcuuaugugcuaaugaggaccugcuggugccaggagaacuuuccuuuuugccuugugaaacagauuguaauaaagugaccagacaacacauuuaaguucuaauuaucuaucaaggaaaaaaaaauauauauauauacucccuuuuuuaaaaaaggaaauaaagcaaaaugcauuggaaaucucugaaaugcugucuuucagcaucccaauggucauuuuauucucauaaguuucuuuacuguccucacuucugcaaaggcagcuguagcugaugaaagugaaaaucaagccuaauucauacauuacagccagaaucauccagaguaaaccaccuaaggucaaaucuggaccaagugcugauaauguacuaagaugaauggggaaggagaaaacuugauuuucauaagcucauuucaucgugcucuuucugagcccagcauggcuucugaaacgguauguuaaaguauguugcucaaaugaaacuuaaugauaaagaacuccaucucuacauauucccagcaauccacuccccagcacguauaaaaagccuaaacaagaaccuucuguccagacucagguaaguauguccacaaauauuucuacuggugaaacauuucucugaagcuuagggaaaccugggagaaaugaagguaaauuuagagaugcuuucucucugaaucuaguuccucuuacaguggaggaagaauuugaaaaaaaaaaaaaaaugguuaacaaaguuucacugcggcauuuugcccuggaaauuuguccuaauuccugggaugaggacauggcccuuguuuguugugaugugucucagauacaggagaaucaggguaggacuggacaacuuuugacuggagauguccuucaguuguuuucuacacaagugaacaauauuuccaauauaaugacuggugccuggugcuuaugugcaggugugcuucccaucacauaccacauuuuuuugugagaucugaaugcaaauacucauuccuaccuauaguuucuaucuccauagccucaggaauuaaccaaucaagcaaagcacaaauacguuaaucagaugcuugggguaaggaaagguucuaauucgcaaaacuucuuaacuauuuauggguuuagauuuuuuuuucuuugagucccuuguugaaaaaucuuccuaaaacacaugcaugcacagaugacccuucacaucuacagcagggguugccuagugcccucagguccuuguucuucacauccaucuucaccucacagcauugcaaaugugacagguagaccagauggccaaaaugugugcuugcccuagaacuuacccugaauguuuaagaauaaauuuucuuagggcauuguuucuauugucaguuaaauugcuuacugguagcaaucauuucaguauguauaaguauaucaaagcaucauguugugcgcuucauacaauaaaauuuaaguuuuauuuauuuuuauuauuauuuuuugagauggagucucacccugucacccaggcuguagugcaguggcgugaucuuggcucacuguaacauccgccucccagguucaagcgauucuccuaucuuagccucccagguagcugggacuacaggcacacgccaccacacccagcuaauguugcauuuuuaguacagacagggguuucacuauguuggccaggcuggucucgaacuccuaaccucaggugauccacccaccuuggccucccaaagugcugggauuacaggcgugagccacugcaccuggccaaguuuuuuuaauuuuaaaagcuagagacaagccauuauuaagugaggguuuaguuuuagauccugaggccccugcacaauguccagcacagaguaaguguuuuugaauuaaaguaaaauaagaaagaaaauuaaauguaaccaacauuuacggugcuccugguauguggcaagcauggcuuuugauucuuuugcuuggaauaccaucauauauucauauuaauugagugaguuugugauguaugaguaugcaggucauauauauacauacauuaguucccccuuaucugcgguuucacuuuccaagguuccauuuaccuucagucaaccgcagccccaaaauauuagauauuuugagagagagacaguacauucaccuaacuuucauuacaguauauuguuauaauuguucuauauuauuauuaguuguuguuaaucuuuuaucaugccuaauuuauaaauuaaacuucaucauagguauguuuguguaagaaacaaacaguauauauagcguuagguacuauccaaggcuucaggcauccaauaucccccgugggcaaagggggaguacuguauaucacaaauauauguaguacauacagauuauauuaaaacccuuagaggaaggaaaauuuauucaaggaaguucuuuaggccuugugugagcuccuacacguuuauauccacaugguuaaauuuaaucagcucuagguuaagccuuuaggacaucaccuuuaccuagaaaguccagggaagauuacuugagucuugaguuuagggcucacuugcagcugucugcaaaacaugauaugacgaaaguauuagccagaccagggacgguggugcgugccuguaguuccagcuacuugggaagcugagacaggaggaucacuugagccuaggaggccgagacugcagugagcaaugaucaugccacuacacuccagccugggugacagagugagacccuguuucuaaaaaagaaaaaaaaaagagaaaguauuagcugaaggaaaugugaaggcaaaacuaaaacaguggucuaugcauaagacguggccagaacuguugguuuuuguaacugagaagcaguuggaggcauauccucagaagagaauuccugggaaaguaaaacagggucuguccuccuuccuggccacaugauggcggucuuaccucacucacugacagcucaggugcuggguuggagugaugagccaggcaguugcagggaaguggcuccuauucauggcauugagagcccggcaggcuuuagggaacuccucacuguuccccaucaauugugggacaauggggcaguggcugcuguaggaacuuauccaccaaggagcuaguguugcccuuauauuuuauggaucucaaagagaacauuucaaaagcacagcagggagguucugauuuauucauuucaucccagcugugcuuugggcaacuaugagaccaaaaucaaaacaccugcaacuuugccaucuggggagggugucacccuguuacguaaauggggcauaacuggggacacuucucuauggagagcaauuguucugugacuuuaagcgaaauuuauaucuuguuacaaacaccuggaaauuguagcaucauuuagauuaaugccaguauuacaacauuuuagagagaaugugcauacggcucagacgaaauccaaauuaaccaauuauugaaucccuaccgcuauguaugacaucaguugcccuugaaagaauuaucuaaaaaauaaaaauaaaaaaucuuauguaucuaguuaagggaaauacuaaaaagaacaagcauuuauugaacauauaugcuagguacugugcuagaugcuugauaugcaauuuuuauuucguccuuguaacagcacuauggcauaaguauagauauugacucagagagguuagcuaacuugucuaagaucacacagucaguuauagaggaacucagauucauguucagauauaucugacacuuagucccaugaucauaaccucccuacccggagacaccuaagaaaacauggggcacuaauugaagguccaaaauuuggaauguagccagccugggacaguaagaguaaggggacacauuuucugaaagugucauuucauauuuaucuccucuuuuguuucugcuacuuguagauaccccguggugcucccccaucaaggugaaguauggggauguguacugcagggccccucaaggaggauacuacaaaacagcccugggaaccaggugcgacauucgcugccagaagggcuacgagcugcauggcucuucccuacugaucugccagucaaacaaacgauggucugacaaggucaucugcaaacgugaguaggccagcucuguguuggguccucagggaugaccagagccaaaguucuuuugcucugagauugaggauuuucacugaauauugaugagaaaaauucuccuuaugaucagggggacaccagggggauucuaagauaugguggaagugaguuggcuccucucagagagaaugauaugaucagcuguuugagaaaaggggagagaagaucauuguucagaaaaugaguuacauuuguucaguuagugcuggauccugaagagguguuggggauuuagaaacaaauaagacgcacauggguccugccaugaagaggcuuuaguaaggcagaggugucaacugggagauaaguacaagaaggguacaaagucagggacauaugguagcagauuaaagaagaguucuccuggcugggcgcaguggcucaugccuguaaucccagcacuuugggaggccgaggcggguggguugccugagcucaggaguucgacaccagccugagcaacacggugaaaccccaucucuacuaaaauacaaaaaauuagcuggguguggcagcgugcaucuguaaucccagcuacucaggaggcugaggcaggagaauugcuagaacccgggaggcggagguuguagugagccgagauugugccacugcacuccaaccugggugacagagcaagacuccaucucuuaaaaaaaaagaaaaaaaaaguguucucccaaggaguggggcuuagggaggcaggaaagagucacagaagaagugaugcuuauuuaugaaagugagugugccucaagggagaagcuuagaggagcagcauuucaggggcuggcuuuuagcuucaugacaagucauaccucauuuggaaaauugcaagugguacagcauuguugaagcacauuuuagaugucuuugguauucaaaacagccaccacuuuuugagcgcuuaugguuugccaagaauuucacauacauuugauuuuuacaguaacacuaucaauaugggugccauuauguuaacuucauugucagggaaacugagguuucaaggcugcagccaugucaucgagacuaugcagacucugcaacugggugacuguaguggacaaucugcucuacccagaucuccucgaugccuuuuacuaguuguauguauccaguacccagcuucugaguacuuugcucuuaaagacuuggaacuucaaccuuauucagaagacugcuccuucagaggacugaucccacucgcucucucucucucucacucucucacucucguucucuuuucacaagagaaagcaucuccugugagcagccuguagcugcccaaugacugacugauaaagaauuaugaaagcccagcuuccuugccugggggcaggacagaaugagcugucauucacacuccagagcuucccuaugggaucaggcugcugcugacuuugccugagaucucaucuugccuggauuucuccccuucccuguucugcuuuccucacccccucacuagucucccugggagcacuuucuuacuaaaccucaugcacauaaauccguaucucagaaucugcuucuggggagcucaaccuaagauaguggcuuagcuggguugccaacccaagccagugugacaggaaacuuugugucuucugugugacauaaaaccauccauuguuucuuaaauuccauuuguuuuauuuauuuauacaaagucguguucuuguugcccaggcuggagcgcaauggcgcaaucucagcucgccgcaaccucugccuccuggguucaagcgauccuccugccguagccucccgaguagcugggauuacaggcaugcgccaccacgccuggcuaauuuuguacuuuuaguagagaugggguuucuccauguuggucaggcuggucucgaacucccgaagucaggugauccaccugccucgaccucccaaagugcugggauuacaggagugagccacugcgccuggccuucuuauauuuaaauuaacuuuucaccucaugcuuucagaguuucuagacucugaaaugaaacucuauagacaaaaacuaagaaaugcugaauaucugauuuucucauuuucagaaaagcgauguccuacccuugccaugccagcaaauggaggguuuaaguguguagauggugccuacuuuaacucccggugugaguauuauuguucaccaggauacacguugaaaggggagcggaccgucacauguauggacaacaaggccuggagcggccggccagccuccuguguggguaagaaaaugccacagcccuuaggaggcacuugcuuugggaggagcaggggguguucacaucguggauuguaaagggagcaucacuauuccuccuguaaggccuaagcaugcaacuuugcucucaguagcaucacugguucucuggcucagcccuagaucuaaccucagugucuauccuggagcugacuucguagcugauggcuuccaucugacuuuugucuuuuucuugguuugcuauugaggcaacuacaggcuggcagagauguggcauacuccugcugauuuuaguucgggggccugagcaaaguuauugacacuauagggacaguccaguagagaacaucuaugugucuuucagccccaauguagcuucuuugucauugacucugguggucagcaagcacucaauuuguucagcuggaagggauuuggauauuuugccuuacucuggguuuguugggcagugagugguucccauggugugguccugggagcagaagcagcaguagcaucuccuggucuaagaaugcaaauuuuuaccaacccacccccaccaccugcugagucagaaacuuuaggggucaggcacagcauuuuguuuuuuaaugagcauuccagggauugugaggcacucaaauagagagcuacugaucuaaggcacugcuucucaaacuuuacugugcagcgaaguccucuagggaccuugggaaaaaugcagauuuaaauucagcaggucugcgguggguccuaggauucugcuaaacgaugcuuuagggcaaaguuucugaaccucagcaugauggacauuuggggccaaauaauucuuuguuguggagcccuguuuuuuuuguuugcaggauguuuagcagcauccuuggauuuuauucacuaagugccaguaacacugcccacagggggcaccucacagauguugcuuucaauauccucccugugauuagcuaugugcauagcucuucaaaacaaaccaaaaagaaaauugaaucuacucccucauauuggaaggggcagaggugauggugggaggagagaagcucaaaaaucuuucugcuaagcaagcuuuggcagaguacucuagggaucauacuguuuaaauuuccagauugugugcaacaauggaaagaaaaugcugauuguucucaaaaaccaacagcaugucuuaagcuggaccagaugcgccuggaaccuucccagaggaagagagaaugaaccccaaauucaggagauucauauuacaguuugucagaacaagguucaggcauauuugggagaaggaggauuguacaugcaauuaguuagggaugacaaaaagggguacagcgauccacaagagagccuagagcucccaggaaaaaagagagaaaugggcaaagcaagcaggcaauucuuucuuugauuuucgcgacagacaagcugagguuuguccccagugaauuuuacuccagggguauuauuuacuuuuuuggcuuuaaauguauuaaaauaguuuaauaaauuuguuuuuguguugacagggguaggggguccuugagcguaacucagaacuucaaccuauuuuaggaggugacacauaguggcuaaguaguucccagauuuccacacaaccuucaacagucuuggccagagcuguacugaguggugagaaaguugucccaguucucuucuagacugugagggaagagagaagacugggcuuacuuuggacucugagguggucaguucuguggucuggcuaauuugaaggugccacaaguuaaaauuaauucucuuacacagaccauacucuggcaaugagcugaaauucauaguuauuucagaaacagauauagauaaaaauaagucaauguaggaggaaaaaaaauacugcaaauugcaggaggguaaaaagucuuugaagagccacaaccuccauugaucuggaagaaaauaaaccuuagaauguaaccacuauuguuuucgggggauauuuuucuuucuuuccauuuuuaguuauuuuugguuauguuggcauuuagauagaacaaugaacaguuggaaucacaacaaguccucauguaaagaccagauuuugaguagacacaugaucucuccuuuagaccaacacuucuuccuaggccaaaacaggaagaaaacaaauuaaagauacuuuaaaaaccacggacaaugaaaaaccagcaaaggucuuuugacauucagagaguauccauuuaauuacuuuaacaaaagacaauguacaaacuuuccuuuuugcccuguggaacggauuguaauaaagugaccagacaacacauuuaaguucuaauuaucuaucaaggaaaaaauauuuuuaaauaaauauauuuuauuuuuugcucacuuauuuuuuguuuucuacagaguagaauagguggagauuuauuaacacaaaugaaauucuggaauaaaacauuuuggagauguaauauauggaaauugauggcauacguuucuugugucccagcugucucacagcugguuuacccaaugacccauaggaaugggaucauugcauuauugcugggcugcauugcauuauucaguugaugcaaacaucaguagggcuaagaaugaauguauccaugcauuguugcaaaugauguuaaauugugcuaaauucuuccuggguugacaaauacacauucuuuugcaaacuuucagaggcuaguuucaguuaaaacaacuugauugacugagauacugauucacuuuuucccuuacaugauuuguuaguacaaacagaacaggucaacuuuuaguggcucucucuaauauaaauguaucaccaaugaauuuuuauuugggcuucuuucuugugaagauguugacuuuuagagaugaggucucauuauguugcccaggcuggccucuugcuaugucguccaggcuggucuugaacucccaggcuuaagugauccucccacaucagccuccugaguagcuggggcuacaggcaugagccaccacacccggcuaugaucaugacuuuuaaauguggauuucauugccucccuucuugccucuuuugucuguuuuggaaaguucucuggauuuuuguauggugccaaacagaggaaaccacuucccagagccauccacagagauuacgcucuggcugggggaagcaaacaacuggaugaguuuucaauggccagguuuguucugcauuuggcagucacucacuuccuaugcccccuugaaaagaacucuuccuuucucuaucaccaaacucaaacuauuuuauauuugcaucagugaucuguugcugcacaauagaccacacaaaacuuaguggcuccaaacaacuauguuauugcucaaagauucuauggguuggaaaguugggcagagcucuguggggacagcucaucucugcuguaugugguaaugguugaggugaccaaguggagcuggaggauucaagauggcuucacucacaggucugguaccucaguugggaaaaguuguacugacuggggucuggcugagucucuuucucucucucucucucauuuauaauuucucauccugauuacauggccucuccagucaauuggacuucuuuagauggcagcuggcuuuuaacauagugaaagcagaaggcaccagauucuuugagggccuaggucuggaacuggcacagggucacuucccuugcauuuuauuguuaucuguugggcaagacuuuguccuuuugagcuucuuccuuauuuccacuaccuaccggguuagaugugucaaggauuuccaaguaaauaguucagcuucagcugggugcugguggcucacaccuguaaucccagcacuuugggaggcuaagacaggcagauuucuugagcccaggaguucgagaccagccugggcaacauggcaaaauccugucucuacaaaaauaaauaaauaaaugaauaaauaaaaucagcuaggcaugguggugcaugccuguagucccagcuacuugggaggcugaggugggaggaucacaugagucugggaagucaaggcugcagugagccgauauugugccacugcacuccagccugggugacagagugagagccugucucgaaaaaaaaguucagcuucuuagauaaauaguaguugauacaaugcaauauauuuguaucucauauuuuauaugcacagagauaacuagagcacagagaagggagacaguuugucagaugucuccaaugaauguggcagagagcaaaggccagaauuuucacugaagguuucaagauuuuuauauaauugcaggcauccuaauucaacaggggauaguaauuauguuucuauaguaacuuuguuccuuucauucauggaaauguauaacuuauaaaaugcuaucggggccaagucuggguaauaacaggcuuaggucucuggagcaucagcugaagggcagaccagcuugucucaccagccgagagagaaggcagcugcuugaggaugugucaggaucaaguccugcagaggcucuucaaggguucauggggaagcuaugacagaccaucacaaaacaguaugugugcaaagguuggcggaaaacacuaggucagcagcaggcagauacacaaaaggguuugguuuauuaaaauagcuuuaaaauauguaauggcauuuaaaaaucccagaccacaaagaaauuccaaaagagaggaaaugcuucuucccagucuauaaaugaggaugcuaauaacacugcuuagucuaaugggugguugugcaaauucaguaaaauaauauagggaggguacuuagcauggggugggcauguaggaaggaguccuccaauauuaguuauuauuuguaaugauuuauuucuucuuguuucuucuuuggaagagcacuguuucugaaaagcuaggccaguucagcugaucauuguuagcuagagauaagcuggcuuugggaaacucugagacucuucacccagauaaccuaucuuggagccugugugcuuacacuguuaguacaucuugauacagaaaacaaacaacaauguaucauccagacauuuaguuuaccugacagagacuaaguugcuuuucacucugaccaugcugcaccaagaaaauaugguaacacaauguaauuuuacauugaaaucuguaugcuaauaaauauacuuucuauaauguaauugccagcuauauuugaccagcagggggcagucauuauauacuugucuuucugugaaauguucaucugaauuauaaaaguuugucuucuaucaccuaucauaguaaaaaauuaaauguuuuuaaaaacguaacagcugaguauagacaucuugaaugcauuuaaagcaucuuccauuucaucauaguauuuguauacuuuauuuuaucaauucugagaagcguauuauuucuaccuuuuaauaucccugaaauagggaugcauuucacaauuaggagugacuuagauucaacaaaauauggugguuauucaauuuaggauuggugcauuaaggcuguuaaguucacacuccacugaagcacgacauagaaugaaaaugaauuuggauagcugaaggcaaaauuguuuaauaaguuauucguaacuucuuacccugaauaaaaugagaaauuauuagacaagacacaggagaaaguauauaaagaauuuuacuuggugcauuuagucucucaaagacaucugucauucagaaucaaaaggacauuuaacuuucauuaaggcaguaauagcacuuaauacuuaucaguugauauguaaaguaacaugaagcugaauguccuuaauuugcuaugccuucuuuaaauacauucucuaccuguucagaaauauuaaguagaauuugcagaaaugugaacuuccucuugugauuucacuucagcuauaagaugaaauacaacccaguguagaguugacaucucauuuacuuugagcccucauuaaccacccauccuuguuaucacuaucgaggcagaacuccuauuaccagguagagaaacuacuugaagaaauuugggaggcuuuuggagguccagagccacaguaaaacugcugucccagaacauaaaaccauaaguguaguucaguagcaguucaaggggagaguggacccagacagaccauugccuauuuuaagauauuaagcaauauguugauaauagauagcaggaagagagagagcuuguuccaguggcaagugcuccgacuuagauuguaauucacagugccauuaucuacauguguggucuuaaauaaaucauuuaaguucuuugagccucaguuugcacaucuguaaaaugagagaguugggcggcuccucuacaccuccauagcauucacuuuuaccuugccuggggcaauugccauuuucuaccucauguuauauuucaugugugauaauguaaucccuccaauacauggcaaauucucugaaaugucaggagcacaugauucucuugccuuugugcacccccaaccccagcaguuggaaugaagccuuggauaagauugguacucaugaaaaauuuguugccuugaauugaaucugacuagaugauagcuagaaugccuuucuguaauauuccaugaugcuguguucaaagcaggaaguacucacuaaagccaaaugacuucuaguuucagcuggguaacugccauguggccuucgguaggcagaguuuggaagcauggggaggaaaggcuguaacuaaugaauuacccacaggacaccuugcaaggccaguugauugcagguuuagcccugcaaaugugaguauuuaaacaaucuucaaaacuuagcaggagaguaaaagcauuaugaagggagaaaaggggaauauauagggugaacaaacucuuugaaaauggagaauacccagaggcuuugguauuuuaaacuguggguguugaaccccaguuugacuagauauuucuugaugaugaugagaauguuuugguuauauuuucagauauggaaccuccuagaaucaagugcccaagugugaaggaacgcauugcagaacccaacaaacugacaguccggguguccugggagacacccgaaggaagagacacagcagauggaauucuuacugaguaagugaaacuuggcagauaaaaugaugcugucucuuuuaugugagauguuuacuacccagaguaggggaguguauauaugcuggucuauuuaugcuuucagauguggucccccuggucacuaccuaacauacuauauaugucaccuauguauuuguugauugccugucucuauuauaauauguucacugcuauguccuuaaugcccagaacugugccuggcacauaguuagcacucaguaaauccuuacugaaggaaaaaggagaaauaagggguggugaaugaugugauuauuaugcauugcaugccuguaucaaaacaucuuggcugggugcgguggcucaugccuguaaucccagcacuuugugaggacgaggcaggcggaucacuugaggucagaaguuugagaccagccuggcuaacauggugaaaccccaucucuacuaaaaauacaaaaauuagccaggcaugguggcacacaccuguaaucccagcuacucaggaggcugaggcaugagaaucgcuugaaccugugaggcugagguugcagugagccaagauugcaccaccgugcuccagccugggugacagagugagacgccaucucaaaaaaauuaaaaaaaaaaaucucauguaccccauaaauauauauaccuaccauauacucacaaaaauuaaaaauaaaaaaaauguaaaagaagggguggugagaagaagggaaggaggaacagaaggggaaagaggaagccaguugguuaauuuaagaauagagccacccccauugccugcccaggcagacccuacucaugcccccaggccauuaccugcacugggaagccaucugugucucccagguggugccaaaggcugccgcucuugugcucugugaguacaguuuagugcaaaacuuuuucaccccuuguuuuuuggcuguauuuaucucuuucaaagcuuuuuaauuuauuuuuaaaacucccgaucauaucaaacacuuacagaugcuuauuuaaaaaaagagaagguaucuucugcuuucuuccccaccucuaccccauucuccuggaccaauuucauucauaguuugacauguaucugaguugcuuuuuguugguguguuuguuuuaccaaucacaaugagaagcacuguuaagaagcuuuuaaaaauggguggaucccuuugugaggguuagcuauguguuguucuaaucuagcauuugggccuguaccccugcaacuguuugguuggccuucauauucccuggagaccacuacuucauguuagcacauucauaucugugccuuaaaguuuaugggcauauuagaguuccccacugaguuuucaucuguagaugaaaggauaccucuaacuuaucuccuggugauccauaaagcaggaaaagacuuucuagaauccuaucaacccaggcugugcaugacaaaacauuuuuacacaaugauuagcaauaacaguacaguuucuagugagaggagacaggacauuuuguuccuacauuccaauaaucuucccccagugccucaucuagcuuaaguaguauuacuaguuaugcucucccauuguaacuucucaaagauaaaguuugaccauuaaaaaauuauuugcugucacauacacaucccacaaauuccuuuggagaaaauguaggcaaucagaauugaaaaguaaguugauguuaucagggauuggguuuuauuuaccuuugacucuucagggucuagcacaaugucuggcccagccccagcacguaguagguuuuuagauuuuugcagcucugacugcuguugaaaaaaccugugugauaaacacaaaacaucaagccaucagaugacucuauuugucuacaagcuuugugagaauauucaccuuguucuuuuuauggguaacuugcguaauaugguuaggaguguuacauuuuauuugauuuuuuuauuuuuugagacagauucucacucuguugcccaggcuggagugcaguggcacgaucuuggcucacagcaaccuccgccucccagguucaagugauucuccugacucagucuccugaguagcugggauuacaggugugcaccaccaugcccugcuaauuuuuguauuuuuaguagagauggguuuuugccauguuggccaggcuggucuugcacuccugaccucaggugaucugccugccucagccuccaaaagugcugggauuacauucaugagccacugcacccggcaggauuguuacauuuuaaaacagcaucucaguauucuccugucccuuuguucagagcagcugucugcuuccagaguucuacaacccagaggccagaaaggcuuagagcaggauguggugggaaugcacuccaacaggaugaggaguucagagaaggcugucuuguucccuuuucgcucucacuagggcuccuugcugcccuggcauuucuccuaugaccccuuccaccauuuccuauccaagcuacugcucuaucgcucccuugugagggagaagguucuagugucaagcucugagacaagugcuucuugugaguucccuuauuuacuccuucuguuauuugcaugucacaggugaaacaaagucucagaaagguuacauccacuuauauuugaaguaucacuccucucagguuuaucugaauuuaaacugugcuuucuaaagaccuuaaagcaucuaaagccaacagcagcaugucucaaaauagugggauuucugacauuuucccaagaccccucucucauaccugguaaacagccaccucacccaccuacauguaaggcuuuccucaauggugacaaugauaauuccacguguucauuauuagcaaauauucucaucauucccagaacuguagggagauggggaauuauauguauauugaaaaacagaacguggauuuugauccugcuauacuuauugguguccucauuaggcagccaagaaaaaagauaaacucacccuagcugugugaccuugggcaaguucuuuagccuuuuugugccucaguuuccucaucugugaaucagagauaauacuaccuaccuuauaggguuguuggauuaaauaaggaggauuaaguaaauauaugcaaaaugccuagaaccaugccuaacauguaagguuuauguaagugcaaagaacacuuuuugucauuauuauuauguuauuaggauaaccaaggaaucacagagaacuugccuuuaggucuccacugucccagacagaaagaacagagaaaguucuagcacccacccccgccccgcaggcccaaauugccagugacugcuuggacuauauucucuaaugauuuuccucacagaaaauucccucgucuucccaacagugaggcaauucagguccccccuggaacaagagugagauugaaggaggagacuugggcccuauauuuuucauccucccuccccccucuacccacuucccuaccauucuacccuucagcaagaaaaaagucuaagcuucccaguaguuugggucuuccauuuucuggucacaaacugcucuucuaaaacagacuaaagcuuaggagauucuauucuucaagaaauuuuuguuuuauuuaaacuggucuaaugguugccccucagucucuccauguccuguaaagaguaggggaucgucacuugcuugucagguccauaaugucaucuuuccuguuucugauuuuuuuucucuaagugucauucuaaaaggccuccccccaggcuccaacuuuccagaaggagaccacaagauccaguacacagucuaugacagagcugagaauaagggcacuugcaaauuucgaguuaaaguaagagguaagaguacugcuuauugguuuuguuucccccucucuuuagaagagcaaagggaaguagguccucaagccagaacucucucaagugccuacuguggugggagacuugccagcuuuagauuagucucuaauaaggcuuggggaagugcccuaucuuaaugccugaauuucacgauacacauccggaugggcgucaguguugccagauuauuuaaggaguucccaggacuagucuuacaggaucccauagcugacuguccuagaagaauauuauucaauaauuuuuccaucccugagcuuagguggccagcugaagccugugaguccaucuacaaccagggugaauaggagcccccuaauuugggccaccaggagaacauguuuuuaguguucuaguaccauugguaugaaagaaaauguuuuuaaggauuauuuuaugccugaugguuugggcaacuaauugcuaaccaucuuuacuccuuacucuucuggacuucacuuccucaucuauaacacuaggggcgaaaccaguugauaucaguggucucauugguauggauggugaccauugcaagacucacucacugaccaaauagucaucccuccucccucacucauuucacaggcugauguagaagccugauugcaaagcugaugccucugcauccucaccuuuucugcuuacucuguggaugggagcucagcacugagaccccucuggacuugugucccuacagucaaacgcuguggcaaacucaaugccccagagaaugguuacaugaagugcuccagcgacggugauaauuauggagccaccugugaguucuccugcaucggcggcuaugagcuccaggguagcccugcccgaguaugucaauccaaccuggcuuggucuggcacggagcccaccugugcagguagguaugccgccccuccagccugcagcagaaccuguaaaccccuugguucuugauuccagugcaagagagguuucccuucauauacuuugagaaguucauggccaucccucuuuaucugaguggaugaacauagucccuagaucccugcugcagcucaucucaucugccauccaucuugccccugccuauccucuaauuuccuuuucauguccucuaaggaagaagcucaagguaggaaccuagggccagccuuuggugacauuaugaaucagcaaaauuugcucuaguuuccuuuguucuagaaauguaaggaucuuauuuauaaagcuaguaaauugccauguagagacaauaucauaccugcuuugcaucacuggcaugaaaguuacauagacuuugggcauuuggaaucuuuccuccuauguaaaaugaagaaaauaauaccucaucuaccucuugaguuguaaggauuaaaugaggucaucuguggaacaguggaauagagcagugccugguacaggcaaagccuuaugccagcucuuauuccugaugaagaaaaauugggcuggguaaugagucugaaacuuggacuagccagaaaauuauguauguaucucuuguuuauagacuucucuuuuucucauuuccuggcacccuuucaucuuuaucacuuucuuuuaauugaagcccccauuuagaguuaagugacagagagacauauauaccaucagcuaaaugccugagauucuucaauuucauguauuaaaguagaaagaacacaccuauuauagacucccuaccuaaggacuucaugcccaccaccuaugaggcuauucugaauugagauaugcuauaaguguaaaauauauaccaauuucaaaaucuuagugugaaaaagaauauaaaguaucuuaauuuuuuauauugauuacauguugaaaugaaauauuuuggauauauuggguuagauaaaacauaaaaucauuucuaccuaucucuuuauauuuuuuauuuguuuguuuguuuguuuguuugagauguagucucucucugucacccaggcuagagugcaguggcgcgaucucgguucacugcaaccucugccucccggguuccagugauucuccugccccagccucccgagcagcugggacuacaggugccugccaccacgccuggcuaauuuuuuguauuuuuaguaaagacgggguuucaccauguuagccaggauggucuugaucuccugaccucgugaucugcacgccucggccucccaaagugcugggauuacagaugugagacacugcgcccggucucuuuacacuuuuuuaaugaggcaacuagaaaauuuaagauuaaauauaguggcuuacauuguauuucucuugaccagagcuauccuagacucugagucccuggggcagggaagagggcaggaaagagggcaggaacuguguaucacucagugugacauccuaguaccuagcauagagcuuggcacauggcaggcacucaguauauaauggcugaaugaaugaaugugugaaugaacaaauacuucaaugcaaaccuaaaaugugaaauaugaaaaccaagauuauaaaucauacauggcaucuacuaguuuuucucuuauuauuucuucucuggggcuaagccuuuugcuugccuaucuauacgacauccuucauugaccuugaacagcuggaauuaguugucauuuauuugcuuaaagggaagaccuauuauaaaaccgccuugucccauguccuguuugccuguguuguuugcucuguggccuuugugccccacauugcuuugucccuucugcaccaaggaggcagacuucagagauucugagccauuccaaagccagccuggccacugcccauucucuuacccuucugccucucugcaccccuuuccccagcagauacuauggugcuuggcccauaugccuuucacauucccaucuguguucaaaaggcuacuuacugcaauuaacugggucugucugucugagagcauuucuuuccuggcuaugaaagcauugucagcccaugcacagagccagcuggaagugauggagaguuagugccccagaagcagcccucagcaaugauggagcaauuguauaaauacuccaguucccuccaguggguuaauucuggagguauguuguauaucaucuccuagaguuccccagugggagugaguuccaaaugcccacagcaaaaacuugcuugauaaccaauugguauuguuuucuuuccuucacugucucacuuccugacauagacagaauaaugguccaccaaagauguccacauccuagucccuggaaccugagaauauguuaccuuacaugaaaaaagggacuuuacagauguaauaaguuaaggauuuugaaaugggaagaguauccugaauuacccagugggcccaauguaaucacaagccuucuuauauaaaggaggcagaacugaugucagagucauagaaagagacgauggaaggagaggucagagagaagagagauuugaagaugcuacacugcugucuuugaagauggaggaagggacuacuagccaaggaaugaauguggccucucgaugcugaaaaagacaagaaaucagauucuccccuagaaccuccaugggagcauagcccugccaacaccuugauuuuagcuccaugagaccaggaucuuuuagauccugaccugcaguaucuaaaagaauaaguuuguauuauguuaagucacuaaguuuauggugauuuguuacagcagcaagaggaagugaauauacuuccguacuccuccacaggcgcuucuugggacugccucccaaauaaacuguuuacacuugaauccuuaucucaggguuuacuucuuacacaaaugguucugugugucaucauaggcucuguugagccagaacaaguggaagguuucugacccauguggccauuucugauuacagccaugaacgucaaugugggugucagaacggcagcugcacuucuggaucaguuuuaugagaaaaggagacuccucauuguguccacacccacagcccgaaaccuccuuuaccggcuccagcuaggaaugcugcaggugaguccucgaggcagggccaaggugagagggagaccuuuaacaggaagggcccagccauuucacuaaaagcaaaggccagauucagugccuaaugcacuuacagugaguuucaggaaguggcacuuuagagcuaccaccauucauuucugguucugggccauaaccugauuaacauugacuccuuagaguuaacccaaucguuuuccaacuaaugagguuugucugucuucaccaauaagucuaauugacaugcuguccaggccuagccacagaacaauugucuuugccaaaccuguccaggauaugccuggcuggaagcaaucaauugguugccugcccacauuuuuccccagggaauuucuuugacucagagggugacagccauuuuuucuuagaaaagugguucucaacgugugauccauggaccggaccagaagcaucagcaucaccugggagcuugauagacaugccaauucucagggccccucccagaccuacugugucagaaucuacacuuuuaacaaaaucuccaggugauuccuaagcacucuaaaguuugagggucacuuuucugggaaauguguccuucucagcuauguaaauuuuguagcuacuaaaugaggcaaccaacaucuuggguguguggggaaggcugacuagaaacuguaaggaucaaacuagaaauugcuugcuuuuguccugaggcugguuugcaaaagaguggccaacuucacugaauacuaaagaggcaggauguaugcugugccauggauacagugcugcacauuuuuuugagacuauuuuauucauuuauuacaguggauagaacuaagugcuuagaacaguauugauuuaaucaaaggcuacaauuuacuucucauaucagcauuaauaaaauggauaauaauaagucucuuuucacucuucccacguacuugaagaauugccuaugaacucugaagagccauauaaaauuuuugugaguucccuugauaggaaccaaauucauugcaucuuuaccccugguccccaccagcuuaccuccccuuguaucuccuuguccaagccaggggcuugcucuucagaaaacacaagcuuauaccucugucuuuugugggaaacuggcauugcaggcuauauuccaugaucaugcauuuccucaucucuucuuauuccauaggaaaaugaauuaagccaaacaacuugcuuuuccucugugucagcaaacuauggugacccauggcuaguuucgguaaauuaacuuuuauuggacacagccacacuaauucauuugugcaugaucuacaacugcuuuugcacuacaaugaugggugaagugguuaggacagaggcaauccaaccuugccaagccugaaguacucucuggcccuuuacagagaaagauugccaucguugcucuagucugucccaucccuucagacacuugcuaacuuaacaacugguuggauaagauauuuuauaucaagauguuuuggugugcccuccuccuccaaauauacuuacauuugcauuuuaaccagagccuucaaagaaagguuugauugacuuaggcauuucagugagaguaauacaaaagucuauuucuaacuuuuuaaacuuuucaaccaguucuguaaccucauauagggacguuucaguggaauuuugguaaaacauauuugauguuuucgucuuucaagacuucaaaauuucuuuucccauuuagccaaauucaucauauuugucuuacauuacuuuuuuuuuuuuuauugccauugccauuccugaugagcccuccucgugguugacugggccacauucccaagguucuugccaagagccagcuuagaggcuuggaaccuuuuauccucuuuuccccugggauuggguguggagggcauagggcaggggaguguggagaguggaaacagggcagagaaguggacucuggaaauagucuucucuccuugcaaagaaaaauuagaauccucugggguggucuuggauacuuuuuaggaaauuugacucacucaaggucucacccugucuggaaauacauagacugcccuuuugcuuagguuuucaaaaucccacugucaagccauaucugaaugauuccucuagcaaagguauuuagguuuuauagccacuaucuuaaccccaauuucucaucuguuuucaggacaguucagagugagcaaauaaacuuccagagacaggccagugcugcuucugucgguuucuaguuugauaaggaugucuuuuuuagccaugcucauacuuccccuguuggguuuucuuuuucccagcaagcacaguguggccuugaucuucgacacaucaccgugguggagcugguggguguguucccgacucucauuggcaggauaggagcaaagauuaugccuccagcccuagcgcugcagcucagguagggggaaguucuguucuuaaaucuuauccccugugaaugcauuuuuaacugauuagguucccugguuucuuucuauucaggauugaguucaggcaaccuucaauguuuaauugcuuuuauucugggaguguuauaaccauacuaaucaguauguugcuguuuguucaaauaaauugugcaguggguaauuaccaguguucuuucuuacucccuccaaccaaccguuuuugcuucauguguguguaugugugugugugguugguggaggaaggaugguuaggagaggagcaccugaagaaaagacuuaagcaaucauggucuuauuagaagagcaugcauccaauuagacuucccaggcuuggucucuuuuuucuccaugcuuccagaacacuuguucauaccuuuauuuuaacaauuauauuuuaguuucauaacccuuacaaaguuggagccauggauuuuagucucugaauaaugauguauuaaagaagcagaauucaacaaccaaaagguaauuucagaauaacccaaauuucuacuugcaucucuugaccacugugaaaucgauaauuaggcuaaagcaaaacuccuuaaaaucuuccuuucucacccagccuuuucucucacacacugcaugggagaguacagaucucuguuuucagggucccaggcugcucccugucucucagggccucaggcaguuacaaacaucucgaacacguggcuuucaggcuucugcaaaaguggggaaagagaguaaaaacucacacugacuccuuuaugcuucacguuggaggugccacaccuugcucacucucuuaguucauuggccagaacuaguuacaugauugcaauucacuuuuaagggaggcugggaaaugcagucuuucuguauugccagaaagaagaaaaugaaaugggacuugguaaacccuaucacaccuguucagaaggcacagaaauuccuugagagguuauaugauagaaacauauccuuagcaaaugaugcuauagauagacacaauagcuucuuucucuaauuucccuguuuuccagcugccuuugacccaucccauguuugauuuguaccacuuuccacccaaaaagauucugccacauuccuaccaagguaaaaaaaaaaaaaaaaaaaaaaaaagaaagaaagaaagaaagaaaaaacucagagggccaggauggaagaaaaauaagaugauucaugaguucucuuuagucggcugaugaauggagaaggcuggguacacucauaugcuuuuguuuuuguuauauuuuacugcauuugcauguagcaccuccccauaccgacuucaguagcagagcuuucaaauauuggcuacucaguaccuagcacaguaccuggcaccauguuggcgcuaaguggaguaaaugacucaaaauuucauugaaacagccuuacuauuuccagaggugauaauagcuuuuaaaaguauauuguauaucuacaguuaguauacaaauacuucaaguugaaguguacaaaacuuaagacagagaguuguguugauaucuaaauauuuauggugaauauuuucaaaguagguuuuaugaagcuguugcuuauuuagaacuacuugcucauauccugugucaaugauuuuuuaaaacuuguugcagaauuuucugaauggucuuuggauugaauguguguguauguguguguguaugucaucuucauaaaaucuugaugugauuuuaaacuguuuaaucuacuugaagaacagaaaaaugugauuaaaaaauacuugucauucagauuguauauauuggggcuaccauagacuucuauaggcugaagauaauuuuuaaauacauuaugucgugguucucaaauuuuuaaccuccaucagaauccccuggagggcuuguuaaaauacguauugcuggagucuacacuguaggcucuaaacuguguuucugauucaguaggucucuggucguacccgagaauuugcauuucucgugagcucccaagagaccacauggugaggaccacuggccuaguuuuuuaccaaagccuuuacaguuugaaauagaauuuuugcccagcagccuucaaggaaagggucaaucacuauuuugcagcuggaugauaguccagguaaaugucauacagaaaugaucacucaggugcauuaccuaauggauucugugucaggccggcaugccuguguuaucaaacauaucagugagaaacaaagagcuuggcagaacuuuuucccuuugaauuggaaagguguuuuuuagacaccuuggagucuagugcagaggaaaaaagaugauuuaggcaaagaaugggaagcaaaagaggagaaggaaaagcauaaugccugcauaauguaaaaauucucuugucuggcuauuuucaaauagcaccaaggccgugauaaaacccuugaagggagucaacagaaagaagagacugggugccugggguugcagggucaccgccuaccuucuuucuuacccucauuucuuuuuuaucuggagguaugaucugauucaugcuuuccagaggaauuuuccagcaaucucaaggaagacagggaccaagaaagccauaguuucuauacccacauuauucuuugagucuacaguguucccuggaagacuuuccaggaagaacuccuuccaaucugacgacagacacauauguaacucaggcauacugucggcaucacaccucauccccgauuuugugugguguuugaucauucauccccaagauuucuguggucuuucggcccuagugggaugcauuccuguggcugcugcuagccugcugauccaaccacucagcucuucccaugacaguuuucccucuuuacauucugugucaaugaaggcacaagacuuacacaggaauguguaugguagcagaugguggcaccguggugguggugguggggguucccauccuagucucacaagcacuauaaaaaaaaugaaugcuccaauuucuuauuggucacccuuucccacaggcuucagccaccacauucccuauuccucuguuuccugagagcucccuguaccagaacuccuccacgcucccaaaagaaaacucaauauccuuccccuuaaagaugcagagcauuuuaucucuucauucacaccuuugcagccuacauucgcguguucagaacucauuaaugcacuuugcagucaucuacuucugagcuccccucuuagcacugcaggaaaccuggcagagguauugucauguccucuuuauuucauuucuagucacugggagugaacuggcaauuuagcuccccacugggauaaaauacaaauuauucccuucuuccucgaaacucccucuuaaaaggcagaaaaaaguaguuuguguucuauguaaugauuuuuuaaccuugaucuguuuguaugaggaaaacauauuuuacuuuaaauccagauggcaguguauauucugccucauacauaaucucaaaauaucuaaacugaaaaaaaaaucuggagaagagacugagugggcucauuuauucauugggcucagcuuaucuguuuguuugcuuucucuagcuauucccaucuaaauauguuuguguugauauaaaaaucauauuuuuuaguuuaaauucuagugugguagagcagaaagaacaccagacacuugaaaccacuucauauucuuuuuuggaauuauuugggguacaaauuaugauuaaucaagucagaauacaugggcuguagaccaagcucaaucccuuauaacucugcaguccugagcuggccacugaacaggccagaacuaucaugcugggaaauuauaucaaucagcuuuaccuagcccagaguuucucagccuuggcacuauugcuaugugggaacagauaauucuuuguuugguggggacaguuggcugugcauugcaagauguuuagcagcauuccuggccucuacccacuaaaugccggucacaucuucacucuccacugugacaaccaaaaauaucuccagacauggccaaauuuccccuggggguggggagcaaaaucaccccuguucauaaucacugacuuuguccuaguguguauguggucgugcaacacuagucagcaaacguggguuuuggguugauuccaaacuuggauugauuccaauuuaauaaaaaaaaucuguuagccuuguaugcaccuuguaccaaacguugguauguggcaccauuguacgccugaagucuuccugacuauaaucuaaaaccaaagcagugcuuuucaaccucucagguacauaccagucaucuggggaucuugauaguaaugcagacacuaauucaguagguuugggguugggcaugagagucuccauuucuagcaaguucucaugugaugcugcugguucaagggucacaguuggaguagacagggucuaaaggaugauucaguccuucauuguaucaaagcuuucucugcacacugucacaguaaggcucugguugauccaccaggacccuugggagucaugguuugacuuagucuccucuuuucuuugucugccacaggcuguugcugcgaaucccacucuacuccuucaguauggugcuaguggauaagcauggcauggacaaagagcgcuaugucucccuggugaugccuguggcccuguucaaccugauugacacuuuucccuugagaaaagaagagaugguccuacaagccgaaaugagccagaccuguaacaccugacaugaugguuccucucuuggcaauuccucuucauugucuacauagugacaugcacacgggaaagccuuaaaaauauccuugauguacagauuuuauuuguaauuuuaaaagucuauuuuauuaugagcuuucuuugcacuuaaaaauuagcaugcugcuuuuuguacuuggaaguguuucaaaaaauuauaugaccauauuuacucuuucuaacuuucuuuacuccaucauggcugcuugauuuuguagagaaauuagaacccauaaccauacacaggcuaucaacauguuauucaaugugacaccuaacucuuuucuauuuuguuuuuuaaguaagacuuuuauuaauaaaacaaaauguuuuggagcaaauuuaguagaacucacuuuguuugucaagcaccagccauacuuguucaguguggucagugguuuuaggauugugauucuuagugguguuuuaagaauggaaaaaauuuaauuagucuuuuuaggagcucugcugagcugggagagagcugagcugucagguguucaaguagccaauuaaagccacaagcugaaaaugaaagaguuaagccuucagucacagucuaaaaccagaggaagcaucaacuucacucuuccauuuuccccugugggacagcacgcuggucaagauucaaguggagcagcacagacguggggucaucuuuauauugagggagucccgaacaaaaggcucuggcaguuuuacggacccuggagucauguggugggguaggaguggaaaaguccugggcacugaggcagagugaaggaaaguaucuucaaauuuuuucccuuuuccuuaccccauaagaucucagcagaggaaccugaagaccucuugcccaaggccucagauaaagggccuagaaaugaaggcacagggcuaggaauguaaauaugugaaagagcaugauuggccagggggucugagucuuugacugcaacaccccacagagacugccauacgcuggcugugcaccaagucugguguguggagggcagcuuucccagugaagccugccagguaaagucuucgucaucgccuaugaucaggccugaaaaaucacacauugguuuuuaaccaguagccagacuccucaauucuccca

SEQ ID NO: 18918 - RNA, 5031 nt, Homo sapiens
ugauuccaagggcccagagcucuggccggcggaccuuuuccuucuggaguuuccccggcgggugugaguuguugcggggucugggggagcugggaggcccgguuugggaaguuuugcaggcaggugcaugagccaucuuucucugaaaguguuuaagaaauguucaagaacagcggccagagucaagaaacugggggaugaaggguuaucucgagacuagacggaaggaaacguaucaggggagggguggaggccagaaggaaggaguuagguaggggcccucucccaagcuggcguuuuugcuggguggaauccuuuugcuagaucccuuggauuuccguuuuccguguguuaucacacuguuggaacugggaagaagagaaaaagaggcaagauuuuggcauuuaguaaguuaagucugaauaccgaguuuucauccgggugcauacguacuuaaaauaccaaauggguccaggaagggggacaaaguacgcuuuaauuuaugagaagaucagcuacuagaaacuguauaucuguuuuucucgaguuuucuucuugcagugcucuuucaaucucauuggacauauuuuauauuauuuuccugcuuaagcacuggggguuggguggaaggaucuguggcucaucauaggcaauuuccacacuuuuaagguuucugacucuucacauaaacaccucucacuaugaugagguccuguaucaaguacaauuaaucuuuguacuuuacaauuuacauagugauuuuuauuuacauuaucauauuuaaacuuaaucaaaguccuuggcacggcccauggaacaagcuccauuuuuuugauaaagaaacugaggcuagaaaaguuucuaugugugcagagaaggaaggugaaauuauuuuaaugcuucaaaguuauauaaugcuuccugccucccuguauuuuucuuuccauugaucuuccuucaaaacccugauaggucuaucccaguuuugcaaguaagaaaacaugggcugugauguagagcuaauacguuuugggguaguggguccucagacuuaggucugucuccaagggucacugacuuuguuuuguuuuguuuguuuuuugucaacagauuaguccuuguggcaccaagucagaauuucauucaaaagacaauuaggaagaugguuuucuauggaaaauauuuaaguguaggucuuaaugugaaagaaagagggagagaaagaaaccccuuuauuauguucucccuuccuuaggcauuuuuugucccgugggaaaaaacuguacuagggacagagaccucuguuaaguuuuagagaaaagggaucuuuuuuuuuuuuauuugagacagagucuugcucugucgcccaggcuggagugcaguggcacgaucucggcucacugcaacuccgccuccuggguucaagcaauucuccugcuucauccucccgaguagcugggauuacaggcgcuggccaccacgcccggcuaauuuuuguauuuuuaguagagaccggguuucaccauguuggccaggcuagucuggaaccccugacuuugugauccgcccgccucggccucccaaagugcugggauuacaggcgugagccaccguuucaggccgagaaaagggauuuaaaaugagaagcuugaaucuuauugaacauaauuguaggacugccagagaggacugguggaugaggaauauggcaagggacaugagaugggaaaaauuaaauaggcugugguuuggaagucucaaagugaaauucaaggugcaaggcucuuaaaaguuaaauccagcgauucgguacauagcuuaggcccuauuaaaugacccagugcuuuaagaacuaucuuuugaaaggaacacuucacacaagcacccucaaaaauaauuagacaccuccccauuucucuguuaaauggugaaagacacccaagacuagaccuaacuacugucacccucuccuggccucuuggcagccaaaaggccacauggcccaggcucuccagcaucacuguguagccgacuuggacaaaaauggacuucuccccauugccacuugcagaucucuucaaagaaucagcagaucugauagugugccccucuucauccccggcaaccacuguuaaaggaaagauugggaaagaucccaccccgccaggagggaggcaaaagccucugacgcuccccuccccccauagcugaccaaggccagggccacugcgggagcaccgcgcguccacgugcacccagcaugcccggucacccuuuauuacguaagagucccaggauggaguuguaccugcugccggccccucuuccccgacggcuaauaauaaacccggguuccuguuucccggccgcggccacuccagauucggggcugaggggcucacucugcaaccaaggcacgugcauucuggucaucccacgcggggagcgcgcgcaaggcccgcccagcccccacaugccagccccacccuccagucgguccggacgccgacgccuuuuugacccucgcugugcccggcccuccucaucuggccugcccagggcuuggugcuggcgggguccagcugcuccaaucccuccuccucugcucugcccugcccugcccuggccugccccggcgcccucccucagcccggguaucaggcgagaggcggagcuggcccggcgcgccccgcccccgcuguagaaagggccgggcgaguguuacucgcggucaucccggccugggccuuuuaucucggugcugccgggggaggcgggaggaggagacaccagggguggcccugagcgccggcgacaccuuuccuggacuauaaauugagcaccugggauggguagggggccaacgcagucaccgccguccgcagucacaguccagccacugaccgcagcagcgcccuugcguagcagccgcuugcagcgagaacacugaauugccaacgagcaggagagucucaaggcgcaagaggaggugggugcccacgccccaucgcugccccggccagcuugguugcuugagcucaggcuuuucggagggagaaguuguggugguggggggacacccuucuccccgcggccguaggugggcgaggaggugggacugcccagccgcggggagccacccaggcgccgucccggacgagcuguagccagagaagggggugcgcgcgggcaagggcgccaggcccccuagcagggugaauaaucuaaucuguucuuucgucuccguguaucaaacaggccagggcucgacccacagagcacccucagccaucgcgaguuuccgggcgccaaagccaggagaagccgcccaucccgcagggccggucugccagcgagacgagaguuggcgagggcggaggagugccgggaaucccgccacaccggcuauagccaggcccccagcgcgggccuuggagagcgcgugaaggcgggcauccccuugacccggccgaccauccccgugccccugcgucccugcgcuccaacguccgcgcggccaccaugaugcaaaucugcgacaccuacaaccagaagcacucgcucuuuaacgccaugaaucgcuucauuggcgccgugaacaacauggaccagacggugauggugcccagcuugcugcgcgacgugccccuggcugaccccggguuagacaacgauguuggcguggagguaggcggcaguggcggcugccuggaggagcgcacgcccccaguccccgacucgggaagcgccaauggcagcuuuuucgcgcccucucgggacauguacagccacuacgugcuucucaaguccauccgcaacgacaucgagugggggguccugcaccagccgccuccaccggcugggagcgaggagggcagugccuggaaguccaaggacauccugguggaccugggccacuuggagggugcggacgccggcgaagaagaccuggaacagcaguuccacuaccaccugcgcgggcugcacacugugcucucgaaacucacgcgcaaagccaacauccucacuaacagauacaagcaggagaucggcuucggcaauuggggccacugaggcguggcgcccguggcugcccagcaccuucuucgacccaucucacccucucucauuccucaaagcuuuuuuuuuuuuuccuggcuggggggcgggaagggcagacugcaaacuggggggcugcguacgugcaggaggcgcgguggggcugcguggaggagggggccacgugugagagagaagaaaaugguggccggagaugggagggcccaaggaaccuccugggagggggccugcauucuauguuggugggaaugggacugggcugacgcccugcauucagccugugccuuuccugggguuucuuuucuguucuuuucggaggagagggcccgagaaggggccauaccagggcgcggcgcuggguugccacacuugggaaagcagcccggagcugggugcuggggaaggcggggcgcguagccucccgccgcccugcgguugggccgguggaggcccaggcguugcuaggauugcaucaguuuuccuguuugcacuauuucuuuuuguaacauuggcccugugugaaguauuucgaaucuccuccuugcucugaaacuucagcgauuccauugugauaagcgcacaaacagcacugucugucgguaaucgguacuacuuuauuaaugauuuucuguuacacuguauaguaguccuauggcacccccaccccaucccuuucgugccacucccguccccacccccaccccaguguguauaagcuggcauuucgccagcuuguacguagcuugccacucagugaaaauaauaacauuauuaugagaaaguggacuuaaccgaaauggaaccaacugacauucuaucguguuguacauagaaugaugaaggguuccacuguuguuguaugucuuaaauuuauuuaaaacuuuuuuuaauccagauguagacuauauucuaaaaaauaaaaaagcaaaugugucaacuaaauuggacaag

SEQ ID NO: 18919 - RNA, 5031 nt, Homo sapiens
cuuguccaauuuaguugacacauuugcuuuuuuauuuuuuagaauauagucuacaucuggauuaaaaaaaguuuuaaauaaauuuaagacauacaacaacaguggaacccuucaucauucuauguacaacacgauagaaugucaguugguuccauuucgguuaaguccacuuucucauaauaauguuauuauuuucacugaguggcaagcuacguacaagcuggcgaaaugccagcuuauacacacugggguggggguggggacgggaguggcacgaaagggauggggugggggugccauaggacuacuauacaguguaacagaaaaucauuaauaaaguaguaccgauuaccgacagacagugcuguuugugcgcuuaucacaauggaaucgcugaaguuucagagcaaggaggagauucgaaauacuucacacagggccaauguuacaaaaagaaauagugcaaacaggaaaacugaugcaauccuagcaacgccugggccuccaccggcccaaccgcagggcggcgggaggcuacgcgccccgccuuccccagcacccagcuccgggcugcuuucccaaguguggcaacccagcgccgcgcccugguauggccccuucucgggcccucuccuccgaaaagaacagaaaagaaaccccaggaaaggcacaggcugaaugcagggcgucagcccagucccauucccaccaacauagaaugcaggcccccucccaggagguuccuugggcccucccaucuccggccaccauuuucuucucucucacacguggcccccuccuccacgcagccccaccgcgccuccugcacguacgcagccccccaguuugcagucugcccuucccgccccccagccaggaaaaaaaaaaaaagcuuugaggaaugagagagggugagaugggucgaagaaggugcugggcagccacgggcgccacgccucaguggccccaauugccgaagccgaucuccugcuuguaucuguuagugaggauguuggcuuugcgcgugaguuucgagagcacagugugcagcccgcgcaggugguaguggaacugcuguuccaggucuucuucgccggcguccgcacccuccaaguggcccagguccaccaggauguccuuggacuuccaggcacugcccuccucgcucccagccgguggaggcggcuggugcaggaccccccacucgaugucguugcggauggacuugagaagcacguaguggcuguacaugucccgagagggcgcgaaaaagcugccauuggcgcuucccgagucggggacugggggcgugcgcuccuccaggcagccgccacugccgccuaccuccacgccaacaucguugucuaacccggggucagccaggggcacgucgcgcagcaagcugggcaccaucaccgucugguccauguuguucacggcgccaaugaagcgauucauggcguuaaagagcgagugcuucugguuguaggugucgcagauuugcaucaugguggccgcgcggacguuggagcgcagggacgcaggggcacggggauggucggccgggucaaggggaugcccgccuucacgcgcucuccaaggcccgcgcugggggccuggcuauagccgguguggcgggauucccggcacuccuccgcccucgccaacucucgucucgcuggcagaccggcccugcgggaugggcggcuucuccuggcuuuggcgcccggaaacucgcgauggcugagggugcucugugggucgagcccuggccuguuugauacacggagacgaaagaacagauuagauuauucacccugcuagggggccuggcgcccuugcccgcgcgcacccccuucucuggcuacagcucguccgggacggcgccuggguggcuccccgcggcugggcagucccaccuccucgcccaccuacggccgcggggagaaggguguccccccaccaccacaacuucucccuccgaaaagccugagcucaagcaaccaagcuggccggggcagcgauggggcgugggcacccaccuccucuugcgccuugagacucuccugcucguuggcaauucaguguucucgcugcaagcggcugcuacgcaagggcgcugcugcggucaguggcuggacugugacugcggacggcggugacugcguuggcccccuacccaucccaggugcucaauuuauaguccaggaaaggugucgccggcgcucagggccaccccuggugucuccuccucccgccucccccggcagcaccgagauaaaaggcccaggccgggaugaccgcgaguaacacucgcccggcccuuucuacagcgggggcggggcgcgccgggccagcuccgccucucgccugauacccgggcugagggagggcgccggggcaggccagggcagggcagggcagagcagaggaggagggauuggagcagcuggaccccgccagcaccaagcccugggcaggccagaugaggagggccgggcacagcgagggucaaaaaggcgucggcguccggaccgacuggaggguggggcuggcaugugggggcugggcgggccuugcgcgcgcuccccgcgugggaugaccagaaugcacgugccuugguugcagagugagccccucagccccgaaucuggaguggccgcggccgggaaacaggaacccggguuuauuauuagccgucggggaagaggggccggcagcagguacaacuccauccugggacucuuacguaauaaagggugaccgggcaugcugggugcacguggacgcgcggugcucccgcaguggcccuggccuuggucagcuauggggggaggggagcgucagaggcuuuugccucccuccuggcggggugggaucuuucccaaucuuuccuuuaacagugguugccggggaugaagaggggcacacuaucagaucugcugauucuuugaagagaucugcaaguggcaauggggagaaguccauuuuuguccaagucggcuacacagugaugcuggagagccugggccauguggccuuuuggcugccaagaggccaggagagggugacaguaguuaggucuagucuugggugucuuucaccauuuaacagagaaauggggaggugucuaauuauuuuugagggugcuugugugaaguguuccuuucaaaagauaguucuuaaagcacugggucauuuaauagggccuaagcuauguaccgaaucgcuggauuuaacuuuuaagagccuugcaccuugaauuucacuuugagacuuccaaaccacagccuauuuaauuuuucccaucucaugucccuugccauauuccucauccaccaguccucucuggcaguccuacaauuauguucaauaagauucaagcuucucauuuuaaaucccuuuucucggccugaaacgguggcucacgccuguaaucccagcacuuugggaggccgaggcgggcggaucacaaagucagggguuccagacuagccuggccaacauggugaaacccggucucuacuaaaaauacaaaaauuagccgggcgugguggccagcgccuguaaucccagcuacucgggaggaugaagcaggagaauugcuugaacccaggaggcggaguugcagugagccgagaucgugccacugcacuccagccugggcgacagagcaagacucugucucaaauaaaaaaaaaaaagaucccuuuucucuaaaacuuaacagaggucucugucccuaguacaguuuuuucccacgggacaaaaaaugccuaaggaagggagaacauaauaaagggguuucuuucucucccucuuucuuucacauuaagaccuacacuuaaauauuuuccauagaaaaccaucuuccuaauugucuuuugaaugaaauucugacuuggugccacaaggacuaaucuguugacaaaaaacaaacaaaacaaaacaaagucagugacccuuggagacagaccuaagucugaggacccacuaccccaaaacguauuagcucuacaucacagcccauguuuucuuacuugcaaaacugggauagaccuaucaggguuuugaaggaagaucaauggaaagaaaaauacagggaggcaggaagcauuauauaacuuugaagcauuaaaauaauuucaccuuccuucucugcacacauagaaacuuuucuagccucaguuucuuuaucaaaaaaauggagcuuguuccaugggccgugccaaggacuuugauuaaguuuaaauaugauaauguaaauaaaaaucacuauguaaauuguaaaguacaaagauuaauuguacuugauacaggaccucaucauagugagagguguuuaugugaagagucagaaaccuuaaaaguguggaaauugccuaugaugagccacagauccuuccacccaacccccagugcuuaagcaggaaaauaauauaaaauauguccaaugagauugaaagagcacugcaagaagaaaacucgagaaaaacagauauacaguuucuaguagcugaucuucucauaaauuaaagcguacuuugucccccuuccuggacccauuugguauuuuaaguacguaugcacccggaugaaaacucgguauucagacuuaacuuacuaaaugccaaaaucuugccucuuuuucucuucuucccaguuccaacagugugauaacacacggaaaacggaaauccaagggaucuagcaaaaggauuccacccagcaaaaacgccagcuugggagagggccccuaccuaacuccuuccuucuggccuccaccccuccccugauacguuuccuuccgucuagucucgagauaacccuucaucccccaguuucuugacucuggccgcuguucuugaacauuucuuaaacacuuucagagaaagauggcucaugcaccugccugcaaaacuucccaaaccgggccucccagcucccccagaccccgcaacaacucacacccgccggggaaacuccagaaggaaaagguccgccggccagagcucugggcccuuggaauca

SEQ ID NO: 18920 - RNA, 125824 nt, Homo sapiens
aagccguggcugcuggguuugaacggaaugcuggagucaguggaagacggagcuggucggcccgaaggucagcgaguuguuuugaguucuccuacccggaagguaggggguggggugggguggggagcagggaguagaggacgccagggcccccgagagaccccgcgucagagcaaaaauuguuugugccccggaacaggcagcucagcggaagccgcgacgggggcgggucacgugcggcgguggcggcgcagcuggcgggggagccgggcugggacaagggccgggccgggcggggguggcgcggggcggcggcucucgcagccgaagguggaaccggcugacucugggcgcugggagcgagcggcuccccgagcccggagcgagggaggagcgcgaguuauggagggaccggugugggagccagggcgcgcggagcuccgcguggugcggcacgggccggacgaggaaucguuggggggcgggggcagggacacggaagcgggcucccggggcgagagcggaaccgacgcggaggcugcgagggcgucugaaccccaagaauggagucgccgcucuuguagucgccggccuuguuuucuucuugcacgcaaaucccggaacgaccggaaccgccauccccgccugcgucccaggggcgccccauuacgcauggcgggggggcccgcggggcuacuccgggaggggauccgugaggccgaggccggggagggcugcgagguggcucgcgggggugcaagccggagcggggcuacacaccacacaaacagccucccuuucccccggaagagcgggcgagggaagacgcgggcuagcucugggggcuccccaggacugugggagccaggcgaggaccgcaaggcggaagggagugcugcagacaaaccaucggccccaccuggaagacauugguggccucguggccgguggugaacggucucacgcuuccccaaaguggcgugcgcuacucuagcgugggagggaaaggacacaaacuuggccaucugccagaacccuugaagacgccugucuuuggugucccuccgccccccgcaguggcccgaaauguacucucccucccguaguccacgagguucagguccgaaaccuggaaaaguaggguagcguggucuggccucggacgggaaacccacccacguucuucugaggugccacgcggggaaggcgcggaacagucuucuugcaaaguuucccgccccucaccccagucgaguaagggcggcucuuccggaggugggggcggggaacggucucguagcggggaguggugcuaguuccucuucccugcgaccgcucgggccgccugcgcguucgcguccccagacgcugcaccccaguuugcugcaacgucugcuuggagucgcgguagcgggugcugcgcggagucuaggacgacgcgagacgccauuugcauccccccucccuccugcagguuggcgagggcggcggugucgcccgccgcggaagcguauuccuggcagugacacugauuagaugcugugucgauacgugcacagaaucggggugggccuucaccucucgugugcgcacacacuuucuguuggaaaaguugcgauauuuuuucucccccucucgccgcacagcugcugucucccgggcggaauuaggcgaccacguuugcucaacccgaaggagagaggaucgcgcgggcgcugggcggccgccgggcccgggccgcgaaaauccagcccuggcuuugcgucgagcugcugagugccgcgcuuacgcgcgcggggccagccggggccugguuuccaucugccccuuuugccuccguguuaaguucgccggggaaaacccaacgauccgugcugagccccucggaggagagcccccgccccaccccacccccagcccgaucccgaccgauggaaaaaaugacaguauaggucagaacaggcugcccgcgaguauuaauauggacggccuccguuccuggugcuuggggaggaugggcgcuucgccaggaaaccgccgaaggaggcgccaugagggccgccugccccuucucgggcuagaaaacguggauucucagagggaccagacaaauguggucagauagcugcaggaacuuaccccaucuaaauacagguugcccguguauauuccaaccaagaucauuuuuguuucaaucuaauacacguugaaucaauuagaaauacugugagaaacuguggucaaacgguagauaggaaacuugcucuuugccuaacauuaaauguaugcucaggaggugcggggcugagcacuaucggcgcagccagucuguguccuaagaagacaggguccccuuugcguuccaccuuccaggaccuuaauagaacgcgaagagaggaauuauuuuaguuguaguuucuauuagaggguugcuuacuccuugcaaacucccgccugggguugucgguaguuaguaguagaugguucugcguuuuggcuuuuacaguccacguuuuucucuuggcuuuuucuuuuccugcguacacgcugcuggguacggggagggggcugcccagacgugugcugccgccgcccucgggcucuuucuugcgcaccacgcggccucggaggaggggaaaugugaacucuccggguggcgcucgagaacuggaauucugauuuagggcugcggguuuguuccggaggcuggcugggagcgucuuguaggggccggaggcugugaaggggaagccccagaggugacccugaggccucagaagcaaaccuggaggcgcccguguucuuugucuuucucggggcuggcagcuuggcacgcacaguuccgauaaggaucuacugagagcuagagcgcacugccagcacauuucagugauuaggcaaacgccgguagccacuuaaggcaaaggccauuugcguuguguuugaaaaggaaaaggcagccucaccuaaugaauuaugggugacccuggagaggccaagcaggggaggccgaggccucccuaggcucuuauuugccgcaacuccuccccuuuuugccagagucgccauuucaaagguaaugggaagccuuuugaaauuagaagucugaccgauucugucuacagaagugguauuugcaucugugcaccaguaaaauguggcccgccagcggcccagggacaaggccugccauacgccagcccugcaccaguguuagaccaaaguacaucccagaggacauggcuuuuggccaacuccuccgagaacugauuuaaagagguggccuucagccaucaaaaaagguguccuggaagaguaggcuggagguccuggaaaccagcgcucuuccccagggcugcagggagagaguggguaauggugccugagcccugacggaacuugcuauuaauccagucuaaaugagcaccauuaaaaaggacucucccuccuauccaccaccacacacacacaagccuuuaugggacggucuaguggagaccuagacaguuugagggcauuuggccuucacuuuucaguggccauacaauagugcccuuuccacccugccaagaccacuggcuccauguaaacuuccaggaacuuuaacccggaacuuuguacucccuacccauccaaagggagugccagaucauaguaacaaacacacguagcauuguacuggaggcagcguucuaagcaccuuauguauggaggcauguuauccucagaacaacccuacgagguagauaauaguauuggucuuauuuuacagaugaggacuccgagguuucgaacuguuaagcgguuugcccaaagccgcacagcuugggauaauagggccuggauugaccagagggagagauagggccuggauugaccagagagagaaauagggcuguguugccucucuagcguuuuguaaugaaagugaucuguuuggggguuguuucgagaggacugccuggaccccaaccuuccaaaggaaaauaugaagagacuagaaggcccaacauuuggccuuuauuuugcaaaagaaaguucuggagagucguacagaggcaucuuacuguggcuccuccgcggcaaggaaggggucagggaaggcaaugcaaaggccccccuggcccaccuagcugcauagcauccggcggucacguccgccggaggugacuggggacuggggacagccgauugccgaggaacuccuuaucgcccagugucagugcucccgggugccggagcuaaacguccgccugcgggggcggcuaguucacaccaguccccuggcucccgacgcgcccccgggcuucucccgcggagcuggcuagaugcccggcggcggcuccgaagcuccgggcuccccgccgcuugucccgccagcccgaggcauggagccccacggcccaggacuggagagcccaguucgucaguccagguugggacugcugguuccggguugcucacgaucacucuccccucaacacccguccggccagggcgcgcgcgcagacacauaaacacacacggcuuccaagcgcgcagcccgccucccgggccuccgcuuuuccuuccuccuccccgcucgggcgcuucggaagcccguggcgguugugugcugcgccagggaagaguccgggucggggagaccgcgcugcccucuuuccccccaaggucugcgcgcacgcuaguauccuuaggaagcacagucaggcuuguggguucccaucuucccgggaaaugacggcugcuggcgaggaccuguucgcuccguguuucgcaauggcccggggaucagaggagaggaccgggcgguggggccugcgcguggaugaggguggcgguaaauccccucucccgcgaagguggcugagccuccggccaccgcuaguaguagucuacccugcucgucuugcauuggccgcagcuugacuccccugcgugccgcgggucgguguggguguccccacucccucaagccuuuacuuucagcucgcgaaaccccauggauccgcggcugggcugggcagcgcagacgcccagcugcccucgccaaccccaggcccagagggggccaggcuggccugggggcugggcggcccggcugcacuugccggcguugagagaggcucugugagccggagccggccgccgagccgagggagagagcgcaucagcccgcgcgccuuaaggcagaacacacgccuuucccggaaccuugaaacccaggggagccgcugccaucuucgcgugacgagcagcgagacgccggugauuaaguguuucuuuccggcucccucuccggguugcggcucuccuccuuuccacagggcuggaagaauaaaaaccuggggaaaaaccacacacaacugcgcucuggucucgcucgccauguccgcacugguuucuuagggugcgcccacgcggggcacccccugcuccccuacuccacgccuggccggggucgagggcugcgugccucgguuuccauccgcucuagcgcaaaucucggaguuuaauggggagggggcacacauugcugaagccacccgacccccauucuccuuacgccccccccccauggggauuaaaccuaaacacaugaaucccccacccauacccgggacuaauccagccgcgccuccugggauuaacucggcucacagguccauaaaacacuuccggcgcggccagagggucugucugcagaaacacuuuaaaauuguccucccgggccuggagucggaauugacuggguggagggaagugaguaaacagacaguuguaagagacaauccgugagguuugcaggcugugaaaagagcugcuuaaaauaugggcugucgggguugccuccagcaggaggguggcccggguccuagcagacagauccaagaaaaggaugcaauauauucuaaaugacauugaccuggaggaaggaggguguaggcaggagcaggcuggcuucacauggcuucuggcuccaguucagugaggaagacuagcuuccagaaauuugugggggcgaguggccagucucuucauguguaaaaucagaacaguaacaccuacucugucccccucggauggguuucugaggaccaaaaugugaaggcacuuuguaaaugcggcucaacccuucugcuucacugugguuaauguucagucucucuuagguagaaaaaccagugacuugcugauuagaaaacaaaguagaaaucagcccuuucucaaaucuacgcaacaauguucgagauaaagggaacccaaaagcaaccuaauauuuugaaccuccuuuuacaucauuucgagauaaguuucugaaguaaugagagaaucuuuggaauguucuaagaaaaucugucaaaaacuggagguuaauggggaagaaagggaggcuuuaaauugggucaaaucacauuuuaagaaggcugggcgcgguggcucacgcuuguaauccuagcacuuugggaggcgagauggguggaucacgugaggucaggaguucgagaccagccuggccaacauggcgaaaccccgucucuaguaaaaauacaaaaaauuagccgggcaagguggcgggcgccuguaaucccagcuacuggggaggcugaggcagaauugcuugaacccgguaggcagagguugcagugagccgagaucgugccacuucacuccagccugggcaaaagagcgaaacuccgucucaaaaaaaaaaaaaccaaaaccaaaacaaaaccggaagaagaauauaaauuuauaguagcuuccuggcuauauccccuucuguuagucugcagaagagaugcccguugguagccauucccccagccccaggaccgaaggacgucuugacucaggcuuggucugcuaggugcaagguguuguuggcgucugggguggggacagugaagaaaggcgaucauuuugcuuuaaaugaacaucagaagacccaggccugcuacugcgucuugaaggccuggaguuguuaaaacucugugggagggggugccucgugaccuccuuccucgcagaugggcucaggcagcgugaccggccccagguggugcccaggcgcgcuggggauggaggcccaggcugcgcguucacccugccucgcagauagcgaguaggggccuccggcuggaccgcccaccggccuuacucucccuucccuggccuuggggccuuggaccaggguuaacccuggucccgucuccaccucauugccccccgugcagcgccguccccgcccuggcucccggcccagaucccgaggccucccucgcccagcagucucgguucuucccccucgugauucauuuagcagcggugcagaaagccuguuuaccuccgcagcccugggcgacucgaucugcguaaaaagccccaacgccagcuccgaccaguaggggggggauuguccuauagauuauuucuccuccugguuuuuguuuuuguuuuuuuuuaaaccagaaggcuugguugaagagggggugggguggcguguugcugcuguuuuuuaaaacaccguauuugaaagagaaacaaaagccacacaaaagccguuuaggagguaccaagacuguuuuuacauauaaaaagugcagcgaauaccaaggggcccccaacagugauaaacuaaaugguuggccgauuucgacaauuaacaguuaaucuguuaucugcgaucagcaaacaaguuuugaggcucgaaggacaccgaauuccuguuccagucgauagcguuguacucgaaucuguugagcacaucagaugcucccuguuucuccuagagcgaauccagcuuuagcaaacauggguuucccagguugaaggaccgacuugagccagagaaaauucucuugugcagcugaggagccucugucugcaucgccccucgagcccgagcucaucuguuugguuuagauuucuccaaauugguuuucaccccgauuucgcggaccuccuaauuuugcacguaauaggccuccgauaaauguguacugaauggcagaaacuaaagugaggcccucggccuggaagacggccugacgcacggccucgcccuuggaaccccacucggguucccagagcccccaggccgcugcagccugcgcgcagcuucgcccugcgccggccagggcgggcgggcgggggaggccaggaggcacgaagcgccuggagccugcacgaugauaaauauugcgcagacagcccauaaauaauuugcauuauguucagcugacaacgcggggcgauuaauuuuaauagcuacauauuugccugggcugcugcuuucguaggccccguaaugaaaggcgagaggccgcccuggcuccgugcucgcgguccaggaaggcagccgggggugcgggaaggcccgauguggcgucuccuccaggcagccccccggggagccccagccccuuggccccccucucgcccuccgugccuuguggaggugaggugugcgcgcaccgccggagcacccccgaggccucgagcaacaggagccaccauaaugacacugcacauuugucuguguggggagagccacuuguggacugggagacccuccacguagcuuugugccccacccggaccaaguccggaguuucagguuccacuuaggcuaggagggggguguuugccgccgccaauucgccagugggccccagcucggccgaggcuucuccgcccucccggcagaggcaagagacaaaacaaagcccggcuguccccgcguccucuccgcgcguguaggguccugaguucugccucccaggagcuguccggcgcuccgcggaaggccccccuaaaaugcuuccugagcuccuugaugcaaaaggaccgcacacauaaaggacggaagaaaagaaagggucuggaggagcucuuuaaaagagggggcagggaaggaagcgcagcgaggaaggacgcggcugccgcggucccgugguggccgggugcgcgcgugugcgugucugugugugcguuccgaugacaaagccccgccgccgccagcaagcuccuggcugccagagcucuggugggggaggggaaagggaggagaggagccagcgcuagcguagguagcggggaaucgaagcuucccaggagaaagaguucauucaugagcuguaggaggccucgcggcccggccagguggagccuccugaagccaacaccuguguauuuuccuuuuuggaaacaggcgagcccaucgaucauuaccauauuuuaauugccuuucgcaaaggucaucucuaauuauggguugcgaggaggguuggucaggaguccguggcccuuuauuaucugugugggugugugugugucgccgcagagacaaugcgcccagcucuuauagaaaugccaauccgaggguguccgugcgcgccugcgaggcggucacgacgugcuggauccacgcagaccaggcugcgugcacaauaaaagccgagcaggcggcugagggccgcgcagacccacggguuuucuuuuuagaaacaguggugcgaagagacuugacaauaauaacacgcagcaggauuaaaucagggcgggaauaaggaaauguauuuucguuucuagaaccgcggacuguguuuaacccauccgauccuccccuccccagagcauuuugugcacacguggaguuccgcgcagggacaggcgccgggcacagaguggcuugggacugcccgaugacguuccagggcagccacguuacguucauauuaaucucuucccuuaauucggcaugguugucaguuacagugacgugaaacagccuuaacgaugucuguuuuaugggaaacaauaccuggcuaguugaaaaagagaaagcaaacguugagguuuuuuaacuuuugaaaguuugcauuuccuuaguuuuuaucacugucagaaacccuuguggcaaaagccuauuuuaacuuccuccgagggagaagagcaguggagaagguagauggagggucagggguucuugggaggauauuuuggagauggagggagguggagaucagugaagagcugugagucagggguggucagcagccacucugaacuugauuuucucaaaggagccuggcacuucugagccccgaugcuguuucugguaguccagccugacaaagucagaggcuggggucaggagccucagagaguuggagaguuuuguacugguccugcuuccugccugcccccacaccuggccuccuggccucaccagcagccagcucugcccugaggaaggcagagccagaugacugguccaaccccccagagaccgccuggcuuucuccuccccuguaaucauaaccagaugcacuuaagcgccuuucaucagaggaagcccaaagcccuuuaacaggcuucaauaaaagccuuuugagggccuaccagccugcucagcguuggggccccugugcccacuuuccaccugagccagccuggggcugcagucagggucuagccucuccccuggggccccagaagccaaggaaguuuacucaacuaaggcaaccucuccaagcagguagggugccaagauuccugccagguguguggguucagaccucauuaacaggaggaaagaaaggcaugggagggaagccagcagcuagugucugucuuaaggaaggacaagaaggagcagccuaugagaaggaaccagaggggcuaggaaauagagccggggugaaggggcagugaugauggagauguucacaaagacucccaugguacuuccaccaacccgaauucagaggucagagcugcugucccacuguguugcagucugucucccuuacuaaacugugaacucccuaaggggagggacugucuuauucaccuuugcaggcccggcccgggaccuggcacaaaauaaguaaucaagaugggagaucacaagcuacgauggaaaacucuggaucaagaugcauacgggcuuaagaugggagcucugcccccagugguuguguagccuaucugagccucaguuuccuuaucuacaaaauggguaugagaaugccuacaucaaaaaauuggagaaagauccgaugaaguaguugcaggugaagcaccaggaagaugauaauaaaguuuuuaauaaauacugugcccuagcugggugugguggcucaggccuguaauccuagcuacucgggaggcagaggugggaggaucacuugagcccaggaggucaaggcugcagugagcugagauugugccacuaagugacagagugagacucucucaaacaaagcaaaacuagauagauagauagauagauagauaaucucaugcccuugcucuugaaggagugaagagaggauuuggacugauauuguuugaauuguaaguaggaagguuuguguuacacccuagcuaggcacaggucucucuggccugggauuuggaucagaagaaggaauuguuucuaaacugugugaauuggagccacaggaccccacugcacuguccaacagggcaagcagcuccaaagcugugaacuugggaagccaagccagccuuggucucaggcucuggggaaggggcagguccuagacccuuggacucuccugcacagggcugguuguggcuggggccuaguugugcacugcggaccaggcugcuggagaugaguggcuggcagauaaucccaguuggugcuggcuuucuguggucaagaggagaacugccccuucagcuuugaccucugcuccaguaaucauggcuguauuuuauuuuuggcggguucauccucuggcauuuggcagggcggggaggggaagcgggguugccugcgucucuuugcuauuccuucuggucugcucaguagcuccccaccucucaucccccaccccaccccacacaauguggccugguuuucuccccauugcaagcugcuuuaucauuuuugccuguucccuggcugcucugcuuguuugagaguggggguaagaccugggcucuccccauuccccuccucgguccaucacauuccagaugucuuucagccccuccucccaucucccugagcuuggcacuuccccaggagggcagccugagggucaggguccaugggccgccugggcaucaggggccugugagugccuggcucagagaaggaggaaauggugggggacagaggccagcugcacugcugcacauuccuagcuuugugaauggaagcucauggcauuuggugugugacacaagucugguagucggggucagaaugaaaaggugugggauuuguaggggaauugggaagaaaaugaaguaagcuaacacuucuugcauaauucaucccucccuaucccugagaugagcacccuccaggagaggcaagaaaaacaagagagaagagaagagaagggagagcaaaaccagccugguggaaaugcuuugccccucucccuuccugccuagggaacuggcucccuugugcagccaauguaggucaggaggggacaauaguuaggguccuuuacccagauccucuagggaaaaugugagaucagauuugaggaagacacaggucacuguccuacagggauuucagaaagaauaagacacugcguuaucaaaggugggggauuuggguuaugaucagaaauuuccuuaaaaaaaauuuccugccugucacacuuuuguuuuuaacccaguucaccuucuuccauggauuuagcaauaaguuaugaaauugaucucuuccccuauagcaugucagcuacaagggagcucagaagcaauuuaauucugcuccuggaaucuguggguccagaauuugguggacucaacagcuggaggcuggaagcauccggaggggucuuuacuuuaugucuggcuguuggcugggaccucagcugugucccauagcaugagcacagggcucucuauguggcaugggcuuccucacaguauggugccuugaggguaauaggacuuuaaguuacaaaucggcagcucagggcuccagaaaaccagcauugcaguaaauaaggcugaagcugcaucaccuuuuuuuuuuuuuuuucugagauggagucuugcucugucgcccaggcuggagugcaguggcaccaucucggcucaccgcaaccuccgccuuccagguucaagagauucuccugccucaaccuccugaguagcuggaauuacaggcaugcaccaccaugcucggcuaauuuuuguauucuuaguagagacgggguuuuagcauguuggucaggcuguucucaaacuccugaccucaggugaucugccugccucggccucccaaagugcugggauuacaggcgugagccaccgugccuggcccgcugcaucaccuuuucuaauccacccuugaagucuauauucauugguugcgauuguggucacaaacccauccagauucaaggggaagggacagagauccuacuuccacuugggaggagugucaaagaacuuguggccaugguggggugggggugggggugggaaggugguaggggaagccauaccaggcaccuuugagagcuaagcuuaauuagcaguagcucuaaacagacuagucuacauuguaauagggguuucuacccucaagaggccucauaaauuauaugggggcagggggacucagagagcuaaaauuaggccaggguaaaagaaauagagccuauaaagcaaauauggauuuuaggaaaaauagaaaauauaucaagacagcugucucuaugaucuuguccaaugugggaaggacugagggagaacugaguggugggaucagauggguuuuaggcucuucugcauugaaagggaagcagguaaaagauuagcauucuaucugccgccauccuuagccuacugucuuggggaagaucuaguaacccuucaucgcucccaacaacauuauuuucacuauugccuuauaagucaccgcccccucuaccaccaguauacagcuaucuuuauaugguacaaagcuaggaauguagucaaugcauuuccuguaguguguauggaaaaacaauuaauacuuacuauuugugcccucccugaggugugguuuuaaauauccagcauggauaguguugugacugaaagggccuggguacaucucuagggccccagguucccauuauccuugucucuaaccccugaauggagaguuugacuucuaauuucaugcuagagguuucacgggcauaauuguauuugccucugccuuugaucugcuauuugaucugcuaguuuauuguggguucgacuaggagacacagauagaaacgugguggaaaacaugauuuuguuuugcuugggaauuggcaguuauuauuuucuauggcucccuuaacaugacacaucuucccuaaauccaaaaucuaaucauuuucccauuuuugaaaauccaaaaggcauguguacccucuggccugcuuuccucuccccuccugaagauuucauuuucaguaagacuuuggaggcaugacguucagauuuuagaccucagugcagauuggagccccgaauuaguguaauacaccugggugaacucugccacaccugccccuuuccugaccucaccacggcuucccaggauguaucugguucacccuagccucccuugaggugauuuugggucugcagggccaacuccuauccugagacccaaacaaagaaacccagauucagcaggugggucagaacuaagcgacauucaggggauggcccuugaaauaagcuggcuucucaggcagggucacuguauuacauuguacaguuuguguacugcacaaagguccccagccaaaacacagaauaggcuacuggcagcucuguucucagggcaaaggagaaagagauuaugucucugauccagaagaaaagagaaggugacacaggacagauagaggucaaaaggguuucuugggagcacacuggaucagccuaagacuggaccaagccaguguugacccagcauguuggcgcgguaggccuauauacacucucuuuguuuuguuaccucucaucugcaggcacugguucguaaguuauugggucccuccuaggccuuauuuggagugugggugggagaaggacaggagugucacccuacuuaugugucuuguuuagccagcaagaugggauuuguuucuugggcagagggaguuucuuugguuuaugaauaugaagauuuuaaggcauauuguucacugcagaccguuauguacuugauguagguguuugagugcaagacccuaacagggcuaggcgcgguggcucaugccuguaaucccagcacuuugggaggccgaggcgggcggaucacgaggucaggagauccagaccauccaggcuaacacggugaaaccccaucucuacuaaaaauacaaaaaauuagcugggcgugauggcgggcgccuguagucccagcuacccgggaggcuggggcaggagaauggcgugaacccaggaggcggagcuugcagugagcccagauugcaccacugcacucuccagccugggcuacagagcgagacucagucucaaaaaaaaaaaaaaaaaaaaaaaggggagaaucggccugguuucuggcucacaccuguaaucccagcacuuugggaggccgaggcgggcggaucacgaggucagggguuugagacuagccugaccaacguggugaaaccccuucucuacuaaaaauacaaaaauuagccgggcaugguggcgcuaaucccagcuacucaggaggcugaggcaggagaaucgcuugaaccuggcaggcggagguugcagugagccaagaucgcgccacuucacuccagccugggcgacagagugagacgacgucucaaaaaaacccaaaaaacaaaaaaaaaccccaaaaaacaaaaaaacaaaaauuagccgggcaugguggcaugaaccuguagucccagcuacucuggaggcugaggugggagaaucgcuccagcccgagagccagaggucaaggcugcagugagcccagaucgcaccacugcacuucgaccugggcaacagagacagacccugucucaaaaaauauguaaauaaauaaaaauuaaaaaaaaaaaauaaaaaaggccgaguucggugacucacgccuguaaucccaacacuuuaggaggccgaggugggcagauugccugagcucaggaguucgcgaccagccugggcaacauggugaaaccccgucucuacuaaaauacaaaaaaaaaaaaaaaaauuagccgggcguggcggagugugccuguagucccagcuacugaggaggcugaggcaggagaauuguuugaaccugggagguggagguugcaguaagccgagauugugccacugcacuccagccugggcgagagagcgagacaccaucuaaaaaaaaaaaaaaaaaaaaaaaguagaggaucaucugaagaaagaaauuccaaucaaaauuaaacaacuccaaaaaggaacuuuucuagugucaguaaugggcugguugaggaggucuuugggagccuucuuuuuauugauugacugauuuuuuuuuuuuuuuuuugagacagggucucgcucugucgcgccgcugcacuccagcccagccugggugacagagugagacuacaucucaaagaaaaaaaagaaaaaguaauccggccgggcgugguggcucaugccuguaaucccagcacucugggaggccgaggcggguggaucacgaggucaggagauggagaccauccuggcuaacacagugaaacccugucucuacuaaaaaaaaaauacacaaaauuagccggguguaguggcgggcgccuguagucccagcuacucgagaggcugaggcaggagaauggcgugaauccgggaggcggagcuugcagugagccgagaucgcgccacugcgcuccagcacuccagccugggcgacagagccagacuccgucucaaaaaaaaaaaaaaguaauccaugucaaccaucugaugguggagggggauuucagaucucuguaccauacuuucccuucuccauucuuaccauagcacuagagcacaaugccuuacuaaauucauauccaguguuuacuuuguaaccacauauauaucauucauugcugagccaaaugagcuucagugauugcaguuccuuucuuguaagauuuuuuuuuccuggaguuaauaauugccucauuuuuauauuugccuaauuuucuuugaccuaugacuacuuuucccauacuuuccaaccucuguacaauuaaucugaggacaauuuucugcauguccaaaucuugaagaccaucugcaaaugggcugaucuuuuuuugcuuuguguuucuuuuuuuaaucccuauuuucuuuaaaucugaaaacuuuuucaaaaaguuuccaaucuuccauuuaguuuuauuuucuaaaacuuuuggccgggcgcgguggcucacgccuguaaucccagcaauuugggaggccgaggcggguggaucacgaggucaggagaucgagaccauccuggcuaacacggugaaaccccgucucuacuaaaaauacaaaaaaaaaauuagccgggcgcguuggcaggcgccuguagucccagcuacucgggaggccgaggcaggaaaauggcgugaaccugggagccagagcuugcagugagcggagaucgcgccagugcacuccaaccuggacgacagagcgagacucugucucaaaaaacaaaaaacaaacaaaaaaaacacuuuuaugaaaugcggugggaguuuuuacugauuucaaaugggguauuguguuuuggugggaaauugugucugucccacccagcuaaugucaagagcugagaaauuaauccagaguuucugauauuugauauuuugcuugguugaaauaaacuuucaucauuuuuccuaaacaacaacuuuucagaaguaaugacuguuagccccgggaaccguggaaauauucaguauuaguaaaucuuuacccuccccucccccccgaacugauucuacauuuuuagaaauaaagauuauuuuuaaaauaauuggccuuuacccaggccauuuacugcaagauucaugcccuuuauuuacguucaccucacggugccuuuuauuuguguucagucauuuacaagucugccuuuccaacuagauuguaaauuacuugagggggccaaaggugucuuuuaaaaauucacuucuguacuuuuggaucccccuagguccuaacacagcgccucgcccuuagcaagcgcuccauaaaugcauguuaaauucaaaaaguggacaaauaaaguuccaguguucuccaaucaggagcccuaaaccgugguaacucucaaauccucucuggccucaacagcgcccugugaacgguggguaggccucgccccccacccccagcugccucggcagguugccucuggggacagaguucuggggugcgcgggagaagcgauaacacguugaccaucgcgggaguccgggaaccagaggucguuucucaggauuaaaauccgcuccagcguuucgaggaggggcgacacuacaggccacgcuuucaccagggacggccgccccaucguccccgaccugggucagcguggcccgcagcggggaggggggccucgggagggagcgccccccggcagcccgggaacgcccgcgcggcagccccggcccagccugcggcuccgcgguccuaccgccgggggcagcgccgccugcgcagccgggccaagauggcggccggugcgcagccgcccgcguccgggggagaagcggcgacagccccgugucagccggggcgcgcgcugucccagggcgcgaagccgcuccuccuuuacccacggggaccccgagggccaguccugccacuucguccugacaggcccccugcccggagcccuaccuggacgggccccggcugggaucgggacggccaggaggauggccgccuggcuagacaugguggacaggggaccagcggggaccacugggugccagccccacacccaagccauuucuuccagcccugggacaccucuggugcgcaauucgacauuaguaaccgcagguagggcuucaugccccguaaaaacacagggcucaaagcacuugaaaucaggaaugucuuggaaaaucugcuacuucugguugugaaauccacgguauucucuaguaaaggcaguaaaggcuacagaauaugugcgguuccucacauuugcugugacaucgguaugcgcgcaguguaggcugccugccuccuaggacacuccaaaaccugagguccaauuuaccagaaauggcauugaugaaugcggugcauucugagugaucucccgcugggcucagguugggaggucagaagggcccccaaagggagcagcuaaugcagguagaaucacaaugguagaaacagagaaguacccagaaacgguuccccauuacccuuuguaaacuggguugacaccucccacugguucaagguuccaaccaaaguuugcauguuguuuaucagcucagcuugagaggcagaaugugaacuuuuugguuuuguuuuggugaaauagucuuucugcauaacauuugcaccggcuuguuauucuuauggaaaacacuuccuccaccuacccugggcagcagccacaccagccuuuacuuccuucugcaggcccucuuaauuaccucucucuugcuccaguuuaggcagcccccggcacuuuguucaaguacagcaauaaacccaagacugggccuaauccucugugguccugaccuuccccacagcgggccuggagucuggagggccuggagucuggagggccuuccugcuccccugauuagggccaaggacgcagcuugauguguuuuguguuuucuccccucugcacacuugguacuuuucagagugcuucacuaaaaaaucagauacaagaaaaaguucacaucagcccuuuggagccaggccuccgugagcuggggucaccccaccaccaagccaaccauucgacuucuaaacuguagccagggccaauggguuaccgcugaccuuuugcacaccgaauuccucuccuagcguuagcucggguggccagggagccucagcugcacccaccuccugcccgguccagucccgaugccccucgcgggaagcgcgguaaccuuaaacggcacgacaggcggcuggccgagcugguucggugacgacucccuggagacagcggcuucgagcagcaggccccaucugcagcgcagcugaacgaguuaagcugccccaggcgugagcguaccaggcuggggccuggacaggagagaaccggcggggggccccggggcgccuaagcccuaggauuuccaaguugcagggggaaaggugaaccugacuccccucccgaagggcugcguggggggcucagaagacuccugucagggguuggggaggcgccucgaagcggggcccagagugaggcugcugaaagggggccugggggguaggcggugcgcccucgaggccaccuggucaguaaaggcgcuucugugcuguacaagcaagacagcaguuguagcacccgacccucgggcuccaguggcccacggugcaggcgggcaggggaagaguggcucugcgcgcagccccgggugcccuaaggucaccuccucauccccugccgcugcugugccgccccagcccuacccccgccccgaaaaaacccggccgcgcgggccagagccuaagcugcacgggcuccugaccccggcucgccaggcucagcccaguccgaccccgccucggcuucacaaaggccacgugcggccagggccgacaaggaacgaccacgacucucagaucuuuaauuacgcuaggagucccuacccuuccccccaacccaucgccggcuuccagcccuuuaaucaauuucacgauauuaaauauuaauuuccugccagccacgguuucucggaggagggggaggggaugggcagggcagcuccgaggcuggaauggcuuugcagggugugaccacgacagcagggcgcggaggacgcgcggauuccuaagugagcugugcccagaacucggagccacuggguuuucgcucuguagcuggggaacuuggagaguuaugagcgccugggugcaggccuccaggaggggcagcgaggugcgcggagaguccgggugugcugggcgaccgccuccugcuccgcgcgcccccccuccccaccccagccgcgagucagccucacgcgggcccgcggcgcgcugcgaugauggaucgcgccuggcgggggugauuugguguugaucgcacauuaucacuggcagguuggacugguugcugauggacgacuucuagcggcggcggcagcagcgucuucagacaccgcgcugggacucgcucgcucggcgagggucuuucccccccccacacccccucccuacuuccaggcgccaggagggccugagaguccgaguggggucuccucgcguccaaggccgcccgcucccgucuggguccgggugugggcuguuggcugggugaggagaggagccaggacgccucucccacuuccucccacuccuccuucccuugccgccugcuccccacccccuuccugcuuccccaccgaaacccggaggcccugggucacuccgcgggugauauccacgccgccugacccuggccgcgggggugcggacuccucugcuccgcagcccccgacccucucccccggucgcagcagccgcggcacugcggugcgccccuucucgccucuuuuucuaaagugccugcagauacaaaagcgguuucguaaugccuuccgucugcgagagccggaggaccuuggcugaccuuucggaaacugauugcaacugccuguuaacagcccguacugaccgcacugagcggagcggaggacaaucauuuaagugacagacggcgagguggccccggcucagucgagcggccugguuaagcccgccccgccccucccccgacccccuccccucccgcagcuacucccccagccccgggcgcacugcgggccgcggcgggcgcucgggcaggcggagaggacgcgcgcgcgcgugcgugugugugugugcgcgcguguccacgauuaccggccgacggguuaacccuuugccgagcagccggucccuuugaggccgggugcugccggauuaaucugccaucugcaaaagaggaauaacagggccgucuccgccgacuuucccuaauggguaaacuguacccuguuagcgugacccacgcugcgucccugcugcugccagggaaagauccggacccuuggcucuucugccgcggcccuggguccccucccugcacugcccuuccucugcacagacacagacacaaggaacagcacgagggguccaaaggcucccaggggcucgcggugcaguggacguggguguucccgguguuuucuauuuuggaaacuggagaaagguggggugggggggacguagagaaaagccgaggugggggaggggaggcuggugacagggcaccucgggcuucgcucgcucccucucucgggagagaucgccagcugcucuccaacaggcagcgcccugaaaucuauuuaaagagagggaaaggggaggagaacaaagggggaggagggggacggcgagcggagccugggcgagagcgagcgagcagggaggauccgccgcuccgcgggcacaucaagcgcucacaucuguacacuccgcgaucgauggggagaauggauaauauuugucagcugcagaccuuucucuucccgguuccuggggaggggagggggcgaggagggggaggggcgggcaggccaggcgagagaggccgccucaaggacagcgcgcuucccgcugcagccacacggaaacccagagccaugaaagccgggggauuuuucucuuauuaucauuauuaauuauuuuuuauuauuccagagcagccagcgaacgcucgguggcgccccucccccgccgccucccuuuguugauucucagcugcuagagcggcgggcccgagccgccaccgccgcagagcacgaucugcucuugcgcccucggucgcagcugcggcccaggaagccggggcugcguccccgcccccugccccccacggcgcggcagcccucgcacccccuccucgccucccgccacgaggccagcccugccucuccacugccucucgcugcggcuccgaguccccaacgcagagcagaggcacuggcugcugcggccccgagccuccggccgcgcgggggccuuugccacccccuaacccccgcggcugcacucugaugccgccguccucacacauggucuucauuuugcacacuagcggcgugcuuccucucagcuccucuccucggggcuuuucggagcgaggagggagguuuagaggaaguuagaaacccagcgagcccaggggaaagggggaaaacccucgcucuuagucucagcuuccgaggcagagggagcgccccgcgggggguggggcagagucugggugcccuccccuuccuuggaugcaggaaagguuaagugagggguggcggucggaggagcgacagauuugcuuuugcucauccacaugccugcucagaccggccuggguaucacugacccggcacucucggaacggcagaacccggaugggagcagauccgccaagcggucaucaaacaagaccaaagacauuucagcugucccccacccucgggccuugggcgagggugggggugcccccugggucuuugcuuccucgcgcaccccaagguuggaaggccaaagccgacgccucacagaccggggguccgggcccccucucuagggcggaggugugcagaaagcucuagugcgaguuuacuugcggccuggcuacccccuccccccgccgcuguccugcgauuccgggccagccugcggcggcguccccgacugcuccgcgguccugggcagggcaggaagcuggcacggccgacggcugggcaggcgccacuuggccgggcaggcugcucgcuggaacucgcgcggcaccuucgcgccgaaucggguuccugggucuccagcccggucacccugagcgguuucaccccccacuuugaccaucggccucccgcggaagucucccugucuccucccgcccucucggcuuuucccuuccucauucugucucgggagcuccuuaaugcagucaaccgccuuucccgagauucaaaaagaaguuuuguguuuccccgggggcagccgccuaaugcuucccuuguuuuccggaacaaagcagacauucagugaggagggggcaggcgcugacucccuccccuccccgcagcaccccgcacuccugcagauucagaacgcuggcuccggggcccggguggccugggggugggguggggacccccuuccccuaggcuuggccacaaaagccucgcccgguagccggagagaaagcggcgugguguuugggugagguucccagcccgggcggggagggcgugcacgcggcuguuuacagugugccugugcugcuggaagcucacccgccgccgcuugacagcguggggcacccgcuggcugccagcucagaggagaugcgcagcggcgagcccuccagcacuccacccgaggccuccgcagcgccagggccagggcgcgcugggaagcuccaggucuccaaccccgaguuccuucggcccacauaccccuccccguaacaauggccuagauccgguaguauaucaaagggacgggguggggaggggugaagagcgcacaaggggcgcucagggcugucgaagcgccuggguucugagcauauccccgccgccgccuguccccuugcaggacuaaauuccccggcccgagugagcgaaagacaaauacucuagugacuuggagguguuucucucuccggauaccccccugcaaccccaccaaccccuacccaccgugcccagugaacuucucuccaccccaccccguggggaccgcugcacuagcugugcccacgagcgccaggccuucucgucggcgcagcgcugccuuagaucccgcuccaccucuuccccucuccugggccuguggccggccccuggcgccuccagcgcggccugaaacuugaucucacgucgaaaggacaguguguaaacaccaggcgcgcuccgagaacccacgggaggggccgagcgagggccgccggggcagcucgaggccccgcgcccccgccugccugcucgcccgggacacgaucggcggggccgccgucucgcucucugccuccccaguuggcucagcuaauuggagccgccgccgccgccaccgcugcggccucuuguugaauuuucuagaucgcaaccguucagucguggcugccugucgcuccccucccccuuccacagcuguuaccucugccggcaacuugguggugguggggacccguccccccgcugacccuggccucaggcuccgaguucaccccagcaguuccaggggguguuuuucuucgagacgugggaagggagguaaagccuuaucggaacugugaggcuucgugccagaauccaaggcucggguacuagccagaggauccucccggcagaaggccaugguccucccugucuuacaccaggagguagugacagucccggagggaggggcuccaggaacaacucugcuggcgacuucuguucauuccaggaaaacauuacagaagggugaggugaugggaggcagaaagauccccccucccuccugcuugccccaaucccugucagcacuugggcauuugggacuugguguguagguuccuucugcagcagagcucaccugcgccuugggccuaauccacccacaugccacaaggaugcuuuuccucuugguuuggaguaccugguggguccaggggggaagugccacccuuaguggguucuggagguacaacucccccaugcugggucaguucuaugcuuguaccaggaggcccuccugggccuugguccuucccagccauccccagccuuagccuccuuuccccuuggccagcugucucaugccuuaaccacacaucugugcuagcugcaaaaggucccgccuguauggaucuguaagaggcccagagcucggccccaugguugaggugggaagaugugaagcaguuugcuagugcaggaaucaugaagauauuguugaugauggcagagcaguuccuggucuccagcauugccuuagaauggcuuuuccucgugguagaacuuucgcuaguggguuucacaggcucagggcccaaucuugugaaaguagcuacacuccccagcccggaaacacauaaauacacauaggcaaacucccaggaggcuggguguaggaaccaccaccggggggaucugcagcagccagagaaugucugcuuuuccugugaugguucugagaagggcgccuguucccucccuuugaugguucucugacaacuguuagguaacaaagaguggaggccacaggcucauuaacugucauuuuccaccucuuuccuccgcuucuaacuuuuacccaaauuacuacuuuggaguuuuccugagguguucucuccaucuauuuauaacuagagcaagauuuccaacucaauccuuauugauuuaaacuaugauaaaaaugaauccauaaaauuauuauuauaauuuggugucuaagaugacauuucacuaggucaaguucacacaguuuuuggcaucuaaaaucccccaggccuuuccaaucagauaaccuaaguguguuucccacugucaguuucucuucccuuuccguaguggaaaaaaacugaauccucucaaagauguuuauucuccuucacuccuaccccaucagucugugagaaccuuguuucuguuuaggguaagguauauuucuauguuuugauaaagaagagaguaauacauguuccucuucaggccugaaaagauaauuaugcauccugggagcuugcucuucuccuggcuguuuaacggacaaucuggauucuggcucuggagcaggaaugcuucgaugucccagucuccuucucguccccuuuccucugucaccacucagccaucaccaggccuuuaggcgggucacacggccugaggauuucuguucugaaggcucagagugccucagaagauugcagcucagagccugguaucaugcauucacauuucuuuuacugugcaaagcauauucggagccauugggauuccuguuccaucucucugaaagcuuaugccaagagcuccccauggggccuauggugauggaugucaugaggcccaggaaggagccaucauggugggaagaguugagagccugcauguaagacucagacucgaaccaaaccuaagugcaaauaacaaggaaaaaaagcaacuccgcgcaccuggcugguacccugcuuggaaacaaaccguaccuccccacccucccaucucaaagcuaguagagccuaggggcacaccauuccuuuggcuucccuuuagcuugaccugggaauggcgcaguuaagcauaucaggaagcugagaugcauccacuacuccucacuuccccuggcgcugggcucagcuuggcugaacuugccguuccugucuuuuuagaagagcugguuguguucccgaagcaggaucgcacugugccgccuccccagggguccccagcuauugauuuuuaauauccguauucaauauuguguauuaaacauugaauccaugcacaagaggaugugaugcaaaucaccagccgugccugagacuuuaauaguuguuuuauugcccggaaaccacaguuggacgcaaggcauccugcagccgaggcuggggguggggaugacaggcugagaagagagcugagcggagcggagcagagcagaggauacgagaucucugaaauccgcacuacugaaggcacagccaggcacuaacagcuccccccaggcaggcugguggggggccggcuccaggcuguuguggaaagagcaggggcuguugugugagacccgggcagaggaagagguguggggcuguguucuuccuuccuggacuucccuaacuggacugugcauuccuguccggcaguccuuccccuccaugcagaugcucacccagaaacacauacacaacgauggaacaggaaaguuaacuuuggggcaggaaaccccaggccucgggccucuuccaccacucuucgcgcugugaccuuagcacagaccucucucaacccgcugggccccauuucccuccuuugccaaugggggugaugcuaucuguccuacuucccucacagcgcugguggugaggcugccgcggcacaugagauaauauucggggaaaaggcuuuuguaaauugucaggccccacguaggcaggcugagggauuagugcuggcuuucccuuuauacucccucucuccugcaggcugugucuccuggcugccuucuuucucagacaugggccuccucccccaugaagggcccucucuucuguuuccucggccaccucugcuugaucucucaggcuuccugcucugccuggacucugcauucaggcuaggcaauccgguuuggaggaggcccagcagggagaaaggaagggugagaacgacugaguguguggugggggugagugcagcaaguguguuuaaagccaacagccucgggagggaggagaagcacacucgguagcugcggcccuggguugcggagcccgcggggguggggccguggguggggggcguugauccgccccgugugcggacaagcgggagaaggguugagggaaaccugagucuaggagugucuucacguuacacuguugcugguuaugggaaguccagcuugaaucccgauugcuggaaggcuagggugugggcagugccuucaggguauugcaauugcgaaggccaaauggaaaugcgguggaaaguggcagcccuccagcgccgccaagucagauaaaaaguugcccgaggcccugagaguggaggcaccagcucucugauggccuuguagacgcccugagaacaguccgagcuccucaaacccgcuaccuuuguccugggcucaaggagggggcggaaaccagaggggcccggauucuugaagaccuccccuggggaccccacugucugcugggaaggccucagccaacuguaggcccaagcccuacagagaccagcucuggcaggaagucaugccaagagucuguguccgcguccuuaggcgugagaauggggcuaugccaggcugggccuggcugcgcacgccuccgcuucgggacucgggcggcugcugcugccuucguuuucgggucuucgaccgagccucccuggcucucuacucccgcuuugucuugcugucagcuucucgccuguccucgccagucuccuaggucggcgggucgcgcucugccucuccgagugcgucuuugcgcacauguggcggucuuccugcaaccugggucagcucggccucuucccgcgggguacuuggcuuugccuuuggaucgcugcgaguguccacuucuugcgcucuccuucuccccaccucgccuuaggcagacgcaucccgggcuuggcggucccccaaacagaaauauccccggguuucugguuuagcuccaccaaaacaaacucgagggauugggguauccuucacuugcguuucccgcuucucucagcccuaggccgaaacuggaggguuuuuuuguuuuguuuuguuuuaaugagaccuacuuugcagaguugacggggaacauuucugcggcagacuucgaggucuguggcgcucucccaacuuucaagacuguaagccgccaagaaagagaauuuggguacaugauuuugccgcugaugugggcugggacgaggguauccagagugcacgugcaugugcggaucgcagggacucucgguggauuagccgccaaaagcuggggagcgccgcguauggacgcuagggcugggggccagcggggaccuacaaacaccccaggcggccgagcaggugaaggaaacguuccgagcccgcccccuccucccgggcccgcacgccgccggccuuugcggcggaaacacgguccaacuccuugaaaguaaacuugccgccaggggcuaggggcgcgaagaaaggagggggcugacagcggugucugcgucggggaggccaggaaggcuugugucaaauuucagcccccaaugacacucgguggcgaggugccaaggcccugggaacggcggcggggguucugggugagagugaucgcgccgcagggcccagcuugcgaaccccgaggcgcccgcagggccuagggaggccacgggggcgggcgcggcgggcggggagggggcgcuccuagagccuccugagcggagcggacgcaggcaucuuccgcaauccauucaugcacugaagcgcgugcagagcugcugaucgcugccauuguuacucgcgggcggugugggagcugagccuccacucuggcgagagauaaauggccucugacagccccuccucgccaagagagcuccucggauuucaccgcgcggcggcucucaggucugugccucgcucgcuucccggugagaaccuuuaaaucagccucucggcccucccuccucccggacacugucccccgcccgcucaggccccggcagggccccgggcgcgcugugugcagucucgggguccucuccccaccuggggguuaaacagagugggggcgcagggaggaccucagggccguggggggaggcaccgggcuccccagccccggcuccgcgccuccgcgggagcggagccccgcgccccgccuccgcgcccacgagauggaucaggcuaccgugcggagagcgggcuguaaauauuuaaaaagucucucgcgcgccggcaguaauggcuuucgcagucggaaugugugcuaggggaagaggaagggcgacguguacuguguugcaggguggggaauuguuccuacgcuuccccuuagguccggggugggcugcauguucaggcuucccgauuucccgcccuccgccucuccgccgccgcgucccacgauagcaucgagaacgccagucgacagggaacuugagcauagccgggcaacagaggcccggucgaggugaccccggagccacccuccccaccggggucucccaagcucguggguugcgaauggucccagaccccuaauccggguccgcuucucgcugcugcacaggggagggcgggaaacgcacagauuggagcccccugaguuuggguggucgcaaaagccugggccgggguuucugcagagggggccuggacccuguuugugccuuugcuacccuccccagccgcucuuaaaccuugauccgcucuccaggagacccccaccccuaucugaaucugaaaguagcuuuguggcugcugggaccgaaaccugggaggaggcagcacggagaguuuggggcggggaggggguagccuccaggcuuaguggaggucacacguggaccugaacggggacucuuuugccuuucuggugagugugggccugggaucuuuaaggccaagcccugccggaugguagaggugggggagggggauucagccuucucggcuuggcugggagagacuuaaugggcccaccacagggugugugucgggugagguuguccccuuugccagcggccacucccuagcggggcggaggggcugaguugcccagagcuggggcgggccgggcgccgcggguucgcgcggaagguuccaggggugugggcccaguccggagcuguucgccugcgccccgccggcucugggaccugccaaagugugggugcuggcggcgugucaggacgcgccaggcugcucuccgcguucgagcgcugggagcucccgacuccuggcagcuccgugcaguccucuuccaggggcuuguguugcgcccuucucgcuuguuugucucgugugagccucguaaaccgccuugauuuauuacccagacuaaaugcuuaauuugugaauaugaaacagauuaaaaggggcggggggagggggguugaggucggcauauuuuagcaaucagaccaaagcagcucggcagauguuucaaauuugucgacauuuucaggcucauguggaaagccagccagaguggucaagagguccuuucuccuuccuucaaccugagaacuuggcagugaucaaaaggaggugauuaguagcuacagagaaaaaacaccagcaggcaaggaguuaacagagacugagccguucaccuccaggauugggauuuggcggggagggggggcggucacaaaggcaagaggaauccuggcuaaacaggcgcaagucguggaagccaacucugaagaacaaaguggaggguccguuaaaaguuaauucaguaaauaaacuucauuggugauaaaacaaauaagaaagauggaaacuccaacuuaaaauagccaaaagauaagaaaaauaaaucgcuuuuauguggccugaacaugugcaugugucuuuggucagguccccgcaaugauccaccuaacaaaggccucuccugaguacccucucccuuugaauaccccacauguauagccaguguuuuuuggcguuugucauuuuggggcaacuucacacaucaaaggcgagcaccguuuucuuuucagcucccugguuccagccacccagugaagcagauacaauuucuauaaauuggccuucuucuccagguuucgauugaucaucaccauaugagauuacugaaagucuaaugucuuauuucacuuucuccaaggagugaggaggggaacaguuuauugaaagucaggccacgugaagacucugguguugugcaauaguaauuuccauuagccuggauuuaucagccuccugauacugccaccugauacugcagucuccugcagguuccuuguaccaccuucccucuuccccuccaggucucagcaucuguccccaugaacagguagaguucaaaccggagccuuccuauugguaaggagaaaauggcugaugaccaaaaauuaggaaacaaaagauuuguuguuguuucucaggacggagucuugcucuuuugcccaggcuggagugcaauggcccgaucucgacucacugcaaccucugccuccuggguucaagcgauucuccugugucagccucccgaguagcugggauuaccaggcacgcgccaccaggcccggcuaauuuuuuguauuuuuaguagagacgggguuucaccacauuggccaggcuggucucaaacuccugaccucgugauccacccgccucggccucccaaagugcugggauuaccggcgugagccaccacgccuggccaaaagauuuguuuuuuaacauauuuguuauaacuuaagaauccccucuuuggcuuuuguuuccuacuccaaaguuuuuuguuccccuuuggccuugauaccaucuuucguuuuauuaaaguugauuaugguuccucugucuugucccuagccagacaaaggcuuaggagaagucaaaggacguguuaauuauguuucuuguaaacugacuuuucauuucccccuaacacauuuaguuggcuugguguuuaguuuaacaaucaauugcuacaaauaugcugcuuaaaaaugcugcuuuuauuaaaacaaauaaaugaauucaaagaccuuucuaauuucaacucgugugggcuagaaacagaagagaaaaucgaaagcaagagagagggaaaggcggcagggaggggagagaaaggagaccaggaaacacacacagacacacacacacacacacagacacacagcauuccugcugccaucccuccggaagccauguuaaacugguccauacaauugucccuggcugcccccugcagcucgccaguccuucuggauuuuccaucacuuggcgccuaaggcgaucauuagcugagaauggacaaccuccucuaccugccggcagcucagcucgucauuuaccagccaggggaggcuggccccauuugcucaacccgagagggguccuugguuuuugccccugggugcauuggugccuaauuaaacucuauccagggcaacgugcacuaaauauacguaggcugagaggaagcugggaggaaaaagcagucauuaccuaggaagagaaagugaaucuuccgagagagaggaggaaggaccccugcgauggugcuuucuguuuacccucagcagagccuuggagugcauguucacuugggugcugaaaucaaggagaaauggaaaucgggaaaaaaauccauagcccacacauaccugaacagggccuaugucaccacagagcaggagggaggucugcuguagcuccagacaguguuggcugcagaaaaaugacucaggugcccuuguggcaucggaguuauugcucaugugccacggcccccucacgcacaggagcuggagcuguauaaauggccguggggacagaaaggaacagaugugucaagaguccaaggacuagguguguguuguaaagccaaacagaugguggaggagcaggggagaaccuucagcugaaggcuaaagacccuacuagcaccugggcccaggcaggaucgaagugacccaaccugaagcuaaaaugacagccggcaaacaagaauguaugcagaugucauacaagagccaccagggcuuuaauugagcucuguuuaacccaguggaggaaaucaguugagagggugaaaacacuagcucagggugacauguuuguggcaaaagagaccagaacccagagcucccagcuucagaaaacagccagaggaggaaagugacugcugguuagagaaagauccagagugcucuuggucacugaagaggccugguauuuuagucauuuggcauuuauuaagcacuugcugugugcaaagcacuaugcuggcaucaaagggggcuaccagcacuaugagcccucaaaggacugagcagggaagacucuccccuuuauaugugccuggugacaaaggccaugaaagacagugggugaaggggcuggggaaugggaggaggaagccaaccacucuggguuccacucuugaagauagcaguuuacaggugggcaucgaggccagagggcaaccuguagcaauggaccccucuauggccucccugagccaaacccuaccuggcuaagcaccugcgccuguaagauuguccucccaguggugggagugcgagagaggccaucuucacuuccccuuccuuggagggccugacuuuguugcccuaggcaggccaggaaacuuauucuaaugccaacgaaggaggcaacuuuucuagcuagaaaagcacacgcuacagcucucucucuugcccugaacaagcagaagagcacagcuuauccccaaaagcuccuggacaaauguaggcucucugggggagcugguaagggaauacugccucccuuaacaaaacaaaccugagaaucuccaagguuuagcacugcacacggagucucccagcagagaagggggcuagcuuaagugccccaugcauuccaccugccccuuggggcgcucucagugugaucacaggugcccuuccucaagccaucuggccugggcccagccucugcucuugguuucccuaagcagaggcgaaacacgcuggaaccuucaaagcacauuccuaaacacuaagagagagcuguggggaagugaaaacaaagaggccaaggagcgcuggagcaguucagcuuccagagucugugggccaacagggcuggcucaaguucagucagacuuacuggcccugggccaaccagagcuggcagcgugcccucuucagcccacugcucaggccccgucgccccccaaaaaccugggcacaccccagagcaagcccaagccccaggaagcccugcugccccuuggcagcccucucagaccacccccucccccuucuaguuguggguugcuaguuccagagccagggaauggcuuccaaaaucccuucacccagagcuucccaagagugaguggguugccaaugggucaagacggggaucccccagccccucagagugaaccaggggugacccaauuccuuggcuggcagcuucaggccauguugggcaauuguggacacucggucacuguuuaacuuugugcaacagaaaaauaucacauucugugcugagaaucacugcucacuugucauaaguguggcauccaugcuccaagaguuacccacacauacgaauaggaaggauauuggaccacaugguccuucguggauggugaacacagcauagucagugauucaacuagcauucguucaagccucucuugucuguccugcacugugcuuguggcuguugggguggcucggggaaacccccgguuaacaagacccaggccccuccuuagagaacauaaagucuccccaagagagauaagccccauggagcugaaaacuucauugugcuuacacuaaaaccaggagaaagagcaaucccugguauuacuccucaggcauaguuuuuugguuuuuuuguuuguuuguuuguuuguuuuaaauggggucuccaucuaucucuugcugaggcuguagugcagugaggugaucacagcucacugcauccucgaccucccaggcucaagugcuucuccugccucagccucccgaguaggugggacuacaggcaugugccaccacagcuggaucauuuuucuuuuuuuuuuuuuuguagagacugggucucaccauguugcccaggcuggucucgaacuccugggcucaagugauccucccgccucggccucccaaagugcugggauuacagccgugagccacugcaccccgcuuagguauauauauauuuuuuaagccaaaggucugaugguguguuucugcccacuuuacacauaaagcugggaaacuaaagacucccucauacucccagcagcugaccugcugaaugggacuugggagcugggaauuccgugcuuucucuccaaaggguccgcccaggugacaucaaguucauggcagauguuauggguaacaccugcacuuggcagaaaauucuaaggcuauaaaaggauguuuggugccucucccacccgcauuucucagucacucaguuugccucucugaaggcaaccagugcucccaguuuauugcuuacucuucccaagauagucuauuaaggcugauuuuuuuuuuuuuuuugagacagucucgcucugucacccaggcuggagcgcaguggcacgaucuuggcucaccgcaaucucugccuaccugguucaagcgauucuccugccucagccuuccgaguagcugggauuacaggcgugugccacgacgcugggcuaauuuuuuguauuuuuaguagagacaggguuucaccguguuagcuaggauggucucuaucuccugaccucgugauccacccaccuuggccucccaaagugcugggauuauaggcgucagccacugcgccuggccuauuaaggcugaugcuuaaaaaaaaaaaaaaauauauauauauauauauauauauauauauauauauauauauguauauauauuauauauauauauauauauauguauauauauuauauauauauauauauauauguauauauauuauauauauauauauauuuuaaauuuuauuuugaaaaaaaucccaaacccacagaaaacuugaaagagcaguacaaugaacacccauauaugaaggcagguuuucaaaagcauuauauuuauucaacacgccuacccuuggaaagaauucaaaaccccuucaaaggucugaauuaguuuaacuuuaucuuaaacuguuacuuaggaguacuuuucccucauagacauguugccugcuuguucaucccccuccucccagcccccagcaccuuauuagugugccucgugcauagugggcauuuccuaaagcuugcaggauuaaauagcgaagacuaugucguaguuaguaugggggagccagacugucuggguucaaaaccuggcucuacaacuugaccagcugugugaccugaggcaguuacucucgccaccuuacuucccccaucugugaaauggaggguagugauacaauauauuuaaugauguugggaggauuaguugauggacauaaagcauguaaaauagugccugggccagacacggugucucacgccuguaauccuagcacuuugggaggccaaggcgagcagaucaccugagguaaggaguucaacagcagccugaccaacauggcgaaaccccgucucuacuaaaaauacaaaaauuaggcaggcgugguggugggugccuguaaccccagcuacucgggaggcugaggcaggagaaucgcuugaacccgggaggcggagguugcaaugagccgagaucgugccacuacacuccugccugggugacagagcaagauuccgucucaaaauaaauaaauaaauaaauaauaaaauagugccuggcaucuagaaagugcuuaauagguguuagggacacuugagacuuaaacacacuugguauuaacuuugcuuuggugauugcauguaagucauuuggccgaguugauggccuccgaguuuuccuugguaaccaugagagagacccaagaaaaccgggaauguggcuucguagucgucccucgccugagaggauugccuacgcucagcacauaaguagcaggggcuucuugugaccaguuuccacucauggagaguuucuagcugugcuuauuaaaaagauauuugaggccgggaguggugacucacgccuguaaucccagcacuuugggaggccaaggcggguggaucaccugaggucgggaguucgagaccagccugaccaacauggagaaaccccgucucuacuaaaaauacaaaauuagccgggcaugauggcgcaugccuguaaucccagcuacucgggaggcugaggcaggagaaucacuugaacccggaaggcggagguuguggugagccaagauagcgccauugcacucuagccugggcaauaagagugaaacucugucuuaaaaaaaaaaaaagauauuuggagggaaagucgccccccguccacuucccuuuuauagccuggcuaguugcugcccugcuaauagaaccaucuuugaagaaagagcuagcauuuguuuuacccacagaccgguaagaucuucucucucagggugaagccuaggcucacaaaagccugagaucagaaagucaaggguuagagagagcaaguaggugcaaccccagaaaccuccacugucuggcaagccagagagucuuggggccccccaacagacaaaguugucuggaauuuucuucacauaggaaguguagaaugguagaugucuuaagagccagaggcaagagaggacuggggaaagauaaaggaauuuguuuauuuuauuuuauauuuuauuuuauuuuauuuuauuuuauuuuauuuuugagauggagucucacucuauuaucuaggcugcagugcaauagcuccauaucggcucacugcaaccuccgccuccuggguucaagugauucuccagccucagccucccaaguagcugggauuacaggugugugccaccacacgugacaauuuuuguauuuuuuuaguagagacgggguuucaccauguuggccaggcuggucucgaacucccaaccucaggugaucuaccugccuuggccucccaaagugcugggauuacaggcgugagucaccgugcccggccaggaauuuguuuaaagguauacucugugcuauaaaauacugcaccuaauguuaggcuuugacggcuauaauaucugacuuugacauugagguguaucugccauauaauuuaauuaacgugugaugccggcacaaugccagagagucaaacauucugacagcucuuggaagccacauaagucccuuugaaguuccccccagugaagugacacacagagaaaccuccuaugguugaggacagccccugauacgguauccagaaauuuagcugcgucuugguuauauuggauggcacuggcaaagccaccugcugguuugccacaguucuggaggucugcugugguuucuaagggccccaaccauggagacuggcucuuuggggaagaagaacucauucuucaucagggacaaaauugggaggucuccuguuugcauauuuuguucuacaaaauguuuuuuucuuccucaacuuugcuuagugcaaagucauugagcugcacacaggaacguaaauuagguaagaggcauauuaaccaaggagaaaaaagaccauagacaucuauuuugcacauaauuauuuaacacccaccauacgccuaccaaagcuuuggacauuuauagcaggaacaaaaacaauaucuuggacaucauaaaacuacauuuuacuggggagagaaaaaguacaugagcaauaaaaauauauaauauugcagguuguaauaaauacucggaagaauuaagaagggugugaggcuacagagagauggaauguucuuuuauguaguuaguuauuucuaucuacagcagguagaacgaguguucuuuuagaugguagguugugcaguaugagccuuggguugaccgaguaacgugcucaggcgauauaucaauaagcucuugucacaacacuguuguaucacaaaccaccucaaaacaucaguaagcacuuauuuccuacauacaugucagugggucaccugugguucacuggucuagaaugugcucaacagggcuugacuccaaguguggauuggaucuaaagcugcuccacgugucccucaucuucuacggacaagugggcuaccugggacauguucuucucaugacaauggcaaaagugcaagaggguagagugcaaaugcaaugacucuuaaguccgggacucaaaauuugcacacuguuacuucugccuacaucuauuggccagaagaagucauguggccugacaucggugggaugaagaggcaugcucuaccucuaaaagguguggacacagggggaggugaagcacugggaagaguaaugcaaucugaaacagguguuucaaaccaaaacuauguaucucuagcugugacauuuauauauacaaacacauauaucaaaugauaaaacgacccuuguugaaaccuucaguuuuagauuaaauuuaaauaaauccaugcaauaauuacauuacccuccccgagaugguuuaugaugucaccagaggcuucugggucauugccgccaaucucaggaaaccugggaagaugggccaccggccaucccaaugcugagagacaaaaaggccaugaagggccgggcgcgguggcucacaccuguaaucccaguacuuucggaggccgaggcaggcagauuaccugaggucaggaguucgagacuggccuggccaacauggugaaacccugucucuacuaaaaauacaaaaguuagccagguauggugguacacgccuguaaucccagguacucgggaggcugagguacgagaaucacuugaauccgggaguggagguugcagugagccgaguauugugucacuacacuucagccugggcgaaagaaugagacucuuuucucaaaaaaaaaaaaagaaaagaaggaaaagaaaaaagccaugauggaauggagaccuuucuuccuacagggguuucccuugcaggaaagguacaggugggaaagcucagaggagaccccagaccgagcaaguuuccuugcuuaccucuaagcaugucuuggagauguggcauaggauccaggaggugugacuaaaagcuagacuuuuagccagucucgcaggcugugcaggacacaccuucaucuguuguaugaagguauaugagcuggccaaagauucgcguucuuccuugcagcuccuuuuccccccaguucugcccaccuuucucuugcuguccuugaauaaugugggggggauuccuaagugucucugcagaaagugaugauuucuaauuuugggccuccuuucaaugaauuccuccagggcucugcagucagccaaguacuggaaccuagcccuucccuuuaggaaggaaagcucuugguucaauugauuccgaugguuaauggaaucucaucaccguugcccagagugguucuaaucaaaggaauccacugucuaaaaauucaagguagcagcaucaagguuuacaucuuguaagcaaagagacuggggcacuggggcagauauguuuuaugguggagccccauggggauucagucucuuauuugggagaauucuggcuccuggcuccaaaggugugugaguugauccaucuucuguaacuaauccuagccuggacuuggaagggggacugccuuuuuuauuuuuugguguuugguuuuugagacagggucucauucugucacccaggcuggaaugcaguggugugaucauggcucacugcagccucaaccuccugggcucaagugauccucccaccucagccucccaagaagcugggaccacaggugugcgccacuacacccagccaauuuuuuauuuuuaguagagacaaggucucauuauguugcucaggcuggucuugaacuccugggcucaagccauccucccgccucagccucccaaaguacugggauuacaagugugagccaccacgccugaccauguccuugaucuguaaaugacaguagcuuuuggaaacugagaaaauaaaaaucuggaucagacuucaaguccccugaccccucucugaucugguccucgucuuccccucuccucugguuccacagcugccacagagcacaccccuggggcagcccagugagucccucuacccauucaugcccuccugcuuguucugcccugggagggagccucagccccugagcccccugccuggagugaucccccugcucacccugacucccagcuccaggccccaccuccucugcggagccccucccaaauuucuaggggguuacauuucagucuaauucucccagaugccuuugugcuuauugucacagccacaaaacuuaucauuugguugcucugaaaugacuuuacgccuuaucuccucgcuucaguuguaaguucuuagagcacagggaccacagagccuagcaagguguuaauacacaugaguguacuuacugguuggauagccucccaucaauuucugucucuuaguggugugggaguagaaaagacuccccagauguuagggccaagaagguugaaauugaggccgggcgcgguggcucacgccuguaaucccagcacuuugggaggccgaggcgggcagagcacgaggucaggagauugagaccauccuggcuaguacagugaaaccccgucucuacuaaaaauacaaaaaaauuagccgggcgugguggccgucgccuguagucccagcuaugcggcaggcugaggcaagagaauggcaugaacccgggaggcggagcuugcagugagccgagguagcgccacugcacuccagccugggcgacagagcgagacuccgucuccaaaaagaaaaaaaaaaaaaaaaaguugaaauugaaguagauggccgggggcgguggcucacgccuguaaucccagcacuucgggaggccgaggaggguggaucacgaggucaggaguucgagaccagccugaccaacauggugaaacccugucucuacuaaaaauacaaaaaugagccaggugugguggcaugugccuguaaucccagccacucaggaggcugaggcagcagaaucacuugaacccagguggcggagguugcagugagcugagaucaugccacugcacuccagucugggcgacagagcgagacuccaucucaaaaaaaaaaaaaaaagaaaaaaagaaaaaaaagaaauugaagcagaugagcucagaucaugagggauuuucugaaacugcuauauuuugaagaaaaccuugcugguccccuccaguuuucuguaauaaccuggcugagcaguggguuucacuguccgguucacgcacuaacugcuucagggucaccuggggugccaguucagaauucagaguccuggccccacgccugaaaauacugacucacuaggccugggguggggccuggaaaucucuaucuuuaacacgccacugcugacucugacgcacagccagguuuggaaacuagucgagucugaaaagaauguucucuucuuggaagugagaaaauguuaggggggcaccgugagaaggggcuaugauuuggauucugagagaccagguuugagucucaguucugccacuuaccaggugugugaccaugggcaaguuauucagccccucugcaccucaguuucaagugggaacaccacggaucuguuuugugacuagugccaugcaacaaauuaccccagaacuuugccacuuaaaacaacucuuuggccggguuugguggcucaugccuguaaucccagcacuuugggaggccgaagcggguaggucaauugagccuaggaguuggagaccagccugggcaacauggggagacccugucucuacaaaaauacaaaaauuagggugagaggauuccuugagcucuggaggucgaggcuguggugagcugagaucccaccacugcacuucagccugggugacagagugauacugucucaaaaacaaacaaaaaaaaccccaacucuuugauuuuguucacaauucuguggguuaggaauucuggaacggacucagcuggguacuucucacuugggauaucucauucgguugcagucacacaucaacaggggcugcagccaucggaaggauauccgagauggcacacuccuguagcaaucaguugaugcuggcuauuggcugggagcucugcugggcuguugacuguggcaccuauguugugagucucugccauggcaguagacuucuuacugacuucucucagagcaagugccccaaaaagagccaggagcaagcugcauggcuucuucugccuuugucuuacaagucucagagugucacuucuguuguguugaaagcagucacaagcccacccagacuucuagaaguagagacagagaccacaccucuuggugggaagagugucgaauaacuagcgggcguguuuaaaaccaccacgguaucucaugggguuguuaugaggauucagugagaugaucuugcugaagugcuggacaagcaugaguuccccuccuccuucuaauuugaggccuggaggcuaacaggguaaagccagugccaggugccaggucuccagucgcuugcaguuguucaugucuacugggccauagggaccguuuuucucagucuugucuccucuucucuucucuucucuuuuacugacagaguuucgcucuuguugccgaggcuagagugcaauggcgcgaucuuggcucacugcaaccucugccuccuggguucaagcgauucuccugccucagccuccugaguagcuucaauuacaggcaugugccaccacgccuggcuaauuuuguauuuuuaguagagaugggauuucuccaugcuggucucgaacccccgaccucaggugaucugccugccucggccuuacaaagugcugggauugcaggcgugagccacugcgccuggccuguuuuucucaguuucuagucauuucuaguccuuuuggauaguaaaugcagggugcagugagcaccuucucauucugaccagcucagcucucucaggagguugggacugcaagaucugugguucacugucacccccauaucagccuuacccaugugccugaucucaagugcaagcucacugggcuccgaaugggaacaccuggcugaguacugaguguuuucaggucagacaaccugguuuggggcccaggagggucaucuguugcaaugguggccugaggggcagcuggagagaaagagagcagcuuugguuggcgugggucuucugucucacggucaugagugggccccuucucugaccuugcuuucuucaccucaggucuggagacaguggaggagcugaggaaaggucacauggagaccacuggggccagcaagccagcuccccagggaaggugggggguggcuugcaugacagaugccucaggaugaggggcauuaagaggguggcuggguuccaggggcugccagaguggguaggauuugccaaauaggguacccuuggaaggcaggacacaagagggaggagccauuaugugccugcugcaauucacuggcauuuguggagggggucguuugccccucuggcccacacccuuauuccugaaaaaggcaguugggccuguguuuagcacuccgaggaaccugcucucucugguccucuucuuuuccuucuggggcuccugaaccuccccaccgacaugcuucccucauuaccaccaagccucacaugcagcagcugccuugcugagagcagacagggguaggcuuggagcugcacagcgaugcgacacaugauggggcuccuucuaugugccccacaccuagccaagggcuaaaaauggucacacgucuccaugaucucauugacgaacucacaccaugggccugaaggagugaugugugagucagcaccccggaaucccuggcagagcgggucuuggaggaccaggaagaccaggggaaaccucccagauugagucauuaggauaggucauagugcaggcugcccuccccucagucuccaugccucaguuuccucaccuguaaaaggagaguaacuaagugcccaccucauagugugaccacaaggagggaauuggggugcacccuuaaucaggcugcucuccaccuguugaagauuuagaugaagagggacagggaaggagggcaggugcauagggaguugcuggggcaggggaggcagagucauggaggagaaggcccggagggugguagaggaggugccugcugcacgggugaagucuguucuucuucuuuuuuuucuuuuuggauggagucucgcucuguugcccaggcuggagugcaguggcaugaucuuggcucacugguucauacaauucucgugccucagccucccaaguagcuaggacuacaggugugcgccaccacgcccagcuaauuuuuguauuuuugguagagacgggguuucgucauguuguccaggcuggucucgaacuccggaccucaagcuauccgcuugccucagccucccacgccugcuggguuuacaggcgugagccaccgcacccggcaaggagucuguucuuagaggcagagccaccacuccugcucccaaggaaaggacagugaaacagcuuucgcccauaccccaacccccaccucccuaaggccccgcagcuccucccucccuccgucuggacuguuuccccuucucccuaagacauuuccuggaagcucugcccacaguucuuccuucuacuuauauaccuggccuggccccagcccugccacugaggccuggcccccccauuaugugaccagcuuuuccucuucuucuuuuuuuuuuuuugagacggagucucacugucgccaggcuggagugcagugacaugaucuuggcucacugcaaccucugccuccugaguucaagugauccuccugccucagccucccgaguagcugggacuacaggcacgugccaacauacccagcuaauuuuuguauuuuuaguagagacgggguuucaccauuuuggccaggauggucucgaucucuugaccucgugaucugcccgccucagccucccaaagugcuaggauuauaggcgugagccaccaugcccggcuaacuuuuccuguuucuacucacuugggcugagauccccguucuccuaugucaccuuccuuaaacaucacaccuuggcuaagaggaaagacuguccauuugggagucuaugcccacuagcucugcgaccucaggagagccgcuuaaccucucugagucucagcuucaucaugugcaaaauagggucauuuaguugugacuagugccucauuuugaccguacuuccaugaggauugaauaagggaaugcauugaauaugcaacaaguacauaguagguacuuaauaaauggcagcuauuuccauggugauucuaggccuguguauccagagaguauuugacuaauagacaucugcacgccuguaaucccagcuacuccagaggcugaggcgggaggauugcuugaggcugggaguuugacaccagccugggcaacauaguuuuuuacaaaaagccaucugaggguaugacuugcauagggagccacuuauuauuggagggcagauaaagaaaaggagguauuccuuucuuuccccugaugauucaggcaagguggucccugcucccuuuuauuuccugaguuacaucuaugcugugcccuagaauuggaaucaguaagcacagaugccauuggaguuuuuccccaauauucuuuuuuuuggagacagggucucacucuguugcccaggcuagagugcgguggcgugaucugggcucacugcaaccucugcuuuccggguucaagcgauucuccagccucagcgucccaagucgcugggaucacaggugugugccaccaagccgagcuaauuuuuguauuuuuuguagagacgggguuuugccauguuggccaggcuggucucaaacuccugagcucaaaugaucugcccgccucggccucccaaagugcugggauuacagcugugagccgcugcaccuggcuucuaacccaauauacuuuuuuguuuuuuuguuuguuuuuuagaaggagucucacucuguugcccaggcuggaguucgguggugugaucucagcucacuacaacuuccuccuuccggguucaagagauucuccugccucaggcacccaaguagcugggacuacaggugcaugccaccacucccggcuaauauuuguauuuuuaguagagaugggguuucaccauauuggccaggcuggucuugaacuccugaucucgugaucuguccgccucggccucccaaagugcugggauuacaggcgugagccacagcgcucggccucuuccccaguauucuugcugccuuuuuuuuuuaaauuuauuuauuuauuuauuuauuuauuuauuuauuuauuuauuuauuuugagacaagguuuugcucuggagcgcaguggcaugaucauagcucacugcagcaucaaauuccugggcuuaagugauccucccaccucagccuccucaguagcugggacugcaggugagagccaccacuccuggccagauuuuaauuuuuuuuuuuuaagacagggucucacuauguugcccaggcuggugucgaacuccugggcucaagugauuauccugccucagccucccaaaguucuaggaucacaggugugagccacugccuagucaacagacuugcuucuaagacuuuuggauggaaacucuucuagaguauauuucaaugagauauaucaguuugcuauugcuauguaacaaaacacucuaaaccauaguagcuuaaagcaacaauuucuucuucuaucacaauuggguaaguuggcugggcuguuccucugcugguuacaucuggguuuacucaugcagcugcagucagcuagccaacagcuguggggagauccaagauggccucaugaacaguguggcaguuggugccagcugucagcugcagugaacugucacucuucucccuguggccucacauccucaaguaugugagacuggcuuccuuacguggcagccucagaacugccugagagggugaagcaggaagcuacaaagucucuuaaggcuucuccucagaagucacacagugucacuucuggugcauucuauuggucagagcaagucaugaugccaacucagauccucgaggaagagauggagauuccacccuagauuagucugcuggggcugccauaacaaaguaacauacacugggugacucaaacaacugaaauauauugucuuacuguucuggaggcugcaaguccaagaacaaguugucagcaggguugguuccuucugagaucucucuccuuggcuugaagauggccaccuucuuuguugugucuucacauguucuucccaauguguguguguguguguguccuaaccuccucuuuuuuuuuuuuuucuuuuucuuugagacaggcuggagugcaguggugccaucucagcucgcugcaaccuccaccucucaggcucaagcaauccucccaucucagccuccuggguagcugggaccacaggcgcacgccaccauacccggcuaauuuuuguauuuucaguagagacaggguuucgccauguugaccaggcuggucucaaacucuugggcucaagccaucugcccaccuuggccucccaaagugcgagccacugugcccagccagaugauucuuuuuuguuguuguuuucgugguuuuuuuucuuuucuuuucuuuuuuuuuuuuuuugacggaauuuugccuuguugcccgagcuggagugcaauggcacgaucucggcucacugcaaccucugccucccagguucaaacgauucuccugccuuaggcacccaaguagcugggauuacaggcaugcaccaccauacccagcuaauuuuuuguauuuuuaguagaagugggguuucacucuguuagccaggcuggucucgaucucccgaccucaggugauccgcccaccuuggccucccaaacugcugggauuacaggugugagccaccacccagccccagaugauucuuuuuuuuuuuuuuuuuugagacggagucucgcucugucgccaggcuggagugcaguggcacgaucuuggcucacugcaaccuccgccucccagguucaagcgauucuccugccucagccucccgaguagcugggacuacaggcacgcaccaccacgcccagcuaauuuuuguauuuuuuuuuuuaguagagacgggguuucaccauguuggccaggauggucucaaucucucgaccucgugauccgcccgccucggccucccaaagugcugggauuacaggcgugagccaccgcgccuggccgacucccagaugauucuuuagugacuucuucugucugccuggaggcugugagacaugugcccucuaggcuugccauuaacuucugugaacacacucagcugugacagcucugagggaacucacccacccccauauuaguuaucuaaugcugcauaacaaguugcccaaaaauguaguggcauaaaccaacaauaacaauguauucuaucucuugauuucugugggucaggaauucagauaaaguacagcagggauggauugucucugcucacaauguuuggggcuucagguggaggaguugaagcugggaugcuggaugauacauuuccaugguggcucacucacuugguugggcgugagggaggaaaaauguagugauuagaagagacugaagagguccagaugugguggcucaugccuguaaucacagcacuuugggaggucgaggcagauggaucacuugaggucaagaguucaagaccagccuggccaacauggugaaaccccgucucuaguaaaaauacaaaaauuagccaggcgugguggugugcaccuguagucccagcuacuagggaggcugaggcgggagaaucacuugaauccaggagacaaagguugacuugagcugagaucucgccacugcacuccagccugggugacagagugagacuccacagucaauuucucccauaaucaaccaccuucuccaggcagcugcuggagcugcugccccaaugcaucacuuccuggcacauagcaggcugcagggaccaccucaucugccuuugccaccucucuucccacuuguucagcugcccuugagcagacuggauggccuuccagaacaggacaaagcaggcuggccacgugugcuuuuaugcccuccuccccaacccgcccccccgacgccacacacaccccuccauccucugucugacccaacacuccccacaagaugccuagaaugucuuucccagggcggccucccuuaaggguaugucuuacuuauuuucauagcucuguacauauauguaagggguguuucagaaggguuugugggccagucacaguggcccuguaauccuagcacuuugggaggcugaagcagguggaucacuugaacccaggaauuugagaaaauacaaaaaauaccaaaaaauuagccagguggugguggugugugccuguagucccagcgacucgggagacugaggugggaggauugguugagcccgggaggucaagucugcagugggccaugaucucgccacugaauuccagccugggugacagagugagaccccccucucaaaaagaaguguuuguggaauagaauugauuuuaaaaccuuuuuaaaaaauuguaagggcuaggugccguggcucacguguguaaucccagcacuuugggaagccgaugugggcggaucacucgagcccaggaguuucagacaacaugacaaaaucccgucucuacaaaaaauaagaaaauuagccaggcauggugaugcaugccuguagucucagcuacuugggaggcugaggcgggaggauugcuugagcccaggaggugaagguuguagugagccaagaucgugccacugcacuccagccugggugacagagugagaugcugucucaaagaaaaaaaaaaauguauauagagauggggucuugcuauguuucccaggcugguugugaacucuugaccucaagcgauccuccugcuucagccucccaaagcacugggauuauaggcaugagccacccugccugaccaauaguucaaaaucuuuaugguccgcuuaaguccguaguucaccauauuccccugaguucucucaauucccaaaguugcaaagaggccaguggggauucugaagguuucuccuaucagcuucucuggugcucauucucccgcucccaagggcccuggccuuuucccaggauucauuacaugguggcccuuucucaccauguggcauccuuaaaagcaugggguuugaacauucagccugaguuuugcuugcuauggauugguggaaugguagugcugggagagaggaaacauuucugcuuccucugaacccucuuaugcgugcgcgcgugcacacacacacacacacacacacacaaccaggaaaccuucucuuccccuagcccacgucuccucccagucugugcucuugcacuuccagagccagauaaauggaggaaaaacacagcugcagauguagccaccccaagagaaaucagaaaguguggaagaaaaaaagaaggccgggcgcgguggcucacaccuguaaucccagcacuuugggaggccgaggcgggcggaucacaaggucaggaguuccauaucagccuggacaauauggugaaaccccgucucuacuaaaaauacaaaaaacuuagccgggcauggugaugcaugccuguaaucccagcuacucgggaggcugaggcaggagaaucgcuugaacccgggaggcggagguugcagugagccgaggccgcaccauugcacuccagucugggugacaagagugaaacugucucaaaaaaaaaaagugugcuuaagugacugcuguaccccuacugacuauacaccacccuccccuccauauugcucuguuggagggucccuaagaccccuucucaauccuuguucucacucccugccacugcacacagagcuugauggcaagccgaauaugguaucuccuugaaagugagagaaacaguugcauuuagaaggggaauucaccuagcagguuaaggaaauggcccaaauggagaucucuaauccccaugccuguuuuuaaguugccauuugacccacaguggacaucucuacaggaaggccaguaagugcccgagacucccaggccuccgagcugccccagggcccaggaacgaggucagaugugauaacggcucugauguggccaaaagcuuccaucaugcuaagcaguuccaaacagucccgcucgucaggcaggcccggggcagugguggguagcgacagugugaugcucggccuugcccccaaagcuuaagccuuugauggcaaaagcacacucggcucuguacugagcugacugccugaaaauauuauagaaaacaucucucccuuggcggggagagaucuaagccccagugaccggggaguuuaaauuuucgggaugggugaccgaaggcugcuaagaauauccagucacaggccugaccacaagccaguuaacgccccgaguggcggcuuccaugguccuuggggcaugggaagaaggagccgacugggcagccaguacuuguggagucccucagcaggaauugugcagacacaaaguaaggaguaaaauaacauuaaagaaaaccaaccaccugaucgugcccucaaggaauaaucugagaagggaagacauugaccuaccaugggguacuuacugugcguuaacagaucaaaacaaggacaaccaugcagaagggaacagucuccgagacaccaagugccaacaagggaccccaggcuggcuucccacagccagaugggguaguucuuguggccuggcagcuggcagccugacagaaagucagguaggcccaggguacacauucuacccucuagcccucaguuuccucaucugcagagugagggguuugggaguccuguuucgucaacauuuugggugucugaggcccucugggacucugaugcauguaccccuggcaaaguggacaugugcacgagggccaccauuuucacagcauuuccagggguguccggccccaaguagaccagccccagaucucaagugagggcucugagguuuuuguauagaggagagacuguucuuggagggcuggaaguggcugggaagaguucauggagaaagcaggaucgaaguuugggcagaaaugagauggcuacaccuucauucaaugaaugccaugagcuucaacggucagcaagcccaagggauggaugcgaugacaaagagaccagagaggaucuggaaucgugugcagcaccguuuccagcuggagagagagagcccauucugcuccagccaugugggcuguccuucucuuccucaggugguccaagguugguccuccuucagggccugugcacuuguugcucggcuaccugaaacucucuuucccccauacucaugcagcugguuccuucucagcucaauuuuucaaagaggccucccaagccauccuggcuaacacugccuucccucccacuacucucagccacacugcucuguuucaucuucuguguggcacaugucaucaucuaaaguuaccuuauuugcucuguuuaugguccaucucccauaggauaaggaccuugucaguccuguucuccacggugcccuggcacccaggacagugcuuggcacagaguaaacaacugccaaauuugcaaugaaccaaaugaaguaauuauagccuuaacgcuagauggcugugcacuggggaggccuguggcguagaggaagggcagggugguuugagagggugaggcugagccacuaaacuggucuggaugacuguuuggggaagguaucuuggaggaagugcuguuugaacagaguugugaaugacuaagugaagcggguggagggaucgcaaaucuaagccagcucccgguggcaacggcuggaugugggaaggggcuggaaacagaagcccagagccaaggucugaggggcagggcccaguaggguggcugagggcuuccaucuuuaucucaauagugaaagccacuggagcacccucgcucuggcugcaggaucaacccccgccccccuuuuaccugucugaucauucuuccucuuuugcaaucuggccacccuagaauccugguuguuccuuaaacacagcaggcagucuccuaccacagggccuuugcacuggcuuugccucugccugcaaaacucucaccucagaaaucuuggcuugcucccccggcuccguugagucuuugcucacaucucacuuucccaagagaccuccccugagcaccuuaauccugcaaauccuucuccccacacccugccuuccaggugcuucuuuccugcucccacuuuucuuuccauggcauacaucacuguccaccauccaugguaauuuugugaccucuuaccuuuauugcuuaucgcccaucucucuccuucuggaauacaaguaccccgaggacagguauuuguuuuguuuccuggggugugucgggagccuggagcagcaccuggcacccagcagcagugguuauuugcgggugugguuguggcugguggcugcugugggggccauggacugcagagggguaggagccagaggagggggcccagugaggaggccauugccauggcguaggugagaagcugugcuaggcagugcagggcgcuggaugugggggaaauggauggacuccuaaaacugcgcagagaaaagaaaacggauuuggugaagggucgguuuggggagugaagggauuggagaggucaagggugauucucagguuucuggaauguauaaccaggugguugguggggaccagggagaagaagcaguuuuaaggggaggaagagagaaggggcauuccugcagggaacaugcaugggccacaauggggaaaggcugugucugcuccgggcauagcggaaaacccaauuuaggcuggaguggaaguuccugcagagaaggugaggaagacagggugggggccuaggcaacccguuaaugcugccaacuccacgcuuucacucuggaagccugggccaugccuagggcugccaugaugaagugcugccaagccuccaauacggcacaucugccuggcgcaucacucucaccccgcuccuccccccgccccaacuguggagcaguaaguuugcuucuauucacgugauuuuauuaacaaaauuugcuuccuugcugucucuagaagcagcacacugcccucccccaaccccccaacuuggcucagagcaaccccacacuccugcuaucaggucaucugcccagagugugauugcaguuuuaaaacugauuccucccugguuuauuauuuuuuuuuaguuucuauuuuuuauuuucuggaaguacagcacacagacagaaaaguguacaaauccugagaguacagcuugaugaauuuuaacacacccauguaaccagcuuccagaucaaccugcaguguucccagcccccaaggagucccacugugcuccccaucuccaaggauaacuccaucuugacuccucuucuuuuuuuuaaugagacagagucucacucugucacccaggcuggagugcagugcugugaucacagcucacugcggccucagccuccugaguagcugagacuacagcacgcccaccacacccagcuuauuuuuguaguuuguguagagaugggguuucaccauguugcccaggcagggcuugaacuccugggcucaagcgauccacccaccucugccuccuaaagugcugggauuacaggagcaagccacugcaccuggcccauccugacuuauaacaacucagauuaaaaccuuugcccacuuuaaaacuugacauaggcaaagcgccacugcacuuuagccuaggugacagagugagacccuguccaccccccaccggcaccaccaccaaaaaaaaaaaaaaaaacaacacccaaacuagauguaaauggaauccuauugugcauauucuuuugaggcuggcuucuuuucauuugcaagguguugugugugcuugcaucuuaaaaaacagagucucaggccaagggugauggcucaugccuguaaucccagcacuucgggaggccaaggugggcagaucaccugagcugaggaguuugagaccagccuggccaacauggcaaaacccugucucuacuaaaaauacaaaaauuagcugggcgugguggcgcaugccuguaaucccagcuacucgggaggcugaggcaggagaauggcuucaacccaggaggcagagauugcagugagccaagaucgcacuacugcacucuagccugggcaacagagcgagccuccgucucaacaacaacaaaaacagagucucccaagcagccucccaccugaggcaagggaucagggcccagucucaggaggccccuguagccuguggaauacucaguagaggaacuagggggucaguggagacuuuguguggggcagaggacagcauugguguuuuaagcaaaugacaugcuaagcauuguguuagaugcugccuggauacaaaaguggaagaugcgguuaagagggggugaagggaagauaagacuggaucuagagucggccagguuguaagaaugucuugggcugggcacaguggcucacaccuauaauuccagcacuuugggaggccgagacggguggaucaccugaggucaggaguucgagaccagccuggauaacauggcaaaaccccaucucuacuaaaaauacaaaaaaaaauuagccaggugcggcggugggcgccuguaaucccagcuacucaggaggcugaggcaggagagucacuugaaccugggaggcggagguugcagugagcugagaucgcgccacugcacaacagccugggggauaagagcaaaacucugucucagaaaaaaauaaauaaaauaaauaaaagaaugucuugaacugcaagaagaggaaagaaagugaaagcucacaccugaggggaggacagaaaggucagaaggguugugacuccccgccucccaaaaagauccccucagugcuacccuuaaagucacuuuccugaaaggggggguccuugccuugggggaggagacaauuucaguucuauuaucucagucauccagaaagacuucucugugccugugguguguuagagagaagacagauagggagggaggaaaaggggugggggggguggagagagagagagagagagagaaagagugcgagcauaguauacuuccugggaaacuaucucucgaauaguaguucuaggaagccucaugccagagggcaguaguacuggccucugccuucuugauggugcccuuggacgucagaaagaggaggaagccucagggauuggcagagacauuugagaguuucagaagcugaaguccagagagggugagcgacuugcccaaggucacacaccaagaaagcaagcauuagaaaggggaucgaguguccccuccaugguuuuuccaugaucguguaccacccuuucacuuuacaaagagccuaguguugccaccaaaauagcugaauuaccucauuuuugaaaggcguuaugaauucacuucuauuauguggaauggggcagagauguugugagcaggcaugacauuauaauucauauuccacuucuucuauuuaucuuugcuggguuuuguguaucuuuggaagcagccuuaaaucauuauuggaacaaaguagggagaaaaauaauaauauguaauuacaaaugaggaauagaccguaugauccuauuaauugccuucccugcaaucuuuauuuuugguauuuucagaauaauuaacggcuuaggucucgauugguggaggugguggguuagcacugaacucuaaacaguaacaucaccuacuccaggaauggcccagugcgaucugacaccugggacgcuuucagggcaacaccaagggcaaugcuccagucuguauuuacucucuucugaggagaaacucuggcagcagcuggaaaauaaaacccaaagcaaggaagaagccgaaaagaagaaauacucaaauacgaggcgcauuaaucaucggugucagaucuagagcagaggacaauggcugguuugaagaaagacugaaccuaaauuaucuuggaaacugaucuucucuccuccggguucccugugccugcaagcaggggucccggugcagccacuggcauggaaccgaugggggcauccacuggcugaccagcaugcuuugucacaggacagguuagagaugaccaccuucugucuguggaucauccauagcuucugcuuaggaagcuacagaagagaaaaggccucucacagggaccugcaggacaaauucauugcccaucguguccucaggggacaucauuugcaugccaggaugcaguaaggccacugccuucagauccaaauaaagcacccaauuagcaugaacuugugcaauuggcagaguaaugaagcugaccacaggugccuggaaaguccgaaauuuaguugcuaguguugcaccgugauggcaggggcugugacggcaugaauaagucugggcuuugggaaugggcagugagcuuccaggcaagcaggcaaauuaauuauccucuaagccucaguuuccccaucugaaaugggaauaauaauaguaccuuuauuauaggacaguuuuuuuuuuuugagacagagucuugcaccguugcccaggcuggagugcaguggcgcuaucucagcucacugcaagcucugccuccugguuucacaccauucugcugccucagccucccgaguagcugggacuacaggcgcccaccaccacacauggcuaauuuuuuguauuuuuaguagagacgggguuucacgguguuagccaggauggucucgaucuccugaccucgugauccacccgccucggccucccaaagcacugggauuacaggcgugagccaccgcgcccagccauauaggacaguuuucuauaugacaugagauuauuaauguguauaaaauguuuagaacugugccuggcagauagaaagcccuuaauaaauucuagcuauuguucuucuaggagcugaagaacauuagugacucucuuuuccucaaaucccaagagcucuucugcuucagaagagcugugugaugaguucuucccauguuaucccuucgugaacuaccuuuucccaugguaaggacaagaguagucuuuauggaagcucaaaacggggaaaaguguugcccaggaauaugaaagggcaagguagcuuauaaucucgccagacauugagccauaauuuaguauugguggagguacagguauuuuucaaacagaaucuauuuguucuggggaggaaguccuucccuugaacaucuuggccccacacuuuuuuuuuuuuuuuugagacacagucacacucugucacccaggcuggagugcaguggugcgaucucggcucacuagaguuuccgccuccuggguucaagcgauucuugugcuucagccuccugaauagcugggaucacaggcgugcaccaccacacccagcuaauuuuuuuauuuuuaguagaggcgagguuuacgccauguuggcuaggcuggucuugaacuccugaccucaagcgauccgccuacuuccaccucccaaagugcugggauuacaggcgugagccaccgagcccaggccggccccacacuuuuucaaggcuuaccuggaaggaaggcaacucuucauucagaugaucaauucuuagguucccauggugaacacaacagaugagcugaggccugcugaucccagaaagaaagaaacuccuuuuaugauacuuacugcaguuggcgaguugccaggaugggcccagaaggaugcaauugcagaagcuauguaggaucuggucccagaaauaguuaaagguuuggggaaacagugcauaugcaugacagacaaacaauauacccuaugggaaagagccuagguuuggagucagguagaauccccguagccacacucuccuagauuagccauguguuuuggcgcaguggcucacgccuguaaucccagcacuuugggaggccgaggugggcagaucacaaggucaagagauugagaccauccuggcuaacacaaugaaaccccgucucuacuaaaaauacaaaaaauuagucgggcgugguggcaggugacuguagucccagcuacaugagaggcugaggcaggagaauggcaugaacccgggagguggagcgugcagugagccgagaucucaccacugcacuccagccugggcgacacagugagacuccaacucaaaaaaaaaaaaaaaaaaaaagugaaugguaauaccuaagccauaggguuauuuuggggugugagugagauaacuuggaaaaguaccugauaaaguaacugaaaugaacaaagguccuuaauaaacaguagcuauuuuuaucacauaggaauuauucauuguuaaaagacuugcuuugcuaucaaaaacagcgcagggacacaguuacuguuagaggucaaauggcauggaauucagagaacuccaauugcccagggucagcugugagaagaaccuacacuucugguuucuuagggucucaaggagaaagacagucucaaucuucugccacuaaguuaaggaccaaaugauuggcaauaggcaaaguacucuaagaaggcucugguuuggguuuugucuuccuuuuggcuuucucaucuccuggggaugauauucugcaggacuuaguuaaggacaggacucccaaggccuccccaccagcaugcacaccaggucacuuggcuccuccagccgacagagaccuguacacaggugucccauacucccacgggccuccccaaaagacagugucucccccagccuuaugcuucacuuuccuaauuucuucugccccaauccucaccagaacuacagagccacuccccaccaguccagguacccccuuuccuauagcacccucuccacaacugucuuguucucuugaaccugguuucuucucuagccaggauauagaauaccgauucaguuagcaaaaauguauuaaguggcuggcuacaguggcucacgcacuuugggaggcugaggugggcagaucaccugaggucaggaguucgagaccagccuggccaacauggugaaacccugucucuacuaaaaacacaaaaaguagccaggcuugguggcacacaccuguaaucccagcuacucaggagaccaaggcagcagaaucacuugaacccggguggcagagauugcagugagcugagaucgugcugcugcauuccagccuggguaacagagugagacucuaucucaaaaaaaaaagaaagaaagaaagaaaaaaaaaguauuaggcaugcaauacuucauuuauuguuuaucagauuuuuuuuucaucaauauguggugagcaccaugcuaggcacugggcacauacagccagaaacaaaauucugagaacauuauggauauauguacaucgcugcacacugaugcaagcuuagcaccuggugaugauacacuguaccauuauggacgauacggucuugcugagggaggugaccucccagggaccaacccgcagagccuauucaggagcugauagcaggccugugugguuggccuucagagggugagcuaaacacuggcaagcaaugaaguggccuuguuaaggcauuuagauuuuguucuaagugcagugggaacuagugggguagugacauucaacacuuuuuuuuuuuuuuugagacauggucucccucugucacccaggcuggagugcaauggugcaaucauggcucacugcagucuggaccuuccaggguuaagcaauccucccaccucagccuccugaguagcugggacuacaggcgugcaccaccacacuugacuacucuuuuuuuuuaaguggagaugaggucuugauccugucucaaaauaaauaaauaaauaaauaaauaaauaaauaaauaagaucuuucuagcugccacguugcggguggacuggaggauagcaaaaguggcagcacagagauugcuagaauaaucauccuguauaauaauccaggcccaagaugguggccuggccucagguggauguaggaaaaugggaagaaguaggcuuacuagauagacuauuuggaaguagaauggguuagcuuugccaguggacuggaggaaggugagggggagaugaaugaaaaugggucaaaaauggcccccuaggauucugcuuuaagcaccugagugggugagccauuuucugugauggggaagggaguuaaagcaaagagcagguucuaaaggaaaagcucuucucuaucuaagagacauuuguccugcucaccacuguuucccuagcacccgcuacaaggccuggcauuuauuaaaugcccccaaauauuuguaaauuaauuccucuuuuuagaauucaguuguggcugggcgcggugcuacacuuguaaucccagcacuuuaggaggcagaggcggguggauuacuugaggucaggaguucgagacacaugccaacgaggcaguguggcaaagugauuaggaccauggacucugaagauaggacugccuggauuugaauccuagcaccaccauuuucuaggaauguucaguaacuucucugauaguuuccucaucuggaaaaaauguacauaauaacucugccuaccuuauagggcaguuguaaggauuaauaguuaauuuauagaaagcacuuugaagagagcuucaaccuaacaggcgugauguaaaugcuugcuauuguuauuaagcugagcguagaugcaaaguugagauaccaaguuugaaguuugauauggggauuuggaacuagaaaaaaaaaauguaagucaucaauaaguaggugguauuuaaagccauaaaccuggaugagacugguggggaggaaggggaggauccaggcccaaggcaacugguagagcauagaaaagcccacaaagaaauugaaagcgguucucagcuaggaugaaaacccugugagcaagcagcucaagggagcaguggucauggugugguaaaugcuucugggaggccaaggaaggcaaggacugaaaaacaacgccgcccccccaccccggcccccacuccuggcaacaaggaaguaaccagugaucuugagcacuuucugcagaauggccagggaggauggagggguugaggagugagauaaaugaccaugugucuauacagugaaauuccaccagccuggaaauugacaaggccugucuccauguguugcuagaaaaguaagauauauugauaaguuucauaggugagguacagaacagauugugcaguguguucccauuucugaaaguagaccagaggacaugcauaucuacagagaaacugggggggaagggggcacuccccugcaguguuggaaaucuuuaaugcacacacaaauaugugucuauauuccccccuauuuuguuuuuacacaaacuguagcagaugguacacacugcucuguaccuuauuuuuuuuuccuuaacuguagaccuugggggucuuuccauaucaauacacagagcagaucuucuuuauuauuuuaacagcuacagaauauuccauuguaugcaugugccaucaaugucacugcugacucuuuagguuguuuauaauccuaugcuguuauaaacaaagcugcacuuauuccagugucuuaaaauaacuucaugacuagcugauuuuuagagugaacaugagguaagccugcagaaauuccacauggauggagacaccucuuucaagaaguccagguguacagggaaacagauaaauagggaaccagcaaaggagaugcgagguuaagaaggggcauuauaaagaugggugaugcuucaagcaaagaaguauaacaaggggccuuucaagaaaggguauggggggugaggguggaggcagcaaggaaaagccucuaagaaggugauauuuuagcagguaugaaacgaugacuuaaaacagugugagauccuauguugggugcugcgggaacaucaggauggauggacagacacuggccuucuggaagguucaacuccagcagggaagcugugcuguuucacaaauuggcugcaauauuguuagaaagugguugauucucggccgggcgugguggcucacgccuguaaucccagcacuuugggaggccguggcugguggaucaccugaggucaggaguuugagaccagccugaccaacauggugaaaccccgucucuacuagaaauacaaaaacauuagcuggguguaguggcgggagccuguaauuccagcuacuugggaggcugaggcaggagaaucacuugaacccgggaggcggagguugcagugagccaagaucaugccauugcacuccagccugggcgacaagagugagacuccgucucaaaaaaaaaaaaaaaaaaaaaaaaaaaaaaaaaaaaaaaaaaaaaaaaaaaaaaaaaaaagaaaaaggaaaaaagaaaaaaaagaaaagaaaagaaaaugguugauugucuuagagguacaggaucuacaaacuucccacuguggucccugcuggugaagugugcucagaguuccagaaguucccugaguuccugauaagacaggaagcuaggggagaggagaauauuuugccugaaauguuaagauuuuuuucccccauagggauucaaugacacgcaugcccuggaagguuucaaaaauuggaaauaaauaaaaauuccaagaagaauuuauauuccugauggcuaugcugauggucuuguaaauuguauauuuaaucaaagacacucaaaugucuuuuuuuuaacuauugaagagcuauuuaaaugucaacauaagugauucccucccaaauagugcuguuuauacauuacuuccccuaauagaccauaaugauucauaaggaggcauuucucgccucuaaauuguaggccuauugaaauauaaauuaagaugauaaauaauuugaccuuaccugagaguacuaaguauuuacaugugucaaauacgaaauuacccugaacaucauggucccuaaaaaggcagccuuccucucccgggugaauucauuaaaugaaacggguuuauaaauuucucuuagaguguggaagagagagagaacacacaaaagaacgggcccggggacccggccguccccgcccuccagcuuucccaugaggcccggggggccgcggaacccacuccccggcggggagaggcgggugcagaccgcccccgcgcgcuucccgcgcuccccucucccccuccuucugcgacgccgcaggaguuucaaaacauggaguuuccacaggaacuuugccaggccgagcucgcagcccucccgggcucccgcagcgggauucgccgagucggcggcgccgcgcggccuccccgccccccacgcccuccggggagccgcugacccggcggccucgggcagcuccgcaaaaccgcucgguggcuguagaaccuggggaggcgcgggggcuccggggcuccgcacccccgccgaccccguccgggccccggaggguggcagccuggcgcccuccgcggggccggcgccgaguccguccgccggcucuguuggcuuggcuccgccgcccggggccggggccgaggagcggaggucgccggccauggcgagcgaggcuggguaccuggccgcccgcucuggaguuuuguuuugaagcccggcgugggggaggggcagcaccucaucaaggagaaauuuccuguucgcaagcaagacuccgcuugcagaguuucuguccugcccuugaccugacaaguggaucucggcugcgcggguccccgagagucgagccagccgcgccaggagcgcgcgggggugggggugggggcacccgcgccgaggaccggggagcccggcugagcggggccgacgccugcccucccgguucccgggcgcacccgggagcgcagagccgagcggugacuaaucugcggcuccgggccucuuggcgcgcagcccggguucgccucccgcccccucgucucuccuccuccccgccgcccucccagcccagcagcgcagcgcuccgccgagcgaaucgugcgggccagggccgccgccgccgccgcguucccgggagugugggaagcgggucgaggcggguggcucgggagccgucuccagucggccuccuucgacccgggaccgaaugugcauguguuaccuuccccuuaagcacuuugaucagcguuuucuccucgcagccgaggagccagagcgaaccggggcuuuuaacccccugcgugccggcuccaccgugggcugagggaagagggugccgcagggagauuggucgauacagggugcgaucaguuugguuuagcaagccugagccaggaggagcccggccggauccgaggagcuugcccaagcgcgggacgcucuccuguggagagcaggccgcugaggcccgaggcgacucguuaauguucaagcucucccaggggcagcgcuguaacgcgaccugccuggccaggcaaggugcgggcuugaaaggcccggcgggcggaggcuucuggaggggcccgggaggccauggcgggacccgccuucacgcacccgguucguuggcgcguggguggcuccuaaccccgguggaggcuuugcgcucgccucgcggacucggcucuggccgccgcucccuccccugguccaggccucgcuugggaguuaaugauugauuuacuggcuccgcgcggccggcgcccucccagcuauuuguccaagcugaggaguugcuggcgagcagcgcaguaggccaagagagcgggggucgccggggaagggaagccacgcugccgacgggaaggagaggccacuagauuagcucccacuuggcggcucuagcugugucggggcaaacccucaggaagccgggcccgggcgaagggagcauugggaagcuccacauguaaauggguuggcagcuggcgauuaggccgcccgauuuuaugagucauaaugggccucccgccuggcccucaaccugcucgcuguggauccggcgcgcuuggggcccaagugguggaccauuccggccgcgcagagggacaugcuucugggggcccaggccgccgaaggaguugagaaggacuuucucuccuuucuuguagaaggcaacacaaacacccuaaaucaaaccgcuccgacaaucgaaggcuccacacagacacaucaauaaggauuucgccucccgcguaugaacgcacagaaacacuuguccuauuuuuaugcaaaugacaccacacaaauagaucucgcaggcccgggagaggggcgggaggaggaggggcgccgccaccccagccagggggcugugagaggggaggggcgccaaacccgcaccccagggcccgcgccggcucgggcgcagcggggcuggcacuggucaggaggcccgccccgcgggcaguggcucccugccagcgccgccaagucggccgcguccccaggcugccugcagaggcggauuagggaaggagcgaagcgagccugugacuaaucgcggggccucggaccggagcaccaaggccaugugcgacugacaggaccgacacuagcagaggacacggcgacgccucgcuuaauugcaggcuuaaaaaauugccgccugagcagcucuggcgcggagagccacggcuugcgcgucgagcuagggagcgcgcgcgcuugggugggggcggggguuccugcucucucgcuccaagguuggaacguuuggcgucuccuggaccgagggaccuggcccuugcgucccccacucugcugggucgccccgccccgcgugccgaccaaguguggcugagcccgccaggagaguacgauccagccuccagggcuagguuucugacccgacccuuucccccuaaauccgacguuuccccgcuuucgcccuagauccuauacgggagggggcugugcaguugggggugacagauuccaacaaauccuuaaaauaaaaaccacacgcacgaaagaaacacuuucucuucccuccccuucuucaccgacugauacaaagccccgaaugaccaaagggaaagagguaagucggggcugcagggagcaaggucaucgagugccaaaaccucggggcucacagacacgcacucugaguucuucaccccuggucacagucucuguggcccagaccuuccuggagcacuggggccucucgggggcgaagggagaagcgucgggaggccggcggcucuguguuggggagggggagugggagggagcggagaacccagcgagagaaguuuccaccacgcucuggccggcuacugccaaaauccccggaccccuccccgccugcaccgccuuccguugccaccacaaguuugguuuaacgagagcucgggacaaaagcaaacguuuucuauagaccccgaaaacaaaggggaaagagacgcgcggggccgcggagaagcggcugcuagcguaauggugccaggccgaaagcagagcauuaaaacugcaaaagccgcgcgggcgggaggaagugcgaggcgggaggcgggagcgcggggagggcgggaggcgggagcgcgggcgggggaggggcgcugcgccauguuuccgugucacccgccgagucgucggcgcugggcucggccgccggcucccgccugccuccguaacagcagaaagcgugcgauuagcagccagacaggcggggacuccgggcccgcggggccgccgcacacgccgcccgcggcccgagcccgcgccccccgcccgccggguaaucauccuccucgcugcagcgcugugugcacucucauuagaguagggaggcuuuucucugugcacucgcucggcucccgcuggcaaaacaacgccuucccgggccgggcccugggccaggagagucggggagggugggacggagguggggggugggugaggcagggcaagccuugcaggucagcuccgccgccggaucuccuccggacacggaggagacggggagcguccauuggcccuucccuagguggaguggcaaaguccgagccccgcagccgacccuacgucccuacguggaggggggcggguggaguaccggugccgccaugaccuacucccgucccccgccggaggcuagaguagggcugagggggagaugagugugucugguuuggagagcgggggcggacacugggaaggcucccaaaacagguuuugccccaucuguuuuaugaacgaccucuucaggccagaagccggaucccagggguggcggcccuucgaccuucgaaaggagacccgggcccccagcaggcccucuggcuucgcgcucugucgccugcagugggugggagauggggguggccgaggcuuggcugcuccuggcccugagcuucggagcccuauuuucuccuccgcgaucucugcacacaacaguaggcagccucucacagcagcacgcgcccagcugcagggccugggagcagguguuccugcccggccggaguggcggcuccgcgccccuccggucccagcugcggagcugcgagcggugcgggggggcgugcuuauggugguagcagagggacagggacaucucaucggaccgcaggaaggguccucucggcuuacaccgggauaccgcagggcccggguggucgccuggggcgaggagggaucaggggugacgcgcggccagcccucgucuggaacagcccuggggccagcggaggccgcucggggcggcgcgagggcuuccgguccccgugacugcggcggcggcggcggggcggccgcgaggagcacccuccccuggcugcugccgccgcgcggcucucggaacggcgccccaggagccucucugcgucuggcagcgccgcuuucggcuugcgcugggaugggggccgcaggguggucucggcccagcccccacggggaggggcggggaggcgggguccggagaccccgcgggaacggccgcgcgccucccagcacccccuccucgccgccgccgccgcugcugcugauauggcgggcacgugaagcgcagcuuggcgccccggcgccagccagggagcggccugccccgccgacucagcuuacccgcgggcccaggaacgcggaaccgagccuggccgggcuccgcggagcccgcaccuccgcccgcagcucgcugcggccccgcacccucuccccgccugagcccggccuuggggccgcgccaggcggcucgcccgaggggaacucgggcugacuaaugggacgcgugugggccuuacgugaggcccggcugucagcggauacccgcuugcucggagcuuagaccgcggccaagcuuuucggggaagggcgagaggagggguuuccccgcugggcgguuucagcuccccagggacaauccguccgcggcaggccccaaccuuuggaucuugcagccuggcuuggagacgguagacuuggcaugugccggacgccacggugccgacccggucgggggcagggggugggagccucgggguugugagcugggggugggcagaggcuaggucagcuuggucuggggcgcccgccuugagguuugcauucuggggcuagccacugggccggggggaauuugcagggcgcucugaggucguggagucugauaccaaaaccuuccucgacaaagucuuccggaaaccccuucgcgaaauuccugugcggaaagaaggauuucuaaaacuccccgaggguccgguucggcugggagcuuucggguucuagggagugugauuuccuuucucucccuuuauaggggccuauaaauaucagaagaguuucuucuuauuucgcauuaacaaccacuucauguugacauaguuauaugacccucccaaguauaacuaccuguuuaguuugaaggcacugagugcgauggcgaaacacaaacaucgaccaguaacuaagagaaggaaaacccagccgcgagcuuggguuggauacaggauaaauccucaucacgcaucccugguuuuauucagccuaauugcacuaguaauccugccccccgcgagaaagccugaaauccugcagucgaggugcgacuuuuccuggggagccccgccaaugggggguggguugucaguggaggggagguggguuuuaaaugucacuuccaaaugaaaaucuuucuuucuuuucuuuuucucuuuuucuuuuuugauccaguuuucgaaaagagcauuuuugcgagauaagaagugaccgaucaaaaucgcuaaggggagguuguaagcagccgcuuugccccagcuuagcguuaucuuaucucucacacuugcauggcggaaaaaaaaauuggcuuaucuuuauccccacccccuucucgccuuaauugcuaaaaaacacuaguguguuaaaccgggaggaaggaggucucuggagugucaguggaaaaggaagauucaaaaaugugggcucccgggggaagcaaggguggcagaauuuauucuuucccccaggccuuucugguacaacacaggguguaguccaggguggaaggcuggguggcucuuuuuuuaaauuauuauuuuaagaacaaaaucugggcuuggccuugggucguguggcuuccccaggccucgcuuucugaacuucuccccuccuucaucucucaaaagcugcuggugggucuggguugaggccucucacucugccuucauccucccuccucuagacacauccuccuuuuggggagggggggaugcaaggcuaggacacauagccugcuggaaaucauuaaaauauaugcgagugucugcaaacacacacuuuuaaaucauggcguuuccccuccacgcuggucuauuuaaacuccagagcgagcuggaucuccucccucucagucguuugucugugucaccgacaggccgcuaauggccgggcuuccaggcgcugugcauuaugcauuagccuccucccuccgccgcacacagaagguucugucaggccgcaccacacaaaccacccugagcccccccaccccaccccccgcacucagggccgggggcugcgcggcugcuaacgcgcugggaacgcagguauggagaggaggaugagcaccgagagcagagugguucggaagguggaaugggagcgggugaaaugugccgaagauuacaccguuuggaaugcccaguccguugugagccccaaagcuuugcuccuggcugcgaccuucucgaggcaaccaucccgcgccacucaccucugugaccgacuuuguugggggcgggagggcagagguauuuagagacagaucagcaccgcuuucccuucugcugguccguacccaccuuccugcugcaggcgaggggcuggcagagccuucucuaccccuccaguucgggagugguaccgcgaagggguucgggguggugcgucuucgcagggacccggugggaguggaggagggaagcuggauacaaaauggcuggggccggaggccggcacacuggguccgaaggcgaguaguuggugguuccccgcccccucucccggcgguucccacucacugcccccagccggguaaaauaugcgcagaaggcgccuugcuaaauaagcagccgaggcgggacguggcguccggguuuaucugcaggagcacccggcccagcgcggcggcgucgagggcucuuaagcccuugccgagcgcaagaggcggccagccucccagaagccuccuguauuaugcccauuuggucgacacccaaccacccugcgggcccccguaguguagaugccaguucacccacacgugccuguguucggggagcucagggccugacccaaaucgagcccagaccagaaauuccaagaugguugcuaggaaccacggagaggcugcccuuagggccuuccuuccccaaacacccaauaacccuccaaaggcuaggaagaagaaagaacagucauguucagccuggcgacccuuaaguccagcagucuucugcccugggaggcagcuaccuuuagauguuuccagaugagugaaauccugggaggaggaugcgccuccuguuuguuaccucguuugaguuucagaggggaagccagcugugccuugugcuuggaggauggggcagcggauguuuuuuaaagugccauuggauaagcccagaguucuuguacaaagugaccagaagacuauaaguguggguguguuuuuaaagaaaggcuaccucacauuauguaaaaauacauuaucuguacucauccgagucccaccuguuccaguaccaagugucaucgcccugagaacagccuccgaggaggaccaucggaagccuacacauacguuauaagcuuuaugauguggauccuaguauacguuauaaauaaaucuugcacacaagguuagaaggccaggguccccccaaacacaggaugccuggccuuuccccuaggccaggguggagcuggaggugugugggagaggcccuagcgggucuugcagagucaaccugccuugagaagggcagccaggcucaaggccugcuccuagaagggccagcucgauugcccaguugcagggccugguuagccugaggucgagugguuuguuauaaucaggagacacuuccaugggaagggagauugguggcggaggggcagcccccgcugcuccauccgcagcaccucucauuucggcaccuauuucuuuauuucuccgugggcugcacggccuccccucccaugcacuccuuugcucacucucuccuccuccucuguuuucauugaaauccuccccuugcugagugcuggguauagcagccugacccccgggucagcucccgaagggcuugugggagggcaggagaggagggggcaggagaagggccaaaccgccggcacccauugcaggccccgcggcauccccagcucccugagccccuucuuaagugaggacacaagaugggauugcccuucgacagcuuucugcuuguuuuccccagaacaauuggaacuaaccgggccaauagguguaaucuccccucccccccucugccuuauagcgccucgggaaaaucccacauuuuaauucccagugagucacgaaucccccccaccacucaugccucuuaggacucccuuaauaagauauuuuugaaaucccacggaguugaaaaauguaucccuaggagauggaggagaaacccuuuaauccuaccagccuaccguggaggcaagaucccuagaaaaggugggggaggauguugcaaauuacgucaaaggcgaauuuacuggccuguuugucuccagcaucaaauuucucccccagucagcccuccccucggccccuucgcauuuacagcacccccaccaccccuguucauuuuaacucuaggacuuuuuuuuuucuuuuucuuuucuuuuuuuuuuuuugagacggaguuucgcucuuguugcccaggcuggagugcaacggcgcgaucucggcucaccgcaaccuccgccucccggguucaagcgauucuccuggcucagccucccgaauucuaggacuuuuaaaguuagacaaacaggccucuuugucagcagccccgggaggccguaagacucugagaggcugcaggccccgagcucgguuccuggauuuucuaaaaguucuggacguuuacaugcgacuucgaacuccgagaaaagccugugccugggggcagaguuggggagacgaggggaggggauagaagguggcugggcgccgggccagggccucugcgguucggccuaaccgagccggaagagccuggcacggcuccacacuggcccaggccaguucucccguccagccugcagcagcagagcggccuccucgccuggaaccacguucagaguuuccccacaaauacccagcuucagccuucccgguuauuuuugacuuguuuugaauaaaaggagucgcuucaaaaagaaauguugccacaacacacaaccagaggccuuuucuccagcugugucuguaacucgcaugcguucaaucuaauaacuuuuaaugucugguccuaaaaugucuuuauaaaaaauaguuuuacagcauaauaguccaggugucuuucugcuuguuaccggagauuaaaaaaauguguggguuggcuugcagagauauccacccccagaaagaccaggaagaaaaaagcgugcauuccauucugcaggcgcugguccuggaagcguucgcggcccagccuggcugggcacugcucgcgggggcacuugcucgccugucuuuugcaucaguuguuauaagcagcucuggagcaugaagauuuaauucugccgaaguuucggguuucaaacgguagagauguuucacuucugcuuugagaagggcuguuuuuauaacuaugugcugagaacuaaaacagaaugaauaaaaucgcaccuaauaccagucccacagucaguagugagucuaauuuuuaaaagggaaaauaucugcuagcuagagcugauuuuggccuugaccuugacuuaguaaucaacuugagaugcuuuugauuauuuuuggcauggggacacuccaggauauuuuaaaaacuuuccguguggauuuacaagccaccuccauuucagauuuauguuucauggagccugcaccaucuuguccuuaggcagaaagagacaccccacccccuucccaguauaaaaagacccuagugggcagccgaauggggucaccauuggccgcgaaguccgggcccgcagucugggcgcgguuaguccggaauacccccucccccacuccuaccccuucccgccagcuucaccaacuagggcuucucggcucgcccuugaggcuuugcgcuccggggaggccggaaccucgcuucuccgcuucccccucccucccgccugcccccgcccuccccccgcgcccagagccgcgccgggugcgcuggagaagcucaauacgugucaauugaauugaacugcugcgggcgcaggcuguacgccgccgccaagcaccgaucagcacgacguuaccgaguggaaauuuauggggcgaacgguguaagccaaaaguugcucccugucaaggaaaauaaaacgcgggagauaaucucccaacgccggggcgaggggccugggcagccccuccaaccaucagagguacagaccgugaaaaugcucgagaaccgggagaaauacaggcggaucuccgcucgccgaccgccccccacacgccucccggugccuccacgggcugcuccccccuucccccaccuccaaacaauucccacacaauugaaacguccggggaacucgggcgcggaguucaggcggaacggccaccguugccuggggugguguuuucagguagcuuuuaacaccgaaaugggaaagggcuccucugggaggaaggggcaaacuggggugggggugagcacgggagcacacaggccacgcuccgcugggucucggaggggacgaggccgggagagcgcagcgcugguggcaagaggcggcggcagcggcugcugccgcugggguuugacagcuuuggcugagcggagugcgaggcgcuuuaugguaauugcgguccuccacuggccuucuggguagcgaggggagucucggcgcgcggcugggagagccgcccccgccgcccccaucccuucggcucuggcucugccggcagcccucgccgccgccgccgcccaagucggucuccggcucgcccaggacgugcgcccgggucgggcgugcgcagccaacucggcccgagcuggggaggggaggccgggggacgaggagggggggcgccacccaagugguccgggguucggauccagagaggccaaaacgugccgggccgugcaucgaugacggccggggaaacucgggcaaaccuuuccuggggaaucaccccucccgaaaccccgccgcggaggcgccgcagcggagggugagcggagacuggcggagcucaaacuugcgagagcuggaggcggcggcgggcgggcggcugucgcccgagcgcugcgccugcggggggaggggaggcggcuguugggagggagggagguagggcgggcgggagggaggacgggcggagggagggggaggaggaagaggagggaaccagggaggggggacgcguugggaucgcggcgugcggcggcagacggagccugggcucccagcggcaaggugaggcagagcugcgcuccucgcugaacgcgggccgagcucggcggcugcgggggagacgcgcaggagcccagaccgcgaccgagagcgggagcuaggcgggcggcggcggcggagggggagcccgcgagccgccgggcggagagcccaagccgcgcugucgccgcgcagggacgacuuggccaacacucacacacacucacacacacccagcccgagcgggcgcucgcggcgaaccgucaacauggcgcuggggcuccugcccgagcgcgggcggcggcggcagcgcgggagcugcugagcucggccaagcccaguccagcugcgggagcccggaggaucgcacggggcugucgccaccugcccggaggccccgagcccgccccgccccgcccccacccggcccagagcccaccccucggcggggccgaccccgagggcagccggcugccagcagacggcgagggagucgagugagcgcggcgccgcgagcgggcugcgggcagccggggaccgcaaacuuugcugcucgccgcgcuucuccggcccggcuccuucuccgcucguuaacgucgccaaccccccccaccccucauaucucucuccacccacccaaccgccccccgcuccuucucgccgccucgaguccgcuugggggaaaacuucaaagagccggaucgcaggcucccugccuacucccccaccggggauuucaggucagugcccggaacaccuuucccccgggagaccgcggacgggugggcgggcgggcgcgcugagggcugcagucggcccccucucccggggcccccucccgcagcguaccccgcgaagcuuuugccucgcgcuucccuuuggcugcuuggcucgcuuucguuuuuauuucauagcuauguuauuuaaaaugcagccaaccuaagcggccccgcgugggcaccagggagggagggggcgcggcugggggccuggcgccucccggugggccaggaggagagcagggaguucgcagaguggaaguuugcagccugugugugucugugcgcgggagcgcggucgccgcugagcgccgcgagucgggcggaggggggggaggugggcuggaagcugggaagcuggguucggcguuagcucgcgagcaggaaggggagggcagcggguugccgucugcuuucuuuuucgacucgggaaagaacuguaaaaacccccagccgccgccaccgccgccucgucucgccucuccgggggccggucguuccuccaaguggaacgucggcgugugcgugcgcgaggguguguggcgagugccucgggccgagccgagcucgaccugccgccgcugccgcgcaacucgggaggggagucccguuuuuucuuggcuugccccaaagcacgaaucacguggauuaaaaaaaaaaacuacuaagaaaucgagcagagcaagggguuccgacuuggcccgcccgccagccaggucagacgcuuuguuuuguaaauguucuuuuaagauuauaaucugcgaucccccucccgcuuucccccuccucucccuccccgauguucagcguagguuuuaaguuaugagcccccagggguggguguagaaugugcuugugcgggggcagcgucguggagggagggcgggggcgggcgagaccugggcccuccgcugggcaauggggagucugguggguagcccugaugggcgugugaaagucugcggccggaggaaguuggucccacucggagggcguguggcaaggaggcuguaggcgaagaggaacuugcgcaccggggcaagauccucggccaaggcggggagggcgaggcgccgcggggcccgcgcucggagccggcgggcggcugcgccgcagagccuccgccaacucgggggcucgcggcggcggugacgagcgccugcuguuuacggagagagccuuggggcaccguguguggaguagggcggccgaagucacgcguggucccggcgggcuucccgccgcucgcacgcucgagugggcccuucccggggucccggagacggacgagucuggcagcguguaggccguggccgggcgaggcguaauuugcuguuaaugaaucuuuuccagaaaguccgcgaucuccagcuagaggcugugagugcccgcgcgccagggcgcgcgccgccggcgucuggaggguggggguggggggaauggaagagcgaagaaggaaggaggaggguuauguguauuuagaaacaaaccuuaaaaagaaaccaacgcgcuucaaauagguauucgcacagccucgcugcgucuagacuagacagcucgggguuuuagcuguguuuucccccccuuuuuucguuuugagaagacgcuagaggagggguagugugguauuugguucuagggguagucuuuuggagaaagauccuuaaaauggccugggaguaaagacuaggaggaaauggcccaccccagaaggugguggguggugagugcagacagacuuggguauuucuggccaucugacacuuccuguggcacuggaaacggacaccgcgggccgaaaucaauccuuacgaaguguuggguucgguuuugccaacagaauugcuugcguggaaggcauuuuaauugucagccucaaagauuccuguacguggacacuuagggaauacgcucguuccuugacccugcccacuccucucucgaccuguuaucugguguggguuuugcaguguugguuuucguguuuauuuugggcaggguuucagcgcguagagcggaguggggggggaaggcgaugauuaauaugccauccagguuuaauccgaggcuggccuucagugugcggguauacaccgccacgcacaccaauugccuugggguguuuaggggagcgcgcggguuuugggcagcaggcgcccggccggcaagucgcggcuggggcucggcuggccccagcgcuguccuuugaggcgcugucaccaguaggugacugagaguuaauuaggaaguguucuccggaucaaugggcugcacagcucauuagcgauucucuccagcccuuugcagggccguccuggccuccgccucccacacaggccggggccucgcuguccaggcugcggggagcgccgcugggaaguggggaggggccgguagcgagggacggcggggaagcgaguguaacuucgcggggcggcgcguugcgugcggcgccucgaggcccgcgcagcccgcucuuucuuccugcccgcggucgccuccacugugucuuuaacucgcucccgcucgcgucgcugccuggcugcuccuccccgccucccgcgccuaucucuuguucucuaagcacgacgccugugcuccccgcccaguuuaggauuagacaagauaaaaauaggacugcccagcgcgcggagcugugacugugccccggcagccgggcuggugggagcgcggggggccggagcuggagaggacccguggugcgcucggagcggccagugccugugggcccccuacccccaccccgcaggcaccgucacgcuccccggguucuguccgccgugaaccgugcgggccgggggaccugggcagggucuccgcgcucucgcggguguuguuggugugccggugauagaucggucuagacaggcaugcaggcucccucccggcugaaggacuggaggggggggaggcgcggagauggcagcagacucugugagcugcgagugagcgagcuagccuccgggcccagcgagcuggguggagggaaggccguggggguuucucuuaacccuuuaaaggccguggugggguaguguaauagggaaaggggggcaaagagccuaguggaaauuccuggaggcagaguagcucgcaguggggaggagcugugagucugggccuaggguuuuccuuucucuuaugugugcacggucacaucuuggugcaucgggcucgauucuuccacaaaccaaacgcagcugcuagaugaucuaguuugaccagguauuucucagucggggagcugugaacacacacaaugaacacccucacuuuaaaaacugaguuuggaagacagacguagacucaauguucccaaagagaauucaugcggguguucaaggacgggaaggucugcacauagcuguagucggguggggccucugacuaugacugcugcagaccaaggaccugagccugaaaugccccgccagcauguacagguaugcacugaagagagcaaagcggucuuugaguugucucuauauaaauagacauacuuuuaaccaggaacuugugaggaguuagauaugugcaaggagacagccuccaaagaggagcuggacacugauguguugugagauccaucguuuguguguguauauauauggcuaauauuaaauuggucuaaaauuuuaauacaccucugcagacauuuaucuaguucuuucuucagcuugaaaugggcggauggguuacccuauacauaaauaacucauuacuaacauuccagucuccuccucccuccucuuccuuucuuuaagaguuugugaucuuaagggauccucuguuuacauuuaaacugcaaacccauauuggucuggccugggaaagagccacauuauaggcaaagcaaaaagaauggaaguaguacgaaugcucagauuaagaugugcgcuugaaugacaugugcugagacaaaucaagacacuugggcuccguugcccaaauggaacaagagauacauaagagauaaagaacuggccaaggggaauguaaacauggguaugcaaauacagagauguauagcgauauucugagagaaaaaucccagacuuuguugagcuggaaacuggggcagaauuucuguaagugcguuccagagacaauagcccauuuaaaggugugaagagggucacuuggaaacacaaaaagcauucauaugcauacauccaugcuuagauacacaggcugaaugacaaacacuccucaaugccugacgaagacuuuccugccgagugagugagaccgacuuggguacagaagagugggccacacaaccacauucacacacuuauucacagggaaauaaugugucuuuggcuugaaggaaacugagggccacgcuagcagccuaaaggauggauggugugcagugaacuaggauuaucucugguuauaguuucuuucccuucuaggggugagguggagugggcagcggguuggugacgagcagguaggagccuuucugaagagauuuugaguuccugaccuugaguggcuggaucguguagccacaagagggguagcuuuccacuuuguggucaguaggaauggcuguugcacugcugggguccaauuugcuaagguggagcagggccucagugggcugggaaggagaacaggaagaagugcggccucugggaggaauaaaagggagguaugcuuucuuucuuuucuuuuuuuuuuuuccucuggaggagaccguggcggggacagccuguguuggguggauuagcaggcgccucggugaccccagacgcgcacguaaacuccggcuaggguauggcuugcccgcggcgucgauuugcugcggucccucuuugucuaagcccagccgggaauuccagcuuuuauugggaagaccgcacuuggguggggcccgcgccgggcggaguggggcaggguccggucgcgcugggcgggaggcuuggagcccgcaggacguuccccggagcugcgggcagcccuggcaaugccaccccggugguuuccucgaggacaccgggcccggcggacccggagaggcgcggcggggcggggaacuuccuggguccaucucggccgccccgccccacccuucucccuccggcccgaggccgaaaggagcucacaaggcccuuuguuaggccccgaggucacacucgugccccgggggccgccgaugggugggagaaagcagugcugcgggucaagaggagccuccuuauugccucggugccccagcccaucuucuggaucgggcccggugggggccucgcccaaagcuggguggggaggccugggccggcccugacccgccccggcuucuuugccaguguuuauggccgacgggauuccgucuguuugcaaaaccggacgcgcugcugaggccuaggugguagagccaggagaagccgccggggcgggaguaaauggucuccccccagccgcccuggugguagccgagccgcguucgucgcgcgcacuuggccgggggcguccacuggucuccagcccugcccgacggcuuucucugguugcccucaacguguucaucaggaagggauaucuuacuuuuuguuggguggaguucauuaacgaugccuuucugcgauauuucuguagaaggcucccuuuuggggcgcaagcucaccuccauguguuuacaaucgagggucucagaaacggggguccucacuccgucauuguuuuagagcugugucucccacagccggcacccacgggcucggcucuccaugauuagagaagcggggaaguccacucggagaagauccugacagcauaaaaaauaauuugugaucuaaaagacaguuuccaguauaaucucauuaugcaccacagacucccgauguuauuuuguggaaggcggacaaugaucaauuuacauugacccggggcugggcgagcuuuuagaugguaauugccauauugauuugcaugcaaaaaggagaccugcuaaaauuaaagaccggaagcuaaauuaaacuaaauuuauugucuaggugcaaaccaggggaacuguugggggaugggauugacucaggucagggugccaggggcagagcaggugagaagcccuggagcuucggaaggucacaacuugggaagcgaucuuugcccuugugauuucauguggggagggggaauguguuuaaggaaaaaaguuauaaaaagacaauuuugcauugaagucacuaggaucuuucaaugcuaauaggaacuuagagggagaggagagguuuauaggguuauaggggucuuccagcaccauuuccggcguccccccuccauuucuauuguucugccuggccagacgcucgcagucgugcuagggacaccaaaaaccucuugcauuugaagaguuaaaaaauaaauaaaagcagcccgucccccccuucccgccuugcucucucuccccucccccuucccggagcauuagacuuuucggagagagcgcaccgcgggcaggccaggaccguuggcgcuguagggaguuccuccccggacgcugcggucccaggcuuggcuggacggcgaucgcuucgggaagccgcccucuccagguggccacaguaggcggggguggggugggguggagcaaggcgucugcccuggccgccgucuagcggugcccgggacuuggggggaaucgccuccccggagggguuaggagggccagccccgccccgccccgccccuccccgaacugggugggggccggggaggacuggaaacccugcccguucgccaaggccggaaaguuuaaaaaagagaaagaacgccacuugcagagggcuggccugcagccagggguggccggccugcgggggcgugcucggcuggcuagcggggugagcgccccggcgccgccgucuccccuccgucccucccgccgccgaggccccugcacacucggucgcacugcggagccauuucgcacauccggagcuucagcgucuggaggaguaaccaguccagggccgggaagcccgaguguccgguaccccugccuguacccaucgagccgagccggagguggcuuuggcaggcucugcggguguagguaguucccggaacaucugaaagccuggggcagacccggaaauuggggauaggguggggaggggauguugggcccugagguuugcugccggccgcuucuguaaagaaacguuggggaaaggacaagauagccuaucccccggcuugcgcuuuugugggggacucuggguggcccaauagaacaucuugcuggcgucuuccaucuuaauucccucucccacacuacuuuguucccugggguuuuuccuuuaaauccuaggaaagguagauggaggagcucccuccaaagggcuuuugcucuaucuagauaauuugauuuauugcuuuauguggcgaaacugggguggcaagccuagcuccuaguaccaguagucagcacuuuucccagagaccugaaaggagucgacccaccuuaccccugacuauucugggguacuggaggaagggaaaggggaggcuuguugagagcauuggccuuacaccaggguauaacaguguagggagauuuguaggauguagggggaaauggugaaagacuuugaguggaccaggagaugacuuagauacaggagaaacuggguucacggcucacuguagaccaaguaacauagguguuaaacacucuuugccucguucuuggguacauaaggccuaaggaagcuuuucagaggagacaguaugugaaaaucaggauuucaaauggcacaauuagaccaauaauuggcuccucuccgcaacuccaggacugaguuugaccguggcccauuuuuuacuagcugugugaccuugggggcaaguuauuuauggccuuugagccccaguaaguuuuuucauuuguaagacugggaauaauuauccaccuuuaggaucuaaauagaaugcuuggcacauaguaggccccaaggaugaauaauugcuuugaaugacuugucauguuccuauagguugcuccuccauucccugcugccccugagacccccugagacuugcuaggccuguguccugggacccaaggaugcagauuaaaucuccccuacgaggguauucuagguccaccuuccuggguuccccuuucccuuuguuaccguaguuugcauucugccuuuuaaaggauuccauaugaaaagacuugcuucuccccuccacccccaagugggaucauuauaugguuaggaacucauuucagaaccgucaucuagguacccuucggcaaggcuuccuggcauuauuucaggggggaaccacggugccuagaggggcaagaccugguuggaagaggugagaggggguggccuggugcagaggccagaggugcugugguuuguuugauagggauuaaguccggauguuaugagggcucaaugugguuuucaauaaagucugccagggauugcuucuuuuauaucaauauguauuuaaaaaaauuacuagcaugagaagaaaaccagaccuguauggauccaggcugguaguaagcuacugugaucagguuuccuacucgacucccagaggggaagucaguguuugauugaagcuacacuugguucuugacucucaggggaugccugcucugaaacaggagcccucccucccuuucucuccuccucucccccuccuccucccucuuuuucccuucuuccccuaaaagccuuugugcugaaagagcuucaguaggcacgaaucccuggucccucucuaaagaaugccuuacagccuuugcugacauuguuuugugaacaguggguuuuaccaggccagcaguuuccccccgauuuuagcgcacgauuuuaaagguaguguauggacaagaugcgccuuacugcagugauugccucaguguguagccugggcuggggcuuggaaucuagagacgccuuaaccuuugcccuaggggcccuccuggaguggggggugaagguggggagcucgaggacugauuguuuucgaggaucuguuuguuuuguccagccaccgaggcugaagguggaguugggcaagucugaguguauguuccagcuuugggucugauuuuaaacuugguuuaauuggagaaacuccuaggcauuuaacaguucuguacaaaugcaaacuugaaauagcucgaggccuacgucauuuaggaaagaauaaaugaaguacagaaauguccaaacuauguaaauccuagcguugucugcccucccauaaacacaugacaagugccaaggcauuuccagucaaaacacccauggaagcagcagccuccauccuuuguauuuauuauuuuauuaacagcauuuuacacagcauuuaacaagcacagcgugccugcuuugcaccaggacucuaagcaggcgaaaggguggaaaauggauggaggugggggaggagugguugcuagaggacaucaacuagagaaaucucaucagauggguagggaaagcagcaccggggguuuauuucuacuggccacaaggaagacagacauagugcuuuggaggaagaaauccucucucccaucccaggaggaaaguuguacagcugugauaugucuggucucagcuuugauuccagaggguaaaacaggguauguuucaugauacucugcccaucgguuauuggugauuuucaaagaauaaguauuugucugcuaucguuauucuauauccugguggaaaguuuauaacgaaaaguaaugccuuucuuaagucauaaaaugagccuuguaugcuuauuuaauuaaaaucuauuuaaggaccgauuaggcguguaauuugcacuaauaaugacgauuauggaaauguucaacuuaaccaaaaaucauaaaggagacauuuugaucaguggggcggccaguaaguauuuagugaguugggcaauuuccgaaagacaggaggcauuccgcugagggcugcagaaagcacagaccugucuggccucugugacauggcauggagaggggcagaccucccugucccggccccggccccagcccggccagaccccacuuugcugagcauggaaaccaacccugcgagucuccacaaccuuuauucucgugaugcuuccucgagcuuccagaaggaguaaacucucggagagggcugaugagccacacggaaaucucugcgaaauggcggugcucuuuugcuuuaacaaacagcgcugacaaacgcaugcuuccuuggcuagccuuggcuggaucccggagggguagggggagaaggggucccuuguuccggagaaaccugccagcugcugggcuuggugugaaggcagcaaaggcagacacaaugcugcuguuguugguuugaucucuaacuguggauuguuagucuggcuuuaacuaugugguaaggggggaaugugaaggcuguuuacagcgagugcaaauaaugugacagcuguuggcgcgcgagcagcgcugcgccuccucagcacuuacacaaagcgcgcacuaugcaggcccauggacgagcugcagagguggcggccaguuucuggccagcgcauccccagaugagagaaagcuccacggcacacccgcccuccauccccaacacacaucuuuaugacuucccaggauugggguggggugcaggaugguuuguauguugugguuuagggaacuuguggugaggcagagguggcgggagaaggcccacggggccgugagugucaccguguuggugggguuuggccaggauccguugaacuggguccucagcuguuuauggcugaguuuuuaagauuugugaaaauaacuuucagcccuaaguaagcuuguuggaaagaauguguuauuaacugaaagcuuucuggaaauugcagaggcucugaaggccguuguuccccucugaaauggcccuguuauucagacaaguuagagacaggcgggugcuguguucugugcacucgacacuguuuccagcuuggaaaugcaagugugcagguucaguacccuaagggggguguauuuuggggggaagggaggacagauuggcuuuugauuacccacaucccuuaaccuuuucuuccaagccuucccguuuucaagagcacauuugccuucaacugcagcacgcaaaggugccguccugaagccugcccacagcaccaccuacucugacuucaucaacuagaugcccacagcaacaggcuuucuuugaguuccugguaccccgccaggcccugcagagaggcgccagggugggagggagagcaguuggugguggcaguuacccacuaggccaguccuggagguucauggcuggcccaagcagguggacuuaggauggccaagaauguggaccugccucuggaccguccuggggcaagcuggguguaaaaauucacuccucucccccaugagucccaagguugaagccuuccaagcccuggcaccugccugguccuccuuggguuuuggaagaucauuuagggcugacuuuggucucuggguguacagccuacaggauaucugcaaaucuacuucauucucuccugucccccccacccucagcaccuccccucccuaagucuacucucuaaguuuuaacauggacuucuacaucuaguuggguuuccgauggggagcugggagaugcuucuggagugagacaugaacuucggugccaguucuauaaauuggucucuuuuuaugacgugugccauuuucuguaggaauguugcuugcaaaacgaguuucgccuuggaggaaaggcggaaagauaaacaagccugcaacgccaaaacacuggcagucuuucccuccuuccagcucucuuaaagcagccgggcuguauuuccaggauuagacuugugcaugugaggagggacucgcguuggcuuuuuuucccccaagcaaaugcaaauuagagaaaaauaauuuucuuucaacgauaugcaauguauuagucacuuguuaucgugcuccgaggcaggccucauuugcgcgucugccagcucgcucacaucugcucagcgcuguucggggcauuuuaaccuuggcggugucgugucuagucccauggaucaaggaggaguaauuaagcccugaacagcuacaaaaauucgugggcccccaucuauaccauaguuguuccauggcuuuguuuugggugcucugaguuccaugacugaguagcagacaugggauuccuauuguuccuuguaaagaaggugggugccccucuccuucucugacccucaucccagccuuucugggacucccaggcucugcacaaucagugagagacucgcuugcagauugcaggaccccugcauuuuacacaucuuuuaugcauuaaaaguuccuuugugcuuccuguguauacuaaugauagcuguuguuauuagccuuacgguauagcuuguucccuucgguggugguggugguggggggggguggcggcgacggcguuuguguuuuacuccuacaaagcccugguggaaacaaaagugcauugacacagccuuuggaggcaugguguggaacauuuauucuggauuugcccccagguuguguagauucccaaguggggacccaguucugcagggacuagaucaaagggggcaagugguuucuuuuugcguggagggaagauaguaaggagggauuccuggcuuuugacuuggguuucuguugccggguggccuccugugaagggacaccuguuucuaaauuugcccucucuugaauacacacgugguuuccugacuccccguguggcaaaaccaugaaggaaagugaaaagaacaaaaagccggugggguggccuggacagauuauccggggagacgggcaagugucccccguuggccugugagagagagguugggggcaccugaccccgggccaugggcucugccuggaggaggggaguguagcggacaauccagguucggcagcgacccucagggucaaccccugcagauuccaccccggaccccaacgcccgagauucgcaccccucccacguuacaguaggcgacgcuuggcucacaucuuuguaaggggaagcguccagaggagcagcgcucuaguaugaucggaagggaacccagaacgauggcgaggaggggucugccgugcccauuccccgggugggcucggcggcguuucccgggaggucucggauucucccugcgcccacccaaaguuucuuuucgucagauucguugauggggagagaaggugcggcggggccucgggaaggggcaccauggagagcgugccaggccgcaggguccgagggguuaccuagggucgggaacugggaaggucgggccgccuccggggaggcugcuggaguuccuggaaggccuggcgggggcgcgccgcgagggcgugagugugugccguggugcggccccgcgcgcugggaccuccgccgaggagcggggaggaggagcgggcgagccccgagcagcacggguguguguggugggagagaaaaucccuuuguugccgaccgaucgcgcuccgggcugaagcgccucagcccggggagggggcgccccucccccuuucuucuucgccggggccaaguucacucccagcccagguggcucuccgcucagaccccgacgccccgggaggaggccgggaagguucugggugcuggaauggucugggccggcgaguuuccccuucccccucccccuuacuaaugcaaaacuuggaggugugggcggggacgcccgugcuggcuacggcuaaggcuguggcuuggagugugccaagaggcagcaccugggccggcuggaucacuucccucacccccaacucucucgggggagggggucgggaggggugggaccgggccagccaccucccucgaccacaccccuggaagccugcgguuuugccucccagggaccuggggggcagccuugggguaucuuacucuccagcagacccggaggacccaucccacacugcacauccggaagagcuuuuucuucucaucucccacucccacacaccccacccccaccccucacauccuaaaauaggaacuucuucaccccucccuuccuugacacccggagcacagcgcugcugcugugacgcagucucuguuuggagcaaccccaggaagggcuggcggguggugagcuuugggcuucuguaaaaucuacacaguucugcugaaguucccucccugcucugauccccucucuguugcugccucagccucccccgcaggaugaggugguagugccccaaagaaacuguguugugauucuggggcuuauuacacaguguguuuauuggagucggguacuauuuagcgggguuaaacguggccagcgccagcuauugccaggcaaaacucaaguccauagugcagcuuaauccuuuggaaaacacagugccaaauauuuacagaggggaccaagguuggagagguucagccaccugcccagagacacgcggugagugagggugggagccgggaggcuguggugaccauguucuccacagagaaccagccaugcaguagcgagaccccuccccugaagaguccucugccagaggaccccagcacacuggcugggaaugccugccuggccaccugagcuggaagcccuugcgaaccucuccaguucuucuggcuguuaacugcuggauagcugccggugggggcaaggggaaccuagugagagagaucccaagaaaagaccccgagaugggccacccucaaugccuguguggacagcagggaggcgugagcagaguuaguuugguggccaugcuuuccaaauugucagugccacuugacaaguguaaugugcagacuuuuaacugaucggcgccucaagggugggggcaguggaaaguggcccuagugcaagagggggccaggguuggggguggggaaggaaaggggccaaggcuugggaccuguggucugcccucacaucuuuucacagagggugggugugucccuacucagggaugccaagguuggagugauggcuuaugaucuuggucccucgacgccccccuucugccaaucaggccuucucccccguguccgggccaagcucaggugcucucaucauaacccuuggcugaagagcgaaugacuacucagagucuguccagggugacccaagcucuccuauguguuccacuuccuuggugcuaagagcuggagaccaugcaguaugcagugugcacgccugcuucucacaagccaggucucuccacuuggcccuggguguuccugcaggcagcuggaacaguucccagucuguucuuuagagacccacacccuccccaucugaccucuucucagcugucuuuccucuccaucccuauccagcaccuuuacccacuucucuccacuacuagaaaaagggguuaaaccccagauccaaggugcagcuucgcagcucacaguggaacagguuggugcuuguaaagugcuuuucaugagugacuucacacaucuuggcacuucuggaagcauagccugcauuuggaagaagugggggguggaggugggcauugaaaaauaaaagcaaacgagcuucaucuauagcugcaaagcacccugaggcucuguuugucauugaaaucaggucauuugcccucuccacaguguuccgcugccaagggucagcaacaucaguuucgaagcacuuggccuuagagguaaaaaaguccccagcuauuucaacagcagcuucuagaaguuugaugucccuauacuuugccucccagucucuuuuuguuucuuaccccaguguccccuucguuguacaugacagagaaaccagggugggcuguagguaauggugaccccuguucuucaguagaggcuuggugugagccguauggccuuugcaaaggaggucccugcuuuuguagguuuggacugcucuuugucacccaggaggagggccuccugugagccagggccauugcucauuggcccuuuccacuccucuccaucuuuggccaggaacccgaagaguuaaaagucuuuagcuuguugcaaugaaauuauggcuggcaguggcgccgcuguuuguucaacagaccuccacuuuuaaacaguucacaaaaaguucauggggcagcuaaagauuauaagugugugugugugugcgcgugugugugugcgcgugugcgugcgugcacgugugugcguaaguccacagcaggauccaacaauguguuccccccuuuugcuuuuauguucagccccauccuccaccccuucccucccaaaacacacacacacacacacacacacacacacacacacacacacacacacacgacagugaaccgcucugcuagccucaacccuccaucugacccugugcauuugagaacacuuuguucugguggcugguaucauuuaucugugcgccauuaauauggaaagccccaaaggaggagcccuggagaaggggagaugcuuugaaagcacccaguaggcccaggugccuguaaaccgcagucaccuuucugcuaaguccagguggacuuugcugaagaaaggcucuuugaagggaagcagcugcuggccuuuucggggcugggccucaguauaaugauucuguuucccaagaaggugccgggagguccuuugcacaaggugucuacuuaagggagguggguaagaggcagguuuuuuguuuguuuguuuguuuuuugaguuuugcucuuguugcccaggcuggagugcaauggugcgaucucggcucaccgcaaccuccaccucccagguuccagcgauucuccugccucagccucccgaguagcugggauugcaggcacgcaccaccacgcccagcuaauuuuguauuuuuaguagagacgggguuucuccuuguuggucaggcuggucucaaacucccgacuucaggugauccacccaccucggccucccaaaguucugggauuacaggcgugagccaucaugcccggccagaggcagcuuuuuuaaaggggaggccaauuuuuaagaauggggacaccagaagauugagguucauuaggcacacgcuucuucccucauccuuuucuuggggguuugguugagugacccuuuggcucaugauguaauuucuguauuucaucauggcacagugaggggguggcauggugcagucccacugcugcagcccgaugaccgggacacacuggcaccggggaaugauguuccaccuucucuauuauccuacccagaaugucuuccuuuuguuagaaagggcagcaggggccggagaggggacacugccacugcacaagggaaugugccuuguggucugcccagcccuagugguggccuuccccacuugauuuguguauuugcaagauggaagaaaagcccacgaacccuuauagaaccuuccccaacagccgagucgguccuuugggggcgcuguggcuagucaacuggaagagccgcugucuggagacacuuccuagggaaauagcuuuccagaaccccaucaugccugaugccucugcagauuucugccuuuuucuugggcccuuuaccucucuuccagccucauuguugagcucuaacuguacguggugugucgcugcauguggauuuugguuaacagacguuguucuauggggaugggggcccaugggggaugcugguggacaaaagaccuaguuaggacaaagaaaugagaaaguacagaccggcuuugggauuccaucccccagguguccccuuaacucccacccucagucacucucacagaagaguccccggaccuggugccuccaacccaaccgaccuggcagucugcuccgugugcuaaaguguaaaagcaagcauuugcauauuuuuuccugcuaacaaaggaaaugugucgacuuagggaacauuugggcuuucggaaacugugugggugggugugugagggaggagaaaaaaguuccccugaugaucugcacaccaauuauuucacacccagguuugggucccguggaaaaaugccauggccggucuggacaagggacacugagauguguuugugagcagggaauugccgagggccaucggucccaggcauuaaaggcuccccuacuuauuaacccagcauuuaacagcaggauaugggcugaagcgcagucaaaagaaacggcucaaccuccaaagagcaauuaaaauccugcacgaggauaaaucacgcgccgugauaauccuguuaauaaaaugcagcuuguccugacccuucacucaugcagcaaacuagaaugugaugugggugggggcggugggcagaggagguaaaggggggugggugguggucugagcuccucugccuuggcaaccucccgcucccggaacguggaaaauggguggcuucugccggcuccccaugugccagcggcuuggagcccaucagccagggcugcuaagacuucugugcucgcuaaugauuucucguccccagugagcaggcgucauugaauuacucagccgccucucucugcagcuuccaggcaaaaccacccggguuagcugcuuaaucuaauccagggcucugguggggcggcucaccagcccaccgacucuuuuucacacuugaucuguaaguugcacacacgacagccuuggaaauucagcccuagaaacgcagguaguuugagagcuggaccugccgcucaccucacuguggugccuuccacccuucuugcacccuuuuggccccaggaaagaucaguugugugccucccagugaugcagcaucccugaaccuauugucagagccuccccuuguugaaucaagucuucuuuaccuucuuuaacaaguggcaagaaugaaugaccacuguacacuuucagaggaaagggagugggcgggugcuguggugugcccugaauguguucugugccuuggaugaggcuaccuguuucgaauuaaacuucuuccccagccccagcaccuccuaccagggaagcugcaugccccuccgcugucccuucgagucaggugucuguccuuggcucccagaccacuguagacagcaggcacagccugccuuccccaucugcauccuuuaugaaucaccuagaaagaggccuucucuagcgcccuguuuggcucuccuuuacugaaccuccugggauuuuuuuucuuuccuuuuaacagacuagacgcuugaagcaaagcugccaucccagaagacgacaugcucucagcaaccccccuguaugggaacguucacagcuggaugaacagcgagaggguccgcauguguggggcgagcgaagacaggugaaugcgcccaucugggccgggccugaguggagcccacgcccaugcugaagccccccucaacuucucacagccaccgugggcccaaaaggggugggagagaaagagcuucccgccuaguaggccgcucuugauuuacaguuuuaacaggcaaccuggcucagugaagcauugccgcccuuuaaaagauuagccccuaaagcggccuuucagugcacuuucguccuuaauuuauuauuucauauuuaugaaggagaauuaaucccagucuauauacugcuuuaacucuaaaugucaggagugugggcccagguggagcagcauucuaugugcuuuuaaaacaaauaguuugcucaguaauaaauggggagagagccaccguuuuccuucauugaagcccaggaucucucauuguccucugcugccuguucccagaggccacuggcgccugcuuuuggucgucagacagcucuguuaugcuuccuaaucaguaauuuuggaguugugggguggaggcagcuaagcaguagaugauugaagcugcucuucgggguaaugaggaaacuuuuccucugccgcuugucagcgauuuuuauccuggggauuuggaaguuggcaccaagcacuuucuuuaucgaugcucucugauaacaagucccagggcagccgcagcagccuggcacagaugugcagcuuccuuuucagccuggaacagcugacauuuguaugauacuaguguguaucccccugucauuuugacaaaggcagucaaauauggcuuuuuuaucaccauggaaaccaguuucguaggacauggucccuaacuuuguuuuggaaaaaguuuugaaagccuacccuccuggguaacacggaagugguugaugacacgaccagccuuccagcccccuuugguauuuggcuguguuaccacuucaugucuacccuccaggagaguuuauaaggguuggcugggacagccgagcuccgauuggccuacuuggccucuagagaaaaaaaucucgagggagaaguaguugugcuuaauuucuggcuuaccuaccuuggggacaucauauuugugauucauguccucacacaugaaagcuuugcguuuccuuuguuuuuccuggucaaguugaaucaccauuugggggcgacuuucaauaugggccauugacagcuggugggggcggaggguuaaggacaguuuuaaaaauuggguuaguagaaacuggucuguucuggggagaucugugaaagauggauucagugaggaaugcuuucaugaaguugguguaucuuuuuaaauaggaaaauccuuguaaaugauggugacgcuucaaaagccagacuggaacugagggaagagaaucccuugaaccacaacgugguaagagauuaauagcuucuguugaugccauaucugcauaucagugaucuguaaucaaucguauuaauuugcaugcccuuaaaggguggggaaugggggagggguggcaguucagagcagggcugaguuggaggccucugcgagaggacaaggcccccacccaagcucuuccagucuugccuuccugccucgccacacaugucccuguccccuagugacuggugggauguguacucucuuuucuuccauaagcuggaugccacaucagcgcucccagcuggauaaauuuccagccuccaaguagccccuuaggguuuaccuuuccaguaaaauacgaaacacaggacugucacuucagacacaagggagaggaagucaaaagacacaaccacaguuugacccauggccucuauauugauauagaaaugaggcugcuaaaguccucuguuccuguugucccaucgaagaucguuucuuguucuguuaagucaugccuuccugcacccaggggaaaugaagcgaacacccacccccaagccugacaggcccagggaggguuagugugaauucuguaccccaugagggugaugcugagaguuuuggaguugguguccuaguuguagcaaagaauuuuugcugagaagguaaaaaucuucagacuuuuuuauuuuuauuuuuuaauuuuaauuuuuuuagagacagagucucgcugugucgcccggccuggagugcaguggcgcagucuuggcucaccgcaaccuccaccucccggguucaagcaauucucuugccucagucucccgaguagcugggacuacaggugcacaccgccacaccuggcuaauuuuuuuguauuuuaguagagaugggguuucaccauguugcccaggcuggucuugaacuccugagcucaggcaaucugcccgccuuggccucccaaagugguaggauuacaggcgugagccaccgcgccuggccaaaaucuucagacuuaauagaugacugaauuaauauaugggccucaaguccaaagggaccaauguuuucccugcuuccaggauacuaguugagaggugagaaggcaggcagcaaagggguuuggauaaggggguggggaaacagaccccccacccccgccccgccggaagccugucuuuaacccuuugugcuuggauguuaaggcugauggcauguugaacuaguuggcagugucuuugggugcugcugccuugaaggaguaucccaguaacacccauguuguucuucugcaaagguggaugcgagcacggcccauaggaucgauggccuggcagcacugagcauggaccgcacuggccugauccgggaagggcugcgggucccgggaaacaucgucuauucuagcuuguguggacugggcucagagaaaggucgggaggcugccacaagcacucuagguggccuuggguuuucuucggaaagaaauccagagaugcaguucaaaccgaauacacccgagacaguggaggcuucugccgucucuggaaaacccccaaauggcuucagugcuauauacaaaacaccgccuggaauacaaaaaagugcuguagccacagcagaagcgcugggcuuggacaggccugccagcgacaaacagagcccucucaacaucaauggugcuaguuaucugcggcugcccugggucaauccuuacauggagggugccacgccagccaucuacccuuuccucgacucgccaaauaaguauucacugaacauguacaaggccuugcuaccucagcaguccuacagcuuggcccagccgcuguauucuccagucugcaccaauggggagcgcuuucucuaccugccgccaccucacuacgucgguccccacaucccaucguccuuggcaucacccaugaggcucucgacaccuucggccuccccagccaucccgccucucguccauugcgcagacaaaagccucccguggaagaugggcgucagcccugggaauccuguugauucccacgccuauccucacauccagaacaguaagcagcccaggguucccucugccaaggcggucaccaguggccugccgggggacacagcucuccuguugccccccucgccucggccgucaccccgaguccaccuucccacccagccugcugcagacaccuacucggaguuccacaagcacuaugccaggaucuccaccucuccuucaguugcccugucaaagccauacaugacaguuagcagcgaguuccccgcggccaggcucuccaauggcaaguaucccaaggcuccggaagggggcgaaggugcccagccagugcccgggcaugcccggaagacagcgguucaagacagaaaagauggcagcucaccuccucuguuggagaagcagaccguuaccaaagacgucacagauaagccacuagacuugucuucuaaagugguggauguagaugcuuccaaagcugaccacaugaaaaagauggcucccacgguccugguucacagcagggcuggaaguggcuuagugcucuccggaagugagauuccgaaagaaacacuaucuccuccaggaaaugguugugcuaucuauagaucugaaaucaucagcacugcucccucauccuggguggugcccgggccaaguccuaacgaagagaacaauggcaaaagcaugucgcugaaaaacaaggcauuggacugggcgauaccacagcagcggaguucaucaugcccgcgcaugggcggcaccgaugcugucaucacuaacguuucagggucagugucgagugcaggccgcccagccuccgcaucacccgcccccaaugccaaugcagauggcaccaaaaccagcaggagcucuguagaaaccacaccauccguuauucagcacgugggccagcccccggccacuccugccaagcacaguagcagcaccagcagcaagggcgccaaagccagcaacccagaaccgaguuucaaagcaaacgagaacggccuuccaccaagcucuauauuucugucuccaaaugaggcauucagguccccaccaauucccuaccccaggaguuaccucccuuacccagccccugagggcauugcuguaaguccccucuccuuacauggcaaaggaccugucuacccucacccaguuuuguuacccaauggcagucuguuuccugggcaccuugccccaaagccugggcugcccuaugggcuucccaccggccguccagaguuugugaccuaccaagaugcccugggguugggcauggugcaucccauguugauaccacacacgcccauagagauuacuaaagaggagaaaccagagaggagaucccggucccaugagagagcccguuacgaggacccaacccuccggaaucgguuuuccgagauuuuggaaacuagcagcaccaaguuacauccagauguccccaccgacaagaaccuaaagccgaaccccaacuggaaucaagggaagacuguugucaaaagcgacaagcuugucuacguagaccuucuccgagaagaaccagaugcuaaaacugacacaaacguguccaaacccagcuuugcagcagagaguguuggccagagcgcugagccccccaagcccucaguugagccggcccugcagcagcaccgugauuucaucgcccugagagaggaguuggggcgcaucagugacuuccacgaaacuuauacuuucaaacagccagucuucaccguaagcaaggacaguguucuggcagguaccaacaaagagaaccuaggguugccagucucgacuccauuccuggagccaccucuggggagcgauggcccugcuguaacuuuugguaaaacccaagaggaucccaaaccauuuugugugggcagugccccaccaaguguggaugugacccccaccuauaccaaagauggagcugaugaggcugaaucaaaugauggcaaaguucugaaaccgaagccaucuaagcuggcaaagagaaucgccaacucagcggguuacgugggugaccgauucaaaugugucacuaccgaacuguaugcagauuccagucagcucagccgggagcaacgggcauugcaggugagcccccccaccugaauuucaguuacuuuaccaguugucaguuuuuuaauguguaaacaggauugggggaguaugguagggcagggcaccaggcagauuuggugaaugaagcuugugguaauuugaauauaugcaauguggccaguaagagaacgugagugguagcacugaggcgugucuggaugcuuuaaguuauucuguagauuauaagggaacuccacucaauugcugauaaccgauguuuuaauuauugugaaggguaucuaaagacugcaugacguuuaccuaucaauugcuuugauuucucugccuguaagauagcaaauauaccuagaagugcugcuuagaaugccuuacuugauaccugguagagauguguagcagccgcaugucugugggauucaugcaaauuuuucaccaaaaagaaaggaaaaaaaaaagaaaaaagguugcuuaaagggauagaguauguauuuaacuugcuagugaauuaugauagauguuguauaggaauuuccuuaagauauuuuacuuuuaauuaaaagaugaauaaagccaaauuguuuugcaauguuaagaaaaaaauugguuuaugcuuauaaaaauggaugaaguuaucuaaaugauccauugagugcccauuuuaauuacauagauggaaggauuacaagaggacaguauuuuaugucuacccgcugcuuacugugaggucaguucuucaaauuuuuauuacuagaaucuuacauaaaccuuuugaguuaaauuucauuuccaaauauacaaagggaaguuugugggccauggucgucuuuauucauuguguauuuuguuucuuuucuguuguguuuuuguuuuguuuucuuugcguuguguuuucguuuuguuuuauuuaccuucaaaagagaaugucugucuguaugcaauaguguauguguggauauacauacacaucgcauauauaucuauauacacaugacuuuaugaauaaagaaugugugacuacuuauauauagauacucuuaaguuuuaucuguuaaacuuuaaaauaucugaguuacaucucauaagcugugguugguuuugggcacuuuucuuugaaaauacuuuccuuuaagauaaggcaaaugaaauagcuuuuaugguaagguguuguuuuuuuuuuuuuccaucuccguucucuuucuagcgugcaaugaugcgcuucucagaguuggagaugaaagaaagagaagguggccacccagcaaccaaagacuccgagaugugcaaauucagcccagccgacugggaaagguugaaaggaaaucaggacaaaaagccaaagucggucacccuggaggaggccauugcagaacagaacgaaagugagagauguaaguaaaccugagcaguuugcuuguguuggccucagguccgguuggcaucugcuuggagaaaugggcugcuuuugccaugcauggaaugaagggccgauuguccuuaugaaugguggcaaccaggaacgaggcgucugugaaagauaguuuccugggacacaucuuuuuuuccaaagaagcacugguucuagaguugauaacagucuaauauaacgcaguguagcagagguauggcaguaggaaauuaggugcagggacagguuauauuuuguagcaguggaaugacacuucccagccaucuccugccccaccccuguggugacagucugauguggaaugaagaguccuuauauucucccuccaaaggcauagauguuguugaaguaggaugaacauggugaagucaccauaaagaugagcguuacgauuuaccguggggggugggggagaauuggccacagaaucccaaggcagccuggcaugcaugagggggcucuucccaccggacagagggcagcuugcauuuuggagggcaagugaugugaagagaaggcuaguaucuuccucaguacacucccuuugguccuuacagcaggucccccaccccaccaacaggguugacuuugggauuugcucacgagucuucuagggugcuaagauguguuggcagcaaguggaggucuuccucuuuauuucuuaaauaugcaagcuugaagcuuuaggucugcuugcaacaugagaaaccucacugggcgaaggggaauuagggugucugggugaacuaacuggaggaguaggugcaaaguccuccugacacaggacacuuggaaguguuggguauguuugagagcuccccaccaugggccgucggagguuugacauucacaacacaguucaucggugccugacagaguuugggaagaaugugugaucagggagagugugcuucuugauacucggagcgcacaccccucccuccacuuccagcucaucccugggagcagacuaaggccaccugccaggauccuggguaagcuaaaccaggacugauuuguuguaagucauugcugaagaaaguaguuucugcugcuaauaggugguggccuuacucaaguggcagggacucaauguaccugaaguugcucacucuuccucaaagaguggcuacagggcagugggagguccaagccacucuugggugaaguggcaaagaaagccuuccuccucccugaugauugcugccaacucgcagcccccacucugaguugccucaacaccagcucuugggaagguugucagagggaccugggagaagugggcaaggccgaguugauggggaaggugcuucuaaaagagggagugccauacauaagaaucccucuuuguucugaguagauggcugggggccuggaggaagggacaggaacuuagccagcuuccagccuucuugcccuugcugugguuuuugaguaacauggccagacccuccguucacaucugaguaacucgguguggccaauggggagcagggcccaagccccacaugauguagaaaggccucccuuucccuuucuguaagucccuccaagcuucauaccaacaggcuguguucuuggagcacccaggacagggcccugcaagccauaagucaccacguagugcuccucagguaaugagccauggcagggagagcagaagaagaguugggggaaggugaaggcugcuuuuuaaauacuagggccaaggaagagcuggggcaccauagguuugugguugaucaagaggaggaaccuagaggaaauguuguccuugcugcugccacugccaucucauccaggguacagcaugcgcuggauccguuuggcuucaaauucacugagcuaucucggccaucacgucucuucaugggugucacuguggcccagagccaagcugugagcauauggaaacugggguggggauuuggggcaggcaggggucacaaagaggguacaggaugccuccccgaagccucuccccuccacuccuacagcaccaguagcuucugagauggcaggugccgccugugcggccucagcugccugcgugugggugcaucuuguugggagggcuuguuuaaaaaaacugaauuaacuggacaacaccgugguuaggauuuucauugacucuuagugauaguauggguugcugaguuuuucauuuagaaauugaacaaaugaguuaggaguguccccaaacuccuaaggaaugauaaguggcauuuugaagaugggguagggaacacggagguguugggcccuuccuuuuuguuuuuaguuuuauuauuuuuauugauugauuuacuuuuguugauacauauuagaugugcauauuagcccuuccuucuugaauuugggugucugucucccuugguagccacuuggcuuguguggaccuaggacucacucaguggcaaugccugagcgggagcuggagaaagcguugagugaaagugaaaggguuucaugggacuucuuggcucaggaaacuucucuuccaggacagcagccccuauguacuuuguaaacuacuuugaguuugggcagacagaugacuaccaaugccucugcugcuggagaggguagaaguuauaacaugguuggccucugcuagaggugauguugccugcagagggaguagaugucaugggcaguccucaaaaaucucaguccucugccauccuguuuagggcuuacugggcgugguuauaacaguggugagguugcuuuguugccacggugacuuguaaauguugccauggcgaugcuuccaggagguauugcaauggcauagccaugguaaauuaugggauguaugugcugugccuuauaggaccaugaugcaaggagaaagugguagacgguguaggacucagccauguucacaucugccuagaucucaugaccaaaggcacauggcauuccacucacagaagggcuguaaguaguugcaauggaagaggacccugaugguuaggaccccuaucuaucccuucaucucugucuaugcacccaucuccuuugcccucaagaguaauuucuguggguacugguaagaauagccccauuugagggagguccaagugaaguguacaggaaagugaccuggagccucucccucauagcuguuugccauacguaucuucggcagucaagguggguguucuuugggauuauuacuggcccauggagggaaacccuagcauaagguuugggggccuucacugaggggaauugggauguuugccuugagaggcucagggguugaaggaaggacaauaggccucauuugcggaaagaucucguuugcggaaagaucuucuugagagcggacaagaagcaucuacacugcgugugggcaggcaugauugcagugaaccccagaugcagcaguggagggcucccgauaauaguucuggacuauucaggaggcagaagggggcccuguccggcugaacggggaaugguggggacuuggaggaggcauguguguuucgcaccccuuauccuagccugcuggcuuccccaugaauggggagcagaagguggugugugcaggggagcccuccccacccccacugggcagcuuuuccuagauggggagccccagagaagacagauggcaagaccuccccauaucuaaugggggugcucccuagcagagagacuagguccccaguuagucacugccuguugaugccagucugugaaauaagugauuacaagucuucuaggugguuuucuguggacaaaauauacuggcaguuugggcauaaggccagguaggugagauauaaacucauuucacuauuaggaaguuugcagugaaggucaaaacuccaauggaaaacuuucucccugagaaagaugccuuagacuugguugagauuguuacaaauacagguggcugugugagaccuggaguucaaauggaagcuguggaagucaaauccaaagcacuaggguugagagauucuuaaucugauggggauuugaugggggggggggggugucucugggaagggugccaagacagggcaguucguucuggguggggccccacacuggcuaagcugcugccucauuuugacccaggaaggcauugugacauuaccuagucaccucugcuuucaaaccacuuggcucaaacccucucuccuaccuaaagggaggggaaaugaguacacuuuaaaaguauaaaaguaaccuugcauguggcgcuucguaacacagucuuuacauuuuuacauugcacccccagccccucccacagggcuuucaggggcggcugauuggcuccagaaagucaaauaguauauaacuaggacaaucaguucacaucuuaaacuuucauaaauaucagggcuaaaaaucaagcuggucuggggaucauagcguccuuuuguaaguaauuucuccagccuuacccucugcccugcugcaccguguuuaugaagcccaccgggggagguggcuugcaguaauagucccacuuuacaacucaagggggccaaacuguaaaguggcgcuguuacugccagagugguuaagacacagagcaacucgagucgcagcccacccucuuugcguccccaggccaagcugagcacaguggucaccacuucugcauaguguaaguuuugggcagcuuguguguuuucuccuguugcugcugugacauaacaccaccuuggccauguuuuuggacgcccauccguugcugguuguaccuacagagaccuggggugguauuccauggugggggcuugggugccgaaucccagucccagccaucccuguccauacagugcacugucgugagugaggaugaggaggaacgguuggggagauucuaccauuccuuugcaagaauagaugcagccccaucuguucccccuuagaacacccuugaagagaaggugaauggguccuugcaccauugagagcacaggcuagccaacaccccuguaaagcucacccccacagcugacugccgugaaccgcuggcaaugcccccgagagaagcgggugagcggugcuggucaggagugggaguaauauuugaaguggguuggggagaggaagaaugagaucagcggaugaggcgugugcuuauuucaucuagaaauugacuugugugccucagcucagaguuaccaagacaccagacucauaacccuggugaugagagggaucauuucagcgggccaagggcugacaccuuaaccucgcaguggucauuaaguaguuaucauuuauauucauuguguauuagaaaaauugugaccagcaaagcaguuaaugagcuauuucuugggcuagagcaaaaauaggaagugauguugggcugaggugauucaaggaaaagccccaaggcccgugauaggccgagcacaggguuccuggaacgagcgguuuugcaagcgcuggccuggcaugggaaggacacaccaacaaugaggagaugucugucgaugcuugccugugacagagggugugaagaggagugucagcugggguggccagcauccccaagggggucccuuuguguuggacaggaaaugggaacagcccaacccauugguuucacaucugugcauccagcaaaucgaguuuuuugaaguuuucucugaacucguguauguguuaggaaaccuugccuuuggcuuugccacgccccucuucccagcagccugggucugccuggguucccugccucccucuggccuggacuguaggcccagagccccccaggagugagggucacuucugcccaucaaggaccuaggcuuucuuucaacacucuugucuccaguccauuuucaucuccccgguuggccuaggugaauauugguguuaucccuucgauagaugacauuuuggggauauuuggucacuuuauccuaucagccugccauuuauuucaaaauaaugaccucagcaaauguuuccauaaagauuuuuaggucagccccagcuugguugcaucuucugcugaaaggacuauagugcuuuaaaaaacguagcauugacgccccaucuuucuugguucccucuugcccccaaccauaagaagggagaaggagaaagucaggagugugacaugcaccucacucugcuuuacuugccacucgucuucaauguacccucccucuggaaaguucuguuucugaggguuuugugcuaaccaugugugaggaccccagucuccaaagaagcagcugucaauagcagauuaccuugggcaugguggucccacgcacuccccagauccugccuucucauggcgaccuucgggcuucauuaaugcccucuugucuccccucccccaggcgaguauaguguuggaaacaagcaccgugaucccuuugaagccccagaggacaaagaucuuccuguggagaaguacuuuguggagaggcagccugugagcgagccucccgcagaccagguggccucggacaugccucacagccccacccuccggguggacaggaaacgcaaagucucaggugacagcagccacacugagaccacugcggaggaggugccagaggacccucugcugaaagccaaacgccgacgagucucuaaaggugagcccugucugcuucgcccgccugccggggggugggccuuugcaugcggccacaguggauggacaggagauguggaugugcggcgcgcugcccccguagacagagucggugaggggaagccgugggggcgcagcaguggagcggaccucuccauucccacacugccucgugagguucccacccuggagcccccggggggagccgcccacaccuccccucccccaaagccagaacccagauggccaaagaugauuaggccccuucccaaaagcagagaccagugaccacacccccccucccccaccccauuagugaugcguaagacaguuuguucccccccggggggcuuuuugauuaauuuguaguuauuucuccauuagaugacuggccugagagggaaaugacaaacaguuccucuaaccacuuagaagacccacauuauagugagcugaccaaccugaaggugugcauugaauuaacagggcuccauccuaaaaaacaacgccacuugcugcaccuuagagaacgaugggagcagcaggugucggcagcagauggcaaaccuggccggcaaagcaggaaggaagugacccaggccacucagccugaggccauuccucaggggacuaacaucacugaagagaaaccuggcaggaaaagggcagaggccaaaggcaacagaagcuggucggaagagucucuuaaacccagugacaaugaacaagguaugcgggggccaccccuugaguguucaccccgcuccuggagggugggucauccacucucuguaggaaagggcuuuugaggagaucuuagaaggccauagcaauugacuucaacgaagauguggcaggcagggaguucucucuugauguccuugcccgugguugcacaggaaggaagucugaacaccuucauuccagccucaggcugucuccagucucuggguccugagcaacccagacccaguggguagggggcaggaaagcaggaagagccagcuucuguccucucuuccgggcccuuugaagcaacuugccacuuggcguuuuguggguuaacuuaggugccguuugaaugugguauaauuaaaauauuaaugcuuugaaaacauaauugguguaucuuuaaaaacugaagccgcuccagugaucaguguuaacaaugggcuuuucuuccugcacuggcuacaacuguguaacgcccgcuucuucucccgucucccauccgcccgccaccccgucacccccuccguauuuaggcuugccuguguucuccggcucuccgcccaugaagagucuuucauccaccagugcaggcggcaaaaagcaggcucagccaagcugcgcaccagccuccaggccgccugccaaacagcagaaaauuaaagaaaaccagaagacagaugugcugugugcagacgaagaagaggauugccaggcugccucccugcugcagaaauacaccgacaacagcgagaagccauccgggaagagacugugcaaaaccaaacacuugaucccucaggaguccaggcggggauugccacugacaggggaauacuacguggagaaugccgauggcaagguaccucuugaccccggcuucccucuggggccugugcgaacacauccccgccugccugcuucccagcuugaggggacaaagcuuuccuuuuccuggacuccucccccacaccacacgucacuccccuguccuagaggagcaugucuucuggguggcagcgaaguuucaaacuaguaagaaugaaaucccuucccccaaacccuccuuugacaggcaccccccacccccaaaaaaagauaaggaauaaagugccucucuccacgcagguuugucacguggggaggaggaggggaagcagcggcuguuagaaggacacgggcuuaaccgugugcgcugcuugguuuuaugauaggugacuguccggagauucagaaagcggccggagcccaguucggacuaugaucugucaccagccaagcaggagccaaagcccuucgaccgcuugcagcaacugcuaccagccucccaguccacacagcugccaugcucaaguuccccucaggagaccacccagucucgcccuaugccgccggaagcacggagacuuauugucaauaagaacgcuggcgagacccuucugcagcgggcagccaggcuuggcuaugaggugugucccugugggcgcucccuggggcugcaggcuggggggcggggccugcggacuguggugggcgaggggagggacauggagagcagagcucagcccccuccacaucggggcugggccggugcuccaacaggauguuuguguuagccccacucucacugcugucucuuugguggcuuguucaaucgcgguguggaaagaaaggccucucugauguucaguucguguucaggcagguaggcugcuacggcauccuccagucucgcuaacuuaucucugauauaaaaucugacacaacccagggcuuggcgacuaggggaauuuuaaugagcccuuuuggauucugauuagcaagggggagagaaguuauuagcucuaucuggggcugcuuguacuguuucggguggaaggguggccguguagggggaguaggcaggaaguagcuguguaggucacagagggagggggguggggcagaccuaaggucucuuucugaguggggggguacaguagccuuagggcugagggcucuggagggagggacugagacuuuucccucaacucacugcuucuccccagccccccugcucauccuccuccuagcaugggccaugacaaugauagcuuacguugacggagccccuaagauccaaaguaacucauuucacccuuucaucaucuuugugcaguaguaacuaauauuauucccgcuuucagaugaggaaacugagucccagaggcguuacaugauuugaacagauaauaauccagcagccuggcuccaaagcccagucuccccccauccccccaaacucggcuccucuccaggacuggcucccauuggaaucacgcuuuucacaguucaaaaccuacgucugccccugugcgucuccccaccacacacuugucaguugagauagugauguaauagcccacagugcaaagacauuuuuuuuuaugcuggcaucagcucucuaggagucguggugaaaauaaaaugcgguucagcaggcugagugugaaguguggagaagcacccgggcgacaggauccaugccaggccaugcucagcugugggcucccggaauucagccagagcccaggcucaugcaccuuaaccaugcugcagucagcagucugcugugccuugagccuuuccugauggggugacccagcugccagucucccuuugacccagagcccacccuggggcaugauugugugggugggaacugggaugcuggcucacaccugugggaugguccuuugaagcacuagcuagguauuuuugguuguaugugacuuugucuauucauaccagcuuguuucuuaucgauaucucuggauuaucuuugagggaacucucuagaaggauuugaaaauuagcucaguuacuugcagauuaaacccaaguggcagccaguugguuucccauaagcugagagcagcggcgccuaugaggacaggguagaugcagcgugccaggcagggccacucauuccuacgcaugauugggaaaauggacuugugcuuccagcaaacaccagagguaagggagggcuccagggcagcaaacuugccggccauagcgggguagggcuccuggccuggucuuugauccuggcuucauuucugccagucucaccuuucugagcccagagcuucaagagacccuugugggugcucuaaggaacaguuuccauucuggugguuuuccuauagcaggccuggacuaaggaacacugauccaugcuuucuuaggcuaccaggccuuuggugcaagaagccuugagaauguuuauggaaggacaacuuuuccccuucaaauguaaaugucauuauagaacuuucccaggucaucaguuuugaugcugaauguuuuaauuacuagaugaaagcuuucaacuuugaauccaacuuucugggauuucuuuagucagaaauuaaaauguuaggaugauaguccauucagauguggcaguguaaacccuuuaaaauaaaagaacaguuugcuuaacaggauaagguacgguaugaaugcacagcuuugggagagguuucccaaaaccccucuuuaucauugucuucugcuuagcuaaaaagauaccacaugcaauaaaaaggcugcucaagcuuuguuuucuguuaaucugguucuugagguuuagaaacacccucugucuucagaucuguaauagaccaccugaaaggccaguuacaguugaaccugucuguucuuaggcuaagaugccaauguggaaccgcaugugugugcauuuaguagugaugguuaaguuuucuaugaaucgaauaaaucauguuuuuaaaaaaguuaaugaggcauuuaauuaauuaacaaugucggguuuauggccuuuaugguuacauuuugcgguuaaugucauucagcuuauagcugcuuaacagagaauuguccaacaaaaacaguuugauuuuguuugggaaugggcgggcugcccuucaaacacucccauuuccagcguggagaauaaaccaaguaauguaauggguagacagacuugucuggcuucuucauucucucuguuggugacagcgguugccacccauuuaagaucccaucacccucccaucuaggagagugucauuagccugcuugaccccaacagaaaaggugcaagggaugccggucauggcuggauugcagcccucuagccagggcccuugauugggccuuuggaaacuucccagcagacccguugccaaaagaccugaguuaugggucugauacuuuguguuaauugaauauggggcuuaaccucucugggccucaacuuccuugaguguugaaugagacucauaccacuuuuccuuccugagaucucacaggucacugugggauaugacauacacauuugggaacaucagaaguguuacgguggccaauggcaaaacgucugaccugguuguuggguuacuguugucuugccugccauccuccaggauaacagaguugacuuacccuucagccucgacaucuuucauuucuauguucccucagaucagcccuaguagugaugaagguuuccaggugaaggccauaauugucagagcaaauaaacccuggguugauaggacaccaggccggcugccgggauccggguagauugaucugugcacagcagucgguggcgcuuagagcugaucccugagucacgugacagggccucucccuggcuggguacacagcucauuagcuugcagccguccacucgagucuggcuagugagggccugcuaaaagagcagcagcuucaugcgguauccuggauaccagugcucggggcagguggccugggagcucagaggauugugggcuuucuggcaggugagggccugaaggaagagacgcaucugugggcaugccuucucucuuccuccccuugauuuggaagggagcugccgcaguguccugaagcaacaggguuaccggccaggguuaccagcgugcagccuuagguucacagggggagcaucuagaacauucuaguuaguguucaagugagugaucaccuuugacugaugugucuuagaaagggcauaaaagaauuuucagaacucaccucacguuuauggguggcucaaaugcugccuauuuuagguuauagaugaguuauuuaagaguugucacaaaggagagccugcugugacccaucaagcuccccccuugccaaguggaacauguguugggcuaccccacauguucuggcuuuccccccagucuucagaaccugacagcucucugcuggccaugacugcuaggaaaacaguguaaccuguugucugguggcagauacuguuccauguguuugaaaacuuucuuaaucaagguaauaaaacauggacuaaauuacugcucugcuuacugggagcgguucauuuuaauguuuuaacacgccaaagaagugagauuaauaacagugauucucaugcaaacuguugaugcggaacacauucugcaaagggggaagggaaggauugucuuacuuaguucuugaaaugcguagguugugguaugugguguauuagauuccugucauuaacuuaaguaaauaugaaaauauauugauucagccccaaguggggcggagagugaagcaaaaagaagguaggguuauuggaagcguugaugucauuuguugaugaguaugauaccaacagaggcacugccgcccaggcuccaacuccgggucuuuccaaggggcgugaggaccagccuaaacuccugggcauccuccucucugugaaguugagaaacguucuccagcucauuuaauuguucauuaugccuugauuggccuugcuuuuaucuaaacuugugucgucauccacuacuaccuauuggaugaaucgauugagugaggaggauguccuuguacuuauucaugcguuguuugaaacauuagcaaccaaaucccucuguacucacugugccaggcacugagcuaagggcuugugugggucucuaauuacaguuucuuagcagccucugguaggcgcuguuacucuccuccagagguaggaaaggaagcuuuggagaauuaggagcauaacucgcccagggccaggcagcugggcagcagaccccuaaaugaugcugucccugucaucaggcgcuucgcacauguguuucccccucaccaagacauccacagcccgcccgagagguucucagguucucaggccugaggguguaugucuuugaaagcuacagagagguccaccuuacaaggucauugugcagugaucugauggcauucuucccuccccuccccacaggaagugguccuguacugcuuagagaacaagauuugugauguaaaucaucgggacaacgcagguuacugcgcccugcaugaagcuugugcuaggggcuggcucaacauugugcgacaccuccuugaauauggcgcugaugucaacuguagugcccaggauggaaccaggucagugaugugucuuguucucagccuggcucugcugagaccaagcuucccuaucugugcgguggugguucucaguguauacgggaaauuccaggaggaaagacagagggugacuguaagcacacugaccacuggguucucuggaauugaauccagcagaccuuucuggcaaauguagauguaaagcucccaauuuugaucaguccuauaauguuccugugaaccaaagcuucugaaaauguugaggccugcaugaauaauuggggguguugccuuuuaagacccuggacucuucaucaccaucuaugaagucacuguauuuaaaauauauuugagcugaaagucccaggaguacacacagagugccagcugccccuccgcugguucagcaggaccugccauugccacccacauccccagccguggcccucacccuguccuugacccugguuuauuggucagagacccaggucugagucagccugaacaucuuccugguugugugagugggaugcugccaugaggcugggcacuggggguuuccugacagugacagaaauagccaaacggaaauguauuugguguuucacacuuugcaaauagcauucccucagauugggcagagacccaucuucucccugccaaccccaacccccagcuccauggacacagguaggaggccucuguauccugcugagaacacaccccaccaggccuguuucuucuccccaccguucccuuggcuucugggccagagguuaaucacugaucugugugagguccugggaucaggcuuucaggagagucucugcuaaucucuuugcaucuaguuucuuuuaaaaacagagguggcuuuuuuuuuuuuuuuuuuuuaaugugugacaguugcuuguuguauuggcuuccaugaugaugggaccucuuuuauccccuguaaguuaccuucauaugguccaugacuacuuaaauuuguugaaaauguuuucauuuugggcuugacuuccuucuuaggccuuggauuaagauaggguuugcagcugggcaguggcucucuugccuguaaucccagcacuuuuggaggccgaggcaggaggaucacuugagccuaggaguucaagaucagccuggaaaacauaguaagaccccgucccuacaaaaagaaaaaauuagccaggugugguggcaugcgccuauagucccagcuaugaggaggcugaggcagaaggaucacuugagcccaggagaucgaggcugcagugagccaugauccgccccacugcacuccagccuggacaguggagugagacccuguccacccccacccccacccccgcaaaaaaaggauagauuuggguuugagauuuaggccugaaauagucucuucaucugcccuguaaaggguuagucaucaaaauaacagugauucauugcuugacguugagccacucacuguagcucaguuucccuaucugugcaguggcggugacugugcacaccuccuggaugaaauacugugcuuaggaggcucaguacccaaggugcacaugugcccagcuuugccuguugcuuuuaaaggagacaacugcuuuauaagcaaguguggcuugcaugagcauaauucuauugcgccucucuuccuaggccucugcacgaugcuguugagaacgaucacuuggaaauuguccgacuacuucucucuuauggugcugaccccaccuuggcuacguacucagguagaaccaucaugaaaaugacccacagugaacuuauggaaaaguucuuaacagguaugacaaaguucaagaaauggucuuauucaaaaauuagaugauaacucgauacaauagaugauuggaauuugacuaggcagaaaucacaaaggcugaaacuguaaagcuuuuaggagagcagccgaguguuugaacuuuugugugguuugacuuuguucuagugaagcuaagucaucuauucacccuaauguuuuaaaagauuuccuaaaguuauucccauuuuccacacaugcauucuuaacuuagguauggcucauagguuuacaucuugagucugggaaaaaugacucaaaccuuccauacaugaaauuauuuggacagguuuaugguguuaggucaucagauaacccauuacuuaagcccugggcauuacaaagugccuaaagcagaagcacaagguuuucaugagugucaggcaccugcaguuaaaguccuuaucaggcacuuccugccaaagaaugccacuaacucacuggugaccugcccuuguuuaccuuaaauuacacucacuuguuggaagaagcagcuuaguuaggcuaucaaagaagagauacauaaguaggccggacacaguuggcucacgccuguaaucccagcacuuugggaggccgaggcagguggaucaccaaaggucaggaguucaagaccaaccuggccaacaugguaaaacccugugucuacuaaaaauacaaaaauuagcugggcaugguggugggcgccucuagucccagcuugggaggcugaggcaggagaaucccuugaacccgggagguggagggguggaggcugcagugagccgagauugugccacugcacuccagccugggcaacagagcaagacucugucaaaaaaaaaaaaaaaaaagagauacauaaguguaaugcuacuuuauuuugcugagaaagaggaagacaggaaaugaccuuccagccugucaugaauguauaggaaaaaaugccacguggcucugccaucauuuuguucucagcaguagauuuuaucuuguuuuuuuauuuuucucucccuccagauuauuuaaaugaccuccagggucgcaaugaugaugacgccaguggcacuugggacuucuauggcagcucuguuugugguaagcugcauuguuugcucuaguuccguaggaggugaacaaguucaaguccauuucugucugguaugggugagggaaaguggauggugggcacuggaagcaggacucacuugggaaagaaucuuguuauuuaaacuccuuguuguuguugacaacuguggacaucuugcuguaguuuacugauuccuuccucucuuauuugcccuccauuagaaccagaugaugaaaguggcuaugauguuuuagccaaccccccaggaccagaagaccaggaugaugaugacgaugccuauagcgauguguuugaauuugaauuuucagagaccccccucuuaccguguuauaacauccaaguaucuguggcucaggggugagcauggcugucaugugauugaaaacuagcugagcugcucuugaggugacaggaguuagaaaugcgcuuugagcagaugagggugggugggugagugaccuccuuaacuguccacgaaccucacacaaugcaguagauauuuuccagaaaggguacacaucagcuuccuuacacccaguguggugggggguggggcacagcaugguauaaaccugcccucaucacuaacaccaaggcuuaagucacuccccagagaagugggugacuggaacuuuauggaagggucagcaccuuggauacuuaaauccuuaaacacuuugagaagguguccucccuaggacugccugcaacagaccacuguaggauguuuugagauguacggacuacacugauaaaccaccuuguguaagguuaggacaaucauuguacaugacacuuaggauauuggugugucaucagauuuaguuaauccccucugcccccuaugguugagccccuauucgccagugaccaaucaucuuggguguacuugucaagagacugcucugcuguguguugacagagcugcuugaugaguaacauccuccucagcccugaagcuauaaacauauaugccauuacaaacagugauggaaaucauaaaguaugguagguuguaugcaaggaauguaacaccuuccuucucaaaagugucacucccaaaagaauggaaggaugggaguggacaugccugaauggagagacagccuuguguguuuauaaugcuguuagugagggucugaggagagaagagaucaaagaaauggggauacagacuuacucucccagugacuguugauagcagggcacuuggauaggcuugacccuaguuguggucacagcugaaugagcaggacuuuacccccagaaaggggagaaauggggcuuauucagaugguccucccuagauggacagaugaguccagaguuccuacugcuagaaguaguuacucugccucaccuuagaaaggaauggcgauggccgggcacgguggcucacauccguaaucccagcacuuugggaggccaaggcgggcggaucacgaggucaggagauugagaccauccugguuaacauggugaaaccccaucucuacuaaaaauacuaaaaaguagccgggcaugguggcgggccccuguagucccagcuacucgggaggcugaggcgggagaauggcgugaaccugggagguggaacuugcagugagcugagaucgcgccacugcacuccagccugggcgacagagcgagauuccgucuccaaaaaaaaaaaaaaaaaaaaaaaaaauggugaucagagaguagguauggugagaaaugaggggugggagcagaaugaaaggacauagaggcugguccacuuggguugguaguuaauauuaauaguugggcgcacuuuucauuuuacuggaaacucaaagcauuuuccuuucuguuuuguaggccacgaaacuggcuacugcuuucggauguccuuaagaaauugaaaauguccucccgcauauuucgcugcaauuuuccaaacguggaaauugucaccauugcagaggcagaauuuuaucggcagguuucugcaagucucuuguucucuugcuccaaagaccuggaagccuucaacccugaaaguaaggagcuguuagaucugguggaauucacgaacgaaauucagacucugcugggcuccucuguagaguggcuccaccccagugaucuggccucagacaacuacuggugagcaagcuggacccaccauguacaguguguuauaguguuaauccuugugcauaugugucauaauacaacuauuucuguaaagaaaggacacuauuacauaugaaaauaucucuucuuuauauaagagaaauuacuccagucagaaggacuuagaaacauguuuuuuuccuuuuaaacuuuuaagucaguuuuuaugaaguuguuauaauguuucuuuacuuuucaaugcacacaugcuuugggauacguuuguuuuuacuuggaacauuuguuucuuuucuuuuuuaaggagaaaaaaaaaugaguaaaaggagcuccacacuuugacuuaauuucauacaaagcucugaugacaggccaugacuguagaguggucagaacugugugguugguuugagggagcgaauucggggaaggcacuuggugauauaacuuuguuuuguuuacagaguaccugcucgggccagguaaaugcuauuggauguaauccaguaguguguaauauaaauucaaaccauauccacacacaacaacuaauuguaugaaacuuuuauauccuaauuuaaaagcugugaaauuaguuuucacgcaucaaaccggauuguuuauauguuuaaacauuuuaugcucuuauuuaaagaagacuuugagcuauuuuuuucuguacccuguaaaauauugaaaacuaacauaauauguugagguugcuuggaaauguacauaaaacuaaaauuuucugaaucguguguuuauguuugaaaucuguguuuuaacuuuguaaguaaauucucugccuuuguauuuauauuuuacaaaaauuuucuuaaaaggcaauaaaacuguugaggaaaggagaaaau

SEQ ID NO: 18921 - RNA, 26192 nt, Homo sapiens
ggagaaagcggcagcugucccagcggaagcgacgaagggacgggacccgggagccuggacgaguccgagcgcgucaccuccucacgcugcggcugucgcccgugucccgccggcccguuccgugucgccccgcagugcugcggccgccgcggcaccauggcuguguuugucgugcuccuggcguugguggcgggugaggagccgggggccggcaggacgugccuggggagguccugcgccgcggggcuugggggucgggggcggccgcgggcgaguagcugcgaggcaggugccgcagugcgguccgucagcggcggccucgccucagccgcguccccgucagcaucuucucuggaucggccguggcggcgcggccucacgggccgccggggccggggcugggcugcguagggggccccugagccugccuccacccuccacuuugagggcggcgcguccggccggcuucuugcgccugaaaaggcccuucagaguacggagaugcauuucucagugaacugggauugagucgcagcccgcugcgaagaagagaaggcagacuuuuuagcugccacuggcugccacgauguuuuugcauuuguauggugccuucauuucuagugguugucaucaguaauugcugaaaucccugccccucccuucccuuauguauauuuccggaugcaaaaguugagauggagucauuauuuuuauaugacuuauauuucuuaaggcgaauacaaagcaccucucaauaguuugucagaguuccaaauuuuaaggauuuggaaacaggaugugagucgcauuuuuagggucacaugucaauaaaugguagcuuucugaguagaaccuagauuccuaagcauucagcaagaggugaagaaaucagcuaauacguggccucuuacugcauaucaugugguaauguauuucauuugacagcaguccuuagagggcaucaucuuuguuuugcagggugaucaaccuaaauaaauuacccaacacuaaacagguugggugcuggauuugauuucagaugagguggugccagcgcaucggccuuuuccauuauauauguuguguugcacaaguaacgcuauuacugugugagaaugugggagugauggggacugagacuggaggcacagacaguagugaacaagaggccaaguugagaacggcuuggaggaaugggugcucugaucucagugugucaguuuaaaaccuaugggaggccgggcgcggugguucacgccuguaaucccggcacuuugggaggccgaagcaggcagaucaccugaggucaggaguuugagaccagccuggccaacaaggcaaaacgccaucucuacugcaaauauaaaaauuagccggguguguuggggcacaccuguaaucccagcuacucaggaggcugagguacgagaaucgcuugagcccgggaggcggagguugcagugagccgagaucgcgccauugcacuccagccugggcgauagagccagaccuugucucagaagcaaaaacaaacauacaaacaaaccaaaaaccuaugugagguguugggagguccugcuuguggaauggcgauuuaauucugcaccaguaugcucuugaaaucugcagaucucugucccuagaggugcggggguuuuguguguuaaugauaguuacguuguauccaugccccaaacguuuucgaguucuuuguuucuuucuucuguuucuggcucuggaaaggucuuucugaucuacugagauacuuugagggaauuaauuuuaauucaguuuuugaaauuuuaaaaauauucccuuugauccugugguuuaacugaacaucuauugagauuccauguuuuaauauuuugacugauauuauuuugauucagugagguauaggcuuuuuuguuuugggucugagauaaaauaauugcuucugcacaugguuugaacauguuuuccuuacuagcauagccgaguucauacagaacaagaaccugauccugucagcuucugaauugcucagucuugucagaugagguucaguuauuauuuuccacaaugacuaaaugugauguaguggaaaacaucuuuaagagcucugacuucucuauuccaggcagaaacaaaaauagaaauccuuuaaaacaguguugccaaacuagagggagaacuagggaccuagagagagaggaagggaacuaggauuuugaauaccauaucaugaggcguauuugauaaaauucagauauuuagccuggagaagaaaggccaagggugaacacauggaauuugaagugaugucauguagaagagggagauaggauccauuuuuuuauuauuauugauuccauccaccauucguagacgauaauagcacaguauaguggaguuccuagagggaaggacacuuagcccagacuggggaggcugaggaaaauuucccaugggaggugccucccagggcuaauguguugaaaaguuggggugggaagaaaagguauuugaaacagaacagcauguguaaaagcauggcgaugugagagcaaaggggcaaguaguuugguggggcugaaauguacaggauuaaguuggggagauaccagaaauaaggcugaugagguuucuuggguguuaaugcuuuggguuuugccucagagucucugggcagugagagaaggcauuuaagcagaagggugaaugaucagaucuguauuuugaagcaguuaugggaaaggcuggauuagagaguggcaugacaagggucauaaggcacccaauucuagcaaaccuggagagggccugaagagugugcccuggacauagaggggaaaggauuugugagauaagaaaaaaagaugaaauucaguggcuaauuagcuguguugcugaggaagauuuaaagacgacugauuccagccacuggguggaaggaaggugguaucauccuucaagauagaauacaggagaaguguguggaaagauggugaauuggguguguuuuugguguuugcagccuuaggaguaguugggcucagccugggagagauguagaauaggaaagcaguaagagucaagaauggagcccucagaucuccaaaguggaguaugcuaggugauccauuuggaugccagaugaauguacuagaaauuccauuuauauccuuuuuguuuuuguuuuugagacagggucucacuccgucacccaggcuggagugcacuggugugaucacagcucacugcagccucgaccacccaggcucaagcgauucucccaccucagccucccuaguagcugggaccacaggcgcaugccaccauacccagcuaauuuuuuguuuguuuuuguagagaugaggucucaaacucuugggcucaagugauccuccuccucagccucccaaagugcugggauuacacgcaggugugagccaucgcacccagccucuaucuuuuuuuuuuuuuuuuuccuuuuuugagacagagucuugcucugucacccaggcugaagugcaguggcacgaucucggcucacuacaaccuccgccucugggguucaagugauucuugucccucagccucccaaguagcugggacuacucuuguugcccaggcuggaaugcaauggcaugaucuuggcucacugcaagcuccaccuuccggguucaagugauucuccugccucagucucccgaguagcuaggauuacaggcaugcaccaccaugccuggcuaauuuuguauuuuuuuaguggagacgggguuucuccauguuggucaggcuggucuugaacucccaaccucaggugcucugccucuugaguagcugggacuacaggcaugcaccaccacaucugucuaacuuguguauuuuuuugguagagacgggguuucacuauguucaccagacuggucucaaacuccugaccucaaaugaucugccugccucagccucugaaagugcugggauuacaggcaugagccaccacaccuggccucauuuuuguauuuuuaguagagaugagguuucgccauuauggccaggcuggucuugaacucuuggccucaagugauccgccugucuuggccucccaaagugcugggauuacaggugugagccaucaugccuggccuauuuuuaucuuaucucuuuuugaauaauaauggucagguauuuuguagacugucccucaauuuggguuuaucugauguuuucucauuauuagauugggaaaaauacuacacagguaucucauccuuuuaaaaacuuuuauuuuuguaugcuuuguaauauagcacaaaucaaauacauaaucuauuacuauaguagaaguauauacuuuacauggagaggaugagagggacagagagaagaaagaagggcuacuuuccaauuuugggcugacaggguugaaaucuaaaaaguuuggcuaccacugcuuuaaaggacaggaagggaaagaaacagaggagaagcagccaaagggauugcaaggaaaaccaggagccguggcugcaugaagaccaaagcaggggcuuuucaaggagggaguugccaguaucaaaugcuuugggaaguuagauaaaauuaagggauggaaauugccuuuugaguuuggggagucguuucaguggcauggugggcuuggaaggugugggcggccaggugggguggcucacgccuguaaucccagcacuuugggaggccgaggcaggcggauuguuugaggucaggaguucgagaccagucuggccaacguagugaaacccugucucuaccaaaaaaauacacaaguuagccagacgugguggugcgugccuguagucccagccacucaggagucugaggcaggagaaucucuugaaccugggagguggagguugcggugagcugagauccuuaccacugcacuccaaccugggugacagcaagacccugucucaaaaaauaaaaauaaaaaaaauuuuuaaaauuuuguggguuaaguaguaaacuuaaaaugaaguauagaagcaaacggugguugacugcucuuccuggauucuuccucugaaggggagcaaggcugguagcugguggagacugguaggaccaaaggagguuuuuuaugguuuuaguuauagaaugggagugccuugagcguauuuuuaugcugaagugaaagggccaguggagagggaaaaaacuggugguuugaagugugacuucauucauucauuaacucaacaaguacuuauugagcaccaaugugucgggcucuguucucagcccuggggauagugugugaacaagacgcacugaaauccccgccuucauggagcuuguauucuauagggccaucuuuugauggcuauuaccauauagccaccucacuccugauguguugucuguccuagaagaguggcuuccuuaacaaacagugaaggaacaaaggucccuaaaaagacugaacacaggauugucuuagucuggaggagggacaucccugcccucaugucuggagggagaggaguuacagauaggggcuuaugcagauaaauuugugguggggagaggaagcagguagcucaagaaauuccucuguuuucucugugaagcuggagaugagguuaucuggugagacugaguuggggagugauagcauaggaaguugaaaguuaggaagcccauuucaguucaguacaaggaaaaacuuuucaaaggacuagaauguuaggaaaauggagccaguugcuggcaaauguaguucguauauugaggugguguccccaucacugguaguauugaaauagaggaggggugacuuucugccagguaucccugagacaugcuuauacuuauaauaagcagaaguuuggacaaaugaccuuccucuguauaggagucccugacucuaagguuuucuaaagcucugggcuucugaaggacuguuguacaggcauggaaguugaaacuacgaagcuggggcaaaguuauuugguauagguuugccagaauugaaugaguagggccgugucucaaaacaaggguaucuccaaaucaaaauaugguuuuuuaaauguguaugguaccuggggcugggcgcgguggcucacgccuguaaucccagcacauagggaggcugaggcgggccgaucacuugaggucaggaguuugagaccagcuuggcuaacauggugucacccugucucuacugaaaauacaaaauuuagccaggcaugguggcacacaccuguaaucccagcuacuugggaggcugaggcaggagaauugcuugaaccuggcaggcagagguugcagugagccaauauugugccacugcacuccagccuaggcgacagugugagacucugucucaaaacaaacaaacaaaauauguguaugguucuugggaagcauaggucucuugguuccccauuuuucuuaguguuugcaguacuacuacuuuagugaaccaagauaucuaucaguuacaaaagaccauuccauucugcuaauuuuuuuggucugucuucagcuagagcaguuuggacauuccuguucugacagcugugccggauugaaauuuguaacucccguguaucagcaccaaccugaagccuuuuauuuacugucaauacugcaacaccaaaacauuuacuguugcuuccaacuuuauuuccauccccuguuagugguacuuuccuuaggucaagagaauaacacugauucuuuacuaaagucuaauuuucccauacuagguguggcuaacauuuguucuagacuuggagcccauuuuuuuaauaggaaccccaaauuaaaaaaucagccaggcaugauggcaugcaucuguaguccuagcuacucagaaggcugaggcaggaggcugaggcaggaagaucacuugggcccuggaguuugaggcugcagugagucaugcagacucaaacucagcuugggugacauagccagacccugucucuaaaaaaauaacuagguacaaauuucauccuuaaauguaaacaaccaaucguguucacuuugguugcccaaagacuacaaaaagcucaggggcucugcccuuaggccuggcagugaagcaguucccaggcagaguuucuguuuucaagggugcucaggauuuggagaaaaguuccuuucaguaacugaaauuagcuacuugucccuguguaagcuagacaucacgagguuaauagauaauggaugaagaggccaaauaccucauccuuagcuguggagagcuuauaaaauagucccuuuauucucaucuuuaucuuuuaauccugaauccuuagacuaguugacuuuaucauuacagaauaccuuuucuuacccucuugacaugucaacuacaaauacuguuuccuggacuuuguuucuaaagucugaaguguuuuuauguuucuacuugugacauguaugcccccccccccccccaacauuugacaguccuuauuucacuaggguugccuaugggacauaaggaaagauguuaccuauccuaagacauaguaaccugguaaaaucuuauagugaaauaauaggaacuuuaugaauuugcauuguguagaaaggauugaugguagaaauaauuuagagauuucaagcuucuuccuuuuuagucugugccugggcuuuguuuuuuguuuuuuaaauuuuggagauaugccacugauuucuaauuccugccaaauugccacaugccucuuuaagagccaucaguaggaaggugucuauaucauuaggaaacccuguuuuguaguuguaccuuuguugaucucuuuuugagacuuuuguuuguuucuuguucuuaucaggcagacccugaaccagaauagguucagagaggcucugauaguuguacuuuuguuccagcagaauguguggacuuaaauucuuagagugauacuuugaaaaagaauuuguuauuguuuaggacucagcauuuugaccagucauaauuuaauacgcuaagucaguggugaauggggaaacauguauuauauuuaauaauugucaagguaaaugauuuaugauguugauaauucauuuacugaucuguuuucuuuucagguguuuuggggaacgaguuuaguauauuaaaaucaccagggucuguuguuuuccgaaauggaaauuggccuauaccaggagagcggaucccagacguggcugcauuguccaugggcuucucugugaaagaaguauguauauauuuuuuaaauguuuggagcugcuuuuaagaacauuuuuacugauuucugcuaauagcccaaaaaagcaucaaacgaacguagguacguuugguacagauuacaaaaguuaaaaagcucaucuggaccaggcacaguggcucacgccuguaaucccggcacucugggaggccgaggugggaggcucaguugaacccaggaauuugagaccaaccugggcaacauagugagacucccaucucaaaaauaaaugaauuaauuuuuuaaaaacccauuuguaguugggaagauuuuggaugagugcuucaagcuuggcuucugaaacaaaucauuagaaaucauuaacuauauaauuauuuauucauaguagugaaauucuuuguauauuagagaaugcaucuguccuacucuuaauaggauaucuacuuucugguuuuuuuuuuuuaguauaggcgauagauucacuaugaaugauaaaauauauaugcauuaugccugagguuaggaaaauaauguggucaguagccauggggcagccaaggaccuugguuuccuagaauggagcuaugaccuguuguaguaauuggcugcuuaugugauuguagggggcgggagggucuagauccagucaaugugagagaucgaaagguaagggcucagaagaaaggaaauacagcuugcucggugcuaucaucuccuucucuuuguaagucuggugcuuuugauguggucucuagauauauaucaucagucacugaaaggaacuuuucuccaaauccugagcacccuugaaaacagaaacucuaccugggaacugcuucacugccaggccuaagggcagagccccugagcuuuuuguagucuuugggcaaccaaagugaacaggauugguuguuuacauuuaaggaugaaauuuguaccuaguuauuuuuuuagagacagggucuggcugugucacccaagcugaguuugagucugcaugacucacugcagccucaaacuccagggcccaagugaucuuccugccucagccuccugccucagccuucugaguagcuaggacuacagaugcaugccaucacgccuagcugauuuuuuaauuuuuuguagagacagggucucgcuauguuguccaggcugguaggucuuuaacuccuggccucaagcaauccuuucugcgucagccucccaaagugcugggauuacaggcacgagccaccacacccagccuguaccuaauucuuuuuuuguuuuguuuuguuuuguuuuuugcuacagggucccgcucuaucacccaagcuagagugcaguggccugaucucggcuuacugcaaccuccaccucccagguucaagagauucucccaccucagccuccccgguagcugggaccacaggcguacaacaccaugcccagaucauuuuuauauuuuuuguagagacaggauuuugccauguugcucaggcuggucuugaacuccuggacacaaggaaucuaccugcuucagccucccaaagugcugagaugacaggcgugaacaccacaccugaccaucuaguucuuuacaaccuuaaacuugacuacugauggcuauuaaaauaacugagaaauaauuauuaguaaacuaaugauaguuacuuuuaguaggaauuguuuuauuuauaaagaucuuagucuaaagaggauguuuuaaugaccaucuugcuaugucucugugaaagauaaaagugaugcuguauaugagggcaaaaaaugaugugggggaagaaaauuuccauggcuacaugaagaaaauauuuugugaucugaaauuugaaagguaccuauguuuuguuuacuugcuugcuuuuuuccacaaaaggugucagaugacuuacuauuggacuuuauuucaaaucuguaaaauuuuaagaaaaugaagaggguagaaaucagcauucuugauuaggggauugcaacgacugccacaaauaaaauguuuacuuucccugugaauuuuccuugucagugucaucucagaaccccuuaacucugcuuauuagauguuauuggggagguggguuccugaguugauaauuaagcaccgcuuugugcuuuucaauguuuaggaccuuucuuggccaggacucgcaguggguaaccuguuucaucguccucgggcuaccgucauggugauggugaagggagugaacaaacuggcucuacccccaggcagugucauuucguacccuuuggagaaugugaguauuuauuauaaaaaauuaaagggaugcauuuuacauuuucccuugucagcugucauuaugaauugcauucuaaacauacuucucuuaucuguuuuugaugcacaguuucuuuugaaauucuuugacaaacacaauuucuuuuuaagaaaauuacaugaugauuguaauuaacugaggcuuggcuguucucuguggaugagaguacuguuuaagauaagagauagagaaauugccccacucagaauagccagaggcuugaaaaagagagccacuaaaggagaaaccaguugggguuguauccugcuacuguuuuuuuggccauugucuugucaucuucccugcaggauuuuaccucuuuucguguguaaggacacuggaggcugcuugcuggcucacuuacuccuucacuggcuauucaggcaaugugggugacugugcugaucuaagaggcccuccuuccauuauaagcauauagaagugcuugaaagaaugucacaaaaaacauuuuuacuagcauaacuaaauuugaaugcaagagggggugauauacacagguguuacauauggauggaaaacucagaagccauaguggugagcagaagcugacgcugaaacuguguuuccugcagaaagccagggacuagaaaugcugucaacuuguucuugaaaagcagacuaguaaaacuaguaaagcuggcuugcugcccuuggcuguuggacccaaagaguccccugagauaaauuagaauuagaauuauaggcuuaugcugugcagagugguucuuugcaaauucacaugaccugccccauagggacaucuccauagccaagggcuccuuuggucaaauacggaagaugaguggaauuuacaaagcaccugaaggaaaaaaaaugccaugagaaacaggugcaacaaacagaauucaucuccuuagaacuacggagaauaggccaauuuccaagagaucuaaaaauacauacauuaaaauugugaaaaaaagggccaggcaugguggcucacgccuguaaucccagcuuugggaggccaagaugggaggauugcuugaggccaggaguuugagaccagcuuggucaacauagcaagacccuaucucuagggggaaaaaaaaagaaagaaagagaaaaaauuugugaaaaaaaggaaggaacagaaacuaugagggaguuauaagacauuuuugauacauggugcuuuagcugauacuucaaaauauuucauaauuuauauugugauucuuuaacccaugaguuauguagaaguauuuuuuccaaaugcauggguuuuaaaaaaguaauuucuaauuuuuaaauuucuaaguucacugcauuguaauacuguggucuaugugaugcugaaguuuugggauuuuuuuuuuuuucagacuuuccuguggucgaguauagauuauuuccaaguacacauggcauacuuagaaaaaauuacugugcaguaguccacaaggcaaaucucaacaaacaauaaagaaucagugucauauaaacuaacuucucugaccacaaugcaguuaaaucugaaaauaauaauaaaaugauaucuuaaaaggguauuuggagcccggcaccauggcucacgccuguaaucccaacacuuugagaggccaaggcgggugaaucacuugaggcgaggaguccgagaccagccuggccaacauggcuaaacccugucucuacugaaaauacaaaaauuagccaggcgugguggcacgcaucuguagucccagcuacucaguggcugaggcacgagaauuacuugaaacugggagguggagguugcagugagcugggauugcgccacugcacuccagccugggugacagagcgagacuccaucugggaaaaaaaaaaagguauuuggaucaacauuucuccuuuccccauccacccgucucccccagcgucuucuaaccaucauucuacucuacuucuaugaguucaacuuacaagugaggucauguaguauuuguccuucuaugccuggcuuacuucacuuaacauaauguccuccagguuuauccauguugcaaaugacaguuucccgcgcuuuaaaggcuguauaguauuccauuauguuuauauaccacauuuucuuucugcuuuuuucuuuuuuuuuugagacagaaucuugcucugucgcccagguuggagugcaguggcgcaaugucaucucacugcaacuucugccuccuggguucaagggauucuggugucucagccuccugaguagcugggauuacaggugcaugccaccacgcccagcuaauuuuuuguauuuuuaguagagaugagguuucaucauguuggccaggcuggucucgaacuccugagcucaggugauccacccaccucagccucccaguggaucucagugcugggauuacaggugugagccacugcacccagcugcacauuaucuuuauccauucguuugauuauggacaccgagguugcuuccauccauaucuuagaaauuguaaauagugcugcagugaacaugggagugcagauaucucuucagcauacugacuucaauugcuuuggauauauauacccagaagugggcuugcuggaucaugcuuuagugaucuauugcacaaaauggugacuauauuaaauaauaaugcauuguguauuucaaaauugcuaaaggaguagauuuuagauacuuuuaccacaaaaaaaauauaaguaugugaggugauggauuuguucauuagccugauuuaaucagucuacuuuguaaacuuauaacaaaacauaacauuguaccccauaaauauauacaguuacuauuugucaguuaaaaauaaaauaaaaaguauuuggaaauaguaacaaacagaagauaacaacuccucagauuuaaagcauauggaacacccaguaggcaaaagccagauccacaccuacauacggugaaauugaagagucaucaaggaaauggaaaaucuuaaaagcugugagggagaaaagacacugucauuacaaaggaaugagaguagaaggaaagcaaggaaaauguagugauuguguaguaugagcuaggcugaguauuauuugcauugucauaauaaugaaaugaugcugaucaagugaaaauuuugauauaacuauuggguaagaguggggagauagaaacagaagcagagcgcauggauggcucagcgcauggauggggcagugguuggugaugugagagagcuaaagccucauuuucuauaauggauaguaaauagacaagaccuaaaauugaaaaaucaggagauguaauuuaagugucuuauuuagagauguuaaaagcaaaaaaagucaacaagaaaagauaguuggaauagaugcacuccuaaauaauucauggguugaggaggaaaucacuguggaacuuuuuaaauuauuuggaacugaguaacaaugaauguagcauuuauuuacaaaauugggaggugcagcuaacgugguaagaaaagggaaauuuauagccuuaaaugcauguuuuagacaauuuagguugucuaagaauggaaauuaaugagcuaaagaaagcggaagaacuucagaguaaauacacauaaaguagaaggaagggaacaauacagaucaaaaggcagauuauuucacagggagcauuuaagucauuuuuuaugugauuucugugaaaaucauugcagaagauuuucuuuaaaauuauaaaaauccaaaaugccauuuugagauuuuuauuagcauguaauccaaaaauaaagauuuaaaaacagacuagccucauuuuacaugagaagaagcugugcugugugaggagcucauuuuauugcuuggcccugguuggcugcucaaugcuuuuccuagcagaagaugguaaaugagauaaaagauucaggggcaaaccccacaaaacauaaaaaucagaguaucuuagaauuccauuuaacgaagcuuccauuugauuagcuagcuguuuuaguuagaauuucaagucauacagguacagaaauuugaggacagauaugcaucucccuuacaauacagugagagaaaaaccaucauucgauauuaagcagccaagcuuuuuacuuuuugagcuuagcugccuauauaauuauuucuuuuccuucauugguguucauuugauucaugagcugcuucaauuugaucgcuauggacaugguuccuaaucuucaacuuuccugaaccgagcgccauuucacuaagugaagugaggcuggaaaguuugcaucauuugcucauguauuccccucacagccugaggagguaaacucuaugaucgcuaaaggaaagcaccuauagaugauucagggcggcugcuagcaguaugcuuuugcaacuuugaacucucuucccccucuucacuuacucauuaacucauuuugagagaauuuggggaagaguuaauaagcaucuugaguaagagaaaaaaauuauuucauuucacagaaucauaaaauugaucacuuaauauugaugcugggccugggcaugguggcucacgccuguaaucccagcacuuugagaggccaaggcaggcagaucacaucaggccaggaguuugagacuagcauggccaacuugaugaaaccccgucucuacuaaaaauacaaaaauuagccaggcgugguggugcgugccuguaaucccagcuauucaggaggcugaggcaggagaaucacuuguaccugggagguggaggcugcacugagccgagaucgcgccacuguacuccagccugggcaacagagugaggcucugucucaaaaaaaaaaaaaugugaugcugggauuuuaucaguaagacauaaucacauugauuucugccuguaucauauuagcguuacuuugcuacuuguaaacaugaaucuuuaaguaguaagggaacuacugaaugaaagaucaauguaagaaaucuccauuaaaacaaaaacaugacuguacugcuuguuuuaauacaguaauacugggaaugaaauaauuuuuuuaggggaaaaauaacuguaauuuauuuuuuuaaaucauguacugcaaaacaaaucuauggggauagaagucagaauuuuuguuacccuugaggguggagguaguacuucgagggcgcugauaguguucugugucgaucuggcugggcuaccugagugcaugcauguguaaacauuuguugagcuguuaccccaagauuuguauacuauauuauauguauuuugcacuuuaauaaaaaaauugaaggaaaaaaguaggucuuaucaccauugguuauuucaaucuaauaauaucaacauguccuaagauaaaggcuucaaaaaccuugugacauacuuaacaccuuaucuaagagucuuuaggcuaucugaagacaaauguuaaaucucauuaaacauuuuuaaaauuuugaaaugaaagaugaauuccauuuuuauuucaauuaaauucaauacucagauuccucuaaccucuuaaaugcaaauuaaauacuuuauuguggaauaugcauucaucguggcacauuuagucaauauugaaaccaaauguauugcugcuucaaauacaugaaugaccaccagaaaaugguuugugcuagauauaguguuguguccaucagguuuaaguuauuuuccacugaggcaugaugggagauacagacuuggcuuaccagggggcuguuuaaucuucugugcccucaaaagggcuuguuuggaaaugauuucgggcuucuaaauuuccauagaaagugcuggaaaaaaguuuaaggcuucuuuuuaaauaccaucugaaugauuuuucuucccacuuugguucacauaauaauugcguucuuacucuuaaauuucaggcaguuccuuuuagucuugacaguguugcaaauuccauucacuccuuauuuucugaggaaacuccuguuguuuugcaguuggcucccagugaggaaguaagugauaaggguuuuauucaagacauuuuaaaaaauaagcuuuuauuauuugaaaauuaugaaauguaauuuuauuaugaaaauauaaaacuaauuuaugaacaauguugucauaccucuggguauuggaacuaaucuguagaauuugagcaacuuaaaauuuucuauucuucuuacagagaguguauaugguagggaaggcaaacucaguguuugaagaccuuucagucaccuugcgccagcuccguaaucgccuguuucaagaaaacucuguucucaguucacucccccucaauucucugaguaggaacaaugaaguaagugcaguuauucaaugaauacaugaauaucauuaauuuccgucuuuuuaaaaaauagagacagggucucacucuguuguccaggcuggucuugaacuccuggccucaagcaauccugucuuggccucccaaagugcugggaucacaggcuugagccacugcaucuggccucccauuccuuauacuacuugaaauuuuggaaauuuugcuauuuuagaaaaugaaagauugugcacauuuacugcugggguagauucuucuuuaguguaauuuucuuaugacucucaugaauaaacugauccuuuuugugaguugagcugugguaaauaacaucacauuuuagcacgaggguugccaccuauuaauucaaacaagccagaggucauagaucuacuuggugacugguggagcuguguggaucugguaacuuggaagccauuguucacugccucugcugauuuguugccacauuuuucucauucauucuggacauugcaguggagggagccaccucuacuuuugacuccuguccuucaguuucuccaucugcucaugcgcccucuuaaccauguggcaugccacuuucgugguggccuccccuuuuuauuugcuguggaugaccagggccaucauccuuuauucucugauguggaaacuauucaagggaagugagcaaacugggccaaugguaggaugucauugcagagugccaggauauccugaugcuuugaaggaaaaccacuggagaacuuggaugcuuuaucaugguuuugccaaaaauauagcuauugaguggcagucacugugcuagggaauggccaucaccuuuuuguuaggaaauaauguuuuauaugcauuuucaauugaagcaaacauaccaaauggaagauaauuauauaaauucacuuauaugaucaacauuuguaauauccugugccuugcuugguaaauggcaaauaaagaucucuggugcacauuuaaaagaaugcucuuuuuuuuugggcucucugaagguugaccugcucuuucuuucugaacugcaagugcuacaugauauuucaagcuugguaaguaggcugcucuaauuuuuuaauuccauuuauuuugguuucuagagaauccuugaauaauaguaaaggcaguugaaaaguuugauuaaguaugcccuagauuuaugaucccaugaaaauugaaaaauuaguggcaauauugggaauuuugaacacauccauguuauagucaaauuauuuugcauuucugcuuuuuagggagagacaacauaucuuccaagaacacaagccugggcguaagaacacccuggccauaguccuaacuuggcuguugauuucuugugagacuuaauuccuaucuauaucuuugggccuaaaauagaaauaauaguuuggacuaauaaugcugucagucaagucaagaagggacgaaauccgucugaaggguauuuuuuuggugaaugauuuuuuaaaaaucauccuuguuacugaaauagaaauucuuaucuguuugcuaccuucugaaguuguuuuccaaacuuuuucaacagguguugguucggggagucuggaaguguagugcauuccugggaucaaacugguccagccaucuguucuuucauacguuggcccauaccugaguuuuuaaaacugaggaauuuuguugaaagcuuuuauuaaauauccaaggagucuuguacugcuccuaaacaugagauucguguuggauuuaucagaaacgcuuauucaaaccaguuucuuuugccaccauuuuagacuauuugcauguugugguacacugguaugguuuaguuuagccuaguuuaguuaggcauaaaacuuuaacuggcuguguuugacgucuuucaucuuacuuuauccgcuaccuuuuuuuguuuguuuguucuccuaagcugucucgucauaagcaucuagccaaggaucauucuccugauuuauauucacuggagcuggcagguuuggaugaaauugggaagcguuauggggaagacucugaacaauucagagaugcuucuaagauccuuguugacgcucugcaaaagguaaauaucaaugcgacaugagagguuggaguaugaccauuucacuuuuagccucuuaauagaaaaaucugcuguuucaaacacuguugauugaacucuuauuugccuucuuuggggcuccucuaauuauacuggccaaggauggaguagggucaaaaauguauauugauauauuucuuccuaaugcuagaaagaacagcauuaggaaaaguuaucucacacaaagcuuuacaaaauuauugugguaaaauauauauaacauaaaauuaccacuuuaaccauuuuuaauuguacaguucagugguauuaagugcaaguacguucacauguuguacaaccaucaccaucuucuauuucuagaacuuuuucuucuuccccaacugaaacucuguacuccuuaaacacuaugagauaacugaaguagaacacccagcacaguaccagacaguagaugcauaauaaaugcuaguuccccucugcccuugaaguucuucaccugcauccuuucagugaggcuucauauuuuaaucuuuauagauguuugugauuaaccagagaccacuuaggaagauuucauuucucuuuccaacuucccuuccuccaauuuauaugcugacaaauucagucucuucuuaaaguaauuuuagucuaaacauuugaauauauguuaaagcuuaacacuuuucuguauaguugagcaaaaucaaaaccuuuaagacuugcuuauuguaagauguaguauauuucaugagccaggagguaaguguacauuguucuuguagcugcacaaaagcuuuaaaaauaauuuuaauaaguauguauuugacucacugcauaaaaugauaaguaggagguaaugcauauguuaauuagccaauguggacuuaagccauuccacaauguguacauauuucaaaacaauauguugaugugauaaauauauaugauuuuaauuuguuaauuaaaaaugaaaaaaguacauaguugagauucccaauaauguuaauaacuaacuuucaguuugcagaugacauguacagucuuuauggugggaaugcagugguagaguuagucacugucaagucauuugacaccucccucauuaggaagacaaggacuauccuugaggcaaaacaagcggugaguauauuuugagauccugcuuuaaaacuguaaaauuaacuucuuauaaaaaaaaaaaaaccaaguccuauaucaccuaagggugacaugaaugagcagucaguaaaucugaaaaacaauuucaguuaaaacguaagcuucuuguucacauacauaugugugcuuugccagugaugaucaguucuuuaggguuauaaucagauaaugcaagaauuugaauuagggauaaaaguaaaucuguccaagauuauaauucaaauaucaguacacacaaggagauaucagaaguuaauguggcgccaggugcaguggcgugcaucuguaauugcagcuucucaggaggccaaggcaggaggauugcuuuagcucaggaggaguuugaggccagucugaggaaacauagcaagacccuguuuugaaaacaaaaagaagugaaugugugcgggagugguguggugcccacauccuaugggcucugcuuuucuagcaggcacauugucuuuguggcguagucccucacuuacugagauccucugugugcaccucuuuaugauuuugauuuacuuaacaguuuuuuuggguauggaucuugcuuugauuuuaagcauuuagagggucaggguuaagcauuaccaugguugcuggccaugguaaaauacauaucuguuuauguguauguacgugcacauuuacauacauacauauauacuuacagcugcagcagaaccuagggagggugaugggaaagaguaguguagaugcucccuaacauccuacgucugagaacauugcuuagggcuggcuguaucacuugcagcagauagauauccacucaauuacauacaccuccgcuucagacccauuugcagcccucacccugcucaguuuuacugaagucagugugggacuuggagucggaaggucgaagccagugccuguuugagauagucuagcgauuacugguuugagauuguuucuuucuaaauuaaauuggggauggaaggaccuuuguuucagacagcaugucagucuagacaaccacccaagauuucccaccauaaaacgucuagaaaugcuagauaaaaauaaagaucuuuuaaaaaguacauaguuugggcugggugugguggcucacgccuguaaucccagcacuuugggagguugaggcgggcggaacaccugaggccaggaguucuagaccagccugggcaacauggugaaaccccgucucuacuaaaaauacaaaaauuagccuggugugguagcgggcaccuguaaucccagcuacuuggaaggcugaggcaggagaauugcuuguacccgggaggcagagguugcagugagccaagauugcaccacugcacucuagccugggagacacagcaagacuccgucucaaauaaaaaaaaaauuacaaaaauaaaaauacauaguucagcucgcaagaaagggaaauucucuuacagaguaaauaaagaagaggaggccgggugcgguggcucacaccuguaaucccagcacuuugggaggccgagguggguggaucacaagguuaggaguucgagaccagccuggccaacauggugaaacuccgucucuacuaaaaacacaaaaaaucagccgggcgugguggcgcacgccuguagucccagcuacuuaggagucugaggcagacaaaucgcuugaacccgggaggcggagguugcagugagcugagauugugccacuguacuccagccugggugacacagugagacuccaucucaaaaaaaaaaaaaaaaaccgaaugugguaagcaggccgcccuaaggauauuugccagcugggucaccaagaguccuuuggugccuugugugugggggaugggaauggacaacuccagauaaagcuggggaccccgagagagcugugcccucagugagaggguagacuggaaauuuuugcccaccagcacagggaaacagaaaggcaccugggcucuggguggucagcacauguguugagaguggggaugccucccagagaauucuuuuuuuuuuuuuuuuuuuuuuuuuuuuggauuuuuuggagauaggaucuuacucugucacccagacuggagugcaguggcacaaucucaacucacugcagccuccaccucccagauucaagugauucuccugccucagccuccugaguagcuggaaucacaggcaugcaccaccacacccggcuaauuuuuguacuuuuaguagagaugggguuuuaccauguuggccaggcuggucuugaacuccuggccucaagugauuugcucaccucagccucccaaagugcugggauuacagguguaagcuaccaugcccggccuaugagauuucuuuuuagggugauagaaauguucuagaauuagauuguggugauaacuaugaaaccacuaaaauuccuugacuuguacacuuaaaauggguaggaaaaagaacauguuuaucaaaaaaaaaaaaaggaaagaaacaaagaggucuucaugggcgugaaauccuuuaacguuugccucagcucugagcuccccgcagguaaauaugcaugccuguguacccauucucuccuacauuugaaaucacucucuuccauuaguuuaaggagacaggaguuuaaggaacauuuacugaguacucacaacauuccaggugcuggggcuguagggacaaauagaucucgguuacauuuucguucucauccucacugccaggcacccugcccccauuucucccaccucauuugacugccgccuccuaacuugucugaacucaucugucucucugcuucccagcuggcuccucccaaauccauccuacacauugucaucaaaguuaucuuuuuucuuuucuuuuuuugagacagggucucgcccugucccaggccggagugcaguggcgcaaucauagcucacuguagccucaaacuccugggcucaggugauccaccugucugagccuccugaguagccaguucuauaggcuugagccaccacacucagcuaauuuuuaauuuuaauguuaucuuuuuaagacaaaccugaucaugucacucacuuucugccuaaagcuugucaauggcuccuuauugcccagaggcucaugucagauuuucuguagcuucccugcuucuagcuucaucuccugcuguguuccuacuuuuaaaauucucuagccagaaugaaugauauuucccaaacagugccuuugucagaaugaauucaguuucccaaacaauguuuuuacacagcucuguauuuuaaaaaaaaguguuaaguggaucauacauacauaaguauauaacauauuuaauacuaguuauuuaaauaauaaaaauaauaacacuguauagcuccguuuucauauggcuauaaagagcuaccugacacuggguaauuuauaaaggaaacagguuugauugauucacaguuccacauggcuggggaggccuuaggaaacuuacaaucauggaggaaggggaaggggaggcaggcaccuucuucacaagguggcaaaagagagagaaaguggcacacuuuuaaaccaucagagcucaugagaacucaguaucaugagaacaguaugggggaaacugcccccaugauccaaucaccucccaccaggucccucucucgacacguggggauuacaaaucgagaugagauuuggguggggacacagagccaaaccauaucaauagcuuaagagaaugcuugcuucuuugaagcucccuauuuucucccucuacccucccucauccagagguaacugcuguccuggauaucauguuaaucccuugcuuuucuuuacagauugacugcauauguauuuguucuuaaacaguguuguuugguuuugccuguauuugaauuuuauauaaauugaaucauacuacauguauuuuucuguguucuuuguucaguauucuuuuuaagauucacucaggcugacaaauguagcuguaguuuagucauuuuacuguuacauauucugcuuguagggauauaccacaauuccauucuguugaugauuuuuuuuuuuuuuuuuuugagacggaguuuugcucuuguugcucaggcuggagugcaauggcacagucuuggcucacugcaaccuccaccugcuggguucaagcaguucuccugccucagccucccgaguagcugggauuacaggcaccugccacgccuggcuaauuucguauuuuuaguagagacgggguuucaccauguuggccaggcugcucuggaacuccugaccucaggugaucugcccgccuuggccucccgaagugcugagauuacaggcaugagccacugugcccagccuugcugcugauauucuuauacaugucucuugguacacauauagaaauuuucccuagcguauggacuuacuggaucacaggauaugcacaccuucaacuuuauuagguauuguccaguuuucccaagcauuuggacugguuuauacuuccaccaucagugcaagugucgucuccacaaaggcgcuccuucuugcuuccuccuaguauaaguagcuguuaugccacuuaugaagaaauguuuguuagacaaaugaaucacagucacuagacugggauaauuuccuauuuuaaaauucuucccucuugauuuuucuuucuuuucuauauuguagaagaacccagcaagucccuauaaccuugcauauaaguauaauuuugaauauuccgugguuuucaacaugguacuuuggauaaugaucgccuuggccuuggcugugauuaucaccucuuacaauauuuggaacauggauccuggauaugauagcaucauuuauaggaugacaaaccagaagauucgaauggauugaauguuaccugugccagaauuagaaaaggggguuggaaauuggcuguuuuguuaaaauauaucuuuuagugugcuuuaaaguagauaguauacuuuacauuuauaaaaaaaaaucaaauuuuguucuuuauuuugugugugccugugauguuuuucuagagugaauuauaguauugacgugaaucccacugugguauagauuccauaauaugcuugaauauuaugauauagccauuuaauaacauugauuucauucuguuuaaugaauuuggaaauaugcacugaaagaaauguaaaacauuuagaauagcucguguuauggaaaaaagugcacugaauuuauuagacaaacuuacgaaugcuuaacuucuuuacacagcauaggugaaaaucauauuugggcuauuguauacuaugaacaauuuguaaaugucuuaauuugauguaaauaacucugaaacaagagaaaagguuuuuaacuuagaguagcccuaaaauauggaugugcuuauauaaucgcuuaguuuuggaacuguaucugaguaacagaggacagcuguuuuuuaacccucuucugcaaguuuguugaccuacaugggcuaauauggauacuaaaaauacuacauugaucuaagaagaaacuagccuuguggaguauauagaugcuuuucauuauacacacaaaaaucccugagggacauuuugaggcaugaauauaaaacauuuuuauuucaguaacuuuucccccuguguaaguuacuaugguuugugguacaacuucauucuauagaauauuaaguggaagugggugaauucuacuuuuuauguuggaguggaccaaugucuaucaagagugacaaauaaaguuaaugaugauuccaaauuugugucauugcaguacuaaaucuauuuuauauuguaaaaaccuaacaaaacaggcuuuucuuucaucaggauuggcuguuuuguuguacagauaauuucaugguguuucuuuuacacuuguuuauucucgcugccuccugagauuuaguacuaauguaaggaaggcauuuuaauuaccauucuuguuacugaauuuauauaggauauaugagaaaugcauacuuuauguaggaaaggguuacauuuuucuauagcuuuuuuuuuuuuaaauuaaaaacauuuuagagaccagucuugcuagguugccaggcugaacuccuggccuccagugauccuccuaccucagccuccccaguagcugggauuacaggugugcaccacugcacccggcccuguagcauuuuuaaagaugaauaagcaacuaauugguuagaauaugaaggacugucucagguaaagguu

SEQ ID NO: 18922 - RNA, 4233 nt, Homo sapiens
cccagaauaaccaugugcauggacagccauauacaggcccagcagcacaucacaugaacaacccucagagaacuggccaacgagcacaagaaaauuaugaaggcagugaagaaguauccccaccucaaaccaaggaucaaugaaaugcacauaauuaacugguuccaucaagacugugcacccaggccuuacaguccaaccuuuuucugugucuggcuaauauuuaaaacuagaaaaacuauuccuaaucaacauggaguggagaguuuauucacugucuuaucugcagaaauuugcugucaauauauaacccgccugcaguggaaaguguauaguguuuuguaauaaauggccugaugcuaauguguaaauggcaaagguguauauaguauauuaauguugacuguuaauucuuaagcaagaaacuuuuuucuugaugagacucacagaucuacacaaacuacaaaaguuaauuuucuuguuacacccacugcacucugcaaccaguguugccugccucauggcaguuggaucagcuccuuuacaaaaaagaaaaaaaaaaaaccaacagcaacaaaacagagcccauccaugucagccacaccaauaguuucauguuaauucuuugccacuggagucaauuuugcuaugagcaauguaaggcugguaaccuuuaaauuauuugguugauguggaaaauuggugauguaacacuguuucuagauuuuuuucauugccuuuuuauucugauauuagguuaaucacuuugaagcuauaguuaugcuguaacauuuagcauggcuucacaccaaguuaguguagccaaugaggaaaaaguuaccauaaugacagcaguuguccgagaagugacagcuguauuacucagagcuuuuacuucuuacaccuagaauauuaaaauauaaaacaaggggagaaaugugacagucuauuuucaguugcacauauguuccuuauauauaauguuugacaguucaaucucuggguggaauaaagaacacuuacguaucaguaaugggaauuuuuaaagauuuaaaacaaauaugcaaaaauuugcuaugccaagaugcuggagcauaauauaagacuguauuuggugugcuuguuuuguuucuuugguagaguuuauuaggugaaucuucuaaaacuuuccuucuguuggaucccagugacguggaagucaucagaaccccacgguacuuggaguaccucucugcaccaagauagcuggcugauuuucugcucagucacaauuuuacuugaaagcaagaauuguccuagcuccuuuuccauuauuccaaaacguuuaacguucaaagcagggucucauuaaaaaagaaacuacugguugauauaauugagauauuacaauuucagaauaaacauuugauuaaaaauaaggaaauccucaguucauacuguauuuaaaagagaauugguaacuugaauguguguaauuuuuuggaaccugucuaaaaaccaaauaccccugcaaacagauacagcccacccuauucuauuuaaauauuuugcuguuuuauuuuauagaaauuauuuugcugaauucacaaauagaauuugauuuaagaagaacuuuuuguccugugguguguuuuugguuuuuuuuuugguuacuuuuuuuguccuuuuuuuuuuuuuuuaaaagaggacugcauauuaaaauucauucugugcauagcaugccuaggcaugacacugauucaggauuucagucacaucaaguuuuugugcacagaaagauuugaccuuuggcccucuacugaagauuuugagaaaucaggauguugacacuguaaaaguuuccuaacauaaucuuguacuuuuuguauguuuuuuauauacauguauauuuaaugagcacaagcuugguuguauuuuuuacaauucaguuaauagggaaauguuuugucaaaaggcuacacuuggaacugaacaaagcagaaacaaaauugagcauugcauuauuuugugauuaaaaggggcagguauuuaagauaaagcuuuggguaucuuauuuguaguacuguauagucaaccugugcuucuagguguuccuguaggacauuuugacaccgauacuuugagugaaagucacacacgguguuugcaauuccaacugauuuuuguuuuguuuuuauuuuuuuguuguuuucuucuuugagauggagucuugcucugucacccaggcuggagugcaguggcacaaucuuggcucacugcaacgucgccuccuggguucaagcgauucuuccgccucagccucccgaguagcugggauuagaggugcccaccaccacgcccagcuaauuuuuguauuuuuguagagacaggguuucaccacguuggccaggcuggucuugaacuccugaccucaggugaucuggccgccucggccucccaaagugcugggauugcaggugugagccaccgcgccuggccccaguugauaguuuuuuuaauuuaaaaguuccucaauuccaagcucuuuaaacgagugaaauagguuaacuuuauuuggaugaguuagguguaccaucucaccaucugagaggagauuuauauauuuccugcugcuccuuaacaaaauauguaauguacuuaaaaacuuuaacgacuuccuaguugagagaaaacuugacauauaaaaggcugugaauuuuucugcuuggaggaagagcccaaccuugguugcuuugaaguuacaagcccccuugugccaggugaggggcuugugagucauuuuugucuccauuugaggaagagugguauucguugugacuaggagcaagggaaaguggaguuauuuuuguuugugcaaauuauuuucuauauuuaacucaagcauuaauguauaaccagaaauuuaaagaugcauguuguugcaagagcaacauaauggugauuuugaggucuuuuucugaacacaaguggcacauuuuaaauuucaagucuucaaagugccuaaggauuauuuaguucucccucaacugauuuuuugagccauauauuuccuauuuuaaauguuugcggaaucgccagucuuccuuugaaagaaacagcccccagaauucuaaaugacacgauuauagaagacaguagaauguguuaccauaaagacugaagauauuuuaguuguaaaaccaugugaacaagggcuuuugcccuauuguaucuaaguauuucagugcacaacuuguuaaaccauguugcugcuguuucuaagcccuccaccaacugaacuuucauguuuagcauuguagaggcagaaauaacauacuagguuuuuuuuuucuuucauugauuuuucuccuggugauaauuucccagccuugugucuuuuagcuguuguguauacaaauuuagaauuaaaauguuuucuauuuuuuucaugauuaacuuagugaauaacuuaaauccuuaauccucguagugguuagaaagaugaggagacuuuuuugacuuacauuuguaaaugaaaacaagucugugaauauucagaugacuacuucgaaguaauucaguuuuuuuauuaguauuuuuccagcuuauguuuucccaugagcuauuuuacuuugcugaauuuuguggguaauuugguggauauauccugccuuauuuaggauuauagcuggauaagaaaauugccuuuucauuguaagugcccaguuuuggucucuaguuugaagguacuacauacugccgauaaaggaaaacacuccccuacaccccaguuuuuguguuaccaagaaaaaaaaaacaguauugguuucauaguaggacucaaccagaauugguccuacauauaugugaguguucaguuuuugcaaauaagguuuuugagugugauaaaacacuacagaagugcuaaguguauugagaauuugcugcugauuguauuuauaacaauuacuugacguuugcagaaauuuagcacuuucccuccaaauuuauagguguaagagaagcgggggcaaggugcaccacauuuuaaaacugcaaaugugugaaaauuuauuuagagauucagauuccuaaaaggaaauuucaccacccaagucaugcacuucuuagccuuuuacaagccaacagacugacaugaagauuguucacaguuccuaagauuuagcacauauacaaaaauaaaacuuuauaaauucaauuucgguuuucccuuuauuuauuaauacaagauuu

SEQ ID NO: 18923 - RNA, 4233 nt, Homo sapiens
aaaucuuguauuaauaaauaaagggaaaaccgaaauugaauuuauaaaguuuuauuuuuguauaugugcuaaaucuuaggaacugugaacaaucuucaugucagucuguuggcuuguaaaaggcuaagaagugcaugacuuggguggugaaauuuccuuuuaggaaucugaaucucuaaauaaauuuucacacauuugcaguuuuaaaauguggugcaccuugcccccgcuucucuuacaccuauaaauuuggagggaaagugcuaaauuucugcaaacgucaaguaauuguuauaaauacaaucagcagcaaauucucaauacacuuagcacuucuguaguguuuuaucacacucaaaaaccuuauuugcaaaaacugaacacucacauauauguaggaccaauucugguugaguccuacuaugaaaccaauacuguuuuuuuuuucuugguaacacaaaaacugggguguaggggaguguuuuccuuuaucggcaguauguaguaccuucaaacuagagaccaaaacugggcacuuacaaugaaaaggcaauuuucuuauccagcuauaauccuaaauaaggcaggauauauccaccaaauuacccacaaaauucagcaaaguaaaauagcucaugggaaaacauaagcuggaaaaauacuaauaaaaaaacugaauuacuucgaaguagucaucugaauauucacagacuuguuuucauuuacaaauguaagucaaaaaagucuccucaucuuucuaaccacuacgaggauuaaggauuuaaguuauucacuaaguuaaucaugaaaaaaauagaaaacauuuuaauucuaaauuuguauacacaacagcuaaaagacacaaggcugggaaauuaucaccaggagaaaaaucaaugaaagaaaaaaaaaaccuaguauguuauuucugccucuacaaugcuaaacaugaaaguucaguugguggagggcuuagaaacagcagcaacaugguuuaacaaguugugcacugaaauacuuagauacaauagggcaaaagcccuuguucacaugguuuuacaacuaaaauaucuucagucuuuaugguaacacauucuacugucuucuauaaucgugucauuuagaauucugggggcuguuucuuucaaaggaagacuggcgauuccgcaaacauuuaaaauaggaaauauauggcucaaaaaaucaguugagggagaacuaaauaauccuuaggcacuuugaagacuugaaauuuaaaaugugccacuuguguucagaaaaagaccucaaaaucaccauuauguugcucuugcaacaacaugcaucuuuaaauuucugguuauacauuaaugcuugaguuaaauauagaaaauaauuugcacaaacaaaaauaacuccacuuucccuugcuccuagucacaacgaauaccacucuuccucaaauggagacaaaaaugacucacaagccccucaccuggcacaagggggcuuguaacuucaaagcaaccaagguugggcucuuccuccaagcagaaaaauucacagccuuuuauaugucaaguuuucucucaacuaggaagucguuaaaguuuuuaaguacauuacauauuuuguuaaggagcagcaggaaauauauaaaucuccucucagauggugagaugguacaccuaacucauccaaauaaaguuaaccuauuucacucguuuaaagagcuuggaauugaggaacuuuuaaauuaaaaaaacuaucaacuggggccaggcgcgguggcucacaccugcaaucccagcacuuugggaggccgaggcggccagaucaccugaggucaggaguucaagaccagccuggccaacguggugaaacccugucucuacaaaaauacaaaaauuagcugggcgugguggugggcaccucuaaucccagcuacucgggaggcugaggcggaagaaucgcuugaacccaggaggcgacguugcagugagccaagauugugccacugcacuccagccugggugacagagcaagacuccaucucaaagaagaaaacaacaaaaaaauaaaaacaaaacaaaaaucaguuggaauugcaaacaccgugugugacuuucacucaaaguaucggugucaaaauguccuacaggaacaccuagaagcacagguugacuauacaguacuacaaauaagauacccaaagcuuuaucuuaaauaccugccccuuuuaaucacaaaauaaugcaaugcucaauuuuguuucugcuuuguucaguuccaaguguagccuuuugacaaaacauuucccuauuaacugaauuguaaaaaauacaaccaagcuugugcucauuaaauauacauguauauaaaaaacauacaaaaaguacaagauuauguuaggaaacuuuuacagugucaacauccugauuucucaaaaucuucaguagagggccaaaggucaaaucuuucugugcacaaaaacuugaugugacugaaauccugaaucagugucaugccuaggcaugcuaugcacagaaugaauuuuaauaugcaguccucuuuuaaaaaaaaaaaaaaaggacaaaaaaaguaaccaaaaaaaaaaccaaaaacacaccacaggacaaaaaguucuucuuaaaucaaauucuauuugugaauucagcaaaauaauuucuauaaaauaaaacagcaaaauauuuaaauagaauagggugggcuguaucuguuugcagggguauuugguuuuuagacagguuccaaaaaauuacacacauucaaguuaccaauucucuuuuaaauacaguaugaacugaggauuuccuuauuuuuaaucaaauguuuauucugaaauuguaauaucucaauuauaucaaccaguaguuucuuuuuuaaugagacccugcuuugaacguuaaacguuuuggaauaauggaaaaggagcuaggacaauucuugcuuucaaguaaaauugugacugagcagaaaaucagccagcuaucuuggugcagagagguacuccaaguaccgugggguucugaugacuuccacgucacugggauccaacagaaggaaaguuuuagaagauucaccuaauaaacucuaccaaagaaacaaaacaagcacaccaaauacagucuuauauuaugcuccagcaucuuggcauagcaaauuuuugcauauuuguuuuaaaucuuuaaaaauucccauuacugauacguaaguguucuuuauuccacccagagauugaacugucaaacauuauauauaaggaacauaugugcaacugaaaauagacugucacauuucuccccuuguuuuauauuuuaauauucuagguguaagaaguaaaagcucugaguaauacagcugucacuucucggacaacugcugucauuaugguaacuuuuuccucauuggcuacacuaacuuggugugaagccaugcuaaauguuacagcauaacuauagcuucaaagugauuaaccuaauaucagaauaaaaaggcaaugaaaaaaaucuagaaacaguguuacaucaccaauuuuccacaucaaccaaauaauuuaaagguuaccagccuuacauugcucauagcaaaauugacuccaguggcaaagaauuaacaugaaacuauugguguggcugacauggaugggcucuguuuuguugcuguugguuuuuuuuuuuucuuuuuuguaaaggagcugauccaacugccaugaggcaggcaacacugguugcagagugcaguggguguaacaagaaaauuaacuuuuguaguuuguguagaucugugagucucaucaagaaaaaaguuucuugcuuaagaauuaacagucaacauuaauauacuauauacaccuuugccauuuacacauuagcaucaggccauuuauuacaaaacacuauacacuuuccacugcaggcggguuauauauugacagcaaauuucugcagauaagacagugaauaaacucuccacuccauguugauuaggaauaguuuuucuaguuuuaaauauuagccagacacagaaaaagguuggacuguaaggccugggugcacagucuugauggaaccaguuaauuaugugcauuucauugauccuugguuugagguggggauacuucuucacugccuucauaauuuucuugugcucguuggccaguucucugaggguuguucaugugaugugcugcugggccuguauauggcuguccaugcacaugguuauucuggg

SEQ ID NO: 18924 - RNA, 623 nt, Homo sapiens
uuuuuuuuuuuuguaucaaagaaaauauuuuauucaaguucccaaaacaaacuucaggaguuaugcuggguuugaauugaagaaaaaaggccaaguuaaaauaggaaaacaaaugguuuucauuugguggcagcugaaaucaaaguauacauguauauacauucuaauccaucaucuaucccauguggcauuuuccaagguuuuaagagucuaccacgccaaacccuuugccacuuucacugcuuuugcuuugcuuuuccccuuucuuuucucucgcuuugccgucagccuuuuucuuugccuuugguucauccauauuggguacuguccaugcuggucuagaagagucuuuuuguuucucuuaguaucagucucccuuuucaugucaucuuuuucaucuuuuaccucacauugcauuuucucuuggcaauguuuggguaccaccacaguugcuaucucuugaacaucuuucauuaaaacaucaccgucuaguuugagaauacuuuuaagccugcuggccuccuuuggggcauucuuuuuucucuuuucagcacgcaucuuucuuuuccacuuacuccguaagcuuuuagccauguuucaccugagaaacgaacacccacacc

SEQ ID NO: 18925 - RNA, 16762 nt, Homo sapiens
cauuuuacaauuuuucaggcaagagcacuuuauuuacaccucugaaaauaaaccacaauugacaacaacaaaggagacugugcaguucaacuuuuuauuuuaauaaaaucagaauaugcacagcacaugcagugcuagcaucuaaacuaauacaauaagcaauuacuaaagcuacagugacuugagguucaaucuuuacauucagcaaguuuaaauccuuacaugauuuuugaaaccuuauuaacugaaaauauugcuugcugauaaaacuugcucaaaugcuauugcugaauguacaagucacugauuaugccaauacaacaaagauaaccacauguuugaggauugcaaugugccagacauucacugaaaaaaaaaaaaaaacacacaacuaaacaaaauccacacaacaaacaucugagaaucuggacacuucacaucaguguuuugaaguguuucauuaauaucuuaagacaaguguaucaaaaccuuggcaugauuuaauuucaagucgccaauuuuguuuuuacuaacaucagaaaguuauggcuacacugccaacgccgggucugcuuaauuugacuuaagaguuuaauaugacuuaaacauuaaaagcucacacuaccccgaaauauauaauuucacgcauacggugacauucaacauucaagugccaguguuuuuguacugucuuuuggucaaguuucuuuaaacuuucaaagaaucacuuuuaggcuuacaaaaauaaauauuugucaaaauguucaauaaauauuacauaaaacuagcagcaaaaaguaucuagaaaucugucgugugcaaauaguuuucuucccaacuaucauucccauggucccaaauaaauuuuagaaucuagucccauccccuuccuagacaagcugcguucaacaaucuccaagagacaaaguaagauuggaaguuuaaggacacgcacacaagacauauauauaaaauucucugaaugugcaauaaaagaaguacuuuguaaaaaguuaugggcaaaauguacaagggccuaaaccuagacuaauugaaauagcaccauaacaaaugaccucaauacugucaagugcaccuacuuaauaaaaguuuuagaacaaggcacaauacacuugaaaaucuauugcacuuuaggaaauuuuugccgucuuccuaugccacuguaaaaagauggagcguuuugaucaccgcauucuggccacaaaauuagcacagaauucaaaguggcagaggcauuuuagugguggacaaugcucaucuuuggccagauuuagcauaaacagacuauaaauacaauggaaaccuaugcaacuaaaacugacuaaaacugcacuguagagcagaauugacaccuugugcaguuauguacauauuuccaaccugugugaucucaaagauuucaguuuguuacucuucuggagccauuuuuacgaagucuauaguaagccaguuuaacaucucaacgcagcuugaacagaguaaugugaaucggcauuuaaaauaaagccugcugcauuuaauucuuccuguucauacccucuugaccaaaaaacaucaacacuagcaugcguuauuagaccaaaaaucauccagggcccuaaugagggcuggucauugcuguggucagccauucuaccauuucaauuucauuuauggcaggcauuuaaaaagucuaaguagaugaauucuccuaaaaaccuauuucaaguuaucagaccuuuaaacuuucccuguaauaguaugcccacauuuggcuagcucauaauuaaugaucugccuaaacguugaaagaggaauugcuguauuuacuugcauuaacuuugaaaacagugcuuugaauguaugcauguauucauacaucaccucaucaugacuggaauggcuuaaagacuaucagguucuaaauaccuauccaggauagagugagcaaaucagaacuuuaacuuaauacaguuugccacauuagaaacuaauuccauuaauaugcuucaagacauuuguuguuuucccccaaucugcaaguaucaaaaagcccuaaugcaggcuaccgcauaaguuuuuccuuauauuauuuauggaugaaucgaugauuccuguuaaguuguaucacaccugugugccaagguuugauuuuagcccaaguucaguaaauuuauuuugucaaaacaauugauaucuugagcauuacugagccaacaggacaucaaaauaaaaaguugucuaaaguuaaaggcacaguacauuaacaaacaaaugauccucagucacaaaauuauaaaugcaguuugggauggggguaggcgggaggggaguuaauccaaacuacagcaaugaagucuucaaaccaccuucugaacagggcugcugauuguuccuuucauuucuucuugugaccuugagcucccuuaaaaaaaaaauuucaguggagaaucacagcugguaauguacugcgaguucuugaagcuacacaagguauagucuggcuaaguuacaugugguuuccauauuagcuuguuuggcagggugaccuacugcaaagcaggcucaguuaccccaccagucaacccccugggaguuauaauuuccuccauauccaucacuguuguaaaagccuccauagccaccuaaugagagauuuaaaaagagagagaaauuaaugaaguuauccaucauuaaauacaauccuucccuuacguaauuugccaucaaguuucuauagugcugaacuuaaauuguuuaauuaggcuuugaaaaagaugacuaaaaggaaaaaaacccuucccaaagcuaugaaguuacagauuaacacuaccuccaccaaauccucugcugcuaccguggccaccuccgccacugcggcugcugcuugcgcggcugcugcugaagcuggaacugcuggcaccgcuacuuugucgguagucucuggcaccaaacccuccacuaaaucugcuacuauaagaaaaaaauuauguugguucacaugaagaugaaauuccacuaaaguaaccuaacucuuuccuaaugaccaauuucuaauuuuuccauucaaacaauuccccauccagccauauuuuccccaacagagugucacccauucuaauacaaccccuuaccaaagaaucuaggaagccuaagaugauuaagcuuuuuaaauacuguacaguuaaccuuggacguuaugcaugcagaggaaacacuaugaacuguaagugaacacccauuccccucauuauauacuauuuauaccucaccucuuagaacguccacgacugcuacccuuguagugguguucauaagccauguuuucuaaccaagacggcacuucuuguuuagcuucaacaagaagauccaacaaauccuuaguaauauuuauguuccucucguuaaagaaugagguugccaggccuaaaagaguucccaaaaaaguauauaaacaaaggucuuccauaaaguaacuugcuacuauucuuacuuuccuacguagaaauauuuaaaauauuaccacguaauauuuaaacaagugcuuugagcaaaaucuuugucacuuucauuguuaaaaauguauuuuagauccuagcaaguucuuuccugcacacaucacagcaaaaaacaaugaaaccaucaaguaaucaaauacuuaccaagguuuccuacacgucccguacgaccaauacgauguacauauucuucaauaucacuuggcaagucaaaauugauaacauguuucacauuugaaauguccaguccucuugcugcuaccuggaaaauaacuuuuaugagauauggcccacuuaaaagaaaacaaauacuugaacaugcucaauuugaauaaaagaaagauguuuauacauacugcuguagccacuaaaauugggcuuuuuccugagcggaacuggugaagggccucuucucuaucccucugagaacggucuccauggaugcugguacaugcguauccuucaugguauaagaaauccuccagagaaucugcacccuuuuuggucuccacaaacacuaaggucagugaauccuugccugucguugaaaaauuauagguuuuugucacuaacauggcuuaguucucuuugcacuuauguaugcacaauuuuaaugugucaauuaaaauacauauauaucuucuuaaaaacgggcuuucaacacagcauguuuugaauugaggaggaaaaguaauaaagguaauccaaauacauuuaagagaugggggucucacuaaauugcccaggcugagagugcacuggccauucgcaggugcaaucauggcauacuacagccucagccugccaaguagcugggacuacaugcacuguaccacugcacccagcccaaauggguuauuaccagagcaauuaaauuauucauaauuuuagcugggugcaguggugagugccuguagucccagcuacucuggagacugaggcaggaggauugucuaagucuaggaguucugggcuguaguguacuaugccuaucagguguccacacuaaguuuggcaucaacaugguaaccucccggaagcaagggagcaccagguugccuaaggaggggugaacaggcccaggucagaaacagagcaggucaaauacucccaugcugaucaguaaugagaucacaccugugaauaaccccugcacuccagccugggcaacaaagagaaacccccaugucuaauaaaauaaaaaauucauaauguuaccuguugcauuuaggaggucaagcagaaaugaccguuugucugauucuuccacccaaacuacuuucugugugauguuuucagagguagagccaacucuuccuacagccaagaagauauauucaucuaagaaaucacgagccagcaucugaaagaaaaaaaauuuuuauuauuaccugagauaaacaaauuucuaaauaaauaaaauuugcaacaucaaacaguaccuguauuuccuuaggaaaaguagcacuaaacaucauaguguggcggacacccuuuggaggcauaguaucuuguucgacuauucuacgaaucugaggcucaaaccccauauccaacauccgaucagcuucaucuaacaccaaguaucugucaugucaugaaaaaaaacaagccugaguuuagaauuugaggagaaaucaacaugguuuuaguauggcuguuaguauaauuacaaauacaauuguauagguuauuacaauuauauauucauuaagauggugccucacacugcauaauuuuacagacacagcacaggauucuugccacuacauaagucauucaagauuacacagucaaauuagcccauccuaguugacugucccacgagcugaucauuguuguaagucucaaccaagauguuacugauuuuucaacauuaaaauuaccaugaacaagcuuuuugugaaaguuagaugucugaaauacaucacuucucagccuuaacauuuagacaauguuaacaucaccacaaaacuaaugggcaguaacuuuaauacugcaucccauacauuuaaaaauuaacauacuuggccgggugcgauggcucacaccuguaaucccagcacuuugggaggccaaggcaggcggaucaccugaggucaggaguucgagaccagccugaccaacauggagaaaccccgccucuacuaaaaauacaaaaauuagcccagcgugguggcacaugccuguaaucccagcuaccugggaggcugaggcaggagaaucgcuugaacccgggaggcagagguuguggugagccgagaucgcgccauggcacuccagccugggcaacaagagcgcaacucugccaaaaacaaaagaacaaaacaaaacaaaacaaaaaaacaaaaacaaaauaaaacauacuugcaaaagucuaauccaaucuuuccucuuuccaucauauccacuagacguccuggaguggcuacuaacaaauggcauccacguuccaagucucgaaucugcugaccaauaucggcaccaccauaaaccacgcaaggacgaacucuagaucgguaugaaaacuauaagcaaaaaaaauguuaugaacuucaaggucaaaauuuuuacauguucauaaaacauuuaauuagaaucaaugaaaaagcuaauaaucacuggaacucauacuuacuuuucuggcuuccucguagaucuguacugccaacucucucguuggugcuaauaccaaggagauuggguauuguuugcggcgcccauaccuuccauuuuccuaagaaauaaguuaauuuuuaaguuaacucuaccuacccuguuugaaaaguucaucacaacauaauucccuuuuguaauuuauagauuacagauuacacuugaaaacugguuuucauucuacuuaagucuuagcaucauuuagaaagcccucucaauggccaccuacaaaguucuacaauuucccauuuuauaaagaaacaucuaccuucauggcccucaaagccucgccuggaccaucugaauaaaucugacucaagaugggcaacagaaaugcugcaguuuuuccagacccuguucaaaaacaaacaaacaaauccugcucauuacuuuuaaacagacauugguagaugacaguguuuuuuaacuacccuauuacuaauaauuaguacuuuuaguuuaugcuuaaguuuuccaaaaaguggcuucucugcuccaccucuaagaggagucagcaaacugagacuauuuuguaaauaaagccuguuauuuuuauaaauaaagcucuuacggaauacagccguaaccaauaauuuauguaucaucuauggcuucuuucacaguccaauagcagcgcagagcagcugcaaaacugcaugacccauaaaaaauaaaauauuuuauugucuaguccuuuacagaagaaauaugauguuuuacucuuaugaguugagcuuaccuguuugggcacaagccaucaagucucuuuucucuuugauaauaggaauagcaugcuuuugcacuggaguugggcgaguauaacgaguaagcucaauguuucccaugauaauuucucccaucucaacaucacugaacuguuaagaaauucaaugggguuaggaaugcuaucuagagcuauuucuguuuuauacuaauaauggaaacaaccaaccaacagcugauugguaacucaguuuauaguuuaaguaaaauuaucacauuauacuuugagaaaaaccaacccccaggcuuacugcacauuggagaagacuuuggguuguuccuauguuugacccauuuucuauuuuagguaauaaauuauucauaauggugacacugaacucaacuucuccuuuuccacaaaucuaugaagccucuggucuacaugacuuuaugaagcccaucucacauucuaauguaacaugaaaacauuuaaccucucugugucuuaaaaagucaagcaaaaauacucacacuuucaauauguggaggacaguuguugccuguugccucaacuggaaugucaucguauuucucaaaauuaaucccaguguugccuccagaaaagaguucccucaaaucaaaaaauggauaaguucauuuguuauacuagcuaguaaggcuucaucacaaguaacauacacuucaaaaacuuacuguuccaagcguucacuuggugggagugguuuugaccaaucaucuucaucugauuugucacaccagcgacuguuuccaccacguucaaauuugccaaagccacuucugucaccacggcugccaaugccaucguaaucacuccguccacgaucaucaaaccugaacagcacaagcaauuaaucagaaucauaucauuuaaccauuaucagauucuuaucccuacucuagaacuguaucuggagacuuaaguuauggcuaaccauaaggaugucaacaauccaauucugaguuacuugacaaauaaggcucucuaaccagcaucauuuacauaaccucguuuucuaaaaucaguaaucuuuacauuucuauaaaguuguauagccuaaaaggccucacagaugccaaaauuaagaauaaggauuuuauuugaaaucggcacacagcucacaaccuucauuuaaagugcucauccaaauauauuuaaugguagggaaaacaagaaaauagcacaccaaauaucaaucguccuaguuauacuaggaugucacuuaaaggacaauucaccugugugacagacuuuggauaaaagguagaaaauaauccuuaccugaacuaagauguuuuuaagaguuuuaggccuguuugcgaaaaaucaggacacaggacuaaccacagcuauuaggcacguggggucaguucaccacacuuguguaaucaaaaauacaagguguuuagaaauuguuauagaguccacaaaaaucccaaccaaauuaggccauucacuagaugaacuuacucuuuuaaguagaacauauaaaacucgagaaauagaauaacucauuucauuaugccaaugagcauauuccuauuuucaucuaauuucuaaguaacagguucaauuuaguaaaagccucuuacggcuaagaaaauacaaugaccaaacagacauaaugcuuaacauccaaacagguggucaggauaacgacuuauuaaacuguuauuauacauacacguaaggugauuaagaaaucacuuaccuuccccuugauccacuuccacgaucacugaagaagcuagacuucccucuugaaucacuacgagauccaaaacugcuauacgcauccuuaucuuugcuagaacuccacccugaacugucuuuaucguagaaaccuuugauuaaaaaagcacaaauacauuuuauuauuaauuagaaauaggaaccauguuaagguauuaucaaucuuucugaauuugaaagccuccacugacuaucccuaccauggcacuguaagagaaccaagauuuaaagcugguuuacacccggacaaaguuuuucuuuaauucuccccacuagaaaauacuguccacuggccaggcaugguggcucacgccuguaaucccagcacuuugggaggccaaggcgggcaggucaccugaggucaggaguucgagacuagccugaccaacauggagaaaccccgucucuacuacauauacaauauuagccaggcgugguggcccacgucuguaaucccagcuacucaggaggcugaggcaggagaaucacuugaacccgggaggcugagguugcagugagccaagauugcgccacugcacuccagcacgggaaacaagagugaaacacccuugucucaaaaaaaaaaaaauuacuuuacacuaaaucaagcaaucugacagucuaagaauguuucucaaugaauacuaccucuaaguggucaacagcuuugccuguaacgcauuaugacguugugugaccauaacaauuuaauuuccauucauuuuauaggugugaaugaguuuacuaggaaaaacaguuaccauuguuuccauguuucuuggaggugguauucauuuagaacauucauagacugucagauuacuugguuuaauacaguauuuuucaguuucaauaguauaaaguacaagaacacuaaugucaaauuguaguauuauuuuagugguucaucuacuauaagcuugaugacaaucaggaauaccugggaaaaagaaaaacccucaucacuauauauucucaguauagacaagguuccuggguacagcuauaaauauccagguaaggggaugacaaacauguaaauuaacccaaagacagguagaggguuuaaagacagguagaggguuuaacuagcuucagcaacaccuuauuaaacagaaacagcuucucaauucaguuacuuuccuucugccuucuaccuccuaccguuaggccagucaggugaccaacagccuuugcuagcaagaaagaguuaaguuagauugccagaucucuaccagcucuaaaaccucuaugauacugccauauacacgagggucaauucuagcuaguauacuaggaauauugagaacauccaugaugauaaagacaaauuccaaaguaaccuccccuaaaaagaauauaaugccagccaggcaugguggcucacgccuguaaucccagcacuuugggaggcugaggcggguggaucacuugaggucaggaguucgagaccagccuaggcaacaaggcaaaaccccgucucuacuaaauauacaaaaauuagccgggcaugguggcacaugccugugaucccagcuacuugggaggcugaggcaggagaaucacuugaacccaggaggcggagguugcagugagcccgcgcuacugcacuccagccuccgcagcagagcaaggcuccgucucaaaaaaaaaaaaaaaaaaaaaaagccaaagugaucuucugguagaaauaauacagauuuuauauccaugcauugccaggacagugaagguaauacagacuacauauggagauggaggaacagcagcaaaccaugugcuccccuguggacucuccacucuuccuaucugccuucuuuauacaguaucuucccuccuaaucuuugguuuuccugacuuucccuuuuccuccaaauuuuggauggucuauuuuacagaauauaaagcacccgaacagcugucucauaauaugaaacauauacuagcugucaucuaucacuacguuacaauuacaaugggaaaagacaccagauauuguaauacauuuuggacaaaaccuuucaaaagcagcaaggcaaggagaugaaaccagagaaucacuuccaacgcuguaacuuguuaacuguucuacaauaagcccaucuucauuucuagcaacuuugccaagacagaaauaaccagguuguuaucauuauacagcuugguuuacacaguagggcacccaccucuuccaaacuaaaaccaugcugugaaugauuacaaacagauucagcacaacacuagugaaacuguacaaaaccaugcccuuggcgucagaacaguuugacauaggaaugccgaauuucccacugcguaacauuagaugaguucuuccaaaauuauuaagcucuaguauuugaaccaaggcugacagaagcauagaaaaacaacaccauguuuagaccucccccaaaugccugguuuuccuuaggcuuuacuaacuucuaaaggaggcaaaaaauagaccuacgaaguuacuugugaggaccuaccuuuaguagcuucucgguuccuuaaaugaggaggaauauagcgcccuucuaaaaaaauauauauauauauaaaauuaauuaaaugccaaaaaaccuucccauuuaaauuucuguuacuaaaaaaugguucugggaaauuaaaaucuccagccuuccaaucugauuacuuaccuggacacugagaggggggaaaaauaagaaucuaauuuuaaauggguuacugcuucauaaggagaacucugaaaggaguuugauaaaaaaaagcugauuuggaaccuaauaguugaaauccacaaauugagcacauuuagccaccaguggucauuuaaugugauuuuuuuaaaggccugcuagauuuaagagaacugucaucaaaacugucaacaaaagcauuaaguauuacuguaacaauuuaagauuacucauguaacauaucucacaaucuuuuguuucuaugccaguaaguugcaaaacauacaauaaauaaacaaggaaaagcugcaaaggggaguuaauuucaaggaauugcagguuuuaauuuggggcuugcugaguuuaaggaaaguugacaguugcucuguaugcgagcaggaguacagccuagaauauggauaagcaaaaaaaacaacauaaagccaaauaaauuugcuuuauaacuaguaaacgugucauuuuucuuuuucacuucuagacugaauuaaauauuuuuaaaaaucucuacuaggacaaucaguuccuaaaagauucuuagcaugacaaauaaggugaaaguuaaagcaaacaccaaguuuuguucccagugaagcuguucuugccuaaaaaugaggacacaucauagcccauacucacuuuuguuuuaauaaguaggaagagaucugagcuaaaaauaagggucuauugcccuuauaauaaaccaccaagauccccuaucuuaacacuaaccucuaacaagucucuaaauaaccccccuuagaagaaaaaaagcaacuuuucuaaugccuuuuuaaaagaaaugacacauuugaaaaccuaaccuaaccaccaauccaaaauucaguauagucuucuguucuucaggagaaaggaguagcuauaaccaaugaaaugcauauucccuuaauucaauuuaauaaauauagucaguuaacagggacacauucccaucaccucuaaacugggcucaggauuuauaauggacaaaaacucuucuagagauaauuugauauaauaagguucuuuccaaugauuagcugcuuuuacucaagagagccagcuagucauugauguuuuauuaucagaaaggcacagcuauucgggaggcugaggcaggagaaucgcuugaacccggaggcagagacugcggugagccgagaucacaccauugcacuccaaccugggcaacaagagcaaagcuccaucucaaccaaaaaaaaaaaaaaaaggcaacgaugcuuuagauugaucacuaaguacuacauaauucuauaacacaaagacuacauaauucuuuaagcaguaaaaaauugaaaggcaaauuucuuaaauuuuacauaagcccaaugaaaucuuaagauguuaagcucuaauauucaauaaacccacaagauguuguacuuacugcuggcuguacuuccuccacucugauuaucugaagaguucaggucuaggccagcaaacuagaagagagugagaugguuagcaccccaugugcucaaauacuacauuaagagaaaacuaguccugcccucuagcauuugcuaguacugcauucaaguaguugcccaguccaccucacagggcuaauaccaacccuuaaugagaaugugacuaagaauguuuucaagucugcaaugcucuaagcaaaugcaauauuacuauuguauauacuacagaaggcggcacaccaagaugcuugugcuguucaguagaaacuguccaaauuuaauucaugcauucaaaauaaauuuucacuaacauguuccauagcacaggcucccuaaucaccaaacuaaagcuuacacugaaucucaaaauuauuccucaaugucaaauagauaaaggauucguuuuagugccgguuaugaaaguuuccaaugccaacuuuccguaauacuugauauuuuaaaccuaaaaugcacaccugaaaaaugucaggacaaauuucgaaguggccguucuuuuaguuagauacuucaucccuaaauauugcccaaguauuuuuagucggguaguacucuuaagaacaacaaaaaaauagcaauauaccuaccacuuacagaacacuauguuaagcacaacucuuaaguaguuugacuguuucguuuguuuuuauuuuuauuuuuuuugagacagagucucccucugucauccaggcuggaauucagucaugugaucucggcucacugcaaccuccaccuccccgaguagcugggauuacaggggugcgccaccacgcuaggcuacuuuuuguacuuuuaguagagaugggguuucgccauguugcccaggcuggucuccugaccucaggucaggugaaccaccugccuuggccucccaaagcacugggauuacaagcaugagcccggccugaaguaguuaccuguuuuuaccccauuuuaacauaaguucaaagaugacuuugaauaaauggcacaacuggcguucaaugcucuuaaagaguaggacaucuuagugccuuucaucucuauuucuaccuauccccuuacacugguagcucaaaagccucuucauucuagaaaaggguuaugugcuaccuucauaacguuuuauaaccaggaacuacucacaaguaguugggagaaaaaacuauacaugcaaaguguuucauuuuucucaaaaaagccacaaaagaccaagucacacaguaccgcugccaaccuguuugcaaaagaugcacuacauaccauguuuauaaaucuuguguuuaaagcucaguaugauacggccaaaccgcaugcaucaucaauggagucacugaaaacuggaagcagaugcuauacuuuuaaaaaaugaguguaagacuucaggcaccuaauuuccagaauuucuaugagcaaaaacaccacugcgcuuucucuugcuaccaucaauacuuuaaagcacgguaggaacacaaacuuuccuuuugcacuuguuauagcacaauuuugcuuuuuaaauaagguucacuguugccuagaauccuuaaaaggacacuauagcuaaauggaaaaugguaaaacugggaauacucugugcugcugguagguuguuaaagugucuguucaauucaacaugugucagcaauuagaggauuuaauauaauugguucauuaacggguagaaaaugcuuccaaaggaacagaucaauuccuaaaaaauauuacauaugacuacauuaaacuauguauucaauuaauuugugccacuaaacuucgucucaggauuauuccggaguuugugaaaucaacgcuccccuaaucacaguagacaguaguuuauuuaaaagcuccgcauaacccacacaagagcuuaucugaagccuggugccacuguugcggugggaugcagacuuccugccaccaaaguccauaaccuucuccucucaaaucacacaucuuucucuccucugccccuaaacccuuagaagaggggauucuggcuaagagaaaaaacccgggggccugggacccauugcaagauucuacuccacagauagcaacaagucaacaacaaaacuguuuacuuccccccuaagccggguguuuuuccaauggcggauuccuggaucacagucacuaacacgaagacacuaccacaacccgcgaugaccccuccaccccagaaaaacaacgcgggacucccggcuaacauaccacacagggacaaucuggggcaagcaaggaggagaaagggccucgcuggcucccuaaccuccccgccacguccaaccucuaucuccagggcccagcgcgcagcggccaauuccugccuccccuccccgcccccaccccucccccacuccuccccaaucuucugcgucacaaaacuuuccacuccggaaacgcagccuccccggcugcggcgcagggcccccggacccugcggaaccugggcugaagcgaaaaagccagcggaaggaacccgggaaaaaacaagaaacccauuccauccuccuuuccaggccuucgcccgcccgagacccgccgucucccggaggugagccacagcgccgcccagcaccacacaaaagaggccgccgccauuaccccgagcgaaggccgcccccucccacauuccugggccgcguucuaccccuugcucgcaggcacgcaaacaccgggugccgccagguccuccggacgggaauccaggcugcgccagccgugaaggccgaagcccuccaagccaaaagggccuccagucgcgucccgccgcgcugcgcacucccgcaaacccccccaggucacuaaucagucgggauucgcgcaugcgcguccccgcgagagcgcgcgcacuuccucccccuccgcccgccugcgcacgcacacacaaaagccgccauugugcucgucccggggacaauacagcgggccgagaccgggcccgggcgacagccccaaccaacauuccuaucccucuauagccccggggcacucacacccgccagcccggggcacccagaaaaugaaaaguaagggugccgguuagcgcugcgccauuagccagguuaggucaggggaggaauucacgcagcagccagcccggugggguucuugcggcucaccugcugguccagcccgagcgcauuuuccacugccacaugacucaucccugaagaguaccgagaacucggagucuuccgcugcuaagcgaguguuuguuccaccgcgaaggcccucucacgggagaacugcggcucuggagcgcaccgcgcggccacggaucuaauauacccgcuggaaagccggcuacgucagcacguacaacgugugcccucccucucacaccgcaauucccugucgcggcgacuucugcccggcuacugcgcgcucccucaggucuaagcucaagggauuuccuacuuaguccugucgccccuagcaguccugccuuggagcuuagggugcgaaaugcugucccaguucucucgagcuacacuucccgugcucuccgcuaaaacccuagucucagccucggaguucucgagaucucgcgagaacuugcgucucccgcuuuccaccggcuaagacgccugaaaauguuaaccuaggccucuucgccccccuuuccaaccuuacgcauucgcuccccuuuccaacucuaugcacucagcuuucguuuuucguuuuuuuuguuuuuguuuuuuuuuuccuaacacuggccuucacucuucuuccucucucaguucccgggcuuggagauguggugggauuucuccggucuaaucugcccucgcucuuccgcggguagccuccccuuagugggagcuaggcagauucccgaaacugagagggcggcaggccacgugaccguaggugucgcgugcgguggccauuuug

SEQ ID NO: 18926 - RNA, 9486 nt, Homo sapiens
cagguccuggaguuguuaauucaccgagauggggaauuucaagaacuaaugaaauuggcacuuaaucagggaaaaauucaucaugaaaugcaaguuuuagaaaaagaaguagagaagagagacagugauauucagcagcuacaaaaacagcuaaaggaagcagaacaaauacugguaaguugacagagguugguucuuaagguuaaaaaggauguuguuuaaucuguuucugaaaaaucuguuaucaauauuuugaagagcagaaaacuagacuuuccaagucuaaaggugauaucuugucacucaccauugccagugguuaaaugaaaggcuauugucauucucuuuuuuacuuacuguuuucaaauagucugcauuacuugugagccacauuuucgaugcuuaaagauuuuacaguauugaauuauagaaauggaaaguuuuacuuuuauccuggucugauauaaauuuuaauuaucaguagucuaaaucucucuuuuuuuuuuuuuggucucugauccuuagcauaaaaaucagggaaauuuuucauuuuuuauauauuuugaaaucaauaaaaauauauacacauuuuauaaauugauuaaaauugacauuaauuuagucauucauccucaucuagguaggauuuggacauagaucaaggauccuaguuuucccuuugcuguucuuggcuacuauuucaaagaggcaacuuauuugcuauuauuugcccaguuacuucacuaaauacuaacuaauauaacaugauaguauugcagaaauagcugagcuugauucucaugucgaccagacauugcuggcauccuuaccacugauuaaucucuuaacaaauguauuaaaaugagcuccaguaacuagaagccugggcaguucaggguaaauuaaucaccucuacuaaggaaacaacucacuaguaaauaguuuuuaaaaauauauuaaaaucaggccgggcaugguggcuaaugccuguaaucccagggcuuugggaggccaacgcagguggaucgcgaggucagucugugauugagaccagucucaguucgagaccagucuggccaacauagugaaacccugucucuauuacaaauacaaaaaauuagccaggugugguggugugugccuguaauuccagcuacucaggagacugaggcaggagaaucgcgugaaccugggaggcauagguugcagugagcugagauugcgcuauuguauuccagcccaggcaacagugcaagacucucaaaaaaaaaaaaaaaaaaaaaaauuagcugggcacaguggcucacacuuguaaucccagcacuuugggaagccaaagugggcagaucaccugaggucgggaguacaagacuagccuagucaacauggugaaauccaucucuacuaaaaauacaaaaaaauuuagcugggcauggugauucacgccuguaaucucagguacuugggaggcugaggcaggagaaucucuugaacccgggaggcagagguugcaaugaacugggaucaccccacugcacuccagccugggcgacagagggagacucugucucaaaauauauuauuuauauguuuguauauauuauauauauauuaaaaucuguaaauauguauauaaaaauccuuauguauguaauacuugcuuaucaaacaaaauucagaaaauacagaaaaauggaaagaagagggaaaaaauugucuuuaguucagcugcggaaagaaugccacuauucauaguuuggucuauuuccuuugagucucagguguauuaauuuuuuagguaauuguaguuagcaggauacuaacagacuuucaauuacuguuuauugaaacuuaagcauuuuucauauaauuguauccacuuuguuugauuuucccacuuuguguuauaaauaauuaaagacagugaacacaggaccauaaaacugaauuucaugacuuaaauaguaguaacuaacauugauugagcacuuaggcaccaggcccugugccuugcauuuuauaugcauuacuuccaucuuccuaacaguuuauaucaagucagugucgucauuuagaggaagaaaccaauacuuuaauaacuaacuugcccauggaggcuaaaaaguagauugaauuuaaaccuugaucucucugacuccauacucuuuuuuuuuuuuuuuuuuuuuuuuugagacagagucuugcucuugcucuauugcccaggccagagugcgauggcacagucuuggcucacugcaaccucugccuccuggguucaagcgauucuccugccucagccucccaaguagcugagauaggcgugugucaccaugcccauauaaauuuuuuguauuuuuaguagagauggguuuuuaccguguuggucaggcuggucucagacuccugaucucaaaugaucugccugccucggccucccaaaaugcugggauuacaggugugagccauugugccuggccugacuccauacucuuaaccacagugucauagucgaagauaugcauauacuagguuaacuucauuuuguccuuuaguguaccugagggcuuggagggaguguuuuugugauaaagucauuaaacauugagcugauauauaaacgaauaagaauaugaauucaagguuguaucuuccaaacuaggggaaaaaaggguauuuuauucuugaacuaguugcaagaauaggaugcuuuuggggucguccauagucugggugucuucugcauguuuaugguagaagacgugaagaaaaagacaauccaauuuauguuuuguuucuacaacuaauuugugaaugggagacuaguucauaaauauaauauuucuuucauuaaauaugacugaaauaaauaaugucaagugguauuucagaacauuacaaauaaauuguugggauuuccaaguuucaaagauuguucuuguaggcuaaaggaucuugugaauuaagccaaaaacuaaguuugauauaguugaagaauaaaccacguuuuuuaaauguuguuuaaauuaggcaacagcuguuuaccaagcgaaggagaaacucaagucaauagaaaaagcaagaaaagguuaguaucaugggaagacugaaugaccugaaaaguuaagguucugguuucaggaaaccaauacaagaggauauuacugauaaucauuugcugcuguugaaaagauucaguaaauuuuuauuguaaaguguguuguguucuagcauugugcuggguuuugugagggagguagaaguaucacaucuuuuuucagauuauaaaaagcaauuaauacaaggcaguuuauggcugugugcccaaaugugcaguaaaaacagugaguuuauaaaauuggugggagagggaaagagaaguauggguuagaagugggauuuguaccaaaucuugaagguuaggacagagagagugaaaagacauccauugggcaacugcgcugggacugaaacaucaugaagucagagccagacguacaugaagucagagccaguuauacccuuggcauauaagcacauuugguggugcagaggcccacaugccuuccugcccugcugucccuuuuucaaaggcuucuguuaaauagcuaauacuccuuuuuuuuuuuuuugagacggagucucgcucugucgcccaggcuggagugcaguggcgcgaucucggcgcacugcaagcuccgccucccggguucacgccacucuccugccucagccucccgaguagcugggacuacaggcgcccgccaccacacccggcuaauuuuuuguauuuuuaguagagacgggguuucacuguguuagccaggauggucuugaucuccugaccucgugaucugcccaccucggccucccaaagugcugggauuacaggcaugagccacugcgcccagccaaauagcuaauauucuuuugagaguuagguuaggcuucuguagcaagaaacaaaucucuaggagagauggcugaggcuggcuguugacuucuagaccguuguuugauucuguuuuuaaucuucaaaaacuguacacacauacacuuuguuacauugaaacaguaucuaaaguuuguaaaaugaagugugugguucucacuucucagagguaacuauuaauguuugguauauguccuagauuuuuuuuuucuagaucugugaguauguauguaauaaaaauacaaauacacauauguacauacauuuugaacagucgggucauaccguacauauuauuuagcaguuuaguuuuuuuuuuuaccuaaugaauacauuguagacaucuuucuauuuaggucuacuuaagagccuuagggcauauugaucgaacagaguggugugaacugucugcucugauuucauagcuuggaugucuuugagaaaugaaacacuguuuucucuauuuuauuugugcucacuaugcuuucagaagaggaaugguauuuaacgguaguuaauaauugagauuauugagugcuauggugcuaaucuccgaaauuuguuuaugucagcuaauuuuucuggauuaguguccuguuuuuggagauuuaaguuuauacuaaacauguagguauuguuaaggaaggcaggugacugagauuauuuuauuuucagauaauuuaaaauuaaauacgauguguaacugauagauacauuucuaaacuuguauguuuguuagacuacagguuauacuguccucuuaaaacucuuucaggugcuaucuccucugaagaaauaauuaaguaugcacauaggaucagugcaaguaaugcuguaugugcuccacugaccuggguuccagguaaacauacucgucuuauuauacuagauauaugugguuuugaagauucuuaggugacuauguacagacauagauuuaauuuaaaauguauuuauccuuagaaaccucugccacauauuuucacaucuuuaaugguuuauaaguaaugauauaggccauggguuuuauaaauuugguuuucugugaagccauuguugcuagggacuguguuucuuucgucuuuugaaauaauaaauugauaauuuuuuaaaguacgagauaauaaugugaugcuucuaaagcuuuggauuuauauaccauuuuaucagggcuggccagaagcaaacucuuuagagccauuaggauuuccacaaagguuccagccugagaaagacaauuccaguucucuuagaugcuaaagacaaagcacuacgcacccaacagugaacauacaggcuuggaaagagcugggauaauuagacagcaaaagagaggaucaagcugcaacuauauugacaguggaugaaacauaaaacaggagacguaagguagcagccuuauuggaggaaggggaaauauuaguaguuaucuccacuucaaaauaacuucugaaggugcuguguuaccaugcugaaagcacuaagggugacuauaauuuuggggauggauaagcugcaguuggugagaugugcccaaaaagucaauccaaaucuggucaaguuuuugucaaccacauacugcuauuuagugugcuuucauguuugggauggacauuaccugcuccugcuauuuugccacuuacacgaauuaguuucugaauuacaagaucaaagagguugguuagaaaaagguuuuaucuuagacaagguggcaugaggaaaauaaaaguaaaacaaaaagaugaaaaauguaaaaaaaaaaaaagauuuuaaauugagacaguccuucuauuaaacauuccaguccuuucugucuuauaagugucaugauuuuuuucucccuugcagcauaaucauugucauuuucuugcuagaaaauacaguuaaguuugaauaauugagauuauuauaauuuucuuaaguugucaucuggaaugucuacaaaaaaaugacaucucuuuuuuuuuaaaguguagaaaauaguauauucuugggaagauucagaaaagaaauuaaaaugcguguauuuuaaaaaguaauaugcuauuaauaacaauuuauaaggugacuuuuauauuucuuucuuucuuuuuuuuuuuuuuuuuuuuuugagacagggucuugcucuguggcccaggcuggagugcaguggugcaaucucagcucacugcaaccucugccucccggguucaagcgauucuccugccucagccucccgaguagcugggauuauaggugcgugccaccacgccugacuaauuuucuuauuuuuaguagagacgggguuucaccaugcuggccaggcuggucuugaacuucugacuugaggugauccacccaccucguccuccuaaagugcugggauuacaggcgugagccacugcaccuggccagaugacuucuguauuucaaaauugaaaauguagccugaacuuuucagcaugaaccagcgaaaaugaguaugucaaauaacauauuaacacuuauuuuuuaaaauaugauugaauuaaaugcagucuuuauuguuuuaggggacccccggagacccuacccaacugauuuagagaugagaaguggguuacugggucagaugaacaauccuuccacuaauggcgugaauggccauuuaccaggagaugcacuugcagcaggaagauugccagguaauguuaagccgaagaguguuuucaaacagaucaggguuuuccagagaugacaagguuggaauaucuggcgguaaagcaaguuugagauucccgacacaauuuuuuuuuuuuuguaaauuugagacagucuuguuaugucacccaggcuggagcguguuggcgaaaucuuggcucccagguucaagugauucuugugccucagccucccgaguagcugggauuacaggugugugccaccaggccuggcuaauuuuuguauuuuuaguggauaugggguuucgcucuguuggccaggcuggucucgaacuccugaccccaagcaaucaccugccucagccucccaaaguacuggaauuacaggugugagccagugugccugccucucagacccaguucauuguaauagcuagauucuuugccgguuuauucugcucuaaagauucuccuugagggagguaugaaauuagaacaagcugccuuucucuuauuuguaaauauuacacugucuuccucaggcauuuggccucucuuuuuaaauuauugcucuaaacauagcuuuuuuauaauugugaaacaugcuauguaaauagaguaagauaguuuacggaauaaagugaacacacuccugaacaacccccaaguuaacaaaaugaauaacaauagcuuuuuauaaacuuuuauaacuuuauaaaauaguauuucugugagacccaguucauucugagcuucaguuuuccucaaguuuuucauagguuugugcuauuuuuauauauauuuguuuuauauuauuccucaucuuuuauaguuuguaggugacuuuuguuuugaugugguagaacauuugggaaguagaaaaaggcauuuaaaaaaggaaaaaaauauacccuuucugaggcagucacuuuaaauauuuuagccuguuuccuuuuuuccccuauacauuuuuugcuuaauguuacaucauaaggcugucccugugucauuaauaaugcuuuguaugcaucauuuuuguuagcuaccuaaaguacaaccaggggaacucaacugugauauccuuggauaucaccucauauuucucauguuuuaaaaguacaggaaaaacagauauggggagucacugccacauuuuggaccaaggaagggacagaccuaaaaacagucuuccccagcuccaucccaaggccgauacucucauaucauggugcugucauuggagagggugcaguguaauguggcccacuccauggcagagaaguuagaugaggcaucagaggccagagcuggcaagcaggaaauuacccacugggguuccagggagacuugcugggaagcugcccuuugggauucuggugaaaccugcuaggaaaccaccuuuagaggcgccaccgaaaguugcuguggugaacaccacuuaauguccugcacaccaaccaggcaucacagcaguaaaggagacaaaaccaccugauccaggaagugaaacuuguuugcuaguggagucccaccugugcccucuacugacaaaacuuaauuguggcagcuggcaaaggagaaaugguuucaggggccagagagaaggguagauuugaggcuaacuggcauaccuuucuaguuaauaccauaacucuuucuuuugacccuuuaaaaaucugccuucuuuauuugagucuugaacuauaccuguuuaugugcucugucccuuugcuucagaaauacagacuuuaaauguaacuugggcccuuuuuuaagguauuucauaugcauacauugcuaaucaaccucucuuugaugagagucacuuacaauagcaguuccucuaucaagaaaucauucaaaucuauuauaauacuaaaguaccuauuacuuguuuauaauauguagaauaaucuacauaaccuaguauacauaaguauguauuauauaugcauauaauagauacauagauacaggaaaaauuuguaauuacaaaugucuuacaaaagaaaaauuaugucaacugacuaaauaguuucuuacagaguaguaugauuuuuuuaaaaaaguccccaguugcuaaaauaucaacuuuuccuugauaaauuugauuuuuauuaauuuggcuaaauguguauuuuuuuccuagucuuaaaaaaauuggcacaauagcuuaugccuguaaucccaacacuuugggaggcugagguagcaggauagcuugagcccaggaguuggagaccagccugguuaacauagugagaccucaucucuacaaaaacuuuaaaaaguacucaagcaugguggcacauaccuguaacccaguuacucaggaggcugaggcaggaggauugcuugagccuaggucagggcuucagugauguauucgugccacugcacucaagccugggugacagaaugagacccugugucaaaaaaagaagagaaaaaaguaaaauuaaaaaaaauacuucaaauuguugcauaaagggaaaaguaagaacuagauuaauuacagauagagcuguucuuaucuaugcuucuuuuuuucuccagauguccuugcuccacaguauccauggcagucaaaugacaugucgaugaauauguuaccaccaaaucauaguagugacuuuuuguuggaaccuccugggcauaauaaagaaaaugaagaugauguagagauuaugucaacggacuccucaagcaguaguagugagucugauugaaaaaccuuaaaagacaauauacagaauugaauacuguagaauucuguuucuuuaacaguagcagggaaauguaaacuacaggugacaaaaaauacccagguaaacacuggcuuugguagaauugugcagucauuaaaagucaaaauuuuuugacuuucuuuuuaaagcc

SEQ ID NO: 18927 - RNA, 869 nt, Homo sapiens
uuuagaacaccaauuugugaggauaaauuccauucgucagggcaaccacagaucacagguagcccuggagcugaggaauagcuuugauuuuugguaaaauuugugaguccacagcuuucugcucaaucuugcacugcuccguaaucucauauuucucuuuuucugugucgaagaucucaccuuccuggugucugggcuuccgcagcuucuucuucuugaaguaagcaucaguaagauguuuugggauuuuuacauugcugauaucgauuuugguugagguggcaaugacaaauuucugguguguucuucguagaggaacucgauugaggaccagagguccagucacaaguaacaagccacuagccagcugcuucaggaaaaccacccucuugccccuguggcguccagugaggaugaucagaauggucccggggguaaugcuggcucgcaguuuucucacgugcugacugaaggguuuuuugcuguggcucaacagcuuucgaggcacaucuucaguaggauaauaucuaggcauuuugcgaaguuuaaccacccggguacugccguucuugucaccaccaacugguuuuguaacaguugcaagaaccuucuccuucuuuuucuuuucaaccuuggauuuagcggcugaguacuuccucuuguacauggccuuucuggaauacauagcagaucgggaauaccugccaauuccucugacaaugacaggguugcggcugcaauggggcuuccccuucuugggcuuuuuagccuugagguuacccuuuuucaccuugccaccagcaucagccuucuuggcuucagguuucuucucuuuaguaucuggcuucucaacuuuuucacccgccauc

SEQ ID NO: 18928 - RNA, 195104 nt, Homo sapiens
auguuuuaagauggcauuuuaaauaguaacaguacgucggcaauguaacaugauguucuguaaaacuaacaugacaaaauaggauuaauugugguuuauggauuuccauuuaauauaaaccuuguuucuuuuuuguuuuuaaugaaauuauaucuacuaaaguaaauguggcaaaaugagagaaguaaaucauagagaauugaccaaaacuggcaugguuauuccuccucuaagccaaacgcguccuucaaaaagguccaguagucaauguauuucgcaggaauaggugauggcauaccaagccaaacaucuucacaucucuagaaaaaaaccaaaaauggauaugauuagaaccacauuucaaaguacaguuuugaaaauucaacaccaguuuauuugcaaagugaaaauuucuaccaucuacuuuagguucauaaggacuuuguggucuacuggauacuuguucuugauucuucauucccucccuguauaagaauuaugugcccacacucuuugucauaugacucuguagaaccuccuguggaguaagaaggguauauuuuccuguuccuuugauaugggguuggccacaugacuggcuuugaccuauguacuauuagcagacauaucauggacagaggcucuagcgugcuggcaucauuuggcuuggccuucugugccucugccaucaccaugaaaagaacauggcccaggaugcugcuguucuuagaaugaccaagguggaucagaccaggcuggacuugcggacuaagagccaagcuuagcugaauccagccaugcuucacugaccuacaugcccauagacaagaaaaagaaaugugucuuguugugaaccauugaaauuuaaggaguuguuaugcagcaugaauacgcugauagauccuccuauacuuucuuaagaacccaauuuuuauuuuuauuuuauuauuuuuuuuaaagacaggguaucacuuuguugcccaggcuggaguacacuggcacaaucucugcucacugcaaccuccaacucccggguucaagugauucucaugccucagccucccgaguagcugggauuacaggcacaugccaccaugcccggcuaauuuuuguauuucuaggagacggguuucgccauauaggccggacuggucuggucucaaacucccggcuucaaguuauauguccaccucagccucccaaagugcuggaauuacagacgugaacugcugccuaaagaacccaauuuuuaaaauacaaacugguaucuauacuggcugauugguuacuguuucuucaguaaacaaugaaaagaacacuggaucacucacaguaugaucuugcagauaagccacuuuauuuguguguguguguguacacauauacacacacagaugcacauuuuauauaauacauaaauacguguauauacacacacacaaacuuuuugcauaugccucaaugguuaauuaauaucaacaggaggcaaaguucauacauaugguugcuuauauuucuacuuucaagguuaaaauaugacugucaagguuaauuguuguauauaagagguucuauaucuuuacuaguguuacauuaguauccagaaucacaaggugucacagaaacauagguaaaggcucaauaauuugaugugauggaauuuuggaagcaagcugaauaaguggugauucaguugcaccuuaugggaugaaaaacaguucagcagaggguuuaggguugugaaggguauuccaggcauagggaccagcguaagcaaaggccuggagaucuaaaaucuauuuucaagaaagggugaguagcccagugugguuugcggcacauggugcaaaguggcaagagagaugguuagaaggagaagcuggggccaaacuucuggccuucugugcuaguuuauacuugaggcugugguuaggggaagucacugguaggucuuggccagggaaaugacagaaaucugauuagaaacugauuagcuaacuugcuggauguacagagaaugacaugaaguaagaaaaucaaucuggaggugaguacuauaauaccgcagaaaaaugacugugccauaaccaggguggcugaagcgggcauggaggacaggagcuacucugagagaugcugcugcaggagaacaugaaauagcuagaaggggaucaacuugaaauggugacaaaagaaagguguagugcuauggguugaguuguguccucaugcaaaagaguuaugugaaguccuaaucccuaguaccucagaaugugaccuuguuuggaaauaggguuuuugcagauguaauuagguaaauuaagaugagcaaaaugagaucauaccggaguagggugggccccuaauccaauaugacuggccucccuauaaaaagacagccagguaaagacagagacacacagggggaacaccaggugaccauagaggcagagauuagagguuugcagcugcaaaccaaggaacgccaaagauugccagaaaaccaucaaagucuaggaagaggcagggaaggauucccacacagguuucagagaaaguauggcccugcugacaccuagauuuugaacugcuagccuccagaacuguggaagaauaaauuucuauuguuuuaagcaacucagucugugguacuuugugagggcaucacuaggaaacuaauacagguaaggaugguucuaagaauucuaaauucaguaauaguugacagugucuguuauuaguuuccuggggcugccguaacaaaguaccacaaaguaaguggcuuaaagcaacagaaacuuauucuuucacaguucagaaggccagaaguccaaaaccaagguguuggcagcguuggaucuuucuggaggcucuaaggaagaauuuauuccaugccucucuccuggcuucuggugguggcuggcagucauuccuuggcuuguaagcacaucacuccaacgucugccuccaacuucacaugguguucucuguguauaccaauaugucuucacgcagcuuucuuauaaagucaccaaucaaugcauuuaggguccacucuaauccagcauaacuucauuuuaauuaauuauaucugcaaagauuauuuccaaauaaggucacauucugagguuuaggguagacaugaguuuuggaggggacaauauucaauccgguguuauaucauaaggaaagcaggaaaaguugaaaaacauuuuuuaguaggaaaacaaggcucagagggaaauucuaaguucaacugugggcauuuuuucuuucagguguccaugggacaucaaggugaagauucugguaaacaucuguaaauacgguucuauauagcacagagcuagaauccagaacugugcaaagauauagaagucacugaaauaugagucauauaugaaauauaacauugucauagaaucagaagagaacuaaguaccagcaucucuaauucagguguaaaaccuuaauuucagagaugauuuaugaugaugauaaacuaguugcagauuugugcaggguuauagauaggaaucuuguaauuaccuaguaguaauaggaauaacaauaaauuuauuggauauuuacuacauggcugauacucuuuuaaguguuuuacauguauuaaguuauuuaaucaucacagaaaccccuuacgagauaaguauuaugaugauaaucuauuuacagaaaaagaaacugagacacagaaggauuaaauagauugucucaagucaaaccuccagucaguggagaagccuggauuauaauaaccugggcaguggagcugcggaacuaugcucgucugcggggcuacccuccagagcugacaaggaucuauucagaagcagcuggcuuucguccuacauagcuacauuugguccucacacuuccaacaagaaaaguuaaguagaaaacaaggcaguucuugaagcgacacuacucuucucucucaaggaugcugccucucagaaguugagcccaaaccaccaacuggcaguaugaagagggaaaucaccauucagacggcugauggcuaaacccacuccuaagggguguuuugugcaacucauaccacauggaacuugguaaaacaaaguugcuacuuuacuacuuacuacuuacaccaaaaaguaguaaaccauuacacacacacacacacacacacacacacacaaaacaauauauuuuaaucaaugaaggcuaagaucaauagucauucaacuccacuauuuaacauguccucaaaaauuucauuacaaaacuuacagcaauauuugcucuuaagugauguuuguaaauuuaaucucauuauagagaaacaguacaaauauaugccuucaaaaaucaccauccucuaauaggucuuccaaauaaaaguuuucaacacagaaauaaugcauuauguaacucauauaaauaugaugaaauuauucggggacuggauccucuuaugaaacaggucaggacuagaagauucugccucauggcuuaugagucagcaaaagugguuuuguuuuuguauuuuuugagcaaggaauugugauuuaaaugcugacaauacagagaaaauaauagaacuuaaaaugcaaucuugacaacucaagaaucuggagaugagaucaaauuuguuagcaacuugggcacaaggaaacucaaguaaauauucaugagauuuggaauuaaggauaauuuaagaugaaaagauaacagcaguccauuucuuuaaauccugaccacuuuaaaccccauggcucucacaaagcucuccuaacuaugccggccccauugugcucuuucuuucgaaucaauaccacuucccuugauuauuuuuccuuuugucacucuuccuuagguuccagaugggaaugacuuucuguccaaauacuucauaaaugccacaagcacauuaacagugcuguggguccaucuauugccaacccccaauuucagggagauuaucacaccuauuggcuuacaauugacuaauggaaucaaauuugggaccaaaggaagguuaggaaacaggggagguuuccaaggcucaggggauggggugaggggcaucaauuaaguagagggaaaggcacuuucuucauaauuuugucuauaaucggauuuacuuaaggaaucucauggccagccccuugguaaaaugaagacauuuuuggcaacauaagaaauccacauauuaccacugccuaauuguacuuccuaauaaaucugcaaauguuccaaauauuauagaaucuuuaugaaaaucugggcagugaguuaaaauacugucuucauugacuuuuuauuaauccuacacuaugcaaugcaaagcaaacucauaucauauggcuuucccagcaaugcauaucaauuuuaagugggaauaacugcgugguacuuuuacaacaggaggagucauccacagaaguugaucccacccauuccaggugagaacaagcuuacuugugucucuguaaaacagauucuccuggcagugcagguuuggaauuugggaucuuaacugucuacgugcagcaggcucugccagcaccccuuccuauccccucauucuuuccacucuggagcacaccaaucugacuuccaacugccagcaccuggguuccuuugcccuugggcuucucuuuggccucugaggcuugcuuuggcugucccuguggcaagccacaagugccagggaauuguuuccuuuccuccacuucaagagcagcccucaaacagugacugaugggaguugauggaugaauaccgcagcucccuugcacuuugggugggaugacucugaagugucaguguuucccaguugcauuaagcucuaaucauuaggucagguguggggacucacaccugcaauuccaccauuugggguggcugagguaggaaaucacuuaaagccaggacuucugaaccagccuggucaacauagugagacccugucucuacaaaagaaaaaaaaaaaaguagcggggugugguggugugggccuguagucccagcugcuugggaggcugagguaggaggauugcuugagcccaggguuucaaggcugcagugagccaugaucgcaccacuacacuccacccugggugacagagugagacccugucccaaaacaaaacaaaacaaaacaaaacucuuaaucgucuacaucaucuacauuuguaacugguuugcuaauaugccuuuaguagcuccuucccuuuccuuucucacucucccacuuccuuacuaguguuuucacuccucccccaaaaaugauuuacacuuaaaucuuugucuccaagucugcuucuagaggaagucagauguagauucuaugcaauuuugcauuuaucaaaauuaagaauauguuuaagaaagccacagcacagcuugaaacaaagcaacuuccuggcaaacuggauggauccagagucuccaagucacuuccagauaacucaaaagacagcacccaaaucucagaagaaaacuugauguaaucuggagcauaaacaauacaugccacauaguguuuucuggaagaaggaagaacuaugaaaugcagagugaaauucaaugauacaaaaaucaugauucuaaaaugucugggaaucauugucuccaagaaggcccuaugacaucuuccaagcuggcugucacucgaggcacuuaagaugucaaaccaguuggcaauaaauuacucguucaucaguggugaaaaaauguagcugccgaucuguaaaaucgcacacccuugaaaugggaagcaaagauggcacuggaugaaaacccaguaaacagcagcugcccagugagaacagcaaagcugugugugagcuaaugggcccuagauuuauuugcuuugacauuuuuaaaaggaaauuuaauuggauuaugucuccuucuaguuuaaaauuuucugcuguaauacuggccaccagaugcaugaggggaaaagaucgggagccaauuaaauuccaugcuucacugaaauaagguuauuuuuauuccucccaaaugcaaggcagauagagucauguuggugauuucaccauguuacuccccucuauucacuaggaaaaggauguuucuaugagaaauaucuauacauuuauggaaaaggccagugguguguauaguauuaaaauuguguuuuucucagauuuucucccuucaaauaaaguuaacauggcuuuggaaauaaucuaauuaguuugacaaaaucauaaaagcaauuaaauuuuaagcaaaucaaauugaaauaaauuuggggaagaggauuuugcgaauauuucuugagauaaucaagagcguucugauaacauaaggaaaagcucauauauaaaaccagaagauuagcuuauauuucuauacauuucugacuuuacagcaaugccaauauuucaugauugucuccccuuucccuagacaaagcuucaacagaguugucaucuaugugugaguuguagcuaaaagacaggcguaguuucuaaacaaaaccuuuccuuggaagugcaaugcagggcaaguaaaguuuucagggagauguggauuuuugagcuucagugauaggcuuauguguacaauucaaguggacauaacccgaugcuauagaugaaaguggauuccaggaguaucauuuccuacuagguuauugcucuguguuaggucaccaguauguguuugccaguuauuuuuuaagucuaagaggaaugguuaacaaccuuuuauuucgacuguuauauucaaccacaaauauuagaaauaacuuuacuuauuuaaaaaauuggcaccagccccugacuauacaauccuuaccauuaggaauaucuccgagccucagcuuccugucuauaaauuggggauaauacuuauucuugcaagauuguugggacaacaaaaugucacagguuauuccaugcucuaaauaccaaaaggagagucucaacaaggcggguguccaaagauguuucccaagguguacccaacugcccccuacuuccugaugccaaggccguauaucauccuauugugaaagagagugcuuuagagcugacugcuaaugcuucugcaguuacgauguucauaaaaugaagccacauccaauuuuucucagaaaugucaaaagauaagacgccagucacacaguguaaguuauaaaguuuauaugagaaccgauuuaguguuauuuuuuaaaacgugacuucugagauuaaccagacaggcucuaaacagugggaccuauucugccaguuuuacagcuaccaucugugagcaaacacaauagaauggaaauggggucuccaggccaugacagugccagggcaacaugcugagaccauagauagucacauaauggagugagaguuaaauuacagccccauggcucaccaugggcugcugaugggccaggcagagggauaaccaagggaguccaaugagaauccaggcuacaggccauuggcuacaggccauagccgacagucaugauggaugauggcuuacauccaaccauguaggaaaaaccugucaccaaaggacaguaggacuaaucaaagcuagacuagcuauacuauaguacucuuuaaauucuccuuguuuguuguugaccccuauucuuacuagcugaggccaccuaacuagcacauguaggggagccaccucugaguccaggaaacugguccucaaauccagcagaccaagccccagaagcaguuaguguagaccuagcuuuuauccuggcuguggggcuuguucugagcucaaggcuuuauucugguaacaaauagauugugcugggucagucuccauuugccccucaagauccauucuuugcccuuuucacucugcuuucugcccugggagacugacucuguggauugcaucacuccucaagcuuccuugcucucuggcuucuggguggguucagccaaugugaagcagcaucaggagaucagaaaacaggagaagcaagaggucagaguauggauuucacuucccuucauccuguucccucccugccaggccaugguuugggaguggcuauaguggcuacacuacucuaccugcugcuauaguuccagcuccucugcugggcuccaauaacaccagucccccagucccucccugcuucucccguuauugccagucccugagugcuccaccccccuccccgccccgcuugguucccuuaacccuacccaccccgucaacagucccuuuaucaaauccaucuccaggaucccuuugaguaugcuguguauuuccagcuauaaccucacggguauaggggcuuagccagcucuguccccuuggcagggugaaagcuuggucugagccugcugaguggcucccucugauugccgaauggugcuaacuucaagauuccccaucacuaugcucacuguuuuggagggaugcccugcuagaacucccuuccaaucucaagucuuguggaccagaccacaccccuacucagccugugguuggcugaagccuguggucuuguuccugguuucugaccucucccuucucaccccaugaugguuagucacacuagacugggaaggugucccaaauuuccacccauaacauccauccuauccauucacgcugaugcagacagaauuagaguugaaucuaguacugaagccuacucagcuuucaucagccaauaaguuuuuuuuauuucuaaggaagauucccagugcagaaaugagauccugcugaugacaauaugcagcccaggaguaaaaauauccacguuccaggugguggccuguccugguaacuucuacagagcucuucauaacaccucugaaacuuuaacccaagccagccuguccggcucauauacuggaggaagggugcagcuucccaacccuggggccuccaucuaagcuuugcuuccacacgggagcucagccugccauuccuucuucucaaaagaccucuggucucaucacuucacacucagggcuggggugccuucacaaccugauggaucuuacccugaagcccuacaugugacuggcuggcuauggaagacuccccaaacguuggcaauccccaaagucauaacugggagguuuucucugcccaguugcacccccgggaccuacacaucuggucugacuccaccauggccucuuauggcauaaccacucuccucucaguucccuaccaugaauagaagaucaggaaauaaccaaggaacaagcuggggaggaggcugucacacugcuaggcucucaguugauaccaagaacagucaacaggggcuucaagaguaguugguugccaagcugugauauacuacccagaauccccuugaggagggauuugguggcccagcugcugggaguccccuuccuggauuuccugagcuacaaacaugucuuggcuacaaagagccacgcugcacaaagucauaucucuucuugaaccaacccaccaggacaaaggccaggccauucuggcccaacucaggacaacgcugaaaagacaugcuaacuccagagcucccuauggguuggccaaggauaucuuugggcuuccaucacaguucgacuucucccucugcccauucuucuuuuuuucccccaccuuccaugggaguugaucccaaggacacucccaaaaaaacauccugcacauuagacuccaucugcuuccuggagaaccccaccugugacaaacucugacccagcaguguuucagggcauuauucaacauuauuaauaacauuugagcacacuuacaugggucaguagauauuauacuuuuugcuccuguauucuacuguauaaacuauucaacauugugcucaaccccuucaugcuaaauauuuucacaugagauuacagacucacugguaacauucccaagguauuuuaugucuucuuuaugaaauaauaacaagcuuaucaguaccagagugcuucgaacucuuuggaaucuaguuaaauucucauuauuggugaaauugaucagguaccauuuuauaucuauuuucuuuucuuuuuaauuggcugaaaaagaauaguccuuucugaaugccuccugcagacugaaauauuucuaggcuuuaucagcagaaaugaugaggcccuaugaguaaauuucucaccguaaaugaaucgcaauuagaagaaccuagugcugaagcacagcuguuucugaugugacauuccuggccuagaaccauucucuugccauuaaagaauagaaucucccaucuuaaccuuggcagggacugcccagcccccugacuugaggaaaguaagacaucucaauuuuacagaaaauaauagcaucuaacacuuaagcccuuacuaugggagagguauugugguaagugacuuguguauauugacuuccuuaauccucacaacccuaauggaagaacuauucuuaucaccauuuuugagaugggaaaaccugaaagguugagugcuuuguaaaaagucacccaguuaguugaucguagagcuaaggauuugaacuagggucccugugauuggagaccuucuguuccacauugccucucaaaagcaucugagguccacagcucgauaccugucccaguugacagaguugaagugaugaaacuggggaggggugauuaaaggcagaguggaucuuuggccuucccaugcagugacuucucuucuaguguggauggugaucuuuuugugggucaugaaaucaauuuaaugggucacgaacaacauucaaaagagaggagaaaaagaggugguggggaaugagaaaaaggaaaagaaaagaaaggaagagagaaaugaaaaaagaaaauguaucauacugcaccacauguagucagaacaauauuaauccgugaaauuuuuguuccauuauauaucugcauacuguguuguuaugaaaaaaaaucuuucuuacuguagguuguaguacaaaaagaugacaggaucucauucaaacucaauagucaucaggaaaauaaaaauuaaaguaguaaaauauguuuucagaggcaaaauauguaaaaacaaccugaaugccugucaauaaagagcagauuaauagggccaggcacgguggcucaugcccguacucccagcacuuugggaggccgaggcaggcggaucacaaagucaggaguucaagaccagcguggccaacauggugaaaaccugucucuauuaaaaauacaaaaaaauuagucaggcaugguggcgugugccuauagucccagcuacucaggaagcugaggcaggagaaucacuugaaccugggagauggaguuugcagugagccgagaucacaccacugcacaccagcuugggcaacagagugagacuucgucucaaaaaaaaaaaagagauuaauaaauuauuauauauucauaccacagcuauuaagaauggcuuaggucuauacauauuaaacuagggaaauuuuccacgauuaagaaagaagagcacacuccagauaaaugcaugugguaugaucuuauuuucauacaauacaugaggaaaugauaaaacccccaacacagagguaaacauuugggugguggauugaguggaauggaagaggaaagagagaaguagaaaguaaggaaaacaaugacaaaggcuuauagcaaaaauagguauguccuguauauuauucaggggcucaugggaaauggcagacauauacaaacuguggaaaucgagaagaguuuaauaaagugacuaguuacaaaguugugggaaguguuuagaaaaaccaauaggggcuaguccccuggguuuauaacagcagggagccauuacuaccaccugaggcugaaggggcacaugagggugguuaccagcgccuggagugaccagccauaugcaaagagccucuagacaagugcuguggacuuuggaaggaggaggccgucaaucugcugugacuggcagggaggaagaagauuucucucuccuuucacccucuacucuccugcuggugcaucccacuggucaacccaacuggaggccuaggggacccacugaugugccuacaaaggucagcugccaaggacuggccugggcagggucagagcacgguagagggcucuggagagcagugcuaaagggacacagggacacagucaauauagacuacuagaacauucaacaaaaagguagaagaauguaaaucccaucuaccauguuucuauuuguauguaaaaauuaaauauucacauggaugagaaugaaaggguuaucagggcaaaugacaguauugauuuguuuuugugauaguguuucagauuuggguuaauccaauccauugucuucaaaaauaauuauauuuaaaggacaguuuucuuuuguauucuuugcagcaagagaccugaguuaaaauucugacucugccuuacauugcuguuucccuaacuuccucaucucuaaacugggaauaauaaaugcaccuaugauugcuaagaggauuaaauaagcuaggugauuuugagaucuuagaacaguaguuggcacacaguaaaugcuuuguuugcuguuauguauggggacaacaggacaagagccuccauggccaggcgugguggcucgugucuguaaucccagcacuuugggaggucaaggcaggcagaucacuugaggccgggaguucgagaccagccuggccaacauggugaaaccuugucucuacuaacaauacaaaaauuagcuggaugugguggcacacaccuguaaucccagcuauucgggaggcugaggcaggagaaucgcuugaaccugggagguggagguuguggugagcugagaucauaucacugcacuccagccugggcgacagagugagacuccaucuccagucuacccaccauccagccaaagcaaguucccuguaaagggcacucuugaucauguugcugucuuccuugaaguuagucaguggucuccagaccucgcaggacaauauucaaaugucacccuuacagguaucuccagcuucauccuuuucaccucuuccccaugugccuucgcucuggccacaccaauuccuccugguucuguacaagugccaugcugucccauguccagagaauucuguuggaaaugccuuuuccagaccaugucacuuuccuaccuugcuaacucuuacuacucaucauugaaauuucaaaugucaccuccccugaaaauacuuccuguucccccccagucuguuuagaagcagcuaccaccucaucccauagaaucccaugcaggcuguaucaugccacacuccaaaucacgaacguaccaauucccccaucaguagugggccccucaaagguagcagugacaauguuugucucuggaccccagccuacagcagagaaccugaugagagucaauacuuaauccugauuuaucuggggauuacauucauaaaucaacaagauaaguaacuuaacugacccaaagucauucagcuaaguagguggcagggccaaaauucaaacccagcucugucugacuccaaaggcuacuacuuucccccaaccaucuggaaguucuauggcugcccuuggaguagcugcaugccugagggaacucccagaggcacuagaccagcuccagccagaaugagcuggucagcagagaccaggagaaauaaaugccuccuuucugggaguaucaaccacaugacauuugcuuuaucaagggacuuucccaagaaaaucaauuucuggagcauguuaaaauacaaacaaaccaccacccacccacccacuucuuaaagacaauuaguccaaagagaucuuagagaauucagacaauuccacaauguugagagcaccaucugaucaugugaacuuuguuuucccuaaccaagcauuuuucuacagaauuuugauuuuaaauuugguuucacugugaaaugugcauccccauucucuauuguuucacccauggcaaaccugugugcacagccgcggauacccggauacccuagggauucuugccauaggcaccauuugagauuugcucuuguggcuuaugaugauguuaccagaaucccuugauaacaguguuuauaucuauuuauaacuguaaccuauuauccuauuuuccauauaauuggaugcgaucgagguuaaaaaaaauucagcugcauaagaaaagucaugcuuuuacagagcagauguuugcucagcauggaaaguaaauuaaccuuuaacacaaaugcccagaaacacauaagcacucuuuccaaaagcacugauguuaauauuuuauaaugaaaaauaauuuaaagauaaaggauauuaaacaugcaagggaaguaaccauagaugguuuuuaaaauagguauucauuuuaccucuuuaagguaugaugcugguugcaauucaggcacuggauucuuucuccaguucagggcagagaaaaaugacuuauaaucuauuuguuuuucacugucuucaaaccugaaaauauaauuauaauauauaauuugacucaaucugcagaauucaagaccaaaaugucaguuucaauuuuaucaugaaaacauaauaccauauaugcuucaauaucugauaguuuucuuauuucuuacaauuucuuauugcuucugacccuccagaauguaaauucuuugagcggggaucuugccuaucuaauucaucaaaauauccccaacaagaucagugcuggcacuuaguagguguucaauaaauacuuguuguaguugccacagacgcaaauuugcucauucaguaaugaagacuauagugaaauuuuguuaaaaagauuuaaagguccuuuuaguuuaaugguugauauuacaugucagcaaaauagaauguccuuauauuucuucaauugcauaccuuuuaaaucuuuaaggcaagcuagauucauuuuucuaccaguauauguuuugaaaaaauaaaaggcaucuuuaucauuuauuauguagccauuaaaagggguuauuuagauccaaauuugcuaucguauaaauauguucuugauacacgguuaaguagaaaggaggcuguaaaacaguauguagaguuacaaucccacuuuagguuuauauauuaaaaaacagaaaaaauaugguagcaauagacuuacauauuaagaauagauaucucugggaagagagauucugauuuuugauuuuucuuuagacuuuuguguaucaucugaauuguuuuaaguuuauaaucagaaaaacuucagcucauuuucauuuugaacaaaaauuaacaaaugauuauucuguaccagaaaaauauaggucaaaauaaugaaucucuuugaccacuauuuccuaauuauggauauuagauaaaauucuuccuuaaccauaauagagauuuggccaugaagauacaguaauuucaacacaauugcuacaaugaccuaaacacaaaauuacuuaguguaaugccucaaugccaccuauccuaaauuugaucacauucugccaguuuuuaaggcuaauuaucauguaacaccaguuuuugaaggaaaauacaaaguggucacuagacauuguuccaggcacccuauuccaggauccugcccuuaaaauauacuccuaaucaguccaaagauuuuucucuuuucuucucaaaguacuaaaaaauuaauagcuuauauuuauaaacuaauaaaaauuagcagcaauaaauuaaauguuacaagcugaagucacauagccucaucaaucuagacaaaauggaauaaacaaagugaccagaagaggggaaaggggaauucuguaauucuuuuguguacauuuucuuuggccaaggauucuaagauacaauuccaauaugcugcccccuacccacuguuuaccacccuuuaaauuauggcucacuagucauuucaacuccuuuaaaggacauacucuguuuauggaaauauuuauagccaaaauguaggaccauuauuucuuuuauuuguguauguuuugggggaagaaugaaaacucaauuaaagaugucucauaauaaacuuuuuuuuagcacagagccuugaaagaaaguauuuccuaauauccugaguaggagcuaaggucaaagaaugagaucauguaggaccuuuggcuuuuaugcugaggaaaacuaagagucacuagggcauauuauacagaaagguuaugagaccuucaauguucugaauguuuguguccccucaaaauucauauauugaggccucaucaaugugaugauauuaggaguuggggcuuuaggaaaggugauuagauagugagggcucugcccucaugaugacauuagugcccuuauauuaauuaaagagaccccagagagcacucuugccccuucugccauguaauccuguaaggauucagagagaaggcaucaucugugagccaggaagugggcccucagcagacccaaaucuguugucaucuuggucuuggacaucccagccaugagaacucugagcaaugaauuucuguuguuuauaagccaccuaguuuacgguauuguuauagcaaucugaacagacuaagaagggacuuaugauauuuuuaaaagaucacucugacugauacauucagaguagaacacagagggcaaggcagaaguggcaaggacaguuagaagucccuugcagggauccagaugagagauaacggcaguuuagaugagggugguggcacuggaaggcagugaggaguggccaauucugaauauauuuugaauguaggauuccuaaaagacuauauauauuauguaagagagagagggaaaaagagaguauucaggaugacuccaaugccuuugcuugaauaacuggagcaauggagcugcccuaacugagaugagaaagacuguaggggcugcugguuggaaagaucaugagcucaguuuuagauaugccacauuuggauggaaagugagcaaguggggcuaugagucugaagcucaaggaaguaguccauuugaagauauaaaugugggagucauuagccauauggaagguauuuaaagccaaaaaauugggagacuugaggagaucaucaauaaaauaaguuucucuaucuguucuuaaaguacagaauuugucaguaaauucccauuacaucaauuauaagaggcacuuacucaauccuagggguuucagaaguauaguauccugguaaucugggaaccagucaaagacuaccaaauaaaucuaggaucacaucagacuucacuccucauauacaauccacuaagcaguccuguggguucuaccacuguagcauauaacaagucuaucuauuucucuccaucucuuuuaccacucccuaauuccaagccacuauugucucucaucuggauuauagcaauaacuuccugucuuggucuugcuacuucuacucuuaccuagcagcagaccauccuccaccacagugcucuuucuaaaacacagaucagaucaaucacuuucuugccugcaauccuccaguggcuucccaauccacuuagaacacaagcuaaacuccuuaucaggguuuauaagacccaacuuaaucuggcugcugauggccucucugauuacaucuccucacuugaaaacucucucuguuuacaauguuucagguauacuaaccuucuucugguuccuugaucaugccaagauugcuggcagaaaugcaaggcauuugcacuucuggucccuuugucuggaaagucccauuucaaauguugcuuccuuagaaaguccuccugaaguuccucuuaucugagucccuaugccugaauuugcauuugcccuagaugauggcucuggaacuuacuggaaaauuucuggaagucaccacacgaaguccuaucauuaaauguuguuaccacuaacucugauauuuacuuguuaccucauaacacccagucuuccuuccugcccaguucauaugucagacucaaaacauugaaccauuuauccauuuagggggacauuuaagaagaauauuuaggaaucaaaugauauucaggaagguccacugaauaaaaguauacauagcucagaaauaaugucuaaaaguuuuuugagaaaaaaugcuugaacgaguucaucuuuccaaaaucccagagccaggccuaaaggaagaguugugguaaugugguaaaauacuccaaguuuuccuuuucaguucugucuuagaggaucucagugugugugggaauccccccaagaggcacaagggagaaaagaacaaaggauauuucaauuaaaaggaauaaaacuagcucauguuucuuggaagaauucuuugcucuugggaaguagauaggguugcaguaaaucacgaugaaucaaucacaaguauuucucucccuuuuccccaaaauccuaccaaaaugaccaaaaaacaauaaaaauagguuauaacccacaaugacaaagagaauuggaaaaaagaccacgguagagaagagacgucaaacucuuuucaagaugaaaaguaaacagaggauugguaacuaacuuggcagagcugaggaagagaagcugaacccuaaaugucccugucaguggggagagggcacucagaguccagucgauuuggcccacaaaauuccugggagacuaagugacugcagacuccaggugccaauaaaggcaggaauaugguguggcacugaaaacacggauuguuugaaagccuuuagaaagcgguguccgggcgugguggcucacgccuguaaucccagcauuuugggaggccgaggugggcggaucacgaggucaggagaucgagaccauccuggcuaacacagugaaaccccgucucuacuaaaaauacaaaaaauuagcugggcguguuggugggcaccuguagucccagcuacucaggaggcugaggcaggagaauggcgugaacccgggaggcggagcuugcagugagccgagauugcgccacuacacuccggccugggcgacagagcgagacuccgucucaaaagaaaaaaaaaaaaaagaaagcaagagcaacugaacagccaaguaucuuccuccguacugugcuccucccuguagagaccagaggcuuguucuccagagaaauucaaugaaagaagcuccaguuuggggagaggaggcaaaauggagugcagaggugaggggcggucaggugccuuccuuccccuuuucuauuccuagaauaccaguggccaugcguaaacucucccuuuccccaucacaaccucccuccuaucuuugcaggagaagauaggauucuucucuccacacucugaaugguuccagagaaaucuccagauuccagcuucuggggauucucuaauaaaaugaaggcucaggaguugacuggguagugaaauccacuaaucaacaaaccccuuccccugaccaaagcauccaacauuaaagacagaagccaaaacagcaacacaaaaaaaaacaaaaaacaaaaggaaccaaaggcaauucagggaacacagggaaagaugugagauaugaggauguauuacauuccugaaaaaagaacagaagacuacaagaaaggaauaucuggaugaaaaacgugcucuuggaauuaaaauuuuuaauaugauaguaaaagaugcaguagaagggcuggaauauaaacuuaaggaaaucccuuaguaaaugcauccuaauaaaaaacaaaaucugggagagaaaauauccaaauucgagagcucuaaaaucuuucuauuuauuauuuauuuauuuauuuuucauacagggucuugcucuguugcccaggcuggagugcaguggugcaauuauagcuuacuguagccucgaucucccaggcucaagugauccuccagcuucagccuacuggguaacugcgacuacaggugcguaccaccaugccuggcuaauuuuuuauuuuuauuuuuuguagagacagggucucacuauguugccaggcuggccgagaacuccugagcucaagucuccugccucggccucccaaagugcugggauuacaggugugagccaccacaccuggccuuaaaaucuuagcaauaggaguucucauaauagagaagaaauuauuaaauaauuaauagaaaguuucucagaaccaaaggacagugacuccaaacuagaaaagccuauaggguguuaagcacaaugaaucuauauauagcuacacauacacacacacacacacacacacauacacacucucucucucucucucaucaugaacuuccagaauacuaggaauaaagagaagauccuaagagcauuccaaaagaauaaauagcaauguaaaucaauauuaagcuaaauuuucagucacuauaacaggaaguuagcagacaguaucugcaaaugaucaauuaugauaucaugugcagugcacucaauauguacaugcuauuuuaaauagcagaagcagcuagaagugcugaaaguggcuucuucuugugaaugggucugggggguggagaagaauguggccagagacugcuguuguugaaauaagcuuuuuagaaugauuugauaauuuuugacuaucaacauaugucaguuugauaugaagaaaauuuuaaggaguguaaaaagcagaugagagacucugagacaugauuuuccagguaguaaacauguaaaagucagauguggaaagaaagaagugcuacuagucaggaguauauucaggaggaaugagucucucaguuuuccucccugcuccaaaauucugcccguagcuuccugggccacugacauagggugauuuuucaugccaucauuuguuauuauaacaugcacucuauacaccaugcuuguuagaugagguuguaaggagagaaucaggacauaaggaagaucuccaguccuaacaauaguauaggucagaggaggaggaggaggcaggggaagcaguucagagacaaaggucugaauauuacaggagugagaacaaaucaaucagucagugacuagaguuaccccugaagguuaucuccccaagucccccaucacagaggccucccucugucucauggcuagaagcaucauuuaccaaauccuagccauccuuucaaaauaaucuggaaaagccuaugaaucauauagaagauaaaucuccuuauuucauggccaugcugugcuuuccauaaaaaaaaaaaaaguggucccaauucuccaccugaguccccugcuucacuccucuccaaacgacauuggcucuuguuaaaacucugauccauggucaaaggacaaagauuugccacucuggaggaaauucuuuucaaaaggcuuugaaaagcaauuccaaagaagaacuuucuauggccacauuguuggaaucagugugcagccuuccagggugacugcccuaaagggcagcacuaauucuggcuuuuaaguguuucuacgcuuguuaaaaagucagccuucuuacuuucaaguccuagcucacagugcgaaaguguuuuccuaaaaccuccauaaauucuucuuucccucugauacuugcgaauccaccauuuucuccacuacacaaacucagagacauguuguggaaaaagggggagggaaggcaauuccucugguuccuuucuagauaauacgaccccucgaacaugcuuccugaugucaugcuaggugggaguucuuagaacugagucugaugugauguuugacugauguucauacucccccuccccaaaaugauaaauggcuugaaaaccacagaagccaagaagccauccaucuucuugcuacggggaauaauccugaacugcucuauuuccacccuugauagagguaaaaggcucaguggcagcuguauuuugcugaagaggagccuucuucuccucuauugcaaaggucaccucaucauuuaggggaauggucuggaagggagagaagacggugaagauccauuuuugacucaguuguauuugguuucaguccauuacccaacgaacccaggggugcaucuugaaacaccugguaaaagucgucaaggccagacacuugagaagagauggagcucugggccucugcgucaaguugccaacaaguaauucugguuaucucuaaauagucaugccucuaaauuccaauucugacuccagcacagaucucuggugaggugggucacagcugccagguaaggccuguacauagagucgauacucuguuuguccauaugguuugggauuuaaaagaaaaaucuuuucaacuagaaauccccuuauauuugaaaagguagaaagcaucuggguggguggaugggucugacaaagagacagagagagugagaggagagagcacacaaaggaggaaaaagggagagacagagagacagagagaaggggcuucucugugaaaacuucaucaguacaccaaacacucugccacaauaacuaccacauggcucagcccuugcccuucagccucacugccagguauuguugggugaaaucacaggagcacuaaccgugccucugggagcagggcagggggcaaggcuggguagacuauaaugagaugauuuuaaagcccuguuaacuuuuuccauuuuaacugauauuucuggaugaggcaccagcucucuugggaggccaguucuaaggcauuccauggaacccaaagccaacuauaaaagucuagcucaggacagagcugcuggggaaagaguugcacuugaaucucuaguuauuccaagucuagauucagaaggccacaauuaggggagaaggcugccucuuuccuucccagucccaugaagaauacagaauggaauggcuucagaauucccucuaccucuuauggucuaacaaucagaauuuuuugcuuauuauuacagaggaauaugaauauccaaaugaaggcucagagggguugaguaaaugcccaagaaucgcauggucaggaaacaguagaguugaccugcagaggcaggagcagcucugguggacaccgagcccauguuuuucuaccccauguccagugcguuagcacaggacaagucuuugaggcugcaaaaaugaacgagaucuagucccuacccucaggagcucagauagaggcaaagguuuagaguaucuuaggcaguuguaguucuacuuccauuagaggcucaucuuggccuggagcacagucuuucagugagagacucucagaguuuauacuuaugaaaugaggaauaaugccuacugccaauuaaaauguaccuuuuaauaugcucaaaaauuuacaaaauauucuaaggcccuuagcacuacaucaauacaaaguaucacuccuauuauuaauggauaaucgcuaccacuauauagaacauuuaagucugaugcucugugcauuaaugaaaugaauuugcuugguaaguaaggugaccuuauaccagcucccacagcacaaacugacaggggcugagguaaccagguacaaaaagguuuugaaguccugauuccaguuugaguuauguuaacauaauaaggaaaagaucaagcugaauuauaagaaaaaugggaauggaguagaaggaaaauccugguaccaaaauauaggguuaggagaaauacauggguaacaauuacugggugaaagaaagcauccaacccuuuagccauauuguuuuucaucuccugaucugaauuuacacagcaggguuacacggcugcucagcagcugcccagcuccauuccaaggcagguaaaacuauuccugggcaagagcaugcauugaacaaaaucaacaagcuccaugccugccucccacgggagacuguagacgucagagggggcucuggcuuagcgugccauaaggagggcugugcagaaagagacucuggucagggcucuguaaagcccuguggagucuguggggaacaauaagaaugcagaauauaaauguaagcugcaggcugaugggcccauuaggaauuagggcagucuuugaaaggaaucugcagagaugaugcaaaacacuaagcaugugacccaaaucauggcagggcauauuggagggagaggggaaugggaaugagacauuuucuaaucugauuagucugaaguuuccccugaguguggagaagggucacugcacaauuagaggcaaaguuagacugaacauggucugcuuagcagcugagcgggaugaccuccucaaagcuaagcugggcuuggagacagauguguucagagacugagaugacuucgaagcaaguucugaaacaaucuuuuugcauuuaaugucaaaucguaaaggcaaagacaaaacagucugcugagagaaugagaggaugaugacuugguggccucagcacuggauaagaaacauguagguccuccagaggccaggcucccacauuacuggacuuuccaggacaacucauccuuaagaccaucaaaagauaaucuaauaaacauccacagcuuccugacuagaagacagcuuaaugugugaaaggcauucagauccaauuguugaaaaacauggcuuccucuacauagaaagacacagguuucuuccaguucauuucuaagucugaguguguggucuauggucccugacuuaaauuucucuccuaguccucaaucaauucuuugcaccagguacugugcuggguacuuuauguauguuaucucaauuaauccucugaaccacuaggaaauagguacuguuacgucauucgagagauaaggaaucugagguucaggcaggucaaaacccuugcacaagaucacacagcuaauaaguggacucaaagaauuuaagagaugggaguggaggagggggguaaaauugucaggaugugacaacccauugguuauuuauaggugguaaaucacacagaagcagugucugcaucugaaugaaucgaaguucaagucacaacucuucauuccaagguaagggauaaagagacacauaaauagcacugugagaauucugagcaggagauaaucacucugauuaucagccaaacgaaugcaacagagcuucauggauauggugccacuugaaaugggucuugaaggaagagcaagcuuucagcaagugaaaaccauugggagcuauugccuacugaugaaauagcaagggaaaaggccaaaaaaaaaagggggggggagggggaaggcaggagguauauguguaauaugcuaaacggcccauguggcuggacuacugggaacaggaaggggaguuuugggagugggggaugauaucugugaagaacucugaguccaaggccugccuacuucaucucaguuccuucacggcaggaucccucacacggcugcuagcaaauaaaagcaaauagaguuaaacaaaaacaaaaucaaaacaaaacaaauagaacugauaaucuagaaaauuauuccagguugauucaaugcacauacacauccaacuagauuugcccucuucuggguuucccuccugauaccuuggacccuaguucccugacauagaauuuggcuuuaucuguuccuuugguuucuccuuuugucucaaacaaggacucccuacuucagacccuauuugagaacaaugcuccagcugcgaacccuaagccccacuauggagaaggagcuuaauucaaaguuaaagagcugguccuuccuuagagagcaaagagacaccacagaagguuugugaguaaaagugcaauaagaugacauacauuuuugcucuuagaagguacuuagcugcuauauguaaagauggauuuaaacauuuagacacugguggaugaaagaccaaugugguggcaccgcaguauuuaagaagcaaugugggucagaacaagaaugaugauaguggaaauggagaggagagaguagaagcaagcaguaaggaggagguagaacugucaagacauccuaaucuacuggcuauuuguagacaguaacucaaaaugauuagaagcagaggaugugcauuugaaaaguucaggauucaaaucagagcucuucuucuucuacacuaugugacuuugggcaaaauaccucaucucucuaaaccucagcauccuuacguaugagauaagaaggauaacaguuucgaccucaccaagcuguucucaaaaaguaaaugagauaauauauccaaaacaaugaucacaaugccuagaacacagcugaaaaugucagaauuaucaagauauauaagucagaggaggagcuagagugagugaugcuauaggaagcauaagagauggccagagucuagguggcugagagggacaugccaggaaaucaaaagucagguucaacaggagaacugauguguuuuagaaagcaguucaccaugcucucauuuuauagcaucauaaucucuauguuuuacaucuggugcucuaucaggacagagccccaugcuaauaacccuagguucucuuacugcaugucuauagcuaucaggaacugcugcuuugaaaaaccugcccugaauuuuacaucuaauguccuccuaaccaacaaaguuguguauuucauuuugucccaggaaucuguggaucuauaaguguguauucauguuaaaaagauaaaauaauaauuuguaauaggcucucuaacauucaaaaucaagacaaacuuuuccuucuguaacacuuaaauggaggcaggucaccaauaauauaaucaaaacaguuaaggguaaaucaaggguaauuaaagggagauguaaaaccaggaauggucccccaaauaaaacuaugcaggacaaucccuaucaagaguggaacucuaacuuaccuugacaauaaggauucuagaagaucaucacucaaagguaaucuggaggauuugcacagccuuuuaaugucuuugguggguaauacauuuuuucugcauuaaaacaacguaaaugagcuuuuauauaccuuguauaccuuuaguaauaauuacauacuauaggaaagaaaauacauuugugauguuuccugagaauguacacauggaaguaugaaaauugguauuggaauucacaauaaggaagaacagucacauuucauuucaucaacuuuuucuauuucagaggccaccagacuccauccuuacaaaggcuuuuccuucaagaugcagauucuugguuggugacaguacagccuauuaaggcuacagccacaaguguugcucuaaguaauugaucugcauucuugaccacuagucaaaaaugguucugauauuugaaaacaucucuuaauuugacaggcaucuagagccuccaacacaaguaugauaugacuugaggguguuuuucuguucuuuuccuuggacccaaaccuuaucaccuggaagccccagcuggggccucaauauucacuucaauuuuuucagaugcuagcaguuuucucuagagcagcccaaaagucauuuucuccagucuuaugggggcaaagacauucuuguccaauguucucauucagccaacacuuuuccaggcaucgggcaaaauuagaaccaacaggaaagaaaguuggcucuuuucuuugcaaugagaauguuuauaucuagaaucaaagcuugauggaucuggaagaaccucaggcuaucuggucaagcagccccauuguuccuaagaaguguuccuugaaugaaggagggccacacuucucacucuggggaagggggcaacaccaggguggaaggcagggccagggccaugcaaaacucaggccacacaucuucuaggaagcuugggaaagcuuaaagagucaaggaaaaauaccaucuuuauaaaaacucaaagaggaugcauuauggauuaauaaaaaaaaugauuauuucuaagacaaacuaugggaccuacacagauauucagggaaugcaguuggccacuuggguucagacuucaaguuuggggauaaggcaagaagucacaaggaagagagauggcaguggugugcagcaauacggauuagaagcuagagcaagaacuaagauuuuucuaauuccagaugaaaucaguaaauuuauauuucuccccacuguauaaggucuguaagaugaaugcaaaaaaaacacauuaaguuguuugcauccaguuguauguaacaaugacuuaaugaagcucaacacgcacacaaucaauguauaagaaauagcuuauacugaacuucauuauuuucaagaagaaauaauuucaaagaaauucuacagaauguuugcuugaaaauuccauuuucuauuuauuauaaaaguuacauuuauaaauccccaucaguacuaaaauaauguaaaaagacgacaucucagaauuaacccuccuaacauuuugauuuacuaugcuucaguugaaagcuucuagaaacaaaugaaaagaacaugcaagggagaagccuauucuuucaaagauacagggccuccccuauuccgucaacaagacuagccuggccaacauggugaaacccugucucuacuaaaaauacaaaaaaaaaaaaaauuagcugggugcgguggugcgagccuguagucccaacuacucaggaggcugaggcaggagacucucuugaaccugggagguggagguugcagugagccgagguugcgccacugcacucuagccugggcgacagggccagaugccauaucacacacacacacacacacacacacacacacacacacacaagcucuccaucacugggaaauaucuguaccuaaauacuucuccgaaaaugauuuaagguguuugugcuaaauaguagaguaugaguaugaugacacaugucuauuuucuuuuugcacuuuuugauaaaauagaaauuccuucauuacucagguucacagaaauguaaaugauuagaaucaauaaaacaaaagcuuacuuuucucgaucuucauacacacaggaauaaaugaaagugucgaaauucucaaacauauuuuucuugaacuuuucgugggccagugcgauuaagaaauccauaucugaacaugugcccucaggcacacgguagugacgugcaaugguuacaaauucuugcucugcaagguuuccaacagucaaagacaucaauaugucucuguaauaaaaauggaaaaacauuuauaaacugauaucuaagaauacaguauuuuacaucuccuucuauuuaaaagauccaaauuccauuuuacaaaacuuuuaccaacuguacagaggucaugugauuuuuuuaacuuaauuucucuucuuaauuugggagcagcaggaaggcaccaaugccagaauggaaaaucauaggcacuguagcuuauaaauaaaauggcauuuugcccagaguuaaacaccuaccaaauaacagccugcaaccaggaaguaaauuuuuaaaggcuuugaauggucaaaaaaccuauuacuaaguacaugacuuuauucaaugccuauuaaucuuccuuacacaaaauaguaacaggcuuggguuucugguuuccugggacauaaaauuuguaaguuaauaaauuagaaagguguuuugggauggggaaagcaaucaugcacauuucuguaauaaaaaguaaaacuggacacacccuggcagugagaaaaaaaaacaagagaaaaaaaaaugaaaaguuaaaagaccuauguaagcguacagcugucugcaucuuuagaaggcaaaugguacugagauuauuaggcagagcuaaaaaaaaaaaacuaaacaacaacauaucaaugaagacgacucaaggccuagcaaauuggcugaauuguuuucaauguaacucuguaugaaagccauaaacuaagcagcauacaccagacagaauuauaucaaaaugauuaaaaugcaaaauguuauggugguuacaggaauaagcuuccacugucuagaaaauuuauuuacuggaaauaauucaguucccaagaauccugaauaaacaagggaauagaaaauuuuauuuggccuucugcuagaaagaggucuuucagaauaaaugcuuucaguucuuuuagguauuucuggacauuaucaucuaauaauucuagauucuccuagucaagaauuuccauagagucuaggaaagcccacagcauugauguugaccuaucuaaaggaaauucauuuaaucuacaucuacuucucaaguuuccuggguuguuuuguuuuguuuaaauuugguuuugcuuuuguauuuuuaaugggaaaugaaugcaaaauccaaccaagaugaucccagaauuucagcaagucaggucagacaaucaauuaguaauauuggcaggaggcucgcuauauggaaaacacuguaaaaggcucucuggcauuugaacuuuucagaaucuguuaucuauuugcacuguccaagcauauagaugaucuuucaaagccacaaacugguagggccacuuaaauaaacugaguaauagcaauaaccucugccauuuguugaguacugugugccagguccugugcuagcagggacuucuggcaucuagccuaggagguggugcuacuauuauccccacuguacagaugugaacugaggcacagaaauguuaaauaaccugccuaaugucacaaaagccagaaugugaacccguguagucuggcucuaaagcucaugcucuugccuacuacucuaucccucuucuguugggacacagaaggcggagagaacugauggaguggggcucagucaggaaaugugccuaaaggcagugggguuuaagcugauuuuuuauggaccuuuauugccuuuauuguccaucaucucugcuuugagggcuaucacuaaucauuauuuaaaaaguaagagaaaauaauuucagaaaaccugagucaccaaccaucucugacagagggcuaaguaaccacaaaagagccacuccaaggaaagccccuggcuccucuacaacgcugaucaagaaacagucaugccauguguguaaaauggaacacuacaucaccauuaaaagcauuauguuuggggccaggcgugguggcucacgcucguaaucccggcacuuagggaggccaagaugggcagaucgccugaggucaggaguugagaucagccuggcacauggugaaacccuaucucuacuaaaaauacaaaaauuagcugggcaugguggcacacaccuguaaucccagguacucaggaggcugaggcacaggaaucacuugaacccaacaggcagagguugcgguagcugagaucaugccacugcacuccagccugggugacagagugagacucugucucaaauaaauaaauaaauaaauaaaaauaaaaaagaagauuauagaagaauaaaucuaaaaguuaaaaaaaagaaguuaugaugucugggaggcugagguaggauugcuucagcccagcaguuugaggcugcagugagcuaugaccaugccacuguacuccagucagggcaacauagugagaacccaucucuaccaaaaaaaaaaaaaaauagcugggcaugguggcaugcaccuauaaucccagcuacuugggaagcugaggcaggaagaucacuugaaguuuaggaguuugaggcugcagugagcuaugaucauaccacugcacuccagcaugagugacagacaaagaccccaucucuaaaaaaagaaaaguaugguauugauugauauuuauugguaggauagauguccaugcuauguugauaaauguaguaugaucccagugaaaaaucaagauacaggugcacauauggucauagaaauaagaccagaaggaugcaugccaaaacaucaauaguauuauccugaaugguugagaugucuuuuaaaaaaaaguauuuccauuuuuucugaauuuuuguaauaaucaaauauuauuuucauugucuaaaugaaaaaaaaaaacauucgaaagcauuuccuuuugagaguagaauauggcgugaagaagagaaaguggcaugcucccaaggacaaggaaaaagaacauguggagcaauaacuagaaacuuuccauacaccuuucacuaaacuuauuauagcaccaccagaacauaaaaguuuauuuuccuuuucauuggauaaacugaaauuauccuggcuucacugcaguuaaaauuuauaucugcuggguuucuguaugcuuggguuuuaaacagcucaguauuccgguuuuacaugacuuuacaugaaaguuucaaagaagcugugcuauauuugaaacugccaacagcccugcagggcaucaggggcuccuggagcggcugccuguguggcugcugugcccacaugaggcagguuccugcacgagggaucucaaucaggauguacaagccucaccuugcagaccucagauggcugucaccacucugccccgcauuugccacaaguguguuuuucaggacucacccccgcccuguuaaacuuuaguaggauucacaaagaauuaaaaaucaaaagucacacauuccauuuuucauugugguaaaauacacauagcauaaaauuugccauuugugacauuuaguauauucacaauguuguauaaccaccaccucuaucuaguucugaaacauuuccaucaccccaaagaaagcucauacccauugagcaaccacgccucuuuccucccuccuuccuaacccuccucccuacccagaaucugcuaucucuacagauuugccagcuucuggauauuuuauauaaauggaauuauguaauauguauucuuuugugauuggguucucucagcacauuuucaagguucauccauguaguagcauguaucaggacuucaucguuuuucacggcugaauucuuauucauuguacuaucauacuauuguucauuauaugaaugugccauacuuuguuuauccacucauacauacauggacauguggguuacuuccaccuuuggcuguugugaauagugcugcuaugaaaaucuguguacaaguuuuguguaaacaccuguuuucaauucuuugggguauauauaccaaggagugaaacuccucagucacagguaagucuguuuaaccuauuguggcacugccaaacugcuuucugcacacucuauuuuugcuuagcagcagccacaaaaacauagguacaacuuccaucaagcauagcccuuccucaccuaaaaugucauacugaacuugaaauaagaucugauagcaaaaucugaucucaguacuucuugaccaaucauuucagggaaauaaaaauguauuuuaaaaggcaguugugauuguauugaucuuguguccugugauuauuauuacuaaucuugaagauuuagauagcaaguuaccuuugccuuuagccaacauugcacuacauuccuggcacuaauauuuuauacaguauaauacuauaauaucacaguauuauuuaguuaaucuuauaaaggaugcugccaugauuuucucuugacuuuaguaacuaaagucauaagacucaaaaaaaugccaagaugcucuaggguauugagaauucuacgcagaauucugaaacaugaaacgcuaaacagcuuuauaagacauaauuccauuaaagucauccaguaaaauggugaaucaaaauuuccuuuuaaagcucugaaucucaggguauuuucuuacuuguugaaucauuaaagucuaagcaaugucuuucaaauaaacuaaaaaaaaauuaguuuuagcauaaacaagggcucaagagccuaagccuucagacccuaaggcauacaacaaaaucuaguugagccuaaauuaagccaagcagcaguuuuggcgacaauuagguagcacccuuucucauuacuuucaauuugauauucaucaaauaaaauguguuuugcuuccuguaaucagaagcugugcacaccugcucauauccuacccucccucaggcuuucucuuacacuugugggccuaagcugcccauacaaaacagaaacccuugccguauugccacuuauauuccagcaugucauacugugguuuuguucauuguugaaucugcagcuagaguauugccagacaguagagggugguagagauagcugguagaauaugugucagaggaaggagagauggcaaaauacaucacagagaguccgacacaaaugucugaccaaacagguuuugcuacaggccuaacuagaguuuaaugccauguacaaagcucuucaacuucacuggagaacaaggccaccauagauggccacuucacuuuggcuucauacugcccaccuccagagggcacaguuauagacuugugguauaagugguuucuuccggaguuaugcaacaugguggccucacaagagagaccaaggaauuccacagaaaaggagaaaaaaggggucacuguagacuaucagaaaacuacuccagcugaggucacaagcuuguuuucaauugggaggcagucuggaaaaagugugagcuuucaaauuacauugacuuguauuaaaauucuagucccacuaauucaccaguaaaugggaacugugguaaacuacucaacuucucugaaucugaguuccuuaucugugaaaugggacaagaccacuugugaaauagaauuuuauuuuccuauagaagccaggaugauauguuaaaacagaagucagaucauguucuuugccuguucaaaacccugugagggcuugccaucucucucaaaguagaacucaaaagccucaugauggcuuacaaggccugacaugaucuggccccuccucugcugucgcuaggaauucauccucuacaacccuucccaucuuucccucuacaccugccuaaaacaagccaggcacauuucaacuucagagccuuuguacuugcuguucucucuaccuagaauggaauguucuuccccaagacagucacauaggcuguuccuucaccuccuguagggcaucuuaucuuguuagaugucagcuucucugugaggccuucucuggccaaccuucuuaaaagugugaccucuggccgggcgugguggcucacacuuguaaucccagcacuuugggaggcugaggccggcagaucaccugaggucagggguucgagaucagccuggccaacauggcaaaaccccgucucuacuaaaaauacaaaaauuagucgggcaugguggcgcacgccuguagucccagcuacuugggagacugaggcagaagaaucgcuugaaccuggaaggcagagguugcagugagcugagauugcgccauugcacuccagccugggcaauaagagcaaaauuccaucucaaaaaaaaaaaaaaaaaaaaagugugaccccuuccucuacaacucuggcacuucuuaacccuuuuccugcuuucuuuuccucagugucauucaucacacucuaacgguauauaauuacuuauuuugaagauagucuuuaucucccucccacccccacuggaguguaagauccacagagaguagugguuuuugucuauuuuguucauuguugaaucugugacaccuuaaguagccccuggcacauaguaagcucucuauaacaaguagucugaugaauaaaugaaaaaugaggauuaaguuagcaagauauaaaaagcauucagcauaguaccuugaacuaugaaugcucaauaaauaauagcaauuuuuacuauuuucaccaucucacaauggagauaauuucaaguuguauuaaacugaaagcacuacuucucuuaaguaaguuuaccuuggagaaaugugaaaugcuuuugaugacucugaaaccuuagaaucuaucugcaggauauaaaaugaaaauggcaugcuuguuuuaaacagucauauucaggaguaagucuaaagugcuaaagaaauaaacuccaggugugccuucuuuuauacaaugaauagaucugaaaugcuccauaaauacuuaauuuuuagaaauugaauuagaugcccucuuucacucucuauuacauauaaagauaugcuaucuuuaucuuggucauuuuaaauuggcaguggcaucuaacaucauagcuuuaaauuccucuaauuucugucaaguucuuaaugacaagcaaggacacugaacccugaaauaaauaauaagucuuuuuuuuuuuaagaggcagggucucacucugcacccaggcuggagugcaguggugugaucauggcucacugcaaccacgaacuccugagcucaagcgauccucccaccuuagccucccaaguagcuagcuccacaggugugcacuaccacgcuuggcuaauuuuuaaacuuucuuguagagauggggucuugcuauguugcccagguuggucuccuaggcucaagugauccucucacuuuggccucccaaagugcugggguuacaggugugagccacugugccugguuuaaagaaauccuuuugaaacuaaauaauauuuacauacuauaaauaauaacagccaaauucaucugccuuguaaauugauuuuuggauauauuuucucaaaaagaaguacaucugcagugaaaaucauugacccuguugucuuauuccaaauaaauauaagcagcuucauguuuucucuguauuacuguuguauguaaucuucauuucauaucaacuauaauacuaugguuuuuccuguuuugacauguaguggaauguacaugguaauuuuaauuuauuuaguuugaaauucaguaugucuuggugcacuagacuucaggccuguuuaaguguagccaaacaaaaugagauauuuucaugcaguuaagaguaauugcuguauaccauuaacagucuauucuucauagaaguauaauuuuagaaauccuuuaaaauguucaucuauaauucuuccaugauuugguacaauaugcauuuaaacaagcuaaagcaacaguggguuuuuuaguuuuguuuuuuaaauugugucaacauuuuugguaacugguaacagcaaaugaagucucaauacuggugcuuaacuugcaagguaagcagaaggagugaauauucauuucauuuacaagcagaguucuucguuuucuaccacugccuuugcauuaacacccacuuuauguucagggauuauuugucuccaagcaaaucccaccuguuuggcuuuuuguuuuuaacugucucucacuugguucccgaugguuuagaggccuacaagaccauggugagcucugugacaaucagggggccuuacaugaugaagggugccuccaaauaaacccacagguacuuauugaucacacaacgguugaauacaaaacacagucugugccauauuggugcuuguaaucaauuuaguaauucaagacuuacucauaucaaauaauuaucaguaauauaaucagauucuuaaaucuuuuugaacacacacuuuaaaauauaaaauuugguccaggcacagaguuucuugccuguaauucuagcaacuugggaggccaaggugggagggugacuugaagccaagaguucaaggccaaccugggaaaccuaaugagacuccaucucuaccaaaacguuaaaaaauuaaccaggcaugguagcacaugccuguaaucccagcuacucgggaggcugagguaggaggaucauuugagccaaggaggucaaaguuguagugagcuaugaucguucugcuguaugccagccugggugacagaacaagaccaugucucaaaggaaaacaaaaugguauauauauauauauaugggcuuuacuccauuauaaaaguaauacauuuccaauuauagagauuuuggauaauaugcaaaagcaaggaaaaaaaagaaaagaaaaaccauacacaccccugccaccgaaauauaaccaaguaaacauccugguacacuccucugcagucucuuuacuaugcaugggcauuugucuuuuucuuaauaggugugaacauauuuucaucuuuuucacuuaacuaauacauuuccauguuauuacagacuauucugaaaccaaaaugcuaaaccauacuucuguuacuagauauuacacauuuuuuuuccaaauuuuuauauaaauaaugccauaaugagcaucuauaugcauaaacauuugucuguauuuacaauuauucccuucggaugguguuccagaaguacaauuagugaggcaaaacaaaggaacauuugaccagcuuaggcaacauagcaagaccccgucucuacagacauuuuuaaaaauuagcucgacauuguggugugugccugcagucccagcuacuugggaggcugagaggcaggagaaucgcuugaguccaggaguuugaggcuucagugaguuaugauaguaccacugcacuccagccugggugacagagugagaaagugucucaaaaaugaaaaguaaaauaaaaauuuaaaagaaacuaacacuuaaaaaggucuugacacauaguacuaagcugcuuuuacccuuccaucagcaaugaguaagagcccacagcaauggaauauccuuucaaaaaguguuuccugucaaacauggagacagaaguaaaagaaaaaaaaaaguguuuuuuuuuuuucuuucuuuaacagagucucgcucugucacccaggcuggaguggaguggugcaaucucagcucacugcaaccucugccuccugggaucaagugauccucccaccucagccucccgaguaucuggggacugcagguaugugagguaugugccaccacgcccagcaauuuuuuuuuuuuuugguagagacgggguuggcuuuuuguuuugcccaggcugguuucaaacuccugggcucaagccaucugccugccucagccuccccaaagcugggauuauaggcaugaaccaccacgccuggccauaaaaaguguuuccuaauucaacaaguaaaaaugaugucucauuuuaaucaauaauaauuugauuacuaauaaacuucaacaucucuuccccuuauuuguuaagaaauauuucuucuauuguguucugucugcacacaucccuuguccaugaauccauucauucauucauucaauaaacacugauuaaauauuaacuuuaugucaaaugauggagaauaauagaggaauggaccagauuugacccccaacccucaauaucuacauccuagaauuaaucacagacuagagggaaagccaagucaaggaagcagaaaaagugcuacaauaaagauauguccaaaagcuccgagaaaguaccccucauccagucugacauguguauacauauagcgagaaauccaggaaagcuucacagcagaggugguagcagagcagaucuugaagaugaaaggcaaucugccaaccagagaagugggagcugaguaagggaaggaggcugagaggaaugggagaaagaaucauauccucaaagauucaaagagggcaagaagagccaggugcaguggaucgcaccuguaaucccagcacuuugggaugcugaggcagguggaucacuugaggucaggaguuugagacuagccuggccaacauggugaaaccccaucucuacuaaaaauaaaaaaaaauuagccgggcaugauggugcacaccuguagucccagauacuucggaggcugaggcaggagaauugcuugaacccgggaggcggagguugcaguaagcugagauugugucacugcacuccagccugggcgacaacgaagcaagacucuaucucaaaaaaaaaaaaaaaaaaaaagagggcaagaagaugguauaauacaucugagaagcuguacaaaguguuaauaacaggcacagacauuaucaagagcucaggguaugucaaacauugaucugcuucacacacauagacucauuuaacccucaugacaauccuuucaguaggaacuugguucccauuuuacugaugaggaacuaaggcccagagagcuuuaacagauugcccaagggcacaguacuauuaauaguaagugguggagccaagaauugaaccacaauguucaggauucauagaaugauuagaauauagugaaaacaaagcaagagauaaauuagagagcuggcaggcggggcccacucaugagagaugcauguguacgccauguaggauacccagguuuucuucuuuuggugaacggaaucucuugaaggguguugagcaagacagcaauaugagcagagaguuagaagccccaccacucaggaagcaaugcagagguaggcacgggagugcaucugagaugaagagaaugggcugagguugcagcucagaggcauaaacuagaauugaaugugcugggccucggauggacucuaagccucuuguugaguguuagggagacagggccaucauggaagccagcuuuggacagcaggagggacaccuuuucuaccgagaugaaaaaggaauggcaaguuguggaugugggggcaugggugugguuuacaucucaggaucucuauaugcucuauuaaccuggagaugagguuuucuguuauaaauuggaggaaaauggugaaguuaggagcuuaagagugagaaagucugaaauauccauuguggagaguggaaacagguacaacuaggccuugauucccuccuuaacugcuucuucauccucagcuacucacugauccaucaguuguccaguuugucaucugugacuuugauuucuauuggcccuuuccuuuuggaccuuauugguccuuuccuuucagcauauagaauguucaugucucucucaacuuaaaacaacagcaaaacccagcccaugaccuucugcccgguaaagucauccugguaguguccaccagccuggcagaaccugucuuccacagcagccuggugacaacaagaagccacagcagcaguguuuggcaguggucuggcccucuccagacaaaauaagcaucccugggguuccuggacaaugaagggcaaaggaaaagagaacaggucucaagaauauacugacaaaucuccaagaggaauucaagauaauauggcaaaugggaauuaaaugagaaaguaaaagagaggugaccauaugccaaucuggagcagguggaaugugucaugaugguucaagggcaaucaagaguucacauuuauggugaggauuucucuugauuuuuuuuccuccugucaucuuauuuuguguuuucaguuuuucauguauuguuaccauuaccuuauauugauugcuucuugucuuuugcaauacauccuaaauauagcagguucuugaauaacaucaccucguucaacaucauuuuaugauaauguugauggggaaaaaaaaauggcuccaggcuggagccacugucugcaugaaguuuguacuuucucuccaugucugcguggguuuucucugguuucuucucacaucccaaagcugugcacaugaggugagcuggcaugucuauauggucccagugugacugaguguggaugugugagugcacccugcgaugggaugguguccuguccagggcugguucccaccuuguacccugagcugcugggacaggcuccagccacccaugaccuugaacuggaauaagcacauuggaaaaugaaugaacaaaugaauacaaauuaggauaaaauaaaaacucaucaagucuaugacaauaaaggacaugggacaaaagcgcucagcaagccugcucuacuugugauuuuuugguuuugaacugcaaggugggaaaagaugcuccuuacaauguucgcucugcaaacauuuauucccugauuuaacccaucacuaccauggccacugccacucacugauucaccaaaauuggguaaaucauugucuuguuuuuauuaauuuuuuuuuuugagacagaguuuuacucuuguugcccaggcuggagugcaauggugugaucucagcucacuguaaccuccgccucccggguuuaagcgauucuccugccucagucucccgaguagcuggaauuacaggcgcccgccaccacacccagcuaauuuuuuguauuuuucguagagaugggguuucaccauguuggccaggcuggucucgaacuccugaccuuaggugauccaccugcuucggccucccaacaugcugggauuacaggcaugagucacugcacccagucuguucaucuuucuuaaauguauguauaacucccauuuauuucaaugcuugauauuauaaguguuugggucuuuauuuagaaguuuggugauuuuuuugugaacagaaauaugcuauaggaacuuaacuuucguuuaucucaauuagccuaagggaaaauugguuucauuauaugucauucaccuaaagucaguuucugagaaccuauugacagcauuaaggauuuaccauauuugguuugcucuuagguucugcaauuccauuuagaaucuuauucuugauuaacuugaaauugcccuaaaauaucuuaaaccuauauauaccuaauuaucaaagaaauggaugaaauaugauuucacauucagauaaaauaugaggaauuuugcccuuagucuccuuauacucucuuucugaguuucgguuauuuuaucuguggcauaacccauuucaucuaccuuuuuaauuuuucuaaucaugucauucaccucuuugaaacaauguuuucacuuugaauucacauauguaaguguguguguguguguguguguguguguguguguauaaaaccuguuuuaauguccaaugcugcuccaauuuuuaaagauaugauguccuccugaguucuuaauuuugauuuuuucaucauauucuggauuaaguuauuaagguaauauauuacuuugagcaauuuacuaaagaaacuagauauuuuuuguuuucuuaaagguuuaaaaaacauuucuauuguuccaugcauaaaaaacaacuuguuuacccucaaagcacugaagauuuaaccacugccucuguguauugccugaggucauaucuuuuuggguuuuagggcauugguucugcuggugauggugguauuuuuaagcguuguuuuggauaaguuugcuuugauucuuauaagagucuucuaugugaccuuucacauuuuuaccaagguauauuuaaugaucucuuuucguauauuuuacagggaucagagugaauucucucaauuuacaaauacuuuacuuagcuuagaaaaugauuuuuuuaaacgaucuuugauuaucacuuuagcuacauuuauuuaguucucucucuaccuucguuucugcucucuucuuugucauuguuucaaucccucucuaauuuugcucucuuggugguauuucuaaagauaguucucugguuuauuaccaaguuucugcaguguccaguuuucuauuagugccucuaauuuuuaauucagaaaauguguuuuguaaguucuaacacaucuuucuuuauucuucucugcuugcuucucaaaauggcuugcuccugcugagacucugauauauuuuguugugaccauaaugaaaauucuaaggccccccaaccaucugaauggaccccuccucucaaccaagggcauuccaaaguuaaccugaaaaacuaguucaagccaugaugggaagugggagccagacaugcuucauuauacccuccucccuuguggaauuacugauagaacagacuuuuuaaguccauuagaaacauguacaaucuauucucucugaagccuguuaccuggaggcuucaucugcauaguaaaaccuuggucuucacaaccccuuauaaugacacagacaauccuuucuauugguaauaacucuuucaacccauugcuaaucagaacaucuuuaaaucuaccuaugacccgaaagccugccccacccccgaccccuucaaauugucccaccuuccuggaccaaaccaauguacaucuuacauauauuuauugaagucugaagucccccuaaaauacauaaaccaagcugugcccugaucuacguugggcacaugucucgggaccuccucaggcucugucaugggcaugucccuaacccuggcaaaauaaacuuucuaaauugauugagaccuuucucagauacuuuugauuuacaauaacguaacuaguuuccuacaacaaacaaacaaaaacuaacuuuucacacaauaaaacuaacuuuucagaaucuguauggauucuccuguacugcgugguuuaguuuuucucugcucaugcaacuuuacaaagaggucucuagaacaguccugggcauugguguguggcuaugguucacaaauuccacaggcucugucacagauggcaugcauguguauguguccguguguguagacagagggagaguggucaaggaaaggagggaccuaguuguauccauucuaaauaaaugugccaaaucacuaugaaaagagggcacauuuauuuagggaaggagggugggagggaggaagaaagaccagcuuuugauuuagagaccaagaagccaaauuugggauagguguuugguaggaaaagaagaggaugaggggcagaguaaaagcugggagccuugugccaauaccccaaccacugacaaaggaauuccaagagaggcucuccaugcaguguuccagaguuguguaguucacaaccagcacaacccuuagcaguggcucuucccugggaccacugacucacauggaagccccaggguagacuuuugggcuugugcucaauugacaaauagucauuaaggcaacuaggucucucaugccaggaaauaaaucaaaaaggcagaaauauaaguccaucaaugaauaaaaugauuuacuuccuucccagaauaugaaguaggagaauuucuuacauuuuauuguuguggcuuauuuuuuuuauuuguuuugggucuucuaugaagaauucugagcuugggagaggguaguacugggcugagaaucaaaucugaauuagaagucauagacacgaucuaggcaaguuacccggcuacguuuugacaguggcuggaauuuugaaacuuuacaaugucaguaagaaaucauuuucaauccagauaauguaaugagaacuuguucuuggcuccuuguuuuaaacauucugugcuuaaauucuauguaauggaucccagcauguaaccacagaacaucaguaccaaauauagcaguuuucaaaguaauggaagaaauccauaugcugauagcuucaucucuaaaacuuagguggcucuaaaucaaaaaauaaaguaaauaugcucaccuaguaaguguuucacauuucuacuuauaaaauauaagggaaaaugagcacgaauuaauuaagaucaaacaaaaugggggagcugguugucaguuauaacccuaacuucccugccacuucaggggcccagccauauuccagcuuagggagggagugugcaacucuagcaggcgcuggcacaaaguucuacccagguuacagaauggugacucgcaggguccaauuuguacugagcucauuugucgcaaugguaacuagccacaaccagagccacuucaugcccaagccuccugcagcagagaauuaaaccugcaugguggcagcagauacaaccagugcaggggccucugugccucaaggggcagugagcuuuucucaaagucauuuccauucccucugugggauacugcaucauugccuucaauacuucccucucacuaucuaugcccuuuccugugucgcuuugcugucgcacucucuaaaggggcacaauuuuccugcucuuugacaauggggucagccacaggacuuguucuggccaagagaaugacguggaagucaaagugugccaguucugcgccuaggccucaagaggucuucuuguuucccacucugacugcacuucugccaucgccaugagaacgacauacuuggguuagcccgcugcuccuugaaggagaaugacagacauauggaacagagccaucccagcugggcccagcucagaucaacgaacccucagccaacccacggaccuguaagcuaaauaaaugugugugugugugguuuuuuuuguuguuguugcuguuuuguuuuuuuguuuuuuugcgugacagauauuuucaggucauuuauuacacaucaaaauucuggcaauugauuauugauguacucuccuaaguccugccuucuugcacuuucuucuccuucacaccccagugcuaugaggcagcuucaaaccccaguguuaagcuggaccucagaaaguuggacaccugggcuauggcacaugaugccucuggcagaauuaauuugacugaacaguauucugauggaaugauauuauuuucuucuagggaauacugucagaaacagccaccuggaccuuaucccuggguauccuggggcacgcuacugagaccaccacucaccuaccagagaguccuuucugugaguggccaguggagaaagucuuucuugcacucugcauuaggaucccuuuuccuaagcaacuuggcuuauuguugcuuuauguuuuuuguguuuuggguuuuguuuuuuguuuguuugcuuguuuuuugagacagggucucacucuguuguccaacuuaagaguauaguggugugaucacagcucccugcagccucgaccuccccagguucaggugauccucccaccucagccucccuaguagcagggaccacaggugugcaccaccauguccagcuaauuuuuauauuucuaguagagaugggguuucaccauguugcccagguuggucagaaauuccugggcucaagugguccaccagccuuggccugccacagugcugagacuacaggcaugagccaccacacccagcuuauaguuacuuuaugaacaccaugaacggaucauggucuccuauuuugcacugacuucuaggaagcucagagccaggccuguggcugacugcuaguaaaugccucuaacuucagagccuguaaauauacucuguaugccagccccacuccuggcuccccuguucuuucuuacuuauauuuuuucuuuuauuuuuagcauuugcauauucauuuuauccuacagaacugucuacaucuuucuagcuuaccuuaaauccauuucugaaacaaggcaaaauagauaaauauaaaaauacauacaauagugagaagaagaacugaagggguauuuacucagaaaguguuuuuuaauccuaccccaacugcccccauuccaaaagacagucuuccagaaaaggcagagucaaggaaaaagauuuuaaucacagccaagaucucaaaguugguggagacagcugcugagccauccaggggcacauacaugcuuucuagacccagaguguaaguuccauguggccagugguaagaagaaauggauggaacuaaugucauggauauuugcuggcuuaguguuuagcauauguuaauucaucuaacgcccccaguaagccauugaaugauucucauuucacagaugaugaaccugaagcauuagagaggcagaaugaauugucaaccuuagcuaguuugauucuaaaucauaacucaugaugaaauugcuagacugccugaugcaaaucccagcucugcaacuuaauauguaauucuggguacauuccuuaaccucucugcuucuuaguuuccucaucugcaaaaugggaauaauaauagugcccacuuuguaggauugcugugaggaguaaaugaguuaauauguagaaagcauuuagugcaacauuugucacaugguaagcagcaagcauauaaauguuagcuuuuaugauaauuauuaguaagugguagaaugaaucauccuucaagaaaggucaaaauaagucuaggaaugcccugucaauaugauccuauuaagugagugaaaauugaauccaaacaaaaggcaccaccuuuguucguucauucauucauucauucauucauucauccaucuauucuccaacuaacaugcaugugggaauaaaaagauaugcuggguagcaccagccauaaauaaaaugaguucaaagaggcaaggauuacucugagcugcagugguaaggaacaucuuaagagaagaaauauaauuuaguucaugucuucaggagcaggcagaagaaacuggacagcaaaggagagaccccuccaaaauggugugggaagagagugacccagauuggcagcacagaaccagcaguccaaggccacagaugaggcuggcacucccaaaaggcagcucauucaccucugagccucugucauccaccaugggacccaauacagagcacaugcacaauauauguuuauugaaugaagaaagaauaaacuuacaugauuaaacacuguacuauguggcacgccuuccauacccaguacuuugaguugcaaaauuuacuugaaugaaaagcagccuggcagggccugcccuaugguggcccaagugccauuacccuccugcccugcgguauccucucauuuuauauccuaauuuuuacaucacaauucucccucugaggaacuacaaauuagcauuuacuuacugcucccauuuuuaaacacaaaauuugcaaucuaauuaaagaagaaaucauggguggcacuaaccaggucauuuguuagcaacuaaauggcuauauagcggccuugcuuuuauucauagaagcuucauuuagaaaacagaccauuagaacacuguauuuuggaugaaacaguaguuucacuguuaaugauuuccucauuuccacaagaauauaaucauggaaaaagaaauaaaauaaacacaauauaaauauauauguauauauaaaaccccagaaaaagaguugguccuuuuuccacucuuuagaaacauaagaaacacucuaucuguuuuggcacaacauuauaugauuuauuuauucuaaaaugccaauaauuuuuucuagcgucccauaaaauucaagguuauaagaauggaugugcuucaaaaauagaaagagagaagccuaagcgugauuaagauuuuuaaauaguggaacugauuuuaacuaggccuauacgaucacagccaaauccaguuuagcauagguauuaauaauaaagugacauucccuaauaauaacgugucuagucaguauuuuccccaguguaauuuuagagagucuuauggcaugggagagagauugugcauggcaaaaugguagacuaggcagcaauuaaaacucacacuccuggcugagcuugugaaaacagagagaaauguccccagguaccaacgcgaagagguagcugacagccagagaggaagaugaacaagcuaauagguggcagcaggaugagagguaguugggguggggaggaagugggaucaaacccuuuagcagguaagagcuuagauuuuuuaacacucaccagggcacaaacgacaagaccuccaguccaggagaguagcaauugggaacuccuacacauuaaaccuaugcauaaagcuagaacuguaaaaggcugcaagugaagugaaagaauuaauaaauucuacccauuggacaagagagaugacaaugaggcuuuucucugcugagucucuagguauaaaaaaaauaaguuaucugauagaaaucaaagccaauauuccaccuaauaagaauuuggaguauaaauuuauuuugcccacuuacuauauaaagcucugauacaguucacauguuuguccccuccaaaucucacauugaaagguaauccccagcguuggagguggggccuggugggagggauuuggaucauggaggcagaucccucaugaauggcucagcgccauccccucagugaugagugagcucucgcucugagaucacaugagaucugcuuguuuaaaagaaguugacaccuccuuacucucucucuugcucccucuuaccauguaauaugccagcuccccacuuugcuuucugcccugauuguaagcuuccugagcucucaccagaggcagaugcuagcaccacacuucguguacagucugaagauccauaauccaaaauuaacauuuuuucuuuauacauuacccagccucagguauuccuuuauaacaaaaaaaauugacuaauccauguuccaaggcaauuaauuaacaucaaaauuaacaugaaauuagaccaguuuauaagcuagccuggaaagguaaaaucaaaauuacucaaagaguucuauugccagaugcuaaaauuagcaggugaguuugagaaaaaguaggguuugcauagucucaaagugucucuuucaagguauuuauuaaaugcaaaaggaaagauaguaacuuuccaauggagaaagcuggcagacauuaccugaaucaagugaucaaggccaacaucaccaguaguaagacauacugacaucaugaaccacuugauaugauguucuaagaaggagacaacaucauuucugugguauucuuuccaaaaguguauaaucucaguccaacuaugagaaaacaucagacaacuccaaauugaacaacauucuacaaaauaauugaccacuauucuuaaaaaguaucaaggucauaaaagacaaagaaagguugaggaacuguuacagaccacagaagacuaacaugaaacaacuacuaaaugcaaugugggauccuggauaggauccugggacagaaaaaugacagugaaaaauugguaaaauucaaaugaaguuuuuagucuguagaacugucccaguguuaauuguuuggguuuaauaauuacacugugguaagauguuaacauagaaaaagcugggugagggaaauaugggaacucuaguuugguaaauuuucuguaagucuacaauuaguucaaaauaaaagauuuuuuaaaaacuacucuaaauggucaacccaagcaacaaaggaacaaugaaguggaggaagaaaguccaauuuaagaugagcucagaaaacaaaaggaaacaauccacccuaagucagcagauauaacagaaaaauuggcauuccaugaauuugggacaauagaacaaaaaucaguaaugaaccaugaaauuaugauguuuaaaauuauuaaagagauaaaacacagagaagccauaagaaaagaacaagaugcuacggaaaaggauggaaacaugaaacacaacaauuaaauaguacuuaaagaauaagaaggcagagucacugaaucaaugaacuagaugggagauuuaaggaaaauuccagaaauguagcagcacagaaugaaaaauaaaugaaaagaaugaaagaucaaaagacauggagaaaaaagaggaguuugacaggauauuaagagauaacaagaacagguugagaguuugagaaggaaaacaggcaaaaugaacaagagaaguuauuugaagagauaauggcucagaauaauucucaaacugaagaauuauaaauagucccaagaugcauuguaauaaaacugcagaacaccaaaaacaaagaaagacagccagagggaauaaaggcuuaugacuacaaaggaacaauuauauuaacaagagacguaccaacaauggaggcaaaagacaauagaguaucuucaaaagaucaaaggaaaauaguuaaaucuagaauuauguacccguuuaaacuucaaaaguaagagaaaaauacaugcauugcagaaauuaagacuuaauucccagguuuaugaagcaagucucauuaaauaucaaagaauuaagaagaugcagacaauguucucuaacuaaacguaauaaaaagagaaauuaagaaccaaaugagaguaacuucauacacauauggaaaugucaaaacaaacuuuuaaauaacuaauuggucaaaaaagaaauaauacuagaaaauauuuauauauggaggauaauaaacacuaaauacaccacagcuaaaguaauacucagaaggcaaauuaaagccuuaagugcauuucuuagaaaagaaacacugaaaaucagugaaacacauauucaagucaagaaguuagaaaauaaacacagaaaaaguacaaagaacaacaugauaaaaauaagaauacaaauugaugaauuaaugaaauagaaaacaaaguuuaaaaagaggguuaacaaguuaaaauuugguuguuuaaaaaaaucuaaaaaacaacucuaguaaaauugauuuuuugaaaagguacaaaucaacaguaacaggacuaaaaagguuauaaaaaauuuaaaauuaggugaaaugggaaaguuucuagaagcuacauaauuuucaaaaccaacucaagaagaaauagaaaucuggaauaaaauguauuagaggaagugaaucauuaaaaaucuacccacugaaaaaaggaagggccauaugguuuuacagacaacuuacacaaaaccuuaaaaaaacugacaauaccuacauuuuacaagcugcuuuaagaaacagugaauguucugaaacucaucuuaugaagcaauuauaaaacacacauuugacauggacaaaggugguaugagaaagaaaaaguauagaccuaucuccuuuaugaauaaagaugugaaaauccuaaagaaaauaucugcaucuaccaaaaacucauaauaagcuaaguacuuaguaaaaauaucuuuuguaagguaaggaaaaagacaaggagaucugcuauuacuacucacauguugcauuguaggcccuagccaauauaauaaaaauagaaaaaaaaaucauaaggauuagaaaggaagaagcaaaucugucauuauuuauaguuuauauaauaugguccaaaauuaaaauccaaaagaaucuacagacucugagaauucaaaaaauaaaaugagaucaauauacaaaacauaaucggguggaucacaaggucaggaguccaagaccagccuggcaagauggugaaaccccguaucuacuaaaaauacaaaaaucagccgggcgugguggugggcaccuguaauuccagcuacucgggaggcugaggcagagaauuguuugaacccggguggcggaggcuguagugagcggagaucgcuccauugcacuccagccugggcgacagagcaagauuccaucaaaaacaaaaaacaaacaaacaaacgaaaacaauagcauucauacauaccaccaacuagaaaauguaauuuuaaaguaaauauaccagcuacaauaacaauaaaacuauaaaguauuauaaaacaagauacauuauauuuauggaugagaaguuucuauuucaaagugacagaaauuauguccccaaaaucagguggccagcuugugcagccaugccacacaacucucagacugaaacugagauggaggguaccacaccagcugugcacauguggugucacugccgugcccagggauccucugcauuugagccacugcaccaccagacaacccacaaacauaccccagaacccacuauaauuuuggcaagcacaggggaccaguagguccccuggagaucuaauuucauugugggcugccccuaagggagaggggagcacagcccaccaaagcauucuuugggacaaaggaaugaugggugugguaccaacugcugaaggggauauuacugaugccugggaacagauauggagagacgggucaucucucaccccucucccaguaacuguuggagaugcagcagcagaucuccccaccagggccccaugagcaugcacugaaagaaagcacuguucacacuuuuccgguggcuccauucccccugaaagugaaugugcacugaaagaaagcaauuuucacacuuuucuggaagcucuaccuccaaugaaagucagagcacacugaaagaaagcacuuuucaugcuuuucuagcagcucuaccccugcugaaagugagcucacacugaaagaaagugcuugucacacuuuucccacagcuccaaccccacugaaagcaagcccgugucugcuugugcuugcacaaaguguaaggcccaacucccccucccuaaacagaauggcagugcccuagcaaugaaggacagaccucggaguuacccucccuggacugugggaauaggcucugcucugacccccacucuaaugguagccaucagaaagguggauucacggcccacagccacacaguggcauagaaccaaaggacaaaaccuuuacaaacaggucgugagcccuugagagugacaugauaagaaaauagauggauuccugcuggucuaagacaagaagcuggugcacuccccaaacccgccucugagacuucauuuuuuuauuugagauagagucucgaucuguugcccagacuggaaugcagucauauggucaugguucacugcagucuugaacuccuggguugaagcaauccucccaccucagccuccccaguaucuggaacuacaggugcacacuaccacacucagcuaauuuuuaaauuuuucuuucguagagauucagucucacuauguuaaccaggcuggcuuugaacuccuggccucaaguaauucuccuaccuuggccuccuaaaauaugggauuacaggugugagccaccaagccuggucccccaagacuuuagcacaccaucaucucuuccugccaccaccaucagggcaggugcguccaccuggacaccaaccuaccuacuggcugcuacucuuaagcaccaucuacuguacugcagccugaacugcaccaccaaacaaaaaugcauugcuacaauaagcagcaucugacaaagccacagcacagaaccuaucugcaaccaaggaaacuguacagagcuuugcccccugaaagcacccagaaaugaagccaaucaaucacacacaacauacaccacagucauacccucaaaggaaaaaagaauaacaaauuuuuagaaagcccucugaaaugguagcaaacccaaaaaaaaaaaaaaaaaaagcagcaacagccucagaugagaaggaaucaggaaucagcacaagaacucuggcaguacagaaaaccagaguguuuucucaccugcaaaggaucacacuagcucccuagcaauggauccuaaccagauugaaaugucugaaaugacagauaaagaauucaaaauauggauugcaaggaaacucaacaauauccaagagaaaguugaaauccagcacaaauaaaacagaaaaaugauccaggaaaugacagaugaaauagaugaaauagauauauuaagaaagaaccaaacagaacuuuuggaauugaaaaguucacuacaggaauuucaaaauauaguuugaagccuugacaauagacuagaucaaguagaagaaagaauuucagaggucaaagacuggucuuccaaguuaacccagucacacaaaauaaggaaaaauaauuuuaaaaaugaauaaaaccuuugagaaauaugggauuauguaaagugacccaaccuaugacuuacuggcauucgagagagagaaggagaaaaagcaagcaauuuggaaaacauuugaggcuauaauucagaaaaauguccccaaucucacuagagaggucaacaugcagauacaagaaauucagagaacuucugcagaaugcuauacaagacaaccacucccauggcaaauagucaucagacuaucugaggucaaaacauaaggaaaaauuuuaaaagcagcuagagaaaagggccaaauuaccuguaaagggaaucccaucagacuaacaguagaccuccuagauuggagaccuauuuuuagccuucuuaaagaaaauaaauccaagccaagaauuucauaccccaccaaacuaagcuucauaaacgaaggugagucuuuaccagacaagcaaaugcuaagggaauuaaucaccaccagaccagucuacaagaaauauuuaaaggaguucuaaacauggaaaugaaagaacaauacuugcuaccacaaaagcacacauaaguauaaagccgagagccuuaugaagcaacuacacaauugauacuacaaagcaacuugcuaacaacacuacaauaggaacaaaaccucacauaucaauacuaaccuugaauauaaauggccuuaacgcuccauauagaagacauaaaauggcaaauuagauuaaaaaaaaaaaauacaagacccaaccuucuccuguuuucaagaggcccauuucacauguaaugacauugauaggcccaaaguaaagggauggagaaagaucuaucaugcaaauggaaaacaaaauagagcagagguagcuauuuuuguaucagauaaaaccaacaacauuaaaaccaacaacaacuuuaaaccaacgacauuaaaaaaggacaaagaagggcacuauauaaugaugaggcguucaauucaacaagaagauuuaacuauccuaaauauauaugcacucaacaucagagcacccagauuuauaaaacaauuacuacuagaccuaagaaaagacauagauggccauacaauaauaguggaggacuucaacaucccauugacaggacuagacagaucacugaggcagaaaacuaacaaggaaacucugcacuuaaguuggacuucugaccaaauggaccuaauagacaucuacagaauacuccacccaauaaccacagaauauacauccuucucaucugcacauggaauagucucuaagauugaccacgugcucagucauaagucucaauaaauucaaaaauaucaaaauucuacuaagcaucuucuuggaccacaguggaauaaaauuagaaaccaguaccaagaggaacucacaaaaccacacaaauacauggaaacuaaacaacuugcuccugaaugacuuuuagguaaacaaugaaauuaaagcaaaaaauuauuugaaacaaaugaaaacagagacacaacauaccaaaaccugugggauacaguaaaagcaguguucagaggaaaguuuauagugcuaaaggcuuacaucaggaagacaaaaguuggcagcauuuccccuaauaacugcaacaagacaaguauguccgcucucuccacuucuauucaauauaguauuggaaguccuagccagggcaaucaagcaagagaaagaaauaaaaggcauccaaauagggaaaaaggcagucaaaucaucucuguuugccaauaaugugauucuacaccuaaaaaacuccaaagguuccuccaauagacuccuagacaugaaaaaugacuucaguaaaguuucaggauacaaaaucacugcacaaauauuaguagcauuucuauacaccaauaacauucaagcugagaaccaaugaagaaugaaaucccauuuacaauagacacaaaaaauaaaauaccuaggaauacaccuaaucaaagggugagauaccccuacaaguagaacuaugaaacacugcugaaagaaaucauagaugacacaagcaaauggaaaaacaucccaugcucauggauuguaagaaucaacaucauuaaaauauccauacugcccaaagcaaucuacagauucaaugcaauuccuaucaaauuaccaaugucauuuuuuucacagaauuagaaaaaacacauuucuaaaauucauauggaaccaaaaaagagccucaaaagccaaaguaaaccuaagcaaaaauaacaaagccagagccaucacauuacccaacuucaaacaauacuacaaggcuauaguaaccaaaacagcaugguacuuguacaaaaaauaggcacguacuaauagaucaauggaaaagaauagagaacucagaaauaaagccacauacccacaaccaacugaucuuugacaaagcugacaaaaauaaacaauagagaaaggacacccucuucaauaaauggugcugggaaaacuggcuagacaugaauuggaucccuaacucucauuauauacaaaaaugaacuaaaaauggauuaaagacuuaaauguggcugggcucaguggcucacuccuauaaucccaacacucugggaggcagaggugggcagaucaccugaggccaggaguucaaaaccagccuggccaacauggugaaacuccgucuccacaaaaauagaaaaguuagcugggcaugguggcaugugccuuuaaucccagcuacucaggaggcugagguaggagaacugcuugagcccgagaggcggagguuacggugagcugagaucaugccacuguacuccagccugggugacagagugagacuccgucucuaaaaaaaaaaaaaagaaaggcuuaaauguaagaccuaaaacuaugaaaaccuaggaaaaauucuucuggacauuugccuaggcaaagaauuuauauugaagaccucaaaagcaaauguaacaaaaccaaaaauugacaaacgggacuuaaucaaacuaaagagcuucugcacagcaaaagaaacugucaauggaguaaacagacaacccacagaaugggagauaauauuugcaaacuaugaaccugacuaaaggacuaauauacagaaucuaaacuuaaaucaacaacaacaacaacaacaacaacauucgaaagugggcaaagaacaugaacagacacuucucaaaagcagacagacauaaaagcagccaacaaacaugaaaaaaugcucagcaucacuaauugucacaggaaggcaaauuaaaaucaaauaagauaucaucucacgccagucagaauggcuauuaaaaagucaaaaaauaacagaugcuggcaaggaugcagagaaaagggaaugcuuauacacuguuggugggaauguaaauuaguucagcuccuguggaaagcaguuuggagauuucucaaauaacuaaaaauagaacugccauuuaacccagcaaucccauuauuggguaucuacccaaaggaaaagaaaucuacauuuucuuuauccaguccacuguugaugggcaccuagguugauucuaugaggugguuauugugaauaccacuuuuauaaacauaucagugcaagaaagugugguacauauacaccauggaauacucugcagccauaaauaaaagagugaaaucauguccuaugcagcaacauggaugcagcuagaggccauuaucuuaagugaauugaugcagaaacagaaaaucaaauaccacauauugucacuuguaagugggagcuaaacaaaacguacacacauacauaaagauggaaauuauagacacugaggacuccaaaaagggggagaaagggaggaaggcgaggguugaaaagcuaccuauugaguacuauguucacuauuugggugacaaggucaguagaagcccagaccccagcauuaugcaaaauacacauguaacaaaccugcacauguaccuucugaaucuaaaauuuuugugaaaaauuucuguccucaaauuaauguauaaauucaacacaauuccaaucaaaauacaaucaccuuuucauagagcuagaaaaaguggucauaaaguucauauggaaaauuaaaagucugcaaauaggacaaaucugaagaaaaauuagaacuuacccugcuuauauuucaucgugacauaucaugaugcuauaguaauaaaugaaaacagauaauacugauuuaagaauagacaagcaaacaaacuuaauaaaauuggagggcuuagaaaccaauucauauggauauggguccaugacauaugucagauguaucaguacaaaccacuggggaaaggacagacaaugcaugauacuggguugauuggcaaucuguguguguguguguguguguguguguguguguguguguguguguguguguguguguguguguguguuaaccuagacacaaaaauuaaucuuagauuaauuuaagacccaaauguggaaggcaaauguuguaacuuuuagaagaaaauggagaagaauaucuucauauauguggggcauacauaauuucuuaaacagaaugcaaaauucacaaacccauaaaggaaaagauggacaaauucaaguauaauuaaaaauuuaaagcuuucaugugacaaaacacaccauauuggcacuuuuagccagugcaauaaagcaagcaaaaagaaaucaaaggaauccagacugaaaauaaagaagugaaaaugucuuuauucacagacgacaggaccaucagcguagaaaaacugauagaauaaaaaggaaaauuaccagaacuaauaaaugaguuuagcaauguugcagaauauaagaucaauauacaaauaucaaucuuauuucuauauauuagcaauauacaauaagaaacuaaauuuuaaaacauuauauuuaugaaaacaucaaaaauaaaauauuuagugacaagcuugacacgagaugugcaagaacuauacccuaaaaacuauaaaguagggguccccaacccccaggccacgggcugguaccaguccguggccuguuaggaacugggcugcacagcaggagaugagcagugggugggcaagagagcaagcgaaucuucaucuguacuuacagccacuccccauugcucgcauuacugccggagcucugccuccuaucagaugagcagcaacauuagauuaucauaggagugcaaaccuuuucgugaacugugcaugcgagggaucuagguugcacgcuacuuaugagaauccaaugccugaugauuuguuacugacucccaucacucccagaugggacccucuaguugcaggaaaacaagcucagggcuccuacugauucuacauuaauuauuauauauuauaauguaauaauaauagaaauaaacugugcaaugaauguaauguguuugaaucauccugaaaccaucucccagccaugacaccugggccuauggagaaacugucuuucaugaaaccggccccuggugccaaaaagguugaggaccacuguuauaaagcauuucugagauaaaggaaauccaaaauaaauggagagacauaccacguucauuagucaaaaggcucaauauugucuccaaauuuaucuguagagucaaugcaaucucaaucaaaaucccaacaggguuuguuauagaaauugacaagcugauaccaaaguucaaaagaaaauacaaagauccaguauagagccaaaauaacuuugaaaaagaagaacaaaguuggagcacuaacacuaucagauuucaagacuuacaaagcuacaguaaucaagaaaaugcgguauugguaucaaaauggacaaauacgucaauuggacagaauagaguccagaaauaggcccauuccuacauggacaacugauuuucaacaaggcaauucaguggagaaaggauagucuuuucaacaaaugaugcuaaaaaaaauugcauauccaugugcaaacgagcaaaacuuuuuaacaaauacuucacacccauacaaaaauuaacucaaaguggaucauagcccuaaauauaaaaucugaaaugauaaugcuucuagaggaaaauacaguagaaaagaaaccuguguggccuuggauuaggccaagacuucuuagauacaauaccaaugcauaauccauagaagcaaaaacugauaaauaggacuuaaucagaauuuaaaacuuuugcucuuugaaagacacuuuuaaaagaauaaaauccacagagaaauagaaaacauuuggcaaucauauaucugauaaaggucugguauccagcacauacuuuuaaaacucucaaaauucaguaauaagagaaacuaaaaauggacaaaaggcuugaauagguaguucaccagauauauggauggcaaauaagugaagaaaagauguucaacauuauuaaucauuagggaaaugcaaaucaaaaucacaaugagauacuacuacacagcuauuaggauagcuaaaauuuaaaagacagaccauaucgagggugauaagcauguaaagguacuagaacucuccaagacuccugguaaaaaagaaaaauauacaacuacuuuaaaaaacaguuuggaggccagggcaguggcucacgccuguaaucucagcacuuugggaggcugagguggguggauaaccugaggucaggaguucaagaccagccugaccaauauagugaaaccccaucuuuacuaaaaauacaaaaauuagccaggcgugguggugugcaccuguaguuccaucuacuugggaggcugagacaggagaaucacuugaacccaggaggcagagguugcaaugagcugagaucgcaccauugcacuccagccugggcgacagagugagacuccaucucaaacaaacaaaaaacaguuugggaaguaaaaaagaaaaaauaaaaaaagauuggccgggcucaguggcucaagccuguaaucccagcacuuugggaggccgaggcgggcagaucaugagaucaggagaucgagaccauccuggcuaacauggugaaacccugucucuacuaaacauacaaaaaaaauacaaaaaauuagcugggcgugguggcgggcaccaguagucccagcuacuggggaggcugagguacgagaacggcgugaagccgggagguggagcuugcagucagccgagaucacgccacuccagccugggcgacagagcaagacucccucucaaaaaaaaaaaaaaaaaaagaacaaacugaaaaaucaagaacucuucuuagaucugucagagaagugaagucacagggcaaaucacuguccccaaaauuagacagacaagcaggaacauacagagaaucacaauuuacuggagcagaaaccucugugggaaccaguacugagguagaaaacucuggacuguaauuggaaugcuggaggcucaauguggauaugccugagggauaaaaacucuugaggucucaggacacaguaaugccagcuacuugagaggcugaggugggaggacugcuuaagcccaggaguuugaauccagucugggcaauguaacaagaccccacuucuaaaaaagaacaaaaaaaauuuuaaugccuuuuaaaacuguagacggcccagucaaaguggaugagggggguugggcggcgagccugcacuuaagugaauuuuaccuccacgaucuccaucagguucucacagugacuauuaaaaaauauguccucagacuucuggcagagagaguagcaaaguaaccacgagccugaccuacugggguuuuaucagagccuaacaaccugggguaaggguaacacucaacugcagccugcucuagccauccacaugggggaagggaaauacgugacuccaguccccuccagacauccggucccaucuagaguagggggaggggaggggaggaacugaggguacuucacaguccaagggcacaggcucacuaaaagacugagaccuaaucagaggacuagagaauauuucccugcccccacaccuuaccaucacaucacuaaaggccuacuugccacaguuccuuuuauuuauuuuuuuaauuuauuuuuuugagacagagucucacucuaucacccaggcuggagugcaguggcgcgaccuaggcucacuacaaccucugccuccuggguuccagugauucucccgccucagccuccggaguagcugggauuacaggcaugagccaccaugccaggcugauuuuuuuuuuauuuuuaguagagacagcguuucaccauguuggccaggcuggucucaaacuccuaaccucaagggauccgcccaccauggcuucccaaagugcugggauuacaggugugagccacugugccuggcccacaguuccuuucacccaguacaucaugucuggcuuucaacaaaauauuacaagguaugcuaaaaggcaaaaaaaaaaaaaaaaaguuugaaaauacaaagcaucagaaucagacucagauauggcagagaaguuggaauuaucagaccaggaauuuaaaacaaacaaccauaauuaauaugcuaugaguuacaguggaaaaauuagacaauaugcaagaauagaugaauaauguaagcagagagauggacauucuaagaaaaacucaaaaagaaaugcuagcaaucaacaacacuaugucgauaaaaagcgucaaauucuauaauauuugaagagauuuaucugagccaaauaugagugaccaguggcccgugacacagcccccaggagauccugagaacauaugcccaagaugguugaggcacagccuaguuuuauauacuuaaaggagacguaagacaucaaucaaauacauguaagauauacuuguuuggucugaaaaggcaggacaacucaaagggcgagggcuucuagguuauagguagauuuuaaaauuuucugaugggcaauuaguucaaagagguacguuauuaucucaagauccugaaucaauagaaagaaaugucuggguuacaaugauaggguauuguggagaccaaaguuuuaucaugcagaugaaggcuccagguagcaggcuucagagagaauagauuguacacguuucucaucagacuugaagaguauguucuaucaguaauuccaaaagggaagaggguauaaugaaguaugucugaccccugccccucaucauggccugaacuagucccucaaguuagucccucagggauacccuugcugagaggagggauccauccagaugagguggggggcuuugaauuuuauuuuugguuuacaacuauaacagaaaugaagaauacuuucaaugggguaguaaacuggacauggaugagaaucucagaccuugagguuaugucaaaagaaacuuccaaaaccaaaaugcaaagagagaaaagacugacaaaaaaaauggaacagaacauccaagaacugugggacaacuacaaaaaguguaacaaauagguaaugggaauacuagaaggagaagaaagagagaaaagaacagcagaaauauuugaauaaguaaugauugagaaauucccuaaauuaaugucagacaccaaaucacagauccaggaaacucagagaacaacagacacgauaaaugccgaaaacaaaacaaaccaaaaccaaaccaaaacaaaaauacugcaccuaggcauuucacauucaaacuguaggaaaugaaaguuaaagaaaauaucuugaaagaagcuacagggaaaaaaaucuuacccauagaggagcaaagguaagaauuacaucugacuucucagacaccaugcaagcaagaagagaguacacugaaauauuuaaaguguugagagaaaaagaccaccaaucuaaaauucuguauccugugaaauuuuuccuuugaaagugaaggagaaauaaagacuuucucagcaaacauggagggaguuuguugccaguagaccugccuugcaagaaauguuaaaagaagcucuucgaagagaaaggaauucucuagguaaaaaucuuagaucuacauaaggaaagauagugcauuagagaaggaguaagugaagguaaguaaaagcuuuuauuuaucuuauucuuaagugaucuaucauaaaaguuuguucaaauaauagcaacaauguauuugauuaugcaugguuuuauacuuauguaugcuuauauguaagugaaaugaaugacagcaaugauacaagagaagggggaaggaguacuugccuacuggugaagcuaguauaguguuaucugaaacugaacuuaugaugugguuugguucuguguccccacccaaaucuuauguugaauuauaauccccaguguugggagagggaacuggugggagguaauuacaucaugggggcagauuucccucaugcuguucucaugauagugaguucucaagagaugugauggucuaaaagcauguggcacuuccccgcuugcucucucucucuuuccugccacccugugaagaagguucuugcuucccguucaccuuccgccaugacuguaaauuuccuaaggccucccagucauguuuccuguauagccugcaaaacuguaagucaauuaaaccucuuuucuucauaaaugacccagucucggguaguuauucauagcacugugagaacugacugauacaauucggauuaguuguaaauguauauugcaaacucuagagcaaccacuaaaaauuaugccacucaauagcaccaaaaauaucaaauaucuagggaaaaaucuaaugaaagauguagaaaaccucuaaaacaaaacaaaaaaaugauaguuucuuacaaaguuuaaacauacaccuaccauaugaucaagacauucaacuccuauguguuuacucaagagaaagcauacuuccauugggggggggugguggguguuggaagggggaaggcagcgugauagaauuguuuuguaucuuuauugugguggcaguuacacaacucuaggaaggcaucacaaccagaacuguacaccaaaaaagugaaucuuauuguauaugaauauaauuuaaauuaaaauuuuaaaaaucaaauguggucuuagaaaaggagaccacaucuucuuuggauggaaaacacaucuaaacucacaaaagccuccaccucaccuggcugaauucaggugaaaggaagagauucccuacuguucuugcagauggaagacacaaguacaaagaaucuugacgugcacacacacacacacaacguguguauguaucuauauauauccacauacauacauauuucugcauuuuaauuauauguaugacaagggaaggucuuugaacaagagauucuuccaagauguggcaugagauuucucuaccccugcauuuaaaaaacuggaaagccaugaccuugaggcacuaaaggauaucaaauuguucuccaaauaaccaaaaauuaaauacuucgugugaaugcaguauaguuucaguauuucauuucccuggaaggcauugauguaugcuguuccaguuaauauugcuuuuuaacaaacuacccuaaaaauuaacagcuaauaacacccauuuugcuauuuucaugguuucugagagugagcaauucagacagagcacagaagaaugucuggagcuuuaacuuggaagauucuauaacuggaggcuugaauuaugccugacaagggccauuagcugagauaucagcuggggcucucaaucaaauuaccacccacaugugguugguuucuccguguagccugggcuucuucauagcauaguagccucaagguggcaggaccucuuacacacacaguagcucagacuccaaagggaagugucacagcagacaaugcacaaccugcaucuuuucuagcuuggccucggaagccacgcagcauuacuucugucauauucuauugguuacauaugagucacaagcccacucgagauucaagggaggugccaagaucauacacuggggaaaagauagucucaucaauaaauggugcuaggaaaacuggauauccauauacaaaagaaugaaaugagaccccuaucucucaccauaucaaaucaaaaauaaaaucaaaauguauuaaagacuuaaaucuaagaccucaaaccaugaaacuacuacaagaaaacauugggaaacucuccaggacaucagucggggcaaagauuucuuggguaauaccccacaagcacaggcaacuacagcaaaaaugggcaaaugggaucacaucaaguuaaaaagcuucugcacaacaaaggaaacaaucaacaaagugaagagacaagccacagaaugggagaaaauaucuacaaacuacccaucugacaagggauuaauaaccagaauauauaaaaagcucaaacaacuuuauagggaaaaaaucuaauaauaugauuuauaaaugggcaaaaaauuugaauacacauuucucaaaagaagacauacaaauggcaaacaggcauaugaaaagaugcucaacaucauugaucaucagauaaaugcaaaucaaaaguacaaugagauaucaucuuaucccaguuaaaauggcucauaucccgagagacaggcaauaacaaaugcuggagaggauguggagaaaagagaacccuuguacacugcuggugggaauguaaauuaguauaaccacuguggagaacaguuuggagguuucucaaaaaacuaaaaacagagcuaccaugugauccagcaaucucacugcuggguauauauccaaaagaaaagaaaucaguauaucgaagagauaucugcacuuucauguuuguugcagcucuguucacaauagccaagauuuggaagcaaccuaaguguccaccaauagguaaguaaauaaggaaaacgugguacucauacacaauggaguacuauucagucaaaaaaaaagaaugaaauuugcucauuauguuaagugaaauaagccaggcacaaaagacaaacaucacauguucucacuuauuugugggaucuacaagucaaaacaagcaaacccauggagauagagaguagaaggaugcuuaucagagaggcuagaaaggguagugggggagaggggagggcagcagguggggaugguuaauggguacaaaaaaaaauagaaugaaugauaguauuugauagcagagcagggugaccauagucaauaacaauuuaacugcauacuuuaaaauaacuuagagugucauuagacuguuuguaacacaaagguuaaaugcuuaagaggaugccccauuuuccaugaugugauuauuaugcauugcaugccuguaucaaaacauuucagguaucccauaaauauauacaccuacuauguacccacaaaaauaagaaauuguaaauuaaaaaagauucaaggggaaaugacauagcccuaucccucagaagaagaagggucaaguucacauuauaggggagcauguuggauaggagauacuguugaagcaaucuuuggaaaauauaauccacuauauguguaguauacaguuucuuucaguuaauaagaucauugguauccagcauuccucaguuaacuaagauauuauuuuagugagaauacuucaauuuuuaagaaauacgaauguauuacauaaggaaacuauugaaaacuauaagauuugagaaaacauaaaaggccaguauuuuagcuuccuuugcaaaggagauuuugauauuuuaacagucaaaacuauaccauagaauaagaaaaaaaaaguauggguaagacaucaguaauuaaauaagaauuugaaaauuaugaaaacucuuccauuucaaaauuauauucuaaagcucuagaauuauuuuuuucuuuacuuuaauauaaaauaugcuggcccauaauauaagaauuccaaauaagcauuuuaagaauuuaagaugaaccuugaucccuacuucacaccauauacaaaauuuaauuugagauaagucauagacuuaaaagcgaaagcuaaaaccauaaagcuauuagagggaaacauaggagacuauccuaggcgacuuugagccagccgaaggcaucuuaaacagaucacagaaagcaacaaccauaaaagacugacaauguggacuuggaaauguaaacugauacaaccacuuugguaaaaggucuggcaguuucucaaaacacuaaacacacacuuacuuuauguaugacccagcaauuccauuccuagguauaaccaagagaaauaaaaacacauguuuacaaaaauauuugugccaggaauauucagaccagguuuauucauauuagccccaaaucgaaaacaacccagguacccuuuggcaggggaaugaaucaacaaauggugguauauucauacaauugaaugcuacucaguaauauaaaggaauuagugauacacucuauaauacgaaugaaucucaaaaucauacugaacgaaagaagucacaaaagaguacacacuguauaauuccguucauaugaaauucuagaacagagaaaaaccaccuauaguuaaaaaaaaaaaaaaagcaccuaaagugaaaaaaauauauaucagaacaguaguuaccucuugaauggcagaugugcacaggaauugacuaggauggagcaugagggaacuuucuggagugaugguaauguucuauguguuaguagggaucuggguugcacaagcguacauuugucaaaacccagcaaauguauaaaguuugugcauuuuauugaacauaaauuucacaucaaaagaaaaacuauaaauaaauaguaagcaugcuaaaauauuuagagggagguaacugaugucuaugauuuucuuugaaaugcacgaaaauuaagauggguuaauagauggauauaagaauguauaaauggagagaugugugacaaagcaaguaaaguuaagagguuaauggcacagugguggauauaugggguguccacuguuuaaucuugccaaauuuucuggauguuuuaaaauuuucauaaaauguuggagaaaaugaauggguaaaacaugcuaauuugauaggaauuugaaaauuauaaaaacuauuucaucucaaaacuuaacuuuaaaccucugaaacuuuguaauugcagaaacauaaaauauuguggccccuaaaauaagaauuuuaaguaagcacauuacaauuaugugacuguagucaauaaucagaguagguagaguaccaacuacagcaaccugugcgcuacucuaugauuccaagccucuugacuuuugcucagaacauucugccagcaucugccauuagcuguuucuggaaacugaagcaagaaauaaaaaauguucuuucugaaaaacuguuccauaagcucuuuucccaggcuuuuugguuuuauuuguuuggguuuuauuuuauuuaaauugaaguuuuaaaaaauaauugcucauuguaaaaaaaaguaaaaaucaaggaaugaagcauacuccacuaauagcuucguguguagccugcuagcauuucuucaaaggauauacauuccuugaaauauuuauauaaauauacaugcacacacaacuuuuacauuuuuggcauaaguaggauauuaacacacuucuggauuuugcuuuaucuacaaaacagcacaacacauaugugguagccacucauagcuguucaccaagaucugguuucccuccuucuucugagcacaugagugggguccugugacuagugcuagccaauaaauugagaguguaaaugauauguauuucuugccaaguaagaauuuguuguacuugacccuccaaaauucucuuuccuuuauggcaaugugacugcgaacauucaagguaguggcuauucugucagccucagucucugaguggcuacuaugaacaaaauuccccugacaaccacaauggauacauaaagucagcaaacaauaaaccuugguugguuuaauucccugagguucagggguuguuguuacugcagcauuacuuagacaauccuaacugauacaucaaacauuuuuucuguuaugccuauguggucuaccucuuucuaauggcuaaaaaauauugucugaaauuaaugcaauagaauauauccaacuauuucccuauuguugggcauuuuauuuuucuaaauguuuacuauuacaaaauuugcugcaauaaauauugugcaugcacauacacauauauuuaucaauccaccuguccaaauuuuuuucaaauaaaaaauuucuacaagugcaacuaccagguaagagucuaaacauuagacacauucugccgauugcccuccaaaaugcugaaccaauuuaaacuccuaucaguggaaaaugagaguaccuguuaccacacauguucaccuggagucaguuauauuauucuuuuuaaauguugccaauauaguaaguggaaauaauauuucaucauuguuucaguuugugucauuauugggcaucuuuucauagguuuaaagacuauuuguauuucuucugugaacuauuccugccuuugauccauuuuuguguguugauuuuauaggaguucuuaaguacuuaauguuaauccccuggcucuuacacugguuauaaauauuuucucuuagucugucccuugucuuuuaaguuugugauagcuuuugccauagagagagauaaaauucuucuguagucaauauaaucuuuccuuuauggcuuuuggaaacugugcuccaccacaaaauaagcguauaaaggcauuuucuaguugacugucaccaaaucuuuauuaauaauccauucuuucucuacugauuugaaauguucuccauacuuauacgaaaguucauaaaaauagcucuucuauagacucuacacuguauuucacugauauuuuuguuucucugcuagaaaauguuuucaaauguauguaaaucauauaccuuucuaguaucuacauuuuaauauucuuuucaacauuuucuuggauauucucaaccccuuauucuucuugaugaaccuucauaaucaaucagucaauuuaucucccuuaacccuguuaaacaaaaccaaaucuaacaacagcaagagcaaaaaccugcugugcaauucugauuggaauugcuucaaaucuauaaauuuggaaaauuagaauuuucacaauauugucuucccauucagagauaucaaguuuaaaaauugcauucauuuuagucucacgcuucuuguccaauuuauucccagauauuucauuuuuguugcuacagcaaauaguauuccccuuuucagaacacuucuuaacuaguuauugcugauauaaaguaaagcuauuguucuauauauagcuuucuuauauuuagcuacuuuccugaauacucuuaauaguuccaaccauuuuaaaauugauuccuuuggauuuuccaaguauacaaucauauuuggauucuaauuuuaaaaaauuagucuucaguucuauuuugaacuauuuauacagugauuccuaaaugccuauuuccacaauaccuagaguaacaaaauaauggaauuuuaugucugggaggugccuuauaugaucuaauccaagaauuaccuagucuaguaccuacugggguagguauguaagauaaauaggagaaagugccuuagcgugagacaauaaggacuuguagaaacugagaagaaaugcagagaacaggcucuaucuaaggagggcaagugccauucacccccaaaagauuguugccauagagaaauguggguccaauuucuauuuuccaagaggcaccagauauauauauucuuagguuuaaacucccaauuuuaaaaacauuaaacaaaagccauacaaaauauaacugccagcuuucaaccuauaaaccuguuuuuaauccaauaccuucauuuaaggcaauggaaacucagaaaaguucaucagagauugcaaaaguagccaagcguaggggagggcuuugccucuuguuuagcugcuuggcgagucaaaacaauauuuucaaaguacuaaaacuagguaggugcuuugucccuguugucaacauauauucguguucccuguuuggcucauguugguuuggauuuacuaucccugcaauauucauggcaaaugaaaaggguaucuuuuauuuauucaauuuccccccagcuuuauuaaaguauaauugacaaauaaaauuguauauauuuacagcacauaauguaauguuuugauacagguauacauuuagaaguaauuaacucaagcuaacucacauaucuaucaccucacaugcuuauuuuuuuguggugagaacauuuaagagcuacucucuuagcaauccaaguauauaauacaucauuauucacuauagucaccaugauguacaauagaucuccagaucuccagaacuuauucauccugucuaacugaaacuuucuacaaaggcuaucuuuuaaauagccuuucuauauuuggggaaauucccacguaaguuuccuaccaccccaacauagaggucagagcucaauuucccagacuuccuugcaguuagaaauaugcaggugacccaggcucucuaccaaucagggaagcuuacuuaagacugugccucagaagggauuaacagaagaaaagcagcucagggugggccacguuuggugucaaaggagcccagccuucaggggugguaaaggacgauugccagaaauagugguaguuauggcugugguaaaaucaaguucuuggcagcaaugcaagugcagcaaugagucauggguggugguaacagaggucauuuucucaucagacaaguucuacagcccuguuuugggcacuguuccuauaguucagccuugagcuuguuucuccagcccuuccaaagacacugugaaccacccaggcuccuuuuaauaaauuccuuuuuuuuuugcuuaacuagccagagaggauauuccuuuuuaaaacuaagcccucaccaauacaaacaccaccaccagacagugacagaaucaaaucaaagaucuccaucuuuuugauucccaggcuagcauucuuucuacaacaucacauuauuuauauuuaaugcuuuuaggaaaguucaaaaugcuguuuucaaaaacauauauggaaauuuccauuuugaagacaggcuaugaauacuguccaagaaucuauuuaguucaugauaagaaccuauguuugagugcuuugggauuuuauuugucuuuguuuuugcuuuuguucauauagauucauagacuaguggcuuccuuaaaagaugcuagauugcuuacaauaaaaaacaccaauagcaauguacacagaguaguccaaauaaaaauagggcaaaaccauauaaaaggagagauaauuguccuagauaaaucaggaugagaucauuaccauguucuaagcacuaaauuuacaauuugcuuccgugaaguaaaggacagcaauaggguagauuauauuaauguuucccagccuugguccaccaacaaugauguuuauuauuuuccaucuucaaggccuacaaguuuuuagaguuucucuuucaaccucauuuauuaaagaauguuuugaaugacccccaccaugaguaaauauaaagcuuauugaaauacuggaaacaagauguaccuuccuauuacuguuguuggugacaccaguucacaacuauugggauaaagcauuuucacuuucugaguauccaccaugcacuagucagcuacaauaagaauuuuaauaucaguaucaaauguauucaucacaacagcuguguccuauguauuacuauccccauuuuacagaugaaaaaauuauucagcagcuuccccaaggccacuaagcugguaaacaagagagccaagagcuagaucuggguuugccaacuccaaaaccagugauaagaacuauuucuauuauauuaccucuuuuaggaagaauuuuaguuuuacaagggagaaaaucuccuugagguucuaaaucuuagaaggaauuuauuacauggauguucacaggagagcuacugacucugcaacugauaacggggaccugaagaaaaaaucuguaauaauucacuauguucauugaggucugauacacuggguucuggaggcaucugggaaagacacaagagugaaccaggcaugggcccugcccucugagagcuuccccagguggagagaagagacaagcacucagcuaaccaaaauacacacaggcuacauggggccaggugucaucucugauggguagaucaaggcucagggagguggccagagagauggacugaccacaucuuccuuggcauugggcucucagugcugcugcugcugcugcugcugccugugguucagaguccagggcccucacugggaagccccacccugccuauguucccaacugcaugaaauacuagcccugccaagcuuagucccugcccugcucccugcugaaaucugcccaccacugccaccagguaucuauccuaaggcucuaagaaagguuaucugcacucucuuggauaacgaucagcagcucucacaggcgaaucugauagaccaugccaaaaagauucuaaagaggaucaaugaaacagaagcagaaguggugaauucccacaaggcaaaagagaaauguucccuacccaaauaaaaaaauuaaaaaaaaaaaaaacaaaaaccauucccuacuucuguuuccugauggcugccugucccugcauuccaucaggucuauucugaggcaaauaucuccgagaggcccacacauuaauccauuauugaccauggcaccuuauacagagguaguuuaucagcuccuacccucaaaguuuuucugagaggagaugcacaucucugagaaaaagggcaaugcugggggcuuggaccacugcccagagcagcaggucugggccccgaagccccagguguaugcugagagugccagguaucuaagcagaagagagucagggccacagaggccaagcccauaggccuaugcugcaguccugccuuugcuugccucugcucuucucuacuaucucaauguacaaauuugaaaagagaacauuuuacaagaauauuauaaacuuacauuuucagaguuuccaguugucagagccuagaagggaccucagagaccaauauaugaacaaaugagugagauacagguaggugaagugaguugcccaaguuacuuggcuagugaggaucaggccuagcuucuccuuacuucccuaaguaagagccagauggcccuucccuggugcaaggaaaucaauuauuuacuugauugcugcaagcuuuagacugaacguuccuugagaaauaggaucguucauuaaauuauucagcaaacaucuauugcacuuggcaggagcugauguggaggcagggaagcaaacaaguaacaacuugacaggaggcuaccagugaagaguagguauaaagcauuuagcacgaugcuuagcccccaguaagugcucaauacaugguggcuucuacaaaaguauucuucuagugagauggaaauacggagcuaaagguaggcaaacucaugugacacacugaugcaggguuaagagcagaagaaugauccgaucagaguuuaggaaggucacucuggcaaaacuuugcaggaugagaguuaagaaaaagagaucaguuacacugcucuccagaggguccaaguaaacagugaugaaaagcugaacuacaaccgugaagcugcagauguaaagaagggaaaguucccagagguaguucaagacguauaauuccaaagggugagugggagaggucgagagaggggagaggggagacacaaagccaacaccuggucuggacucuuggggaugcccaugauggccuuuaucaggauacagucuccuagcugcuacuuuaugaaagaagaaaaugaggucaaguuagggaaaguuauuucugggaugccuaagagacaugcgagggggaaacgucccagagguauucguguuuccagguuuauagcucaggagaaaggucugagcuugaagaacuagcauggacacaaucagccuacaggucaaagccaaagcagugagggcuagauaaaauguacacauucagaacacauguacacagggaggggaacaucauacaccggggccugucggggggucgggaccuaggggagggauagcaucaggagaaauacguaauguagaugauggguugaugggugcagcaaaccaccauggcacguguauaccuagguaacaaaccugcacguucugcacauguaccccagaauuuaaaguauaauaaaaaaaagaaaaagaaaaagaagaaggaaggaaggaaggaaggagaagagaaaagagagaagguagaacacaaaagacacaaaagcagagaauuaucucagagaauuauuucaucugaggcauauuaaacacuaaacaaaaaaaaaauguacccauucaacuaguauuuauuaacacccuauuguuugccagacacugaaauaagucauaaggcuaaagcagaaaacaagaaagagaaggucccugcccucaaagagguuauauucugaugaggagagucagaauacacacacacacacaaacacacacacacauacgcauacauaaugaaaggaaaauauuagcuaguaaaagcacugagcaaagaauugaauuaggguaugaugugauagacacgggcuauguaguuccuuuuucuuugcucaaagaguuugaaaagcauaagauggggcugaagacaaggugcagggaccauuugugggcugagcacaaaugagcagccccaagcacagagggcucagcauccggcaccaagcaugucauauggauugagacaucuagacucuuggucuacgcucucauuugaaggccaugccaucaccuccaaacuagaacccccaggaacaacucuagugguucauuauuucauuuaguaacuauauguauugagcccagcaguaggggaugcugcagggaacaacaccauugaguuccccacccucagaaagcucacauucgaauaggagaagacacacacagcacauacacauagauaccccacccccaaguaaacagaucucuaaauaaaauaacugcaaguugugcuaagugcugugaaaaauauaaacaaguggcuaagaauaacagcaggugaucuacucuagauaggaucuagaaagccccucugaaugaaagccccucugggaguuggcauuugagaugaguccuagagugugccaugcagaggaugguggugacugcauuucaggcagagggaacuuggugugcauaggcucagagacaggaaagagcuugauguguuugagaaaccgaaagacagucaguaaggccaaaagacagggcugcagaaaaagaggugaugacacuggaaauacaaacagacucacaucacucaaggccuugcuggcugcagucaaauguuuggaucuuauugugaggacaauggcaagccacugaaggauuuuucaagccaggcgaaaccugaucugaguuucauuuuaaggaauuucugggacggggagguccuucuuuuagagcaugcagcuccuugaggccaccccuccaaucacagcguaguggcccuuuaucccacccacaauuagggucaggccuccaucugcaaagcaacuuuuccuccuuggaucgccugccuggccuaagugcuucccaaaaagcccuauaaacucacuaaaguguuuccaauagacuuugcgagugcuggaaaaauggaugcuuuuguaaaaggacacaaauaauaaaacgaaaccacucccucauuucugauggaaauuucuugcuuucaccuccacugccuuccauuagcccauggccuguguaauugucucugcucuuuacugucuccauuuauuuuccaaaacacuaugaacauguguaugugacuaugaacaauaacaaagaacuauaaauucuuauugaucccagaagguugggaauucuaaacaauaaaaauauguccucugacugcuucucuccaaagaacauuuuggagacacaaaagagcuuuguuaaaacaacaaaugagcucuugggacacucugggccuaauggugggcuccaggccaccagguagugaugcaauaggcgacugcagacacaaaguuggaaagaccucccugcuacccucuccugggcucacuuccucauuucucagcccacaucuugacugcaucaagcggaguuuacuauauagcuuucagccacuaucguugucaggagccagaauucucagccuaaagagaaaguccccuuuguccuccauccaugauuuaauuuauucuccuaaaugcuccauucacuuuguuuucagccuaagaagucucacgauuguacuagacccugaauuugaauuucccuguguuucugcuguuuggaaauuugccucggucagccacuggauagucccagaauucagcuucaccuuagagaaaaucuuaaucaugauuuguuauaauauuuccaacuacugucauauauuuuucccucgauuccuauauuuucaugucuuucagaauacacauauguguguaagcacauguauacacagaugcauacauaucaccuuugcucugauaaucggugaaguuuuuacuauuuuccaacuucaucacauuccuggagaugucccuccuuugucccccagauuuugguagggaggacgugcucuuagcggugcuuuuuucugucuuucucacucagaugcaucauuccuggcauucugcugauccuucaaccuccugauucauaagacaaugugaccagcugacuuucuaugcucuugucccucuguucucauguacaaacuccuuuuauauguaaauucguaacauuuacuagaguauucguggccaaaacuuuaccacaaaauaauacaaacucaaagaaaugccaauuccuaauaaaaaauaguuaacugauuaggaaagaaauaguucucucuguucuuuggacaaccuugaggggaaaacaggugauuguuagcagaauauggcuuaccugaauguauuauaauccaccauauuugugugcuuagagucagcagcuuuaaauaccugcuugagcucucuggauuuuccuucuucuugcuucagcuuuuguagggcaaguuugagguuacugaaaggauacuguaagggggaaaugaaaggaaaaacauauuuaaauauuccuaacaguucaggagcccaaucuugcugauggccagcaaagggacuucacacugugaauaugaaguuagcagauuugucuuugcaaagaaaccaacaccgagaaggcaugacuagcuuuguaucuccucaauuaaagcuucuggacaacagcugacaucagcauaggccccagcucugagggaaaugagcuuaaggaacaccaggccacagagaucagaaaacaaccccugcuuccaucucagccuccucccucuaacccuuggauaguggcccaauauguugggagauccuaauggagaaaauggggauucaaaacuggauaaguagcccuccauuuucucuagaucuuuagaauggggucccccuggaacugcuguccauuaggcaacgcacugaugagagcaaggcuggguaucaaagauccacgcaagcacccuaacccucgcacagucauucucugggccguccacuguuccugucucuuauccugugacuagcuuuuugacuugguaagaauacuucuugcauccagugaaacauaaggucguaaauaauuauagguaagagaccaaaaaugagauuaaauuuuaaaauaaaaauauugauggcaauuuagucuaaagaucccucucucccaccagaaaaugauccaggugguuuggcaccuaucgcagaccccuacuccucccacuuuuuuugcauuuccuuucaucuauuuccaugacaggaucuauuagcucuuuugaaaagauuccucaggcugauauuaaauaguauagcaauccuucucugcuuagaaugucuuuguuaagggcaguuuuaaaauaaugcaguuuugacuugggaugcugauuccagauaauguccuacccugcuuuuauuguccucaaaggaaaaaaaaaccuuuauaucuuauauuuaugcuauauauauuuuauauuaagguauaggcucacccucugauuagaaauagaacucuaauuuacaauagcaacacugauugagcuuaccaugggccucaugguuagcucagcgcuucauacacauuaucacaucuaaucuucauagcaauucuaucaaacaggcacuguuguuccucccauuccaaagaugaagaaacugaaguucaggaaaaauacaauaucuaaggucccucagcuauuaauguggagucagguucccaagccaggccugcuggucuccagaaaucuaaacucccaauuacugaguuucucaucuagauucaguguuuucgaauagcuacugguucaagguuuuaugauaaccugaaucccuaagacuacaaauggagagauggcauggcagccauggagggcgcuucucaggccuccuaucaagagagacccuguggagaagagcauuguuggcugacagacuccagcugccauaccuuccggauucacacagaguucacaggcaaugucgcugcuggggccacacucuccccaagcuguucccacccaaugacacagcacagcagggggacuagaaccaggugauuccugccugacaggggaccucucugaugggcagucugugcucuggggcuccccaucagccugguugagacuuucucagagcuguguugucagcugaggcucucccuacccaccccuccuccuuccuuucgcucuccuuccauagggguucaaccugccucccggucugaagguccccccugcccacuccugcccccucccccuuuauccuucucagaaauuuccaccacaacaucucucacacuucucauucugucuuggcgucugcuucucagaggauccaaacugauaugaaugaugugauguacacagagacaucaaucuuagcaacuuaaccccagccauuuuauauauaaaugagacaaaauuggcacuguauguauauaaauggcacauaaauauuaucacuuauagguaaacuuuuaaaauaaaauuuuccagauagauuuuuccauauuaggcaaugacucccaaauaaacauguuuguacaccgaacuaguccacauuuaaaaucaagauuuuaucaauauguuauuuuuaccgaacagcauugccauaauggcacuugcaguaacaguacccaucugccaucuuauuucaaaaaaaaaaacucuuugagcucacuguugccaguuuauccuuaaauccuuauuuaggccucagguggcuacuguuaugggaaguuguaaacccagcaacuauucaguucccuugagguuucuguuuguucaggucuuggccuucucuguuggccugugccaauuaacugggacggcacaguguguggcaccagauuuuucuuccuuuccuauaguuguugaauuucuuucugaaaacauuguuagcgucagcagaaaacccaggaaacuugauucaacccuggcccugccuccugccugugccuggaauccgugaugcugggcagaagagaacccagcauguaaacagaguagacaagaaccuggccucugugaugggacauguggccaagucacacgaauccauuauucaugcccacaugugugaaugcacaauguacaacugguggcaagaugaagaagaaaaggcccuagagaaagaaaaacacagacugcggagggcugagaggcaagucaagaauuauacaaaguaaauucaccuuaucuguauucugcuccauguaguuuaagguauacucaucagcauugagcaaacgaaauagguaaccauucacauucaccgugacuccaauguacagcuccucggccuugauauauucagauaguucacuuuuaaagacuucuuguccaggcuucuuaacgcgacuucuuuucaagaacaucccaccagcaauuccuauaaaaaauagaaaaguucaugagcagccuuuauucuuaaaagaaccacgugacuugccuucagaguuacuuuaucuucaagcacagaccaccauauaaguuaccugugaacucauauugccuguuauuuuuggacuuaagggaagaaugaggcagugagugaagaaauaagacuuccuaggugaggauguucaagacaaaaagcaaagccaggcaugguggcaugugccugcagucccagcaacgcaagaggcugaggcacgaggaucacuugaggccagcaguacaagaccagccugagcagcauagcaagauuccaucucaaaaaaacaaaaaaaagaaaaaacagagaaaaaaugguguguaauucuagccuuuucuucucucugucuacucccuucccaguccaauaaacacuuggcaaggaccuccuauauaugcccagcagcauacugggaguguggaacaucaggaaggcacucaucuuuagagcacguuugaacaguaccaguuagaaaauuccucacuugugcuuauuuccaccuauuugucccagaugaugucuuauacuuaaucugacgugcagauuagguagcaaaugcccuacuucuguaaaggagauuacuuaaguguuuaaagauaacuaugggaguccccuuaagucuuuuuuuccuacagguaaaauuccuuugcuucuuuuaguaaugccucauauuucuuacuuuccagaacugucaucauuucaucuguucucuucuagacauuauuuguuuugaccucuuggaaaguagccaguagaguugaacagggaacuccaggaucuucugauacugaacugaaaucuacagaccuauaaauauagccugagaccagauaagcuuuuuggucacuucaucccacuccuccuaccacauucaa[450 bp omitted]cagcucucccagccucuucuggcuccuuccacauuuucccucaccagcauucccccuauuaaaucucuugcauauuuaauccugucuuggcauuugcuucuuagaggagcuggacuaacacaaaaccuaaccucauaaaguccuuguaaggauaauaguaaguucucaaucauggccacuaggauuacuaguaagcuuguuguugacuaccaucacuccuuucuauuucauacaugcugcaacuuguuuggccacaucuuccccauucuaaguguauagaguugauuuuugaccuguaagagcaugacuuauauucaucccuaggcaauuucauauuuuaagauuugauccauuauucaaaucacucuggagccuuaguuauacaaguuauuccuuacucauuggugugcuaaguagcucauaccagcucauaggagcugacaguugaauuuucagagauuuugcaagccaguuuuuaaacucuuggcugcuugaaauuggccaugguugggguauucacaccauggaaacuggcaaacaguacaaaucagggcuuuuaaaauauuuucaaagagccaguuaaccagcacaucacugauuauucuucccaaaugcgugucuucagcacugauaaaaguucuaaacauguugagacaaagaacaggauccuacagugccaugauugggcaagucaaugccucuccucagcaaugacagugguaccagcauauuacagagaggcauucugugggccugagugcuggaaccuuggcaacaaccucaacagacagaaggaccagauaaagauggacccugacgauugaauuuguguaucugggauucuugucuuacagccaaacaaaaauguuguaaguaggacuaccaagaauacagacuuccucuuggcuugcuggauacaaguaaaacuagugguacucagaccaugauuuugaagcccuuggguuccacagagguaccucagaggccacagcggaaguggggauaguggcaagaaggagguaaccccaggucucccagcccuaagccaaccaaaacuguuccacuucuaucauuuuaaauguuuagguucccauuuaagagaucuguaaaaagaacccuauuguucaggguuuuuuuuuauaaagccucuauuguagauaaucuaagcuacaaaaucagaucauguucccuaauuuucaacaugaagagacacuuaaaauguucucaagaaaauacugugaagaguauaucucuuaccugaauuccucucuauagguucaaacacugaaauggugucaucaccgagauaauaugaaauaacaaacauccuguccaagucaacacauuugucugugacuaguuuugcaaaaaaacggaguauauugcuuuuggagccauagcuaaauggaagagaaaugagaguuagagcauuauacagguaaucuuccacauauuauguuuuuaaaagucugcaaaagauauaauauggcuuuaauauaguaggcauaaacuguccaaagugaaagaguucaaccaucgucuaauuaagguucuaaaucuaaaugcagaggaauuuucucaguauauuaagauaucucugauucuuuacauguccuggguaacacauugggaaaaugaacccaaaacaaacgucauaaacacacuguucaaaccagcugcacuaacaggcuguucucuaaugacaaggcuagucaccaaucacaauaaucaugcuggaaagaagagcaagcaccuagcccuacugccugggcaauccugggcucugccaguaucuggggcuaccucccccauucaccacucacugucucaugcccuuuacuuuucugucuuccagcccacauccuccccucucagacucacuccuccagcuccccagcaaccccccaacuuccuucaagggaaaaauuaacuuuuccuuuucaaaugcuauaacaaauaugauagacccaccuuuuuuuuuuuuuaaauagugcuuaucacucguauuguaagccauuacaagucuguuuuccaaggacaaagauugucuuauuaaccauuaucuaauauaauacuuuuuacauuguaaguauucaauaaauguuuauggaaaauuguuaugagaucuguauugauuggaauuugcacucagaauucuaugcauaaauagaauagucuaguagacuaaagauaggaucaaauuauagaauuaaaaguuaccaaagcugauugccuggucacugaagaaauugauuuauggucuguagcagaagcaugucuguggauauccgcuagugaaagguggacuuuguaagaaacaguaaacccuuggagaggucuuugauaacuaaaaucauuaccccagggagguacacaggagaauaaaccauguccucugucacaacucuaagcagagaagucuucccuugcagggucuccuauacugaaaaucauucuuuccuuguguucacagugauuuaaaaaauaaaccaaguauuucugauuugcagaggcaaaaagugcuuuucucugcuccuuucucaggcuguacaagaauccgggcugaaaaaggauagcaccaagauuccuaggcuugaggccccaugugagacggugugcagcaguuuggaaggcucaccccagaacagccugagcaaagcagccaggucugcauggcuguuuucucuguacccaguuuccaggcuucagacagaccucauauaguguggggggaagcuaugccuugucaaccaucuucucugguauauaauuggauuuauauguaacaaauagauuugguagccccucucacacaagaaagccauaacauuucagauacuagaaauaucacugaaacaacugaggaaggucuaacuucaggaaaaggaauauuacuguaaauuuaacuucuuauaauuuauaaguguacauguuaaguguggguuuuucacacguucaauaugccuuuuuuuuuucaccuaaaucuaguguucuggagaucucaucaauugagaauauaaucuacucaauaaaacuuuuagaauagcaguucacaaaguuuauuauauauaaaagucaccuggggagcuuguuaaauauauagaauccagaguccaauccccagagauauggggggauucaguaguuagcucacaucuccagaaaccugcauuauuaauaagcaccccagaagauucugauaaggugguccccugggcauacuuugagaagcacugcaaauguuuucagauauuucccuaauaacuacuuuucaaacuucccagaauauucuuuuuuaucacaaugcuccagcugaccaccuacuuauaccuccugcaucaauuguaaggccacacccaauuuagcucuauauagacuuuuacucuuggaugguuguuuuaaaaauguguuuauucccguuguccccaaacaaauuauaaguuccuaggucaagaagccaugucuuaacuuuuucuacauacagcccagaguuaucuaaaaucauuaccucaaauucuucucccauuuucucuugaauccauuuccauuagguuugcucuaccuaaacugcucuuguagaggucaacaaugaucuccacggugccaauuccaaugcuuaauuuuuugugccuaucuaacuuaaccaaucagcagcaauuggcacaaaugaucacuccuucaguguuacucuugcuucacuggcuuccgggauccagcauucucuugguugugcuccuaccuccuuguuugcuccuuuuuagucuccuuuguugguuccuccuuuuuuccccaagcuccuaauuggggauguuccagaguuuauuccuuggucaugcucugcucuagguauauucacucccuuggugauuucauccaaucucaaggcuuuaauacaauuugguaucauggcuuuaaauaccaucuacaugcugauggcauccacauucaccuaucuucugaacccuauacucacacauguauccaacugccuacuugguauugccacuugauaucuaauagacaucccaaacuuaacugguucuaaaacugaacuucuacucuugucccuaaaccuacccuaucuccagucuuucucaucucaguagauggcaacuccacccuuccaguugcucaagcccaaaucuugagagucaucuuaacuccucacuucuuucauacuucauauccaguuugucagggaaucccacuggcccuacccucaaaauaauuccaggauccacuaauuaauuucaucacuuccacugcgcucacccagaucugagccaccaaaacuuuucucuuggacuacugcaguagcuucuuacccagucuuaauuuccaccacugccaucuauagucugcccucaacacuacacuggaaugauucuuuuaagaagaaaaucagcucaagucacuucucugcucaaauuuucuaauggcccccuuaucacucaaagucaaaagcauccuuaaacagucuguagagcccuguguacccagucccccauacacucucaucuccucucugugugcucugcucuuuacucaucuacuccauccaugucggccucccggaugcuccuugcacaucccaagcacacuucuugcucagggccuuuacaccgacuguuccuuuugccuggagcacauuuccucuccucaguaaaguccaucaagaccacacuauuuaaaauugcaaccaggaauguuccucagccccauacucccaaucugccuuuauucuuuccacagcaacuuaauaccuucuuuauuuuuuucacaguacuuaacaucuuguaaauacuucauaauuuacuuauguauuaauugaugguccaccucccagaacuagaauauaaguuccacgauggcaggccuuggugucuauuuuguucacugauguaucacaaacacccagaacacugcuuggcacacagcagggauucaagaacuaguuauucacuaagauaaugaauggcucauccagggcuauacaccuacuaaaaaccucaaauauaucuagagcuauagagucuuaugguuggaacacacaugaaggcuuauuuuuauuaauggggaaacauuuuuaaaagaagaaaaaaaaugacugguggggacagcagauggacaauaucuguaacaagacagagaugaagauuaaaccaugaauuuuuggaugcuauaugguuaugacuggcacaagucugguauaauaacccuccuggugagaagucaucugucucuucuauccaugauuaagaacuggaugagugaacauuuauucuauuugcucacuucuucauccauuccuucucuucuuagacaaacuauugauccccaaauauauagccagcacuaacucuuauggaagcaauaaagcuggccccugcccucaaggagcucuuggucuaaaaggagcccacaaauuacauaaacaagucauuaagaugcacuguuauauguauagguucugucgaaagacagguaaauuccagaagucagauuucccuggguucaguuccuaguucagcuaaaaauuagcugugucaccuugaggaaguuguauggccucucugagccucaguuuucucauguaaaaaauggguacaauaacauuaucuacuuuccaaggauuugaugauuaaauuagauuaaguauuguaacauagcacauaguaaccacuaauggcuuauuaugaguaaucaguaauaguaguaauauuauuauuagaaauauaaucaacagaguacugugggcacacaaagaacagaguaacuaauucagccuggugcagcaagaaagauauuauccugguucucccuccucagacuagacaaucugcccagcaggcuaccgcagugauaucuacccagauaauaaagaagaucuuuauauccaucaaaagcucauaugcuuuaaucugaaacuauucccuccaaugacucauagaucagcauuaaccucauaauaauagcaccaaguacauuuuuaauagcaauauauauauaaucaaugugucauguacaauuccaugucucaauucacaguuuauuuguauuuuaaaaaacuauucuuuguaugcuuugugaaaucaucuuccuuagguucuuacaguuuuaaaaccuuggguuauucaaacucaucuauaagucuccagccgaaugugcuaguuacuauggaaacauggucccugugugagaagagcuugaggaaaguguauuccuggcacagauugagcaguggacagaaagaacaaaaugagagacauuugugccuauacuaccauucuccagccaggacaacaugaaaagaacauggaauaccaucuacagucaguguucugugggcaaguuuacccaguguagacagaaagagggacuaagucaacuacucacaaagaacgguuuuccccuggguuccagaaacaacacccuggauaauauuucaucuuguuuacuuauaagaaaaauucccucuccuuuuacaauagggacauucuuccugcccgccuccuucggguggcuguccuuaaaaacagcaguuagccaucaaaaguccuacccuggaaccucaccuaaacacuguucucgauaagggaggacagaguauaagcuggcaacccucuuaugugauaaaaaucagugguucucaaacacuggugugucucagaauccacuggaagacuugagaaaauucagaauguugggccccuuccccagagcuucuaucucagucagucugggggugggggagacacaauaauuagcauuucuaaaaaguacagggaccacuccugagaagcaucaaaucuaaaacuuaaaaauagaacccuaaaauccuuaaaaguaaaagauuauuucuagaaagacaaaggacaucaugucauagcaaaggcagacuuuaagacauucuauauaauucuuaaucaauuuuuaccacuuuuauagauacaacauaacuacuguucucucuccuucaaaugugcuacaacagcaccugaccccaaucaauuuuaugaaauucaggaugucuuuuucuucuccuucuccuagacuuaccacauucccuuuaucacugcuucuccccagaaucuccuuauccauuauuucccucacacaggacuguaacccuuagcccacauccuauucaagcaccuacaauguuuccccaccacuuuuccccugacuucuuucuccagggccugcucucccugcagaagcaaaaaguagccgagggcagugucuacauucuauaugcaugauuuacaggcagguuuuucuccaugucuauuaggaauacuucugaaaguccaucauuuaaaauuauauucagccaagugagaaaccuaugguuacugaacucaaccaaccucucaagugaaaacaacauuaaucaccaaauaacacuuuuaaaaacacguauaaauccuugaaaucucuauagcagggguuggcaaaccacagucagugagccaaaucuaccaggccaccuguuuuuauaugacuuuugagauaagaaugguuuuuacauuuugaaacgguuggcaagaucaaaauaagaguaauauuuugugauauguaaaaauuacaugaaacuugaaugucaguguccauaaaaaaagucuuauuggaacacagucacacaaucauuuacauucugucuguggugcuuucacgcuacaaaggcagaucugagugguugugacagacaccguauggcccacaaggccaaaaauauuuccuaucugacccuuuaagaaagagcuuguuaacuccuacucuacaucuuuccuauuuucgggagacagauauauagauagauauggaaaggcaacauagacuagagauaauauuacuuuaggggccuccagaugauacuuauuaaaauaagcacucagguaagaaccuguuaauacgugcauguuaaucaaccucauuaaaagccuauaauaaugucucccuggacuugcaauuagaugagcugcgugacaucuguuucgucaugagaacuauguuauaaaccccaaacacauuugggaaagaucagacuaaaaucaugguucccucaagcaccugucuuuuuccauaaacuucuugaaguuccuccgaugaggugugggcuugaggucuaugcaguuacggagagaauccucuucagaaccaaaaccguuguaagguggaaauuuccuuucuauuuuuggaggaggagaaggaggcuugcaugaaacugagguaaaguucucuagaacaaaacaaaggcaaacaaaacaucaauauuuuuuuugcccugauuauggcuguuuugaaagguuuguuauguuuucaagaugaacauggagaucuuuguagacuauuuuaaacucuuucaaacaaaacagcaaaauccugugagaguacuuuucaaucauguuuacaaaaaccauggaacucacuuaauaaucaccauugguucaaaaguuaaaaaaaaaaaaaagaaucuaugucaaauaaguaaacguuuauauuuugucaucacauucccauuucugaauauuuuuuguucuccucugauuuuuccaauaauaugaaaauucaaacuugaaacuuuaggccacucguuccacauuuuaaccuguaauuuagcccucuccuaucucagucaacacucacuaauaaaauucuuuuccaaacaggacuuacuccugacuauucaccuuuauccuuccccauccaccaucuccuccuacugcacccuguauuugaguacccuccauugccuccaaaguaacuccaggucauaguacuucccuauguaguucaaaaacaaacaccaaaacagaacuuuccucucaccagccacggccccagguagcuuuuguuaagcccaagaaaagacuacaauugcacucaaaugcaaugaagcgaacaaacaaaacagaaaaagaaaaaacuuuuaaaauagccaacugccuacucucuccaagggagugcuacgcgguaaauacuguugauuuuauuuauauacuuaucaucugugaggaaagagagguggagagagagcugguaacauauuuguaauagccuaggagcuuucagguacucauuugcgaggcuguacaaucucagaagcaaccgugcucuccagagcaaggaacauauugaccuggucuauccaagucacuguguuuguccccaacauaaauggcaaaaaaagaugccacaucuuuccuaaaacaaaacaaaacaaacucccacagaaucuauuuucuacuucuuccccaagcuucaguaugacauagguguuuucaauccuguaugaaaggaguucuacauaagcaaauauuuccuuuuccacugucaaaguucccauagaggaagaguacaaauuuuagugcacaccuccggaagagaaaauggagaucaauuuuucauccaagauaaccuaacucuuaauauuaaggugguuguuugguuuuuguuuuguuuuguuuuguuuuguuuuuuaacugaugaucaaaaggcuaagggcuugaggccacuucuaacucuuguugaaaacauuuucagcuuucauauguccuuagacuuccuagcagccuuugugugaaauuuccccaaaaacaauccccaaaagaguauuguuacauccuaacagagacugcuuacagcagacauguuuauaaaggugacucagugaaaggggggagccagugugccaguacagaagugacuugugagcuucaacuauugcuauuuuuauggugauuuuaaagaaaagucuuggaaauaaagaggagaguucaaaucuuggaauugggcagaauugcaguagacucuaucauugcuaaccauuacaucuaacacaccacuguuuggucuuucauuucaggaagaacaucauagccauggcaggagagcuguaugugauuauuuaaaaaucugggccugaggaguuucuuucaacaggagacauauacauacaacucuacauaccaaucuaagcagucuaaccaaaagaggacacauauugaaucucaaaguaauuaggacugcauucuacacuucccccuagaauuacagggcuuauaccacacuguuguuuucucaaccauauaauuuuugcaacagauuuaaguaacaaaagaaccaauuuagagcuuuccucugcacccacagugccaucuaguguauaaaagcugagaacuuuuccacuccaucaugccugacuuuuauaccaccacauacaucuuuuuggaaacucuggcucaagauccaacuuuaaaucccauuuaucuggguaauuugcauacguucacaaagcucuggacucacagcugaaugacaaguuuccucacuuugguuuuccaucaucccagcauccugcguguuuuagguguucaaaaauauucauugaauaaaugaaaaaguauacauuuuuguacaaagcaucuuccccaaugucucaaguuggcauucugcuagauccugagacagauaugucuuuuaauuaucugauuccucuaauuccaagugacuugucaaaacauauauauauugaaugcccauccaugguugacuagauuccaacaaauuggcagacagaugauacauauuacaaaggagucuuaaugcuucuucguggugauuuucuauucaccaucucagugggaaagacuacugggaaaagccuucaguuaccucaacguucacugcuuauguucuaguagccuagagaugaauacagguuuugggaggcuggaagcuuaaauaauuugggcaaagcucuucuaggcaaagaaugucaaauuacuaagacaaaguuaggccagggccuuggauugggaccccuggaaaggaagaccucuaaagauuacgcuucauuagcuucaagguaaauccacuugugcuuguauucaauacccaugucaaaugauuucaaugaaaccuaaauucgugaaucacauuauguuagagcuauaaaaucuuuaagaauccucccaucucaaccaucuucauuucauaggggaagcaaaagaaacaaaauuguuagguccaucagggccaugugaugagaccagaagccaauucuauccuauuggugcaauuuuaaguguccaauucacucaaauaaucauuaaacacucaucuuaaauguccugcuguuccuaaaaauucagagauggccagaaaugacuccacaaaauuaaaggugcuuuaagauuuuuguugaaucuaagcauagcccaauaaguguucaacagcaacaagaaugaacaaucuuguuacuaguuucauugucccagccacuaagaaaaaauaagaaaguccacugauagacaaauaauaaccuaaagcagaaauuccuacguaagaacaguuuacauuugaucccuguccuuuuagugaaagaaacaccugcuggaaccccuagagccuuuuucaaccuucaugcuauaggaaagaucaacagaccuccaucugccggaccguguucauucacauaaaauaaugagggagugacaugcuacagccuggcaggcaagccagggccagcaggauggccaaacugucugauggagggggucccacugcacuauuaaagagaagaaaucuauggaaucaccuucuccuuagaauccuuaaauguaugaaggaaucaucuuaagagauugaguuuuacacaggagcucaaaugucucuuggaauuuuagcaagcccuccacuucuacauaaauagaaagguuauccauguaccuuucuugggacuguggccaacuccuucucuuugucugccauuuuuucucccccaaaauauguuggggugucauuacacaggagaagguacuaaagcaccaaggcggcguacugcguuagaaaucucccgugacuuccugcuagagacgccccuagcuguguugcugcugcuugucagauccuuccugcgugcugcacaguggagauacccagguuuucuacugaacacaauuauugacaaaggaggaaaugugaccacaauuauugacagaaccacaaugauugaugggacuuuguccugguuuggguuuuaaggauaccaaaacauaacgcauguaauuuggucaauuuaaaaaauugcugagaccagaugaacuauaaauaaaauuaaaauggcagaaauaacuguaucuaagcaacauuaaggauauuaauuuaaccuuaccaaaaaaucaggaaaagcaaaugcaaagauuaucagagaacacugauucauucuccccuccaccucaucauagauauaauuucuagucuuuacuuacauuaaguacacuguuguaacacaagaaauguuguguaauaauagugucuguuaaaugggauauuuuaacauauguuaugagaaauauaaaaagucagugugacuaugaaaugcaucauaauuuugcauuugcauaauuuucuguuuaaaugcauaaugcucauguuauauuagcuuuagaggcacagacuacuuuuuuuuuacauaauacaauuaguccacggagugaacaaaagaagugaacagaaagaaauuagcacaaggacucgacugaaauggaccauaggacauuugaagcugauacauuuacccaggauggcucgauuuggagcacaccagggaauucacacugccucaaaaaauuuucuagagaagccguuaagacccuaacaacauacuaagucccaccaguaggacauucauuuucccaaaugcaacuuucauauucucaccaagcugacagacaaacaucaaccaaaaguuagacuuuauguuuaaggaaucauauaaugcuuuggaacaccacauccuuuauauuaagguaaucaucagguguaaguuacgguuuuuggugacucaucuugauauauacauuuaaauuuucauucuacacuaaagacggauuccaaacaggcaucuacauuuauuaaaggccaaauucuuuucccacagucuaggggccaccagcagcuucucuauagcagcugccaccugcacauuccuggcugcuucuuguccacaguccccaaggcaaauaugcccaacuguguccacugaaggggacuaauuuuagaaaauaaaaagaggccaccaauuuggccccaguagggcccauacauuuugacuaaucuggcaugcagaugcagugcaacaaauuccccuaaugaaccuaagaguaaaacuguaagccuuuuucacucuaacccccuuguguacuugaugugccuucucucacaauauaaagauucccagaaggccaggaauacuacacaaugcggacaacaagacacauaacauggcuucaucucauucuagugacaaagcaccuugucuuucaagaagcugcgguugcacuuggcuuccaucuugccccucggggaaguguguucauaugaauacuccaagguucagaaagaaguacaggacuaaguacccacuaucccaacuccaguaccaaacugggaggucagcaagucccaucaauuccuagcagcagcagguaccuggagccucagguagaggggaguuuaacaaaugaggguuuaugcuuuagguuucacgucacauccuccgccagcuuccaagacacucauaacacggugucacucgcugcaggucucaguuccccuuccagccuagaaaccucuuacacaacucuaucuccuaagucuacuacagugaccuacauauaguaggugcuuaaucaaucacucauuuucauucugaacugaacuaaccuuacuggaauggaguuaauaucugagaagagagaagcuuaaaaccuggcugagccucaccaggaaagguagagcaaacuagcagaagagaauucccucaauaacucaauuagguauauccauugugguaagaagaaguaagugaaaagaaaagcauucagauuuccauuucgauugcuaaaccaaaacauuuacccccccagcaucaggcagacaaguucaaaucuuggcucacucuuugcucacuguauaaccuuggacaaaugagcccccuuuaagccucgguuuuuuucaccucuaaaauggggauaaugagccuauccauagagaauuguuaggaauauauaagacaacaaacggcuggaagauagcaaaugcacaauaagugguagcuauuaugagccuagcauuugaaacuccaaaguaaaaucuuaauuagggaacaaacaauuuaauuuuaaaaauauuuuuaauugacauauguaucacuuaccaauuccauauuuagacuuauaauaagacuucguaaauucaucacagucauaaaggagcacuuuucuuccccacacauugauggugacuccuagggacaggucacuaucuuuguaaaacucuuggucuacuuuuccuagcuaaaaaagacaaaggaacauagcauuggcaccauggacccuccaaagaaccaggaaccccuucccagagaaaaaaaggaaauuaaaaauaaaacuucaaucuuuaauaacuaaauuuuaaaaaucaaauaaaaaagcaaccaguugauguuaauauucuaaaguauuauuuuagcacuguaguauuauacuuacaaacugcaaugcauugcauauauuuauauagacauuucagcauguuuauuacugauaaauagcaguacaaugcauacauuuauguauucaucgauuucauucacaaucucacaagagaagaguacguaacucgccccacuguucagguuccaaagaagucacacuagaaacagguaauaaaauaugagguuccuucccuuauaucuaucgaacagguagccauccgcuugguucuuuauaaagucaccauaugaauugagaacugcucgaucuguuaucuggccugguugauagacucuaggugggcaauucuggaagacaaaaucaaaacaagaugugguaggauuuaauccauucccuuucuuacuauaaccccagggcuggcauagagguggcacucaaugaauauuuguugaaugaaugaauaaaaugaauuaacuaauguuggcacacuguaaaugucagguaugucauuauuauuuuauauucagccuauuuuucaaagucauucuaaaaacagguuuuucugacaccuccugguugccugcuauggguaucccagggcucccucugggacaaauugugccucuccugccuccaagcaaacgcaguagggcuuccagcagugggcucagagaaucugggaaagccucccggugaggacugaauggccagcaguuauuugccucggaaauuagcauuaugguaaccuuuucaugugcacuaagaagacacuuuauccaaauaagaaagaaaauauaacauagagcuuuugaaaaagccuuuauguucuuaaguguccuuauagguguuuacagguccuuagaugguguuuuuuugguuuuuuuuuuuuacuauguuaugacauuuuaaagauggggaaauaagcucaaagagguuaagugauuugcccaagguaacacagcuauuaaggggcagacucacaacucuaauccaggucugggcuguuucugcugcacccaaauuacaugagcucucaaauggccauaaauauuuguagaaaucaaucugacaacucuuuuuaauguuaaauaaaaugcaaaagucaucacugccacuagcuaguggcuaguuggugacuaguugcuacauucagaaaaggcacuuugguuuguaaacuugcauguguauguuugugagugcauguguacaugcacauguaggugcacguguauaaguguguguuuguauucacaacccagaccaaaccaugggcucucuucaguagucugcagugcccuguccaaagccacaagcaauucuuuuacuaaggagucauuuaguuucauaaaacuggaugugaacucaaugaugaauaggugcuuuuucuuacauuugacuuuuuuccuuuacuugccuuaacuucaauguuccaacucuaauugaucauauucucuguauuacuuucacagauguguauuaauagagggcacaaaaugaaagguuucuaaauaccugcacuagugcaugguuacuaucaucauauagucauaacacacaacauuccaaacagugacuagucucuugacccacaagcaaauucaaagugguuauauccacugcucaccuuggguagcuuacuccuccggaggaacauuuuuagagcaucucggccugagcuguguggaagcaauucuuugauuucaauaguaucaucacacaagaaguaaugcaggaugaguucucuacggucuccaaacauugagacugagucaucccacaggcagaagaaacacaaaaucuugccaugauacuggaggaacuguuucagggugucgagggauucguagggacguaagggcucuacguguucuacaaccugcaaauggagaaaaugucaauaauaguugcaggguuugcauaaucacuucuaagauauacacaaucaagugacaaauauauaaagauauauuuuuggucaggcaugguggcugaugccuguaaucccagcauuuugggaggccaaggcgggaagacugcuugaguucaggaguucaagaccagccugggcaacauggcaaaaacacaacucuuaaaaaaaaaaaaaaauuaggcagauguggugucacacgccuguagucccagcuacuugggaggcugagaugggagaauugcuugaccccaggaggucaaggcugcagugagccauguucacaccacugcgcuacagccuggucaacagagugagacuccauuucgaaaaaaaaaaaaaaaaagaaaagaaaacaaaaaagauauauuuuucuacagauuauucugugauuuuguuuuuaauuucaacuaugacauagauacauacacaucuauaaccaguuuuaaccuuaagaacuggccgggcgcgguggcucacgccuguaaucccagcacuuugggaggcugaggcagguggaucacgaggucaggagaucgagaccauccugacuaacacggugaaaccccgucucuacuaaaaauacaaaaaaauuagccgggcgugguggcaggcaccuguagucccagcuacucgggaggcugaggcaggagaauggugugaacccaguagguggagcuugcagugagcagagaucgcgccacugcacuccagcccgggcgacagagugagacuccaucucaaaaaaaaaaaaaaaaaaaaaaaaaaagaauagagacaaacaaguuugaggaaguuuuucauauuaaacauuaauacacuaaacuauacuucuggccaggcgggguggcucacaccuguaaucucagcaccuugggaggccacagugggucgaucacuugaggccaggaguuugagaccagccuggcugucucuacuaaaaaugcaaaaaaguuuagccagguccgguggcaggugccaguaaucccagcuacucaggaggcugaggcaggaggaucccuugaaccugggaggcagagguugcagugagccgagauugugucacugcacuccagccugggugacagagcaauacucuguaaaaaaaaaaaaaaaaaaaaaaaaaaaaaaaaaaaaaaaaaaaaaaaaagauuaaaaaaagaaaaaacuauacuucuuuaauauuuuuuaaaacugacuuuucaaaaagauuuaaaauucuuauuuaagaacagacaaaacuaaucuacggugacagaaaucagaacaguaauugccucuggguagggaauuugaccagaaauggggagaaaggaacuuucugaggugguaaaaauauucuacaucucgauuuuuguguugguuacucaauugcacacauuuuacaaaacuuguugaccuauauacuuaagauuuauauguuugacuccguauuaauuauaucucaaccaaauacauaauuugucuuuucacugggaaauucauauguguucauaauucuuacucauucaaagauuuuugugaagguaaaagggaagaaauauauucacuguuuuauuucagcucaaaaagcuuuagguaucaaggauaagaaugccccggagaaacaggagcacagcaaauggagaaggucuuaaggucugcagagccucugccucggcuguccucugucccaggaaccacuaguuaguuccauagucuucuugaugcaacucuucccucuauuugcacuuucgcagcccugucguggaguuaaacugcccccauuucaucugauguaaccaaauaggacuguuauauaaggaagugcacacugacaagggagauguuaucccaaaucagguuauacaaucuuuuuguaaauuuuugaaauuucuaucugucgagggcagucuaggugcagucuuaacccaagacaguggggagacaugauggcuuuccaaagacucuucagucuuaucucugauauuuaaaugaaauuaugggaccacuauuucaauugauugaaaaauguuucuuuggcauuaugaggccucuaagaaaagcauuauugauaauauaugggauucuuuucagucuaaguuaaauuguuuaauuuuaacuuuacaguucaagacagcaaacacugcagaaguaaauguaugaaagucaauauagaagccucuuauuaaacuccuaauuucccaaagauuacuauauuuauugaagaauuuucucccugagggaauaaaugcuaaaaugauguuccuacucugaaaggaaauuauuuaaaacauuucuuagcuguucuugguauuuauucucaauuccuggcacaaaagaucuuuuucuggggguggcuggcaagauggccgaauaggaacagcucuggucugcagcucccagcgagaucaaugcaaaaggagggugauuucugcauuuccaacugagguauccggcucaucucauugggacugcuuagacaguaggugcagcccacggagggcgagcugaagcaggguggggcaucgccucacccgggaagcacaaggggucagggaacucccuccccuagccaagggaagccgugagggaccgugcugugaggaacaguguacucuggcccagauacuaugcuuuucccauggucuuugcaacccucagaccaggagauucccucaagugccuacaccaccagggcccuagguuucaagcacaaaacugggcagcuguuugggcagacaccaagcuagcugcaguuuuuuuuuuuuuucauaccccaguggcgccuggaacaccagugagacagaacugcucacuccccuggaaaggagguggaagccagggagccaaguggucuagcucaguggauccccccagcaagcuaagaccgauggcuugaaauucucgcugccagcacagcagucugaagucgaucugggacgcuggagcuugguggggggaggggcgucccccauuacugaggcuuguguaggcgguuuuccccucacaguguaaacaaagcugccaggaaguuguaacugggcggaguccaccacagcucagcaaugauuuuguagccagacuaccucucuagauuccuccucucuggguaaggcaucuaugaaagaaaggcagcagccccagucacaggcuuauagauaaaacucccaucuuccugggacacagaacaugggggaagggguggcugugggcacagcuucagcagacuuaaacguuccuccugccagcucuaaagagagcagcagaccucccagcacagugcucgagcucugcuaaaggacagauugccuccucaagugugucccugaccccugugccuccugcuaggagacaccucccagcagggguugacaccucuuaaaggagaccuccgacuggcaucuggagggugccccucugggacgaagcuuccagaggaaggaacagguagcaaucuuugcuguucugcagccuccacuggugauaccaaggcaaacaaggucuggauuggacuuccaggaaacuccagcagaccugcagcagagaagccugacuauuagaaggaaaacuaacaaacagaaaggaauagcaucaacaucaacaaaaaggauguccaaaugaaaacuccauccgaaggucaacaacaucaaagaccaaagguagauaaauccacaaagaugaagaaaaaccagcacaaaaaggcugaaaauuccaaaaaaccagaacaccucuucuccuccgaaggaucacaacuccucgccagcaagagaacaaaacuggacggagaaugaguuugaugaauugacagaaguaggcuucagaagguggguaauaacuaacuccucugagcuaaaggagcauguuuuaacccaaugcaaggaagcuaagaaccuugaaaaaagguuagaggaauugcuaacuagaauaaccaguuuagagaagaacauaaaugaccugauggagcugaaaaacacagcacgagagcuuugugaagcauacacaaguaucaauagcugaaucgauuaagcagaagaaaggauaucagagauggaagaucaacuuaaugaaauaaagcgugaagacaagauuagagaagaaagaaugaaaaggaacaaacaaagccuccaagaaauacgggacuaugugaaaagaccaaacguacguuugauugguguaccugaaagugauagggagaauggaaccaaguuggaaaacacacuucagcauauuauccaggagaacuuccccaaccuagcaagacaggccaacauucaaauuuaggaaauacagaggaaaccacaaagauacuucucaagaagagcaaccccaagacacauaauugucagauucaccaagguugaaaugaaggaaaaagugucaagggcagccagagagaaaggucggguuacccacaaagggaagcccaucagacuaacaggagaccucucugcagaaacccuacaagccacaagagagugggggccaauauucaacauccuuaaagaaaagaauuuucaacccagaauuucauauccagccaaacuaagcuucacaagcaagggggaaauaaaauccuuuacagauaagcaaaugcugaaagauuuugucaucaccaggccugccuuacaagagcuccugaaggaagcacuaaauguggaaaggaaaaaucaguaccagcugcugcaaaaacauaccaaauuauaaagaccauugaugcuaugaagaaacugcaucaauuaaugggcaaaauaaucagcuagcaucauaaugacaggaucaaauucacacauaacaauauuaaccuuaaauguaaacaggcuaaaugucccaauuaaaagacacagacuggcaaauuggauaaagggucaagacacaucagugugcuguauucaggagacccaucucacaugcaaagacacacauaagcucaaaauaaagggagggaggaauauuuaccaaaaaaauggaaagcaaaaaaaagcagggguuucuauccuagucucugauaaaacagacuuuaaaccaacaaagaucaaaaaagacaaagaagggcauuucauaaugguaaagagaucaaugcaacaagaagagccaacuauacuaaauauauaugcacccaauacaggagcacccagauucauaaagcaaguccuuagagaccuacagagagauuuagacucccacacaauaauaaugaaagacuuuaacaccccacugucaauauuagacagaucaacgagacagaaaauuaacaaggauauucaggacuugaacucagcucuggaccaaguggaccuaauagacaucuacagaacucuccaccccaaaucaacagaguauacauucuucucagcaccacaucacauuuauucuaaaguugaccacauaaugggaaguaaaacacuccucagcaaaugcaaaagaacggaaaucauaacaaacagucucucagaccacagagcaaucaacuuagaacucaggauuaagaaacucacucaaaaccgcacaauugcaugcaaacugaacaaccugcuccugaaugacuacuggguaaauaacaaaauuaaggcagaaauaaauaaguucuuugaaacaaaugacaacaaagacacaacauaccagaaucucugggacacaacuaaagcaguguuuagaggcaaauuuauauauuuagugcuuauaagcacuaaaugcccacaggagaaagugagaaagaucuaaaaucaacacacuaacaucacaauuaaaagaacuagagaagcaagagcaaauaaauucaaaagcuagcagaaggcaaaaaauaacuaagaucagaguggaacugaaggagauagagacacaaaaaacccuucaaaaaaucaaagaauccaggaggugguuuuuugaaaagaucaacaaaauagauagacugcuagccagacuaauaaagaaaaaaagugagaagaaucaaauggacacaauaaaaaacgauaaacaggauaucaccacugaucccacagaaauacaaacuaccaucagagaauauuauaaacaccucuaugcagaaaaucuagaagaaauagauaaauuccuggacacauacacccucccaagacuaacccaggaagaagucaaaucccugaauagaccaaccaauaacaaguucugaaauugaggcaguaauuaauagccuaccaaccaaaaacagcccaggaccagauggauucacagccaaauucuaccagagguacaaagaggagcugguaccauuccuucugaaacuauuccaaacaauagaaaaagaggcacuccucccuaacucauuuuaugaggccagcaucauccugauaccaaaaccuggcagagacacaacaacaacaacaacacaaaaaggaaauuucaggccaauaucccugaugaagauugaugcgaaaauccucaauaaaauacuggcaaaccaaauccagcagcacaugaaaaagcuuauccaccaagaucaagucagcuuccucccugggaugcaaggcugguucaacauaugcaaaucaauaaauguaacccaucauauaaacagaaccaaugacaaaaaccacaugauuaucucaauagaugcagaaaaggccuucaauaaaauucaacaccccuucaugcuaaaaacucuccauaaacuagguauugauggaacguaucucaaaauaauaagagcuauuuaugacaaacccacagccaauaucauacugaaugggcaaaagcuggaagcauucccuuugaaaacuggcacaagacaaggaugcccucucucaccacuccuauucaacauaguauuggaaguucuggccagggcaagagaaagaaauaaaggguauccaaauaggaagagaggaagucaaauugucucuguuugcagaugacaugauuguauauuuagaaaaccccaucaucucagcccaaaaucuccuuaagcugauaagcaacuucagcaaagucucaggguacaaaaucgaugugcaaaaaucacaagcauuccuguacaccaauaauagacagacagccaaaucaugagugaacucccauucacaauugcuacaaagagaauaaaauaccuaggaauacaacuuauaagggaugugaaggaucucuucaagaacuacaaaccacugcucaaggaaauaagggaggacacaaacaaauggaaaaacauuccaugcccauagauagaagaaucaauaucauaaaaauggccauacugcccaagguaauuuauagauucaaugccaucuccaucaagcuaccacugacuuucuucacagaauuagaaaaaaacuacuuuacauuuuauauagaaccaaaaaagagcucguauagccaagacaauccuaagcaaaaagaauaaagcuggaggcaucacacuaccugacuucaaacuauacuacaaguuuacaguaaccaaaacagcaugguacugguaccaaaacagagauauagaccaauggaacagaacagaguccucaaaaauaacaccacacaucuacaaccaacugaucuuugacaaaccugacaaaaacaagcaaugaggaaaggauuccuuauuuaauaaaugguguugggaaaacuggcuagccauaugcagaaaacugaaacuggaccccuuccuuacaccuuauacaaaaauuaauucaagauggauuaaagacuuaaacauaagaccuaaaaucauaaaaacucuaaagaaaaccuaggcaauaccauucaggacauaggcaugggcaaagacuucaugacuaaaauaccaaaagcaauggcaacaaaagccaaaauugacaaaugggaucuaauuaaauuaacaagcuucugcacagcaaaagaaacuaucauuagagugaacaggcaaccuacagaauggaagaaaauuuuugcaaucuauccaacugacaaagggcuaauauccagaaucuacaaggaacuuaaacaaauuuacaaaaaaaaaaaaaaucaaaaaguggacaaaggauaugaacagacacuucucaaaacaagacauuuaugcagccaagaaacauaugaaaaaaaguucaucaucacuggucauuagagaaaugcaaaucaaaaccacaauaagauaccaucucacgccaguuagaauggcgaucacugggaggccgaggcagguggaucacgaggucaggaguucaauaccaaccuggccaagauggugaaacccugucuguacuaaaaauauuuaaaaaaaaauuagccgggugugguggcaggccucuguaaucccagcuacucaggaggcugaggcacagaauuucuugaaccugggaggcagaguuugcagugagccaagaucgcgccacugcacuacagccuggucaacagagugagacuccauuuaaaaaaaaaaaaaagaauggcaaucauuaaaaagucaggaaacaacagaugcuggagaggauguggagaaauaggaaugcuuuuacacuguuggugggaguguaaauuaguucaaccauuguggaagacaguguggcaauuccuuaaggaucuagaaccagaaauaccauuugacccagcaaucccauuacuggguauauacccaaaggauuauaaaucauccuacuauaaagacacaugcacacguguuuauugcagcacuauucacaauagcaaagacuuggaaccaacgcaaaugcucaucaaugauagacuggauaaagaaaauguggcacauauacaccaugggauacuaugcagucauuaaaaaggaugaguucauguccuuugcagggacauggaugaaguuggaaaccagcauucucagcaaacuaacacaggaacagaaaacaaaacacugcauguucucacucauaaaugggaguugaacaaugagaacacauggacacagggaggggaacaucacacaccagggccugucaggggguggggggauaggggagggacagcauuaggagaaauaccuaaaguagaugauggguugauggguguagaaaaccaccauggcagguguauaccuauguaacaaaccugcaaauucugcacauguaucccagaacuuaaaguauaauuuuaaauauacauaaauuuuuuucuucauaaaccuaugaaaucccacagugcucugcgcauuuucauauaauccaucauuauucacaaucacuaucauauaacaacaacuguuagugaaugacugcagccauaugcaaaggguggcaauucauuuggauccauuuccuucaaguucucucugcugguucuaaauucuuucuauuuaucuagacucuuucauccagggcauuuggaaaaaauaaaaaugaauccaaaccaaaaaaaaucccuuuguacaucaauauacaggcauuucaccuuagauauuccaggaucaacaauauauauauuucuccagagggcuguaugccuacaacaacauuaaagaauaauucugcuggggcugggaggcaggaauagaugaaugauccuacaaguggcuuuuaaaaagagaucaaaacagaaucaaaagagaauuuuguucuaaauuuuguuaccucucugcaaggaaaugaaucauaaguuuuaaaacaauaaaaaucagacaaaacucaucuauggguauagaaaugagaacagcaguugucugugguggggagcgggaucgauucgauaaacacaugaggggacuuucugggggaagagaaaugcucuacaucucaauauggggguagguuauagggguacguguauuuguuaagacucauccaacuguacacuuaauuucuguguauuuuacuguguguaaucacacuucaauagaaaaggaaaaaggaaacaagugacaaugauggaaaucaggguaagagucaagacauuugcgauccagucccagcaaggagauuagcuggguguugucaccuuccaccccccuuugaguguucaaauucuucuggaaaacaaaauuugggcccagggacuguuuaaaaaauaggaagacaaaaauaauacuaaaaauauugagucuuuacucccuuacacuagcuggggucagaccuuguacauaaacauccuuuccuaaaggggguauaucagaaucauggucuuccuuauucuuccagagcaucuuggcauccaaugccauccuaagaggaccuggaauuuccuaggaggaagaaaaaauguguacccaaggcuugcuucacuaaaucacuaguauagaagcaaagaucuuucuagccagaguuagacaacuaaaaagcaaaaacacaagccaaggaaauguggauacaacucauauaccaucagugaccacaaagucaauugugggugccuagaaucugucucaccugugcaguucacugaagacuccuacugccugaaagagagagucucuacagagagaauuggggugaggcagugaggaagucauucuugcucuguggcuaacacucagccuucccucuagcccaaagaagaacaaaacuggaauaacuauggcucuaaaagcucuuucacaucugcaucaggaguacaaacacccuuuacugacuuuccaaagggauuuuuauuuugaagacaagaacucaacaaacgucaauuccuuaccucucuccgaaucuucauguaaggaucuucuggacauugcacugggggauucacuuugaccccuauuuuccucaaaaaguuucuugugaaugcaucacagucauaaaucuugaauguccggccauagaagacaaccucugugccgacauuaaaaugauacacaguauaaaacugauccucaucaggaggcggaagaguaauccgaugacgccggauagaagucccuauggcaugaaagaaaauacaacuguuuuaucauguggcuaacaaguaagaagauacagcacauucacuaacaacccugaauacuuucccgcaacagaaaacugggcaaaggacucguucuaggaagcagcauuaguacauuccaacucugaggaagucagaaugagcugagauuucugagguucagagcucuguggccagccuugcaugugguuagaguugccuaaguggugcuugggaaguauuuuaauaaaccauaaagacuggggugaggaugggggaugaaggacaggggacauaagcagaaugacgaaaaauaccagacgcugccaucaugucuuuuccuagaacaagccugcucacauucagccaccagcaagcacucaaugugagcacacucaacaggcauuaaggcaccaaugcagaaugcucacaaaaauguguacucauggcucaaaaaaaaaaaaaaaaaaaaaaagcuaguaagcuuuggaaugauaggugccaacauugacuuagaaguuucaauaaggaugaaucacuuuuggcugcugugaaguuucauggaaucuucuuuccucuaucaaccuauuuuuccuccuccuuccucuauagccucuguccaccuccacccaagcacuaccucaagugaggguuaucagaggcuucacaguucuagccagugcucugggccaaaagcucuagaucucaucccaucuucuacuuccaacccugaugcccauucauuucuccucuugagaauauguucccagggucccacguauauccaaaagaguggucagccacuggagguaaaagaguuccuugccuacaugaguguaccaacuauaccacaccauaccagccaaguuacccaaauauugcugcaaucuguuguuaaggauuguuuaggggccaggcaugguggcucaugccuguaaucccaccacuuuuggaggccgaggcaggcagauugcuugagcccaagaguucgagaccagccugggcaacauggcaaaauccugucucuacaaaagaaaaaaaaaauuaauuaaaaaaaaauuagcuggguaugguggugcccacauguggucccaucuacuugggaggcugaaaggugggagaauugcuugaguccaggaggucaaggcuaaagugagccaugaucacaccacuguacucuagcuugggcaacagagcaaagcccugucucaaaaaaaaaaaaaaaaaaaaaaagaaaagaaaagaaaaagaaaaaagaauuugaaaaaaagaaaaaaggguuugagauuuuauccuacuugcaagaugagaaguuagccuuccauaguuucauggaugcugguagaagacaggaggugccuuggucagagacaaaaggcaguuuauuaaucaacagcaguaagaauagccuaaauaucagcauuucuuuuuccaguuuccuaagccccaauucccacaggaugacauaguaagggccagguaacauuuguacaugcaguggguuacauuacaggagaguaacccuuagcuuagggaacccaaaucuucuauaauuagcaauaagcaucccugcucuuuaucuccaagggagcuacuaucuuuauuagacuggaaggagacacuaagccucuaucuuccaacgcuauaagcaaaccuauacuuugcuccagagggagagacuauuuuugucuuccacagcuacuugcuauauaaacauccuugaagagauaguccagaacaaagagaagucagugccucugcuuacaagagauacagaaaugcaugauaccauggagaauugucucucaauaucuguaacugacuuaggccugagaaucuacuccaagaacaaagagaaaaggaaagcagaacaaacugcagaucuaaugauucaauaaaaauuggcuugugggaacucugcauggagguauuuuaauauaaagaugucaaccuaucuucuuuguauuuuauacagcacugaaaauggugccuuuucucaaagucuagagacacuuagaaauuagucauugcuuauucauuaaggaauauuuaaugaauaucuuuaugugccaggaacuguguugggcucucuuccauuauucuacuuaucaucuuuucacucuguugaggggaaauuaccuaaaaucauuuucagcuucuuuucuuugcagcaauuuuuaauuacuuggugcauuaaauuaaaauaauaaaacuauaaaauuagaacuggccuagaauauuuuuaaauguacuacauaaaagaugauacaauuuuacugugaaaaaauuauacuucaauuagccuuuaauucauagcacugaaaacaguaugcaaauuauuuaaucauucaagauuagacauuuagaacaaauugcauacuuaaacauguauaaaaggaugggcauuucagguauuuucaggaaccauuauauacuacuuuaaaaauacuuauauugugacaguuuuuaaaauauauaagaauuauucaacagucaggagcuucuucaaaaauuccaucuaucuugcauuuuuacuucauuauagaaauucaaauaagcaaguuagcgaugauuuuuguuccauaagacuuugaauaggaguccuauauuuuucuagguggcaaaaacuggcccacccacugggcuuuuaaauaauacuaaucacaaucaucaucauagcccuaggauaaacuuucacuuacauuuucucauuuaauccucaauaauucuauaaggcagauaauacaugaaauaugaauauucaguuuaaggaugagaaaaccaaagcucagagagguuaaaugccaugcccaaggucaugcccuaacaaauggcaguaaaagaucuugaaguugggcuuucagacucuaacuaaauaccauuacuuuccauaguuugcacugagcuguaucucacuguacugcagcuacauauuacuugaggaggaagagccauaggcauaacaggauggaaauggauaaaagagcuaccagccaccaugaaaagaaaagagagaugaagcugcucuuccgaaagaacagccucucuccucgaaggggaaauuuccagagaugcccacccacugcuauggcaaugcacccugcagggccugccccaccagcugacuugccucucccaggagccugcagaucucaagccccccaacucuuccuucucuuagccgcuacacuucucucacuagaugcuucucagaaaaggccagggaagcucuucuuggugacaaaaaagaauccugaacacccaugaguuagaaagaaaaggcaggucuaacacuaacaguaaaguuuugauaaccaaaaaucuaacgucacaauuccauauuaaucagaaaaccaaggugggccauuugaaauguacaguugcacaugagagcuuucaauaacauauucauaggauuucucaacuguguccuuugagaauuaaaauuucuaauuaucagaauuuuuauguuuuuagucuuccacgauaaauggcagaaacuccaucagcaggaauuuguuuugggauaucaaagaaaugggcaggauaccauguccuugacccacauugaagagcaggugaaaucaucaagguagauaaauaaagauauuguuacaaaacagaaaaacaacuaaagcaccauauuugcccuuuaaauuuucaggaguuuaucuuaacugcccaauaaagacuauugggacacauguccagcuuuuccucaucuucauguuuuacauuucucuuccuuuguaaaagcccugcuaucuggcuaugcucuucaagcuuuaacuuucuaacauuucccugugguuuagaucaaagugaccauauauccauuuauguuucauguguuuucauguuauucaguugagacuugccuuagaucuuugcucauaccacuaaauuuacuuuucuggaauucaccuuccagaauuaagacuccaaacucucaccucuauuuuauuuuuuauuuauuuauuuauuuuugagacagggucucacaucauugcccaggcuacagugcaguggcaugaucauggaucaaugcagccucaaccucccaggcucaagcgauccucccuaccucaaccucccguguagcugagauuacgggcauggccaccacgccuggcuaacuuuuuauuuuuuguagagacagccuugcuuuguugcccaggcuggucuugaacuccuggacuuaagcaauccuuuugccucggccucacaaagugcugggauuacaggcgugagccacugcaccugggucaccucuauuuuaauuuaaguauguuaauuucauuuuaguaaugcugcaggccuagaguacauccaagucuaaaggcagauauuucuuagguaaaugaagauauaacugcaauugccacuuaucaucacaucuacaaguuugugcccuaaaaauacuaagaggcuuaaccacaaucacacauaacagagugucuuuucuuccucuugugcuuacuauauuccucuacuaaaaugacuuguauacuuuuacuuuuauuuuucuaaaaugucaccuuuagaguuucgguuucacaagaauaauuauuuuuauauacacaaccgggcacucaccuugcagcaaaagaauaagaaguuaaaaauuccacauuucugcucacaauaagaaacaguaacccuacgcaucucccccuuagcuauugaaaaagcaccaaaauaacagaugcuuuaauguccucuugcaugaccaccuucuugcccuguuuucccuauucaaucuaugaucugcucccaaauacuucccaauuuauugucccaccacuuuaucucauguugcuccuuuugacuauucugccuuucucuuccaucuuuaucuagagaaacuuuugagguaccauucaaaugccagauucucuaguggauauuggcuuuuccuccucuaaucccucaaguaccugguucucuccccaguguccacccucuagggugaccagauuuagcaaauuaaaauauaggcugcucaguuaaauuugaauuccagauaaacaacaaagaauucuuuuuuuuuuuaaauuuuuuuaauuuuuuuucacccaggcuggagugcaguggugugaucucggcucacugcaaccuccgucucccagguucaagcaauucuccugucuuagccuccugaguagcuaggauuauaggcaugugccaccacacccagcuaauuuuuauauuuuuagucgacgagguuuugcuauguuggucaggcuggucucaaacucccggccucaaguuaucagcccgccucugccucccaaagugcugggauuacagguguaagccaccaugcccagccaaauucuuuaguauaacuauguccuaugcaauauuugggacauaauuauacuaaaaacuucauugcuuaccugaaauucaaauauaacugaguaucuuauacuucaucuggcaaccuucccaccaccccuccaccacuuuaugggauauaauaccuauauauaguacaugcccaauaagagugaauggcauaugaaugacugacuucuauuuugugugauuacauuugccugaucaagcagauuaucuuagaguauuaaaaaauauauauaugagaaauacuaccuuauuaaggggccaaaacaagucauuaguggaaaucaguguucucaaccaagaugcacuaagaaucauagggaagccaguucuugaccccaugucuacagaagaaaaaauucuggggugggcuaggagauucugaggaucacuuucaacugagaacaacugguauagaccauaccagaaaaucacggcacauuucuaaucauuauccuuucuuuagcacagauuaggcuggacuugguguauuuaacugacaauuauucuguuagacaauuagagguaaaacuacuggauuaaccucugacauucuuggcuugauauaauguuguuuuaacuacauuccagcagaaaagcaacacguucuguaaauauaacacaucuaaccgaaaagagagugauguccuggcaagaaaugaaagcaagccuugaagugcaauacuggcuuucuugacucauaacacacacaaaucuccuugccaacaagaacuugugaauauuaaaaauauguuguucugauuagaagcugcaugaaugccuauuuugguaccaugcuaauggaugccucuuuuguuucuggcugauuccaaacuccccccacccuaaaaaauuacaugauaauagaggcaaccaaaagggagcaggggaggguuauaauuccuccaguugcacuaauuuccaaauggucacacaagaaacaagugcaucugaccuccaaguucaucuagaaaauaucaaaauccuauggaagugacaggaacgccaucacugcacagcaccuaaucuugaccauuugccucuucccagggcccagaugcauggaaagcaagcccgggccacucaagucacaacugaaagaaacacuaccuacccugucccacugacgucugaaccacuggcucauuaaguguuuucuuuuuuccaaucacuuaauuuagaaaagcuugaagaaggcauuuaaaugauuuuucaaacuaucugcaguccaaauagaccuuccuuaacaagaauuaucauauuaaauauuucaagagacugguuucucucuaaacaaagcuuggugacagagugguuauucauguuugcuuucuacaggauuugcuacagccuuccaaauuucucuacucugcugacaaauucaaugucauuacgcagcgugauuacuguguauucuauacacaacucuugagcugugucuucacacagggaaauguccugaccacagugagccaaucaaaaauucggaaaauuuccagagacuuuaaaguugucuuuuacucaggucuuuuuuuucugagacuuuaugauagcauuccucccuccuuacacaagaaugauuuucaaguacaucauuaugacuaucuucagcuugccuuuggaaucugccuaugugagauuugaaaucaagagucugaaagaauugagaagucuuaauaaaagccuuuccaagauucuaaaagaagcuacauuucauauuucuucuuggauaguuuaauaaaacuaagaugaacuggacaggggccagugagcuauaggauuaugagcuuucacuuuaaagguaauaaugaaaacaauaaugcaagucacuaacccaggccugggguguccugugaccuccagucuaucauuugugcaaguuuggugucauggugggaaaguaaucagaaaauaagcagagcuuagugagggaauaucagaacaaaauguuuaggugaaaaccuguaagaaauuuuuucuuuuugccacagcaauacuauuauauaaucaaauacacguaaguaaaauagauguccacaaaaauuauaaauuguaaauucuuuguucuuaaauaaucuucaaccauuuucuaaugcauucuugccaaucuuuaaaaacugccuuauauguuuuaaaugacccuaaagaaucuaaaaccucuugucccuuuguaaaauaaaaugucauacuuuuaaccuuaaaauuugugaaaaccuguuuuuaaaauguuaugguauuuccauauuuccugaaagauuuaccauuaggccaaauucaccaaauaaaauggccagggaguggauaguguaucaguuggaacacaaagaacaaugaggacaguucauauuaccuccucauacuaaucuucgucuuuucccaccacuaguaaaaccaagcagagacacuaaauugaauucccuuuaucuuuccaucaccucaccaguggcucuccucuaacaugguagaauagccuggucaugaucugggcaccucugauucccaaucuccauuucuagucuugacuuuuuuccugaaaacacauccuaaguuuguaccugccuggaggggcaucaccacacagaugucuaacaccccuucaaaggccucaugcccugaaacacaccccagauucaaaccccaauccuguuucuugcucugugcuccugggcuuuauaaagguaucaugacucaaccacagagaccucugaggccgauauaguuuggauauuuguccccuccaaaucucaugcugaaaugugauccccaguguuggagauggggccugcugggagguguuugggucauggggguggaucccacaugaaugucuuuguguugucuucgcaguaaugugugaguucuuucuguugguuaccguaaaaucugauuguuaacaagagucuggcauccccuccuuucucucuugcuccccgucuugccaugugacacgccugcucuccuuucaccuuccaccacgaguaaaagcuuccugaggccucaccagaugcagaagcuggugccaugcuucuuguacagucugcagaacugugagccacauaauccucuuuucuuuauaaauuacccagccccagguauuccuuuagagcaaugcaaaacagacugagcaaauuaccucccuaagccuguuuccuuuucuguaaaagcugacagugacaguaacuacuuuagauggucaucaggagauuaaaugagauaaugauaagguaggcacuuuuucauuagauauucccccuccucacucucuguauuuaaucacuggccaaugcauaucaacucugccaaccaaaugucucucaaauccuuccccaauuuucuauuccuaccaucauuguccugguuuggacacucagcauuucuagccugaacaauugcaaaacucuuggacugguggccuugcucccuuuccuuuccaaucugguggccuauuauuacuccaugagauagggcuaugaugggacucaguccuuuuguccauuuucccaaaacauagcacagugccugacacagaauaggcauccaacaaauacuucuuggcaaugcuggcuggcuccaaauucauuauuccaaccaccagacacaaugaagccaugcucuaagaaaaaccucaaucucaugagcauugaaggaaguccucugcacacuuaaugagguugcaugacaaccuuauucucagagcccauggcccucaaaucccugcuucucccccuugaacucauugugguauaucaauacagagcccucaggccuagauuaguaauuaguaagcaaaauuuguucagcauaggcagaaaucaugagauguguuaaauaacaauagguagguagguaugcuaaguagagcaugggcauguuaaacauagaaagaaagggauggaaaaaccaaaagauaacugauuuucaguaggucguaaauauacaugaggcaccuggacucuaaauauucaugauaugcuaaauauauaaggacacuaaauauucaugagcacccaauauuuaugaggccucaauuuggccacucauucaucggugacacccauucuagccccaugugaccucugcccaagaaacacaaacaaaacccaagacuauccagcaggcuuauugacaagcuacagccauggccaggcacacuucucccugcaucuccccaacagagcaagugugugcccucagcccgaagccccuucugucugugguucuccuugcuugaaccucaguucuggucucuaaaccauacuaguagcagggaagguuagugaaacagagacagaaccauugcugaccccaggauucaggcaguaugguccuucugccuacuuguacccugucccaagugugugaaccuacccuaucucuuucccucuuucuucucaucauguguuuuaaauuacuuuaauguaacaugugauucaugcauuuuaaugugauccaugagccuucuguuuugugaccucugggagagccugcauguacaauucucaaaggccaccacuguauccagguaacaucccacacaacacucucccugcugcauacagaacagauuguaggaggagcaagaauggaaacagggagaccacguuaggcagcuauucuauuccucuagucaacagaugaggguagcuuaggugaggaugguagugaaggggauggaaagacauggacauauucaggauauguuuuucuaggagagugaagaacagggaugguaguuaugagcaaguagggaaaguaaaaggaguauauauuguaguuagagaagacaauuucagagacugagauacuggagguggcaauacucuaaaaggcaaagaaacaacaacacacccaagaaucagcucgucaaggaacugaguacccugaaaggucauuuacaccagcaaccaaacaaacacucaaauccucucauacuuccagcaggcugucagugaaaaaccaccccugaccugcccccagggccaucuaucuacacgagggaacaaacaaaucugugacucuccucuccuccgccccuacaccagaccccuaaccccaacccuacccagguccauucccuauaacuucuagcagcucucugccagaaaguucuuccucuuacugaccugaacucugaccccuaggucccauccaugaacauaaagagaauaaggucaccccuucuccacaugacagcccuuuagauuccugaggacauuuaucaagcacacuggagucuccccauuacagacaaauaucccuuuucacuauucugucuugcacaugacaaauguucaguucuuucaccgucauaguugcuguccccugaagucauucagaacuccgcagcaucccaagagaaggacccacagcacaaacagaagaaaucagucaucuccauugaucucugccauacuuaaugcaaccuaggauuagcuucucugguggccacaucacagaguuaacucuuaucuguggcugagaggaguauggacaaagaugacuggcauacacagggugaaggaacaaugacucucuggugagguaccaucgaagucuguaguuaacagguaugaggaugaggagggggugguugaaacaaaugacaguaaauucaagaaagaagagaaugccaaucuggaagcugcaguagagaacagcuuucucuucuccccuaaugguguugugaaggaagugaucugcucacggcaaggcgaccaaaggguuugaggaaaaagucaaaggcacaggagaguuuacucauaccagagcagcaccugaaaggauacaaguaugccacggaggagugagagacccagccaauguugacaugcagaggguagaaagcugguaagucacaaucaauaacuacacgcuaauggcauguuuauauucaccacugccagcagguuagacagccuaaacaguagcaugcagucuuuugaaaagcuaaaggcaggcaguauauaaaggcaggagucagaagugaaggaaccauaacucugcuuuaaauagauaccuugaaguaauccacuauuuuucaccucugguucauuuacuugaauugugucaucuucaggguagaaguagauuuuauaguaucuuauucuguaguugguuuggcuuuuaucaaguacuuccucuuccaaauaggcaucaaaagauaauaccuguuggaauaauaauuagaaacuaagaaaugaaaagaaaauucagcaaacuuaaaauuaacaaagcagcugccuguauacuuuuuguuaauauaaagaaaaaaguagagagaauuuuuccaagaacucauucuacacaucagccaugcgaauggauauacaaucuaagauacaauacauaaagauuauuuaauacuuuuaucaccaucugguuaaaacaaggaaaugauauucaaguaauacauccaucguucagcucuaccauaaacugaacuagagucugccuuugggauuucacagugggauucuaaauguauauguuauagagacaaaauauucuuucucacaagaugaauaaguuuugucauuuuuuucccauuaacaauaacacaaagcugccuugguucuggcauaaaauuauccugacuguuaguccugaugauugcuugccuucaggcaauucaagcaggcauaucugaaauucauccaaugcccuggagaccccaccuuacacuucgggaaccucaaggagccuagcccaaugcuagacucagacucaucuuguaugggggcgguagggaauaaggaagggaaggacagguggauucuaaagcaguuaugguaaaauucagagauagucaaaaauaucuuugaaaauuccuuaacuacuuuagaaaacugugccucucaguaaguaaaacacagcccauuuuucucccauauugaagcagaugacugccugcuucuucaguugaagaccaguuaaaaucauuucuuuaugcuuaggugccauguuguaugaauaauauauaucuuuagccauuggaaacauucuuaauauggcauccugcucacacacugagcacgacaagguaauugaggacaacugugggaaaaguagauucaggcuaccauuucaagcuugaccugcggcucaagcucugugagagcuccauuuaaauauucucuuugucucucacuuuugaucaauuuuuauaauugaaguugcaaaacuuaacugugcauaugauguaacuccaggguuauucaauguggacaauaugauauauaugagugagucuguuagaugcaaucuacccucuaggggugguggucaguuaaccuaaguaagaauauauacuccaggaguguuuagcauauuuuuaucagaagcccacacuucagaaguggcuaacagaaugccucaguagcuuuuucuuugaucaacacaagaagcuuugucaauugccauaaaugauauuagaauaaauuuuagugaaaugauuguauucaaaaugcacauaucaguuacaaauacuaaccaggcacuguccuuacaggaacagguuauaagagucuggugaacccagagaucuacucccuucaggauggcaccuuuggcuucauucccaaauaguccuauguucagcugcuuucuuaaagaauuugucuggccugacuccaauuagguuagcuaaaccccauugcuagaaugcugucacauuuguauugagugaauauuucagauaagaugcuguuggacaaguauagaguuuccuucuggggugacaaaaaagucuuggaacuagauagaugugaugguugcacagccuuguggauauguuaaaugucacugaauugcacacuuuaaaauggcuaaugguuaauuucauguuaugugaauuuuaccucaguuaaaaaaagauauuagacacugaguuguguuggacacuuuaaaauggugaguuuuuguuaugugaauuauauuucaacuuuuaaaaaguagggggagggagcuggcuacaguggcucaggccuguggcaggaagaucacuugagcccaggaguuugagaccagccugggcaacauaaugagaccccguuuuuacaaaaaaaaauuuaaaaauuagucgggcuugguuacguguacuuguagucucagcuacuagggaggcugaggugggaggauugcuugagcccaggagaucgaggcugcagugaguuaugaccucgccacugcacuccagccugggugagagaacgagacucugugucucaaaaauaauuuuuuuuaaaaaaggaggaggaaaaaaagauguuggaacaccuaaaaggagaaagagcuggggcuucaucaaacuuucaguguacguaauauuuaaucugagauuuuuuuuucuuuguaaucaaguaggaaaguguagagagaauauucuuggcugucacccaccucuauauacugaaugcugccaguauaaauuugagaaugacuacacuggcauaggucaauugacaacuggcauaggucaacugucauguauguaaucauuaaauauuuaucaaucaaaugaugcauuaaaagagaaggaugcuaaauugaaauaaagagaaaaggaaagacauuaucuuagguugggcuucaauaugucuagaugagggacagacugauauuucauagucugcucccaugagaauacagggcugucaaacuccagcaugaaagauacagagcaagucagaaugagguagagauggaaagauaaaaaaggaagaggaagaggaaauuauaaaauguggugaaguagaauguaagaggagagacaccaaauagauuaaaaagugaucucacaaaaauaaaugaucuaauugcaauggaacuugauguaucagagaauccagaaaacagaaccuaaaauaaaaacuguuaaaaaugaaaauuuauaggaacauaauuaugauguaagguguuaucaucauuuaugaugucaagcagaaacuagauaaauaagguccuaggccgggcaugauggcucacaccuguaaucccagcacuuugggaagccgacgcagguggaucacuugaggucagggguucgagaccagccugaccaauauggagaaaccccgucucuacuaaaaauacaaaaauuagccgugcgugcuggcacaugcuuguaaucccagcuacucaagaggcugaggcaggagaaucgcuugaacccgggagguggagguugcagugagccgagauggugccacugcacuccagccugggugauagagugagacgccaucucaaaaaaaaaaaaaagaaaaaagaaaaauaagguccuagaggauguaauuggcugcaauuuucuugaaaacggaauauaaauaucauuuggugggggcaugugaucuucaguccuccacaggccucucuggcucugcaggcccuaugauauuauaugagguuaccuaccugauccucaaggcauuuggaauuuuaaucuuagccuagaggauauaaaaccuuagaccaggcacaguggaucaugccuguaaucccaacacguuaggaggcuacaucaggaggauugaaacacuuuaggccaagaguucuagaccagccugggugacacaugggucccugucucuccaacaauuuuucuuuauuuaacuagucagguaugguggugcgugccucauaguccaagcugcucaggaagcugaggcaggaggauugcuuuagcccaggaauuuaaggcugcacugggcuaugaucaugccacugcauuccagcuugggugacagaaaaacagaaaagaaaauaaaaaagaaaaagaaaaaacuccugaaaucugaaaucaauuagcuuuaaauaacagguauaugauuuccucauuacaaaggaaaaauuuuaaauguuaauguuucugaauucaggaucuucuuacaauuaaagccaaaagaaucucaaagcagucaagaaugcauuuugaugggaaguaguucuaacuugauauauggugcaaauuuagcuuuguagagaagaaucuauccuaucuucaugacaguugaguuauuugcuuagcauugcauaucccaaacagcuggauuuuaacauuagauucuuaauuuucacuuaaaauguuugaaaaugauuauugucugaugcaguaugacacaaaaaauaauugcguggagaagguuguccauugcaggcuagaccaugcaacuguaaggcaaaggcaaaagccuaauuucuuagaauaaagcauauaauuuuuaaagauggggaggcugauguggccaauacgugagucagaaagacuaucacuucaggaaucaaacaucuaaugucaaaaacuuacagcugaggccgggcacggugacucacgccuauaaucccagcauuucggaggccgaggcgggcggaucacgaggucaggagaucgagaccauccuggcuaacacggugaaacgcugucucuacuaaaaauacaaaaaauuagccaggugugggggcgggugcccguagucccagcuacucgggagggugaggcaggagaauggcaugaaccugggaggcagagcuugcagugagcagagauugcgccacugcacuccagccugggcgacagagcgagacuccagcucaaaaaaaaaaaaaaaaaaaaaaaucuuacagcugaauuucuagagaagcugucaggaaagaaagacaaaacaucggcaauguucaauaaccucaacauuuuauaaagaggucaacaucacauguccaaguuuaauauguuuaagcucuguuuuaugaaaaagguucagacuuaaauugugaaguacuauaaaagggauauaaugguaaggauaaaugcaugcucuauauguuaguagacaagaaaaauuuguguacauuuaauacaguguuguuuauucuuccugaaaaagcuguuauuaaaucaaugguuucucucaugauuaugaagucccauaaucaaggaaauaaacgauaauacauuuuguguugcauauagaggauggcuccuuuauacaugacaauauauauauuuacagaaauauaucugaaacauaugcuaauucacaaaaauuuuaauaaauuuuaaaaacagaaaaauuauacaaguuauauucacugaucacaaaguaauacaacuagaaguguauaauguaccuauaaacgaaaauugucacuccucauaauuguaccaaaaauaaaucuaaaaauauaaaaaauauacaaauaaaauuuauauacauguauguaauaaauuuauauaaaaguauauaauaaaauauaaggccauacaaaccuauaggauauaggcaaauuugcaaucugggguaaauuaauggauuaaaauuauuacauaaaagaauuuagagucugagagagaggauaaauugcuaacaguguuucucagccuuggcuaugcauugggaacuuuaaaaaaaauuugaaagaccagaucuggccgggcgcaauggcucacaccuguaaucccaacacuuugggaggccaaggugaguggauaaccugaggucaggaguuggagaccagccuggccaacauggcaaaacccaaucucuacuaaaaacacaaaaaauagccaggcacggugguggacaccuguaaucccagcuacucaggaggcugaggcaggagaaucacuugagccugggagguggagguugcagugagccaagauuacgccacugcacuccagccugagcaacgacagagugacauuccgugaaaaacaaacaaacaaaaaacccagacccuugccuaaguaaguuaaaucagaaccuuggggaggggacuauuacuauuuuuuaaaagcuacugaugggguucaggacaugcuaccucggcaaauaugccgaggcacauggcaccuuggcauuugagaaaaaggcagaagcaggaaggucucucugaccuucuuccaucauucuccccggaggcaggucauaacaccuaggaaggucauucucugaccuucucccuuccuccuucccuauagacucgcaugugacagguguccugcccuauacccagaggaaaggagugucacauaaggaugaagaauaaaaaucggaacaaacaaaucuugcuauuauaaguuccccccaguuuauuaccauuagaucauauccuuuuguccuccagucacaguucuacaugacuguccauaaaaauaguuuuuccuguuucuuuggaucauuucugaaggcuccaugucuccugaagcuuucauuaaauaaauuugugugcuuuucucuuguuaaucugucuuuuguuauagaggucucagccaugaacuuugagauaggcaaguacaagauccuucuuuuucuuuccuacucuccccagguaauucugaaacauagccagaguuuagaaccagugagcaaugauucaaacaaaagcuuuuaaggccgggcgcaguagcucacgccuguaaucccagcacuuuggaaggccaaggcgggcagaucaccugaggucaggaguucaaguccagccuggccaacauggugaaaccccgucucuacuaaaaauacaaaaaaauuagcugggccugguggugcaugccuguaaucccagcuacucaggaggcugaggcaggagaauugcuugaacacaggaggcagagguugcagugagccaugaucgugccacugcacuccagccugggcgaaagaaugagacugccucaaaacaauaaacaaaagguuuugaaaaagcaaaaauuugucauaagaaaaacagaaagcaaaaaagauaguaaggauauauaaauuugaaagaagaaaaacaacugcaauaaauaaauccaaggacuuuuuaaauaaauaaaauagauaagauuuuagaaagcucaucaagaaaaauauaaauaaaaugagaaaugauacagugcaugacagagaugcaauuauaagauauaaaccauaagauaaauuaucuuauaauaaucaugcaaacauaugaaaaugaauuuuaaaauugcaauuaaauaagugauauucuguaagaaccgugacuuaucaaaaacacaaugaauaagcuaauaaccaaguaagcagugaaaaaaauuaccaaagaauugccccaauaaagucuccaaccaggaugauuuacuaaugaauuuguuccaacuuucaaggaaaagaaaauuaccaaauuauauaacucuccaggauaccaaaaaugauggaaagcuacaaaggugaauuccuaugccuaauagacguaccaugaaaaaaaaguaacuguaaaacaauaguucucacccuggcuacacauuagaaucaccuauagagcuuuuaaaaauccugaugcauuggccacacuguccaccaccagccccccaacccccgccacagacauccaccaucccccauacacacacacacacacacacacacacacacacacacagaaaucagauucucucagggugggccuaggcaucaguaauuuuuaaagcuccccaagugauuacaaacugcaagccaagguugagaacuacugcuacagaacaauuucacuacuuaugauuuacagaagauccuaaguaaaauacaagcaaacagaauuuaauagucuguaacaguuacaagccaccuacacaaaaaaaaaacagcauuuuacucacagaugccaacauguuucccaauuaggaaauaugagcaaauauauaaugaucucacaccauuuccuaccacauacauuuuuaaaugcaaggguaguuccuuaacaagauuacaaaaagaucugcuuuaaaacaacagccuaaauaucuaacauaauacuuaauuaaacuaugugccuaccaaaaucaggaauagaacaauaaugccccuacuagcaucauuauuuaauauuguuuuuaaaagcucuggacaacguagaaagauaugaaguaaaaauauuagcaagaaagagacaaaaauuaucauuauggguagauaaaauaaugaccuaggcaaaggcugaaaaacuaacaaagauuucaguacaaccauaccugaauuuaaaauauucuuauguguuagcaauaaccagcuagaccauacaauggggggaaaguauguucauaauacaaaauuacaaaauacuuaaaaauaguuuuaauaaaaacucugugacccagauaaaacucuaaaaauauuuacuagaagauauauuaauagaagagcuugacuaaaaggauaggcgaaguauauucuggauaagcagacuaaaauaacuuuucaaguggguauuucaaugucauucuggagggacuuagaauuauuauuuuuuuuuuagaugaagucucacucugucacccaggcuggagugcaguggugugaucuggacucacugcaaccucugccucccggguucaagugauucuccugccucagccucccgaguagcugggacuacaggggcacaccuccacgccuggcuaauuuuuguauuuuuaguagagacagaguuucaccauguuggccaggcuggucucaaacuccugaccucaggugauccacccgccucagccucccaaagugcugggauuacaggcgugagccaccgggccuggccuagaauuauuuuuuuaagucuaccugauaaauaguucagccuauuaaagauaguuguaaaauuuaaguguaaugaaggaaaucuagcucucccagacuuuauaccuuaauauaauaguucauuuauuaaaguaguacaauaccacaguaacaagagacauaguagguguaaaagaacagaugcccuggaaauagacucuguuaacaggaauuuaacacauaaugaaagaggagucacauaucaauaagcaaaaaaaguaccaacuuggaaaagcaucaguguauagccuccuuccuguaaaauccaacccaaauaucagaugaaguauuggcuuaaauauaauaaaucaauuccuuucaccuuccaaaaaaauaaauaugugucaagccucagaaggaggaaugacauugcaggcuugggagaaaaagagaaagaaaacauuuuuaaaaauuaagauuuaacuacauaaguuauaacuccgauauacuaaaauauaaacaaaaacaugcuaacaaaacauuuuagaaaauauggcuaaacuuuaauuuuauaaaaauguuuaauuuuuuaaagacccuaaaagagaaaugggaaaacagcauaaacaaaauucaugagagggucaacaaauaaaaagaaguucacucuaagaaacugucagauuaagugcaaauuaaaauaacaacgaggcauaggguuuauguguguguuucuccuauuaaauggaccacucauuacggaugagauuuuaaguuaguacaauuuucugcggcaauguaauguuaugaggaaccaauuuaaaauuccuaccuccucucaggaacuccauuuccccgcacguaguccaaagaaacaacccaaaauacagaagaaacuuguaugugcaaagauguucuuugcagcuuuuuaucauagaaaaaaaaagguagaauaaggggaccugaaaaguuaacaaaaagggaagggcuuggugaauuacggcacaucuacguucuccauggaguauuauaaaggcaccagcaugauauuuuugaaaaacaugaggcaauaagaaaaauacugaggcuauacaguaauguuaagugacuaaaacacaggacugggccgggcacgguggcucacaccuguaaucccagcacuuugggaggccgaggcagguggaacaccugagauuaggaguuggagaccagccuggccaacauggugaaaccccgucucuacuaaaaaaaaaaaaaaaaauacaaaauuuagccuggcaugguggcacgagccuguagucccagcuacuugggaggcacaggcaggagaaucacuugaacccaggagguggagguugcaacgagccgagaucgcacuacugcaauccagccugggcgacagagugagacucccucucggggcggggggggggggggggugggggggggugggggggugggagaggaggacaaagaaaaaaacaaaaacaaaaaaaaaacaccacaagacugaaaauuguuauauaccacagucauaacuauguuuuuuaaaacuauguuuuuaaacuaugcucuaaaaaccaugacuacgcuuuuggaagaaacugaggguggaggggaggaacaaaaagcauguaauggcugcagcucggguagacacguggcugggcagugagaagaggcgugguaaaggaggggcuggauggccguggggaggugaguguugcucuuagauggagcgggcugcuggccugacccaggcuggcaggcgaggugaugggggcugggcaggcuucccgacucggcuucuacaguauguucugcccuguccuccagcuggccguuggggaucagggcaucuaggccagaagcccacccaggggcacccugugucugaucccuaaggugucuuguagucauuucauggacucugacaucuccaaagggccuuguauuccaaaccaaaaguaagaguuuugaucggaagcacuuuguuuguuuuugagacagagucuggcucugucccccaggcuggagugcagugguacgaucucagcucacugcaagcucugccucccagguucacgccauucuccuggcucagccucccgaguagcugggacuacaggugcccgccaccacacccagcuaauuuuuuguauuuuuaguagagacgggguuucaccguguuagccaggauggucucuaucuccugaccucgugauccgcccaccucggccucccaaagugcugggauuacaggcguaagccacggcgcacggccgaucggaagcacuuugacuccccggaagcacuuugacuccacggaaguaccuuuuuuuuuuuuuuuuuacauccgggaaguugcacagcgcaaaaucagaccauuugggacagucuuaggagugcguuccgggcucggacgccauaccaggccacuuugacuccccggaaacacuuugacuccacggaaguaccuuuuuuuuuuuuuuuuuuuuacauccgggaaguugcacagcgcaaaaucagaccauuugggacagucuuaggaguacguuccgggcucggacgccauaccaggccuggauccuuaggacuucuccagagcacuuugaaauaauuguggaagggcuuuggcaucucuagaacaccgagaacugugauagacaguugaaaaaaggaggcgccggaguggcgugagggcccuccagcucuggggcccgucggcacgcagaaaaguaccaccggagcggcacuuagguaggaucccccagcaaacacaggugccccgcagagcucaguaacgugguuugcagcaaacacaggugccccgcggagcucaguaacgugguuuggaaggggagagaggccccaaaggccugaaaggccuaaaggcuacuuuguggccugcacaccguguuuuucucaagguucauccugccacagaaauucuuucuccuccuucuccucccauuccucagccacuggccugauuagggccggcuccaaagacugccucauuuggagcauuuggaguuccuuucguccuugugauccccagugcacucugccagccccguuuuuaaagaaauggcuucucuggaggaggguaucuacagccuuaaaauuaauuccaaacguagcuccuauaauuccaugaacccucaauuuacagcuggaagugagggucaaaaugaaacugaggaaccaaacaaguuccagagcaggaaggguagaccucaagauaguggcucuucauugucucugaguguucuccaggagauccugggagaugacauuccaaaaguaaaggaagaggcugucauuaguucacaaucagaccuaggagagugucccuacuguggagaaagaccagccaggaaugccacuaucuuugcuccucaaaaagagaaagagucagccccagaaaugagcagcuccugugacaagagggugacuguuaauccuccugagaaauucagugaggggcgaccuaaaacacaaaauacacucauuugugaaaaaugcucucagccuucaaauuuucuggaugacuauaacccccauguaauaauccaaaagcgacuuagcaaccaaaguagagucauuugugaaaaaagcucuccaccuuuaaauguuccggauaacuauaacucccauucaguaauucaaaagcacaaagaaaagauggcaauugagcgccccucuucagggagugacuggucugauguagguggaaccacagucauauucucugaagagaagccauucucacugugucuuccuguagugucagagccuccauacuacgccacugacuacaccacuuuuccaccucauuauaguccuuggcaugacuacaccagcucuugguucagcaguaccaagucuucuugcuaucccuccuugggcagcagcaguaacacauugcaggcugggaagagcagcuguagcagcagcagcagaagcaacaacaacauauuccagggugagaggagcagccaccagagcuuccugagugauuauuccaccaguuuuccagugagcuccgaaaacacauccagagaucugaagaugacagaggaaggcagauccaagaauucuuccuuauuuuacuacuccagaaauguggaagcagaggcgaaggaggagagaguauaucaagaggagacauuaggacauccuuauggaggacgugcaucuagcuuuccgccaaggaccaucuggcagccagagcaaccggguuucauugauacccacugucauuuagacuugcuauauuccaggcugccuuucaaaggcaccuuuaccaaauucagaaaaauuuauagcaacaccuuccccaaggaguuucagggcugcauuucuugcuucugcaauccucaaaaccuaagugauaaccugugggaggaucaguugaaagaugaucugguuuggggggucuuuggcugucgcccucauuuugcccauuauuauaacaacuaucaagaaagaaguauuuuaaaagccuuacgacaccccaaggcuguggcauucggcgaaaugggcuuggauuacuccaguaagugcaccacgcauaucccagagcagcagaaaguauuuaagagacugcugcggcuggccgucucucuaaagaagcccaugaugauccacugccgagaagccgaugaagaccuacugcacaucuugaaaaauuacgugcccucugaccacaagauacaucgccauugcuucacugggaguuacucagucaucgagccccuguugaaccacuuucccaaccuguaugugggcuucacggcaauucugacuuacucuucugcugggcaagcccgagaaacugugagaaagaucccgcuagagagaauuauuguagaaaccgaugcucccuucuuccucccucgcuggguucccaaaagcuauugccaguaugcccacccaggccuggcccugcauacugugcgagagauugccagaaucaaaggugugucgcucucccacaccuugaccgucuugcgggagaacacccaucgccucuaccaucuuuaaacagaaaaggcacagucaggagucuucccaagaaaggagaccgguagccuaacaaaacauacagacuagauuugaacucugcguauguccugggucaaggauguguuugaagaauucguuggaacggaguaaacuaggacaggauauuuuccucaaaaccuuuucguaagacuucuguuucuggcugguagggugggguacaaugggauggcaggaggguuaagguaaacugcccuugauguuauuaagguuuuucuucccagcaaaaaugccuuaagguagccaguaaagaagacagcuugauagaauacaaagaguuucccaaucuaaaucccuguccucugcagccugcuuuugaucgcuuggugaauaaagucacccuccuacuugucuuuaaaaaaauguagaauuuuaaaagugagguaggugauuuguguauuauauuuguauauuauaggaauucuauuuaaaaaaauuuaaaaaucggccgggcaugguggcucacgccugucauuccagcacuuugggaggccgaggcgagcggaucacuugagcccaggaauucaagaccagccugggcaacauagugaaaccucgucucuacaaaaaaaaaauaaaaacaacaaaacaacagccgggugugguggcacacaccuguaauuccagcuacuugggaggcugaggugggaggaucacuugaauccaggagucucaggcugcagugagcuauaaucacaccacugcacuccagccuggcaacagagugaaacucccaucucuaaaaaaaaaaaaaaaaaaaaaaaaaaaaguuuuuuaaugaaaaauaggccgggcgcaguggcucacgccuguaaucccagcacuuugggaggccgaagugaguggaucacuugagcccaggaguuugaaacuagccuaggcaacauagugaaaccucguuucuaaaaaaaaauuuuuuaaauaaaaaauguaaguauacacucaacaagguaagcaagauauacacacaaugaguuuuccuuucaaaaaaaauuuuucuaucaaaaaaauuuuuuuuaauuuuagaugagaaaacuacuuuuccaaccugcuccucucucccugcauuucuguguggcaaaugcaaguauuauacucugcaguguuucuaacaugcaggagagaaccuuguugcaauucaccuuuauuucuuuaggaaggggagugagcaauguaguucugaguguaguauaucaagaguggccuaaaucaaaaagcacaaccuucauuuacuuauuccaugagugagguaaagaacaguucacuuacucauguuacuaguaaaaucuugcaaugcaaaugugcaaaauuugggacacuuaguaaauaguuugcuacuuaagugauagauauuccauugaaccucgaagaauuauuauuuagcauuuauuuuucuggcauuuggugugucuacucucccauccuggaggcaucagagagcugugaaaguagccaguaaucuagaaauucaauuuacucuuaguggucccugggccauuaguccagagucacagagccucucaaggcccauuaacaggcucccugaaccuuggcaguccuuucagggcaugucaacauuucgcuucacuuaaauuuuagaaaggcagcuauuucuaccuuuaaagcucaaaagaaacaaacugcccacuuugucuugggagacagagggauuugcuuuuucaguugguuuuuauucauaucuaacuucaaaauucauaccugcuuauuaaaaauuuuugagacaagcaaaaaaauaaacgugauuuuuuaaaaacccaaacaaaauaaaagcaacagaaggaaaaaugcacaugguaaaauugauuuuuuaaaaaucaauagaagagucaaauauuuacaaaaucuggauauacaaaauuugacuuaggaaaauugauuuugguagaaaugugaucaucaaaaaaaacucagauugucaaaagccaugauggacagcauucauauagacaaaaauuaaugaaccaaauguuuccaguaaaauuuauuguagaaaaaaaaucuauugaaaauauuucuuaauaggaaaauaugguaacaguuuacccgcauggaaaaauuguucaaagaauuaaaguagcuuguaguggggaaaaaaguaaaaaguaaaaauuaaaaaaaaaaacacacaaagagggaguaaaauagcccauaaugcuacccacuuagagacaaucacuaacauuuggaguagcucuuuggcaguuuucucuaauauuuccauauauuggccaauuccagcauuguacuuaagucaauuuugcuaauuaauacuauucacuucauaguuagcauagcuauacauuuuacuuucucugaguuuaugauuuaaauacauuguuuucuguauuuuuuguuuagguuuaauucuguuuguuuuaaauacucaacucagacggcaugugcuuuuucaaaacuauuguuuacugauacaaaaaauugugcuuugaaauuuauuuuucuuuuuguucucugaugucuguuuuauuguguauuuuuuaaugucuuaagcuaaaugcuuaguuuauuuuuaauuuggagagcaauaacaaagcagucaauacuacaaaugugucuguaauuauaacucugcuguauacauagauuuaauuugauaaaguuuacacacuauaaaaauacaaacguauuacaaaaauauggaaauagagaguagcaggaaaaaguauauggcauuucuauuaccuagaaccccacuguuguugaugucuuuccuugacauaguugugaccauauagccuguuaaauugcauauucuucuaaauaauucauauuuuuuuucuaucccuaucuuggauuuggggcucauuuuaugauuguuauucuuuuaucuuucaauaaauacucaaaauguuuauguuauguuuugaauuuuauuuauauuucacgaccuauuauauauguuucuuucuacuacucaccacuaaucauuuuauuucaugaccuccccaugguugaacuguuuaauuugcuuuaucucuuaauugacuagcaauuaagcaacuuuuucaggaaaaguauguggauagcauauuagugauaaauuauauaacugagaucuuacugcuguuuucacuaaugauaacaccuuggcugaguuuagauuuucugagucacauuuuccccuaaaaguuauagacauggcuucauugucuucuggcauuuaguauugcugagaauuccaaugucaacuuugccuuugaggguuaaauuacuuuuucuauccugaugcuugguaauuuccuugcuuuauccuugaaaauuugucaggguagaucuaauuauugaucucuuuuuuauuuucucugguacagaauaaguauuuuaucugccggucuacaucuuucuuuucuuucuuuuuuuuuuuuuuuuuuuuuugagacagagacucacucugucgccagggcuggagugcaauggcgcaaucucggcucacugcaaccuccaccuuccagguucaagcgauucuccugccucagccucccgaauagcugggauuacaggcacccaccacuacacccagcuaauuuuuuguauuuuuuguagagaugggguuucaccauguuggccaggcuggucucgaacuccugaccucgugauccgcccgccucggccucccaaagugcugggauuacaggcgugagccucggcacccggcccggucuacgucuuucuguaauccagaaaguugcuuuuguuuguauuguuuucuuaugguaugcuuaaucaauuugguugcuuuuaaucuagacuuuaauucuuuaggaacaauugucugcauguuagagcucaauccucuguccaaccugccaucaucucauugcucuguuaucuuuuuccauugcauuucaggagaauuucucaaguuuaccuuuuccaucacucaucccauucuccccaguuuuaauacuuuucuuuacuacauauaaugcauuuuuagauuccucacauuucauccuucuucagcaaucucccuuugacuuuuugccugcagucucauucaauaauauuuuuaauuugcuuuuacuucucacuuuguauuauauacuuccuuacacaaagcacauuguuaucaaaaauacuuauuuuuuucuguagaaaacauacuuuuaaaauaaguauuuuucuuccucugccucuugaauacuauguucuccauuuauguuguagaaucuuuucagaaaccuuaaguuucuuuguucauuccugaacaaagagcagucuaucuaggcugguguuuuccacaaaauaggguggguggguggguuuucuuucacucccuucaccaucuauccuaauguucuuagauaccuccucucugguuaauauaaauucauguagaguggucaagagaaguaggaagggagcuggaaccauggguaguccccagcaggaaaaacuucuaauuuuccauauaaacauuuuaugaguugacccaaccuccacuccaggaagaguggccaguccuuuguaugccguugccuguuccaucagagaaaagcccgaaugcagggccugcuuugacuucagugugacuauauuucugggucuccuagugacacucuuaagccaucaauaguugugaaaguaaaccauguggaaaccccuacagguuguccuaacccccaacucgauucuugucacuuucucgggaagugaaauugcaaguucguuuggguauauucuuucaguaucaucccaucugcacuauaucagguggaaacucuucaaaguuugcaacaugaagguggaacaccucccuggccuccagcaugaauuuaguuucuccacauuuuaaaauuuugcagugauuucaauugggauuguggagguggggguacaucuaaauaccaaugcucaaguuauaaucucacuccaaauucuuauuuuuuuccucucacuucauuuuuugauaaauuuauguuccuauggauacuguguuuauauaggcguaucuuauuuuaagaaaacucaaguuauacaaaccugaaucucauuuagcauguugaacauaagagauggucaauaaagguaaguugcauaaaugaauaacaaaaaagauaaauuacagagggaugacuuccaaagaauuuuuuuguauuacaaaaauaucauaaaccuauuuauaaucgauacucaaguuuucaugacuaaaucuaugguuuaagauaaaaugcaccuguaugggcaauauaagcauucauaaaauuuaguuuuacuugucugcauaagacaugauuuuaugaugcaugaaaauggaaagggaaguggcuagaaugcuagaauguucacguagcuuuaucacuaauuaacuacaucacugguacaaaccacuuaagcucuuuguucacugauuaaccuuucagcaaaaauuagaaaaucaacacuugcuaaccacagugauaaccacagcacuauuuaaagaauuaagaaaauuauguauauauaacagcuuuggagagaaaaugaauguauaaaaauacugaauaauauauaaaucaguguaggaugcaaagcuggaagcuugaaaauacugucaaaaccauaucuaaaauagucuucacauccuuauggagucuauugcgcaagcaauuaaaaaacacuugauauuacuaagagaagagauuccaaaccacuguuuaaaaucagacuuccuggaaaaaugauacuaggacuagaagaaagggggucacccuauccugcagaaaucacauugcuaaucauggaguuuuauaaacugaaucaagaaaacugacauucaauaugaaaaauacaaaagaaaaacaccuaccauauaaaaaauuauauauauguguguuuuuuuguguguauauauauacauauaugauuguuccuuuaucuuuuauaauauuuuucauuuaucacauacacacacacacacagaaacacauauguauguacauauguagguucgguaccccauauccgaaauucuugagaacagaguguuucagauguuuuucagauuuugggauauuugcauauacauaaugagauauccuggggaugggacacaagucuaaauaagaaauucauuuauguuucauacacaccuuauacacauagccuaaagauaauuuuauguacuauuuuuaaugauuuugcacaugaaacaaaguuguguacauugaaccaucagaaagcaaaggugucacuaucucagccacucauauggacaaucugugguuauuuggcauaaucaucauuccugacugaauuuauaugcuuuggauaagcaauaauuuucuuacacuuauucacaugugauaugguuuggaucuguguacccacccaaauuucaugucaaauuguaauucccaauguuggagguggguccugaugggaggugauuggaucaaggggguggauuucccccucgguacuguccucacuauagugaguucucaugagaucugguuguuuaaagguguguggcaccuccccacuccuuuucuuccugcuccagccaugugaagugccucacucccccuuugccuucuaccaugauuggaagcuuccugaggccuccuuagaagcagaugugccaugcuuccuguacagccugcagaaccaugaaccaacuaaaccucuuuauaaauuaccuagucucagguauuucuuuuccuuucuuucuuuuuuuuuuuuuuuuugagacagagugucgcucugucgcccaggcuggagugcagcaguggugcgaucucggcucacugcaaccuccaccuccagguucaagcaauuccccugccucagucuccugaguagcugggauuacagguacgugccaccaugcccagcuaauuuauacacucuauuuuuuuaggugagaagaaacaucagaagaaguugagggaccaggaaguagguccucuagagaugaggaggcauucugcuggauggcuuucuuaaauguuuccuccagaguuaucagccucauuaauagagguuuuugucuuauaagugccccugauuuuaucaacugacaugauuucuuguucuguuauggaugcauauggcucuagucauccaauaaucccaucacaauuucaccacaucaucuauaggcacuuuuuuuuacaguuagcaaugucaucuucaucaucaccuugauuuagaaccauuucagcuauuauagguuggugcaaaaauaauuacaguuuuugccauugaaagcaauggcaaaauuuuugccauuucuuugcuuguuucauaaucagcauaccauuaaauggcacguguucacugugauacugauggacucacucuuucaauacauguuugagaccuucauuuuuagcuuuaugcacuguuuuucuauuuuucauuaauaaccucuauacaucacuuuuguauagaacuucaacuguuuaucauucuguuucuucaggucauauauaguggucacuccaacaccauacucuccuguaagaugcuucacaguuacacugcuguccaguuucucccacagcuugacuuucuaugcuauggauacacauaaauccuuccucuuacccauagggcuaucuucagaccuauuugacauuuucaacaauaucuuuacaccacagagcagagaauaagcaaaaauacacaaugaguaaugcacgaaggucuugguccuacacggggaauuguggggaacgugccguuggcauauccagccugcacaugugccauuuuauuacacuuuguaggcaugcuuguuugggggaaucuggacaugugcaaagaaucuauacuguaggugaaggggguuggaagggcuuuuucuucccuugggaugcugaauaaacuguguugugcacuuguguuuugacugugacccaucacaugagggcagguguggaauuuuccacuuguggcaucaugucagcacucaaaaaguuuucagauuugguauacucaacguguguguguguguguguguguguguguguguguguguguguguguaaaauuagcaggaauaauaugagaaccaaggcaaaaacacuccuucaugccaucauuuugcaauauuuuuuaaaagcuggauuccaugcaaaagagucagaagaaagaugcuuggauaugaugcccuuuauguucuccuccaguccaaagaauuuguucuauaauucuaguaauuacccaauaaauuggaccucccaguacauuggaugauuuuaaugggauuuuaaugaucccaaaguauguuauuuauuucccacaagugcaucaccaaccaaggucacaaaauggguacuuccauuacuaauggaaaauaauacaaaccaaaccagccacagaauaccugcuaaguucaaagcucugugcuguggauacaacacucaauaagacaaucucuccagcuacaaagaguacacagucaaguaaggggaauaagacuauaugcaaauaacugcaaaacagaguaugguaccuccaaauaaugauaaugcauuggagauaaaagcuaaaagccauuaggaaagacuuaauaauauuguagcuccguauauauugccaaguugucuuccaugugucaggcguugugcuaagcucugagaauucaaagcuaaauaaaauagccaacacugauuaaguacuuauaaugggucaggcauuguauuaaguacuuuuauacucuuaucucauuuacuccucacaaaacaccaauaaaguagguaauacugugauucucauuuuauagaauucaagauuugggagguuaaguaaucuacacacagucucaaaguaagagaaugagacagcugggaacacaagaugccuagccucagaggccacaagcuuaaccacuaugcccugaacugccacaaaaucuccacucacuccugcucaguggaggacacagagaagaguaauaaggguuuaugaaaaugcuccaaaaggagagggaauugccagucaccugaaaguauuaagcagaaggcaucaugguggagguaacaucugaaaugggucuucaaugggcugaaagacggaguaaguggacaagaagggaagggcauucucugcaaaggggaacagcaugugcaaaguuaugggagcauaggaguguucgguaugugggguacugcaagucauuuuguguggcuaaggguugaguggugaugggggagcaaaggagaugagacuacaaagguacaagagccaaaauauagguggucccuaagccaugcaaaggaggucaaaggagucuaaacauuuuagaaaguuaacucuguagcagagugggcaguugagaaagggaauuauauugaaggcagggaugccuucaacggaggcuacucuccaggugaaagaugaacuaggauggcagcaguggccauggaaagaagcagacugaugaaagggagauuucagagggagacgagaggacuuaggucaacugaucaguguugggagagggguggguaauggcaguucucuuauuuguguaagcauacacaaaaauauaucauuuaguaaguuaacauuuagaaguaacucaaauaauaagccaguguggcuuagucucagcaugguaguauauucaaagaaaaggcccagcaacuaauagcaauugaaaauccuguuucaucuucacuuagaccuccaaggaaaaucuaaaggugauccaauuuaugcugcacauccacacuucucccccaaaaaagccuuuucucucuuuuucgauucucacgaguuucacauuucaucaccaucagugcucucccacucauacucucucucccuccuauccacuucuuccuuuccuauaucccacaaagcauaagaacaacugaaaaagucagaagaauccuuagaggauggagguggagaaaaguggagugagcaaagacaaauuuuuguuuagcaggcaggguauguggaaaaggagaaagcugggaacacacaauaauauuaucuccauuaccuacccauaagaaccaaagcuucaauucauaaagcugacuguaaaagccaaguagaccagaacugaaaauaguuuuaauauguaaaacuauuaaaauaugauauuuuugauauguaaauauaaaugcaaaaauaaaugcuuugaaauucugaaugaaaaauaucaacaaguagaaucaaagagaaauaauaaaaugcaugcaaaacauauuucauauuuuaagccaaaaaaaggggggaacaugguagacugcaaaggaaguacaauuucaacuaaacauaaaaggaccugcaugaaauuucuagaaccuagaggaucaugguauaaaaucuaugaguacaguuaugaauaauaggcauguaaauacaguuguagcagccuauuacugacugcuauuaguucagaauaaugaaaaaauaaaauaauuuaaaagguaguuauuuaucaccuuuccuccuaaaagaccauuaaguaaauuugcuaaaauagaagagacaugacaaaaucuuuuguuuaaacaauauaugauuuuaugaacuacccuaauuucaacauaaauggugcccagaacaauuggaaagagcaauacaaugauagcuuaauagcugcuuuuuagaacucacugggcucagugguagcaucuccaaauuuauucuucuggaaaaucccagaauuuuucccaaagaaaaaugcaagaauccuguagcacaaaugagcauugggauagucccagcuuaugcuucacuuccccuaggaaaacugcucuccccaccccauguaaggaaauaauucuucgugacuacuaugaccugggcauuugacaugcauuacccauuugauacucacggcaacucuaagguggguuuuguuauucccacuugacagaugagggaauucaggcuaagagagguuaaaaacauggccaggaugaaauagguaauagaugguaaauccagguucuaaaccucagucuaacugaaaagccuuguucuuucuacuauaccaaagagccucucauuaaggagguauugcaggcaggccauguuuccaaagaacacccuagacacugcacacagaguuaauuucagacaacacuccauuuggagagacauauauacccuggguccagcccuaggggaaaggggaaggggaaaggcccuaguaauaauaauaucaaugaugggcugggcacaguggcucacaccuguaauccuagcacuuugggaggcugaggcaggcagaucacgaagucaggaguuccagaccagccugaccaacauggugaaaccccaucuauacuaaaaaaaauauauaaaaauuagcugggugugguggcgugcaccuguaaucccagcuacccaggaggcuaaggcagaagaaucauuugaaaccgagagguggagguugcagugagcugagauugcaccacugcacuccagccugggcgacagagcgagacuccaucucaaaaaaaaaaaaaaaaaaccgaugaugaugaugaugacaacaaugaugauacucuccuaagaagagaagucagcaacugcaaggccagaaacaggcgaagacaaaguaaggaaaggaagaaaguuaaauagggcacucacaauagaagaugaauaaaaauggaugaaaguaaagagaaugaggaugaagagacagaaguccaauaaaagagaaaagaaaacagaaaaaagguaaaaaaauaaaaauaaaaauaaaauuaaaaaaaaaaaacaccagaagggaagggacaagaagguugagagagauggaauaaaagaaaaggaaaugggacaacauugaaaaaagaauggagauaagcauuucuucauaucuuugaauaaugugguguuauuaacaucuuaaaguauuuuaaaaccucugaaggagguuagaagaguaauuugaaaaaacugaagcagaauguuuuaaaguaaagggauaucaaaccagaggacuaaaaaggacuguaaaaugcccagaaaucuguuauaguauauuauuacaugaauuugcuacacuuuguuuauauacacauugucaaagcugcgccucaaaucuuaaaucucaaacaguaagcuagauuccagggcagaugcaccauaagauuccguuuaucugaaaucugagaaaaaaaugaaagacuaagcuauggugauagaagucagaacaaugggaaagggcuaaacgaauugggggaauaagggaaccuccugaggcaacagagacgucuagacggugucugggguggugguuacacagaugcauacauuugucacaacuaauggaauuguauacuuaaaauaggcucauuuuggccaggugugguggcucaugccuguaaugccagcgcuuugggaggcugaggcaggcagaucacgaggucagcagcucgagaccagccuggccaacauggugaaaccccgucucuacuaaaaauacaaaaauuagccaggcgugcuggcgggcguuuguaaucccagcuacuugggaggcugaggcaggagaauugcaugaacccaggagguagagguugcagugagcagagaccgcgccauugcacuccagccugggcaacagagugagacucugucucaaaaaaaaaaaaaaaaaaaaaaaaaggcucauuuuauuacauauaaauuauaccucaauaaaguugauuuuaagaauuaaaaugaaguuuaccucaauaaaugaggacucaaacagcaaaauccuaaagaacacaguuauucuguauccugaacaugguggugguuacaugaaucuauauaugggauaagauuccacaggacuguuaaacuaagggggaaaaagugagugcauguaaaaacuggugaaauccaaauaaaguuugcgguuuaguuaauaguauuauacuguaaaccaaaaauaaaauucuaagccccccagccaucugaacagaucccuccucuaggccaaggacauucccaaguuagccugaaaaacuaguuucaggccaugaugggaagggggaaccagacauuccuuauuauacccuccucccuuuuggaauucaggaaaaguugaccagcauuaucgucaacacagaccuuaagucugauaagaaacauuuacaaucuauucugucugaagccugcuuccuggaggcugcaucugcaugauaaaacguuggucuccacaagcccuuaucauaacccagacauuccuuuauauugauaauaacuccuucaaccaauugccaaucagaaaaucuuugaaucugccugugacuuggaagccucuccccggcuuuguguuggcccgccuuuccagaucaaaccaauguacaucuuacauauauugauugauguauuaugucucacuaaaaauguaugaaagcaagcuguaccccgaccaccuugggcacaugucgucaggaccuccucaggcugucacaggcacauccuuaaccuuggcaaaauaaacuuucuaaauugauugagaccugucucagauacuuugggguucacaaugccaaugcugauuuccugcauuuuuguucuuguuuuaccauguugcagaagguaaaauccugguuuugauaagguauaucaaacuguuauauaagauguuaucaucggggaaagcugugaaaaggguauucaggaacucucuguacuauuuuugugacuuuuugugaguccaaaauuacuuuaaaaaaaauuuuuuuaagaauacagcuagauuauauggucuauggcauuugugcuaucacccaccaucagcguuacaaaaagugaguuuaccauagggcagaguccugcaaauacaaaauaaaggaagguaaauaauuuuuuuuuuaauauuucaaauaaacuugcagcugguuugaacucgggggggaagaauacauaaauaaccaugacuuuuauagauuaaaaguucagaacaaaauauaaaucagccuaaaauuuaagucaacaagucaaauagugacuaucaguuucuuccuaauuugugaacuaaaaucuuauaaaugacaaggauuuuauguucaaaauaacuauaauuagugugcacagaggaugaggcagcaagaggguagucaucuguaagacaagaagagaggccucaggagaaaccaacccugccagcaccuugaccuuggacuuccagccuccagaacugugagaaaaaaaauuucuguuuaagccacccagucuguaguauuuuguuauggugaaaucgucuuuacaaaaaucauaauugagaaaauuauuacagugaaagagaucugaccuaaccaacuccaucuugcuucuaaccuccaagcuguccuuguucauucugaggcauaggucaaacuaacuucaggaggaacuuaguguauaguuaaacuuugaaacaaaaacauacuagcccuuucccaaaacaaccccuuccugccuagggacuagacugccuuugcagaaguaacgaauuagccacaagauuagugauuaugguuuaggagucauauagcuggaggcugcaagauucuaaaccuccccaaauugcuccuggggaugaauaagaucacuauuauaaaaccuaacaucaccagguacaguggcucacaccuguaacaccagcacuuugggaggucaaggcgggcagaucaugaggucaggagaucgagaccauccuggccagcacagugaaaccccaucuacacuaaaaauacacaaaauuagccgggcgugguggcacacgccuguagucccagcuacuugggaggcugaggcaggagaaucgcuugaacccaggagauggagguugcagugagccaagaucacgccacugcacuccagcaugggugauagagugagacucuaucucaaaaaaaaaaaaaaaaaaaggaaaaccuaacaucagugcuugagauauuuugcagacccuguacucaauggaucagcuggcaccacccagauugacaaacuggcucaucuggccuuguggcccccacccaggaacaauucagugcaagaggacagcuucaacucccuaugauuuccaaccugaccaaucagcacuccccacuuuccaacccacuccccccccgaccaaauuauacuuaaaaaacccaauuccugaguuuugugggagacugauuugaguaauauuaaaacucuggucuccugaacagccagcuuugugugaauaacucuuucucuauuacaauuccccuaucuugauaaaugggcucugucuaggcagcaggcauggugaaccaguugggcaguuacaauggcaacccaaacaaacuaauauuuuaagcuguaauuuauauaccauaaaauuuacuacuuuuaagcauacaguucaauggcuuuuuguaaauuuacagagcuguguaaucaucaccacaauccaguuuaaaacauuucuaucacuucccccacaaaaguccccucucccaccaucagccccagucaacugcugaucugcuuuuuccuauguauuugccuuuucuaggauuucauauauauggaaucauauaauaggaagucuucugugucuggcuucuuuuacuuaguguaauguuuuugagguucacccauguuguaacauauauaucauuagguuucuuuauuguuguauaguuuucauuauguagauauaccauauuuuguuuauccauuauuacuuaagggacauuuggguuguucccuguuuuuuggcuacuacgaauaaugaugcuauaaacauuucacacagaaguuuuugugugaacauguuuuaauuucuuuuagauggauacauagaaguggaauuacugggucaugcagcaaguauauguuuaacuaagaaacugucaaacugucuuucaaaauggcagcaccauuuuacauuccuaccaggaauguaugaagguucuaguuucucuacaugaucaccgacacuuagugguaagagucuuaaaauuauagccauucuaauggggauguagugguaccuacaaaaguuaaaguucaaaaagacaauuuuaacuuuggacuaaucagaauaagccacaggccuaguuacugauaaaaaguuuuggccugagggaagggccuuaaaauguugucaaauagcuaaauucuagguuuuagaaaagagggaaggaagaacucucuucuuuaguaaaaggcucauuuaugauucucauucuuuuuauuccaaaaacauuuauuccagacuuggggauuauuuuuauuaagugccuuuugaauuucaaaagaagauuaaagaaaccuacauaauacaaugaaauuggaagcuuuaucacuuuaauauaaauuuaaagacuaaguguuuuauucuuagugacaaaugcagaaugcauaguugagaauuugggguaugacaugguugauuucaggcaagauuuuuuauuucuucucuaaaacuaaauagcugaagaucuguguacuugugauguaaaacaugggauuaaaacggcaaauguauugcaauuacguugucuuauaauuauacauguuggugucuuuuaugacaugguaauagcaagagucagauaaucugagaauuauauaaaccuauagaaagauuuccauuugaaauuucggguaugguuuaaugguauaucuaauguauuuuccaguuuuuuuaaaagcuuaauuguauuuuauuuuuauauauucugauuauauuuuauaacauuccuaacuggcuuuaggcaaaacuucaagaaucuguauuuacguauuguucuuuguuaagcaagugaaauuauaauguaccugaucauucguuaauccuaccgcaggaaaauuaaaaauucuagcuaguacuggguaagaaagagaaaaguagccccugacauccaggagccggccuauacuaucagcuggucuuggugcuguuacaagcuggccuggcauccacagcuaggccuugguguucuccugcuaaacaagaauaauuucagagaccaccaacaucagacaaggccacucugugaccgugacggaucaagacaaaaccaagaccacuccacagucacaucuaaacacagaaaaugaaccuuguccagccaugaaaugucaaacaucccccucuccuggcucacagaagugacagcugcuucucucccaauuauagguauagacucacucuagucuguucucucccucugagauuuauuaagauacccaguuguagauguaccccuacuuccugauagcacccaauccagagcaaagcccugcuuccuuaaucacuccccacaauuacuuaacacaagcccaaauccuauaauaagccuuuucuaacaccugcuucauuagacaucccacaguugcuuaggguauguuuuuucccuugcugcaaaugaauaauaaacuaacuuguuuaaucuaaaaaaaaaaaaaaaaaucaagaugacccaggggaccaaauuauauuuuaaaaauuuauuuuuauauuguucaaaucauagagucacacagcuacauaaauaaucagcuacauaaauaaucagcucauuacaagcucgaugucaauuaauguaagugauuaaaauucaauugugcggucaguaguuuugauuauaaccauuauguuuacaauagauggaaaaaaaaagaaauaauauuuucaaauguaugcauaucccauaagaucaacuuuuaucuugccacuuacuauaacugagucauuugugaaauagcaaacaaauuaggcuaacuaggagcuguugacaaaugaaaaaugagagcaaaauuguagagucuauguaaauggggcuuaacuuccagacgaaagucauauaaaaacauucagucauuuguauauuucuaaauauuccaacguuuuauaaaagcagcuaacuauagaucuuauacagccaccauagcguagcauaaacugcuaaaugccaaauuucaauuaauaaugaaguagugggugccugauguaauuagagaguccuaggccauuagauccagggucugggcucaguucuaggauaaacaagcugaauuugacuuuagucaaguuuuagacguaaauugccagagguaaaagggccuuacagaucagcuagccaaguccugcauuauaguuaaggaaacugaggcucagagagguaaagugacuaagccacaaucacacauauaguuaauggcgggaccagaaccagaaucagugccuccaacacccagucucagacucugguuccugcuccauuucuccuugagaaugauucuucauuuauaugaugaggacaaccgucuauauuugcuuccuacucauggagguacugggaugaugacuggaaauaacuggcgugagugaugcauuuugugacuuggacaguguucguguucuguguucagacaguuaugauuauggaauagucuuguuuuugucuuggccccaucauagucugcuuuuauuuaaaugaauucaaugaaauaacgaagucuuugaagggugggugcaguauuaagcaaaauucuuuugccuguuuuuagaaauucucccaaugcuacggguuuuaagcaaguaguacacacacuguguuucucgguggaaacaguauuggcauuugagguagaacaauuuuuccccaauguaggguugccuuccccacacugcaggauauaaaauauacacuuggccccuggauacucaaugguagcagcaccuccuggucagggcuggcccuagggugaggcgauuuaaaacaucaaaauuaaugcaagccaggcgugguggcucaugccuguaaucccagcacuuugggaggcugagggggguggauuaccugaggucaggaguucgagaccagccuggucaacauggcgaaaucccgucucuacuaaaaauacaaaaauuagccgggugugguggugggugccuguagucccagcuacucgggaggcugagacaggagaaucgcuugaacuugggaggcggagguugcagugagccaagaucgugccacugcacuccagccugggcaacagagcgagauuccgccucaaaaaaaaauaauaaaauaaaacaaaauuaaugcaaaauauccaggagaaacaaaauaucaaaaugccaaauuuuuaaugaagauuggaucaguauuacugauuuuuccuuuugccucaggcuccaauauaacuuccauggcacaguugcugaucuugucuuuauuuaaaauguuggcauuuuguucaucaugaauuucuggcauuaauuugauuuuuuaaaauauuauacuagcuuaauaacagauaauaauaauaauuagauaauaaaauauuaucuagcuuaauugcugaguuuuggggcaccccaaauguugcaccgaaggcaagugccucauuugccuuacccuagucuggcccugcuccugaucauugugacaacucaaaacaccuccacauauuuccaaauaccuugcuagguugagaaucucugaaauauagccugauuuuucucacauaacuacaaguccaaagagaggcagccugggccuuaaacaguggcuccaugaugccaacaaggaccuagguuuccuuuaucucugucaugcucacaagauagcugcugugcccuaggaauuauguccuaguguaaccgcaccagacuaaucuaguucaacuuuuauaaaacaaaaucgugaguuguuuuucaguugccguggaccccaggguugaaggucauacaacccgagcaugcccaguugaaccaagugugcacaggugaaaccuaagugcuuggaccaaggaacagggacugaauuaagaaguggaccccauauggcaggauccaggaaccaaagagaucgugcucuggugucaccccauagcaggauccaaucagauuaugccucccagcaucaccucauugcaagaugcaaucagaucacaccucauuacacuaugcuuauaaaacccgacccagcccccagcuccaggagacagauuugaguguuuccuccugucuccuugccaaucaacucaauaaaccuuucuugcugcaaaaaccuggugcuuuggcguuuggcuuucccuugcaugcagguaaauggacccaguuugguucgguaacacuaguuccagacaggaaaaacaaaaggagggcaaaggguaggaaaaucauaccugcugagccuguuuucauuagaaaaauaguaacucucccacgagccccacccaauaaaucuuaaugcauauaucauuggccaaaagugagucaugcggccagcccuagcugcaaggagccuggggagguaacacauuuaagugggcacaauuccagccugcauaaaaccguucugccuauaagaaggaaggguagaaugcauaaaggauaaacagcuagaagugucugccgcaggggccaugcgggauaacaaauacuggcuccuuuucaugauugcaaaaggcauuuucucugcuuguaaugugauagucuacuugagcaaggcauuuuggugguugcuuucagaauuauggauuaaaaccuggaauguugucuuagguugggguuccauagaggcagagccugaaacagggauuuuagugcaugugauuuauuaagggcagacucuugggagaaaccuguaagggagugagggaagcagcaaaggaaagggaaaugaaccgcgcaagcaaggaugcauucucaggucaaguguagccuuggucugaugcacgaggggcuauggagccugaaucauagcaaagaauuauccccccuucaggcaaggaagcugaccuuuuuuuacccuugauaaaucaguuauuagcugcccccucuuaggggaaaggggccaguguaaccucucaggugucucugagagaugcaacucccaucagccaagagcaagucuccagagaggguuacaggugugagcuguuugucaaaccauuugucacagcugggggugggggaucaccaccccagcauggaucugggugggcacaaagagcaucuacuacaaauauuaauuuuaauacacuuuccaaagaacugucuuuauuuuuacuuuguauuauuugagaguguaaugcuagauauauugcuaggauuaaaagcuacuggaaaaacuggcaacaaguugaaaacgucuuuuauuuuuuuuggcuuucuucauuuuaauguuguacaaguauaaggaccauauaaucuggauuaacuuuagguaacaauaacuuaaaagauaggaaaauguauuauauuacagagauuuaaaaauugacuauaccauaaaugaugaaggaaacuaacaauagaacaggacaauguucaaauagcgaauacaauuaacaaauggggccaaaagaucaacauuuaucucucaucaucuuucaugcaaugucucagcuuucuucucccaaacauaaaggcagauuaauucaaaguagccguauuaagaauauuuguuuaucaugccuguaaucccagcacuuuaggaggcugagguggguggaucaccugaggucaggaguucgagaccagccugaccaacauggugaaacuccaucuccacuaaaaauaaaaaaauuagccaggugugguggcacauaccugcagucccagcuacucgggaggcugagacaggagaauugcuugaacccaagaggcagagguugcagugagccaaaaucgcaccacugcacuccagacugggcuacagagcgagacuuugucucaaaaaaaaaaaaaaauuuuguuucguucugaaauuaauauuugaauggaaacuguaugaauaacucaugguuuccuacugaaguuuaagauuccccuagauaauacucagauuuagacaaugcuagaauaagacacugggugauuauuuuaaaguaugaacuacagguaaaaucuaaaaggacauacauaauaaaaaauuucugauuuaaaagacauaguaaauauaaaugaauuaacucacacaacguacuuacacacaaacaaaacuagaauaaacaacaacuuguaggaaccaccucuaguugauuucaccacuuaacaggagcaagaucuuagguuggucauuuuguuuaaggaugacuugaaguuuuacaauacuaccuuagcucccacauauaagugcuuuuaaagcauuaucucauuuaauuuaaucauagcacauaaaaaagaccucaauaaaaagagacauauucuuguauuaaaagaaaaaaaaaagaaaaaaaaacucuucaauaguuuuuucuuaucaacuagaaauuggggaaaauauagugagaaauaaaauggaacggcuucucacacauaugaaggcccagaucacgccuaaauuucuagugauuuaacuuaagaagcuccuugcccugagagauuccuuuaucccacaacacucuacucagagggggcagagaaucccaggacacuacccaagccgcaggauaaaaacacaaccugucuucuaucuggcaccaacagacuaguaucuaucuaaacacaggacugacuuuaaaguugguuaacgaguauuuuaauucacuaaaauaaaacuuagaaauuacaugcuuagucuacacaaguuuaacuuacuuuagucacuuagugaauugugaauuggcucccauuaguggucaggagaaugcuuuguauuugguguagaaaccaaauaaaucaagcuauuaucgccuugugaguacaaacaauguuuauuuguuuguaaagugccaguuuuauauuuaaguaaacauugaaaucugcgcugaagcagugaggcugcaucuuucaacuuucaacucccugugcugguuaaaugacuguuuaauccugcugugccaagcucacuagagggucaacccucacuuuaaagccaagacugccauugucacugcuauaguaagucacagccagccaggccugcuggcaaaaggugauacuaccagcauuauaaauaaacaggacugguugugagguagcuacacaguuuuaaagaugcuguuaaugaacauuauggacaauucaugguguggcuaguugauaauacuucagcugauuuuuuuuaugagauggaaaaaaaucagcaaaauaagggcacaucuucaguucauuuagaagucagcauuuaagguaaaagaauucucuuuuggacuugacaccacucccauccucugauacucgccuacucuccucucaaagaaguuagucuuucagugaaauauucuccguaaagucaaaugggcucucuacuccgaaaaccuugcuaaaacccaguuccagcauaagucugucugccacaaacucaauguauugcuucauuagagugcaauucaucccaaugagcuucacaggcaaggccucggugaggaauucuuguucuaucugaacagcauugauaauuauuucucucacuuucuccuccgaugguuuguguaccagguguuugaacaucaagcaagcaaaaucacaguguaaacccucuucucugcuaauaaguucauuggaaaacgugaggccaggcaucgguccucguuucuugagccagaauaucgaugcaaaagaaccagaaaagaagaugccuucuacugcagcaaaggcuacaacacguucaccauagguagccucuuuguccccaauccagcgcaaggcccaaucugccuucuucuugacacaaggcaucguucaauggcauugaagagaaauucccuuucuuugggaucuuugauguaagugucaauaaggagacuauacauuucagaauguauguuuuccauggcaauuuggaagccauagaaacagcgggcuucuguaaucugaacuauuuggcuaaaucgcuccaccaaauuuucauuuauuaugccaucacuugcugcaaagaaaaccagaacaugggauauaaaauaucucuccucgggcuucagggauucccagugccgaauguccuuggacagguccaccuccucggugguccagaaggaagccuccgccuucucauacaucugccagauaucaugguacucgauggggaagaugacaaagcggcaaggguuuccucucagcagcggcucauccuccacgccgggggcagcugcuuuaguuuucggcucgcgggcuccuggaagauccuccaugcagucuugcuggccagaacccgggucccgcucagggccggcggccuguucaccuugucgaccaggcugagccccuucagcggcgagagcugcagcugcugcggguccguaaugugcagcagcgggacgcggacggagagcauggugguagcgcggcaaaggagagugaggggccgggaccgggcggcugggauggggugcacugaaaaugucucauuuuuaagacaaaugauuaacaaguguugacuuguuuuuguugaaccgcuaauguagaaagcgcuuuauaauuugcuugggguauuaaccaggaucuagucuguaguucacagucucaucagagcacguaaauauuucagucuuagugucucauuuaaagcucaaugaauauuuaauagaaguugaccaacaaaauaacugaaagaauuauguugcauuuaguuagcccugaaaugagcaagcucuucguuuacucaaguagucugaagcuaaaauuauuccagauucaugaaauauucuacauaaguaauuaaaggccugcaaaauaggcuugaaaggcacauauuaaauauugagaaaaacaugaaaugacuuuucgacuugaaaugcaagagaauaguuuaauauuaauacauuguggccuacgauacuuauucaguaguggauuaguuuaaaauauugucgauacccucuauuuuacaugagguaaaaauagaaucuuuucuuuggcccaugcaaaguaaacauccuauaagauugagaguaacagaaaacuaugcauaauccacccaagucagucagcccagaauuguuuuugagcuuuggguccagcacugagccagguacugaaaauaauccaagaaaagaauauuggcccauguugaaaggagaaaugguuucccaggaaggaagccucccuguggucuguuagaucacuauaagugucagaacuaggcuucaaaaaaaaaugugcacucuaauugaucuacccuaucacagaugacauggggaugugucaauuugaggacauuuuaauuagaaucaaaguacugccaaccaauccauguuaaaagcugcuaaaaaccaccugguaaacuuagcaugcuaugguuucaauucuuuaucuaguccugaacuaucuuucaauuacaggaucuaaaauaaucuaauaacuaguucuuucuggagaacagaacauugggcugugauacagggcuaucugauaaacacagcauauccauauagcuggucgccuuuucuuuccucugaucuuagccuuuuuaaaaaauauucaaauacauuccuuuuucuaacugccaauauguccauauguauauguguguguauguguauagacauauacauuaaaaaauuccaacucuugucuaauaauggcaucacuuccuuucacuauucuucuugccacaucacauuuuagcccuuagggauggggaaucauuacuacgguuuauuacuaauuaguauggagaaaagaagagaaggcauuuuucuauuccuauuuaaagccacauucagacucaaacacaauuauuuagucaauggcaacucaaaagcaaaagugacaaucugacgagacucuuaguuucuauaggacagauuauccuguccagugaaggagaugagagaaagguuaauaagcauuagccaagaaagauaaacauuuggcauucugcaaccaaugugccugauaaaaaagagcagagcaagaaugauuuuucuuuguuuaggauacuuuuguucuugaauuuaucuuuucagaagaacuaaccuuagucaaaagaagcaaaauuucacuuaggaggaauacguuuaagagaucuauuguauaacacaaugacuauagcuaauaacaauguauuguauauuugaaaauuguaagacaauaguguuuucaucacaaaaaaagagaagcacaugagguaacgcauauguuaauuagcucaauuuagccauuccauaguguauacauauuucaaaacaucauguuguacaccauaaauauauacaauuauguuugucaauuuaaacaaauaaagacaaagggagaaacacuaaaaauaaaacacuaaaaauaaaggcaauaauaaguagaaaaggcaaaaagaaaaagaacuagccuuaacauuuacacugaagacuccuacuuucucaaaacuaaauuauuuagcaucuguaaaaugcuaagacugcauuccucccagugucaugugacuuaccuguuuaucaaaggcuacccaugaugguacaucacuuccaucuccuuuaggauauaugcuacauuuaggcuuuaucuuuugccccagaagugguucuccaccuauuccaggcuuuucaucacucaccaacaucauaacauuguugcaaaagccccaauguugggauuugugaaacuucuccuuucccaccugugaacauaagagacaacauaaaauagccaaaguuacucuuuaugacuuuucuaaccuguuuguaaaaugucaacacauuuucuuaccauguauuuuucccucacaaaaugcaaauaaaguggcaaauaauuaugaucaaucuuuauccauaaaguugugucacauucuuaaauuuaauucauuuuaaucaauucaaaacauugaaaagcaguacacauaaaccuaauguuccaugcuauauaaaacauuaaaaaaugacuguuacugcaaguaaauauuuagaacauuagcuugcuaauuggucuuuccuacuuguuugccaagaaugcaaacagcaaaaaaaaaaaaaaaaagaaagaaagaaagaaaaaacugcucugcuucagaauaaaaaguguauguaacuguuuuccacagaagucuaaacauuauuuucaccaaaacagagaacaaaaucuuuuccucauuaaaguaaauguaacaggaaauucuucagagcugacauucuccuuuaauugaaaaaccuuaacucccaccuuuucuggugaucuggagagagaggagaaagcacagauacaacuaccaaggguuggcaaggacauggccaacaucaacauuugugcacugcuggugggaagguaaaguaggacaaucacucugaggagcgauguggcaauacgagcaaagagagaggcauauauguccuauggccuagccaauccacuccuacagaaguaucuugucuuaggcacaaggaacugcauaucagacuauuguuauagcauuguuugcaaaagugaaaaauaggaaaccacugaaaugucuacccaauagcagaaaagauacaucucuuuauaacauggaauauuaauacagagucuaauauuacacguaucaauauagacaaaucuaggccaggcacaguggcucacaccuguaaucccagcacuuugggaggcugaggcgggaggaucaccugaggucaagaguucuagaccagccuggccaacauggugaaaccccaucucuacuaaaaauauaaaaaauuagccgggcaugguggugggcaccuguaaucccagcuacuugggaggcugaaacaggagaaucguuugaaccugggaggcggagguugcagugagccgaaaucaugccacugcacuccagccugggcaacaagagcaaaacucuaucucaaaaaaacaaacaaacaaaauagacaaaucucaaaaacugccaggcaaaaaauauagguagcugaaguacacauaaaauuucacgacacauauguaaagcuggaaaauacucgaaaaauacgguaauauuuauggauaauacaugcauagaaaugauaagcagcaaauacaagauuauacaauguucaugauaauaaaugaacacucauaugccccacagcccugcauaaaaaauaaauaccucagagauaacugaagcuuuaucucagagcucauagcccugccucccuuauccagagguaaccauuauccugaauuugcuucuuuaauguuagcacacugcccaggacuguauauagccagggcaauagccucuugcaaaacaugaugccuuggcagagaagucugauaaggucaaaaauaccucauuuccuuuugugguaaaggcagccuggaagaaugaggaaggccugagcagcccuccccaggggagucagggccauaacagcugcccugggcagauaacagcccagcucuagggcugggagaggaaagcuagaugcagugguuaggauggugagcuguagcuggcucugucccuuagggaaucaauugucgcuaccuccaccauucccuccacucucucucucugucucucucucucacacauacacacacacacacuugcucacacauacaaucagauuaccacaagucagucccagauccccauaaaacaaagcaaaaguuggguuucagaaaaugaaucguagaauaauauagaauucaauaaugauauacugucuccuaaagcaaguaacuccgaguaaucacaaagucaccucgaaccaacaaauguuucuuaaguacuuacuauaguccuaacuuugugccaaauauacgaguuaaaauaagcauaagacucagccccugcccugaagaaaaaaacccacaaucuugcggaggaagcaagauuuagauauauaaaaugauaccguuuggauguuuguccucuccaaaucucauguugaaaugugauucucaguguuggaggugggggccuggugggaggugauuggaucgugggggcagaucucucaugaaugguuucacaccauccccuuagugauaaaugaguugucgcucaguuauuucacaugagaucugcuuguuuaaaagagucugggaccucccccuucucucucuuucucccacucucaccaugugauacacuggcucucccuuugccuuccaccaugauuggaagcuuucugaggcccucaucagaagcaaaugccaacaccacacuucuuguacagccugcagaaccaugagccaauuaagccuuuuuuuuuuaauaaauuacccagccucacguauuucuuuauagcaacacgagaacagccaaauacagcaaacaacuagaaaacaguacagcuaccauuuuugaccgcuuacuaugagcuggaugcuuuacuaaggguuuuauaucucauuuauuaucucauuucacugucacagaacuguuuuagcaguguuauuacugccauuuuuccaaugaggaaaccaaggcagagagagggagacuggcccacccaagcuuacacaguaacuaguggagccugcaucugaaccuaagaucaugugacccuaagcucugguaaguguauagcuaaguguauggcugacuagagccauacacugaugugcuggaguaguaguguugagguucuguggauaacuggauacugucuugggccuggaggaaugagaugaauuagauaggagaggagaggcaaggauguuccaagcaggguuaggagugauguacugcagcugagcugacagcaccuaggagaggggcgaaucugguaaaaaaagaaagucaaggucaaguuuggaaggagggcgagcuagaguagaauauauaaggaggacuauaucaugaaaagccucucauguaaauaucuuaaaagucucccucaucaggccacuggaauauuuacuaaagccuaauaccggccaggcccuauucuagagaguaugguauaaagaugaagucacagccagccuuccuuccccugaggagcuuucuccacuacucacaaguuuccuccauggaucuagguuuccauaaucacauggaaaaagcccuugccaccguugaaggccucacucagcuaccugucccccagaauuccacaauuuguucauguguacccuccucuuuggucagaccacaucuuacagcuuauaagguaccuuaaugucuauucaaagucaugucccuggucaggcuauacuucuacacaaaccccucuccccaccaagggucagcucacaucccacuacauagucaucccuucuacaaacaucuggugagcauccauugggugcuaaguugugagagacuuuggggacauggccuugggcaagccacagcucccaacccuagaauagaagccagucacuauggcucuggauuuggcaauggguuucauacauguggcaccaaaagcacaagcaacaaaaggaaaaauaaauugggcuucaucaaaauuagaacugugugucaaaggauacuaucaagagagugaaaaaauccauagaaugaaguuugggugagguggcucaagccuguaucccagcaacacuuuaagaggcuaagcugggagaaucacuggggcccaggaguucaagaccacccugggcaauagagugagaugucauuucuaaaaaacagagaaacccagagaaugacagaaaauauuuggaaaucauauaagggucuauuauauagaauauauaaagauucucacaacucagcaaaaacacaaacaauugaauuuaaaaaugggcaaaggaugugguagacugccacaguuacuacuugagacugucaccacgacaguuacuacuuuuacuacuuaagaccgucauuacaacaguuacuacuguuaguacuugagaccgucauuacaacaguuacuacuguuaguacuugagaccgucauuacaagaguuacuauuguuacuacuugagaccgucauuacgagacugaacgaagggggaugaacauagaaaugaaaacuuaagacaaaagaaacuguuuuaaaggaaggguccggggaagaagagagcucccugcuucuagugagcaaaggcagccccccugagcuuccacagcccuucguauuuauuggguagaaugaguagggaggaggagguaaugauuggucagcuccuuaauugaucacagguucauauuauuacuaacaggcuucugauguaccuaaucacaauaaacacugcacuuggggcauaacugcccucagcauuccuucuggguggcagacgcaguuugucaguuugccaacauucugcauuuaugagaaaguuugcuguuuacucauauagccuccagugguauacugaguugaccacgacccucauuucuccaaagaagauauacaaauggccaacaagcacaugaaaauauguccaaugccauuagucauuagggaaauguaaaucaaaaguacaaugaagccuggcacaguggcucacaccuguaaucucaauacuuugggaggcuuaggcaggcagaucauuugaguccaggaguuugagaccagccugagcaacauggugagaccuugucucuacauaaaauacaaaaauuagccaggcauggcggugcaugcguauagucccagcuacucgggaggcugaggugaaaggagcgcuugcgcucacgaggcugaggcuguagugagcuaugaagcuaugaucgcaccacugcacuccagccuaagcgacggagacccugucucaaaaauaaauacauauauacauacauauacugugauaacgcuucacauucacuaggguggcuauaauuuuuuuaaaaugaaaaauaaauguuggugaggauguggagacauuggaacugucacaccuugcugguggggauguacacuaguauggcugcuguggaaaacaguuuggcaguuucucauuaaguuaaacauagaaucaucauaugauccagcaguugcacuucucaguauauucucaggagaauugaaaacauacauccacagaaagaaacuuacacauaaauguucauagcagcauuauuuacaauagccaaaagguggaaacaucccaaaugucuaucagcugaugaaugguuaaacaguugugguauauccauacaauggaauguuauucugccgccaaagggaacaaagcacugauaucgugcuaccauguggaugaaccuugaaaacauuaugcuaagagaaaaaagccagauacaaagggccacauauuauaugauuccauuuauaugaaauauacaaaauaggcaaauucauagagacagaaggcagauuaaugguuggcagggacugggaggaagaaagaauggggagugacugcuuaccggguacagguuuccuuugaagugaugaaaauuuucuugaaacaguggggacagcugcacagcguugugaauguacaaaaugccacugaauuguauaauuuaaaugguuaaaaugguaacuuuuauacuuuguauauuuuaccacaauaaaaaagaaaaccccagccagcaugagauucacacaccacaaaugagcuauaugaugaccaagcccagggaugggcagauucaugaggccuucucugaccaccagcccuucgucguguacaugcaccauaauaugugcacauacucguguuugauuugucucaacuagaugacacauuuuuuaaacucugggaccaugguguauauuucugccuuuuucuauguccccucaccaucuaacauauugcugcagauacaggaagcccauaaaacuugagugguagauucacugguugccaaauugaacauuguggucuggaucaaauaggcaacaaggagccauuaaaguuucccgagggacacagggacaauaugaggcagcacgucugaagacagauccacuaacagugggcaggguggguuggaagggggaaggucugaaggcaaaagacuuuuuuuuuuuuuuuuuugagacagagucucacucuugucgcccaggccggaguacagugacgugaucccagcucacugcaaccuccaccucccagguucaagcaauucuccugccucagccucccaaguagcugggauuacaggugcccaccacuacaccuggcucuuuuuguauuuucaguagaaacgggguuucaccacguuggccaggcuggucucaaacucccaggcucaaguaauccgccugccucagccucccaaagugcugggauuauagguauaagccacugcgccgggcacaaaagacuuuuaaagaggccacugccauaucuuaacaugaagaucuucaaccaaucuuaaacugaaacugauuaagcaagccacagcaugccaacccuugcgcugucucugcacacaaacacccgggccucacucuuuccagggaugccacccuaguugguaauggagacgauuucagagggcgcgcaagaauguucaucuuccucuauccucuuccuuucgauuaaggcaagggugagucucaauuugguaguacugacuauaccucccaaauacuugccuauaaaaaagaaagcaggccucaggcuccuaacuuuuuguaggcaucaaaucuaaaaacacuguuuuguuuucauuucuuuuuuucuuaccaugaccuuccacuuagaucaaaugaugugguuuucauuuaugguaaggauauaaaguuucccuuuuaaauauguuuuaguuuuccaaaagugauucaauucacagagagauauuaaguaaauaauggaucgguuggcauguagauacauuuuuuaaauuccaaagacagcauguaugcuucuaaaguuucacagccucugacccuaucaaacaaaugucacaggagcagauaaguuuuuauuuauuuuauuuauuuuuuuuauuuuuuuauuuuuuuauuuuuaugagacggagucucacucugucacccaggcuggagugcaguggugcaaucucggcucacugcaaccucugccuccuggguucaagcaauucuccugccucagccucccaaguagcugggauuacaggugcauaccaccacaaccagcuaauuuuuguauuuuuaguagagacaggguuucaccauguuggccagacuggucuugaacucccagccucaggugauccacccacccuggccucccaaagugcugugauuacgggcaugagccacugcaacuggcuuggaguagauaaguuuaaagcaccugggaggagggcaggaauuaagagacaaagaauagugauccaggaagcaaugugacccucaggaccugugucacauccacaguguucaggagccuggagcagaacaagggagaaggcacugggauuaacuggcaggcauaacaaaagggcugguaguagacugaagauaauuagaaggcucuggccagaagacagagugaaguggugggauaaagccaugcaacuaagcaaacaaaagugacugcagucaauuuaugauuuccauauucacguggguccuaacugucucuccuugcaguacuggcuuacuugugucccugauaagucagugaucaacagcauuagccucucccuuccauggccuccuuucaaugaacucauaaagacacucaagucuuucaacucuuagaggaagaaaagccuccuucagugcccuuagucuugcuuucguuaccaucuugacucccucccauccucuaucuucauguuucacgaaacaguagucugcagucaccgagagucccuucuccccuccauucacuccugcacucuggauuaucauacaaccuccccuguuaggccuuaccuugcaggacaccacauuauucugguguuugaaaggucuagaguccucuaacuugagacaugagguuaagaguauaaacaggggccagugccuuagagguuuaaggaacacuggauuuuguuuugagcagggcauagaaaggaucgcucuggccacaauacaaagaacuggggauauugcaauaguccaggcaagaaaugauaguggccuagaccagguuaauagaaguagagacaguggaagugaucaaguucuguauguaucuugaagguagaacaaaaaggauuuaccaauagauuagauguaggguguggaaaaagagaugaguuauuaacaaccccaaguauuuuggccugaacaacgagaagaauggaguuuuaggugcugggauguagaauggugggagagaacuuaaaugagaauucuggagguaggaggcaggcacaggaguccagaauucuauuuuggacauguuacauucaagauaccacucagacaagcaaguagaaauguggacuagcagguggauaugggagucugaaguucaagcaagaagucgaggcuggauauaaaaauuugauauacaucaguugauggaugguauuuaaggcuacagugcuggaaugaaugaugauagugcagaaaagaaguccaagacugagcuuuaaaauaucccaauguuacgugaucagggagaugggguagaauuagcaaacaagacuaaaaaggggcagcugguaagaugggaagaacaccaggagaguuuaguaucauggaaacuaccuaaagaaagcauuugaaggaacacgugacuaacuguguuaaaugcuacuaauaauucaaaugaagacgaggcuugagacuugacccccugauuuggcaacauggagguggcuggugaccuugacgagaaugguuucagcagaaucauggggacagaaauagcuugugaaccauauggcucuuugaacagcucuagguaagguauugcaaaucaaaacucuugaguuucuaguauuuauaauuuccuuaaaauaacccaagcucagaaaaaugcaagaaauaaauaaaagaucaucuaaaugucaucucuuaaagucuucucugacugccagaggcagaacauucuguuccugcauagaucuucuauuaaagucuggaagguuacccucucuuuaacuauuuaggaacuuacccuuuccccucccccacccccagcuguaucaccagggccaggccaagugccuagaacagagaauaaaauguuuucuaaaaaauaauacacgugcuccuugaaagggcagcagugguacagacaaacaaucucacaagguucauucuugauucauucauucuauacccauaauuccuguacagccaucacuguacucaccauauuauacuauaguuuccuguuuauauacuugcaucuuauacuaggcuuuguacuuucugacaguaaggacuauagggccuugcacauaguagguguucaaugagcaucuaucgaaugaauagaacauaagcuguggauuauuuucaaacaaucagauauugucagcugaucuuucccuguucauguuaccuggcuuagacccccuuaaaucuaauaaucaaacauuuggaauggagagcagcaccagggaguaauagggucauaaaggauaggacaggagaccuggcaucagaagccuggcauucaccuuccagcuuugccucuaugggucaugugaugcuggagcagucacuuuacuucuccagaggcuugccaugucuaaagugagaauaauaauaccugcuucacgagacagugguuaggacuaagugagagaauaucugugccugugccugccuguuagcauuuauuauuuuguuuucucaagaggaaggacuugguauuggcuuuuagagagaacugagucagagcuccaauaaaaagggaccaaguauaggaguucaagaccagccuggccaacauggugaaaccccgucucugcuaaaaauacaaaaauuagccaggugugguggcacguaccuguaaucccagcuacucacgaggcugaggcaggaggaucacuugaaccugggagguggagguugcaguaagccgagaucgcaccacugcacuccagccugggugacagagcaagacuccgucuaaaaaaaaaagggaccaaguaugacucccuuacuaaccaacccaagagcuuauauguucuuuuccacaaauagauuuauagauuuaucuccacuuuuaugacauucuuagccauaauaauauuugcuccaugaacauacauaaauuaugugaucuucauuccuggguuaaaugucacuuuuaacacuguuccucuuaguuccauggaagcagggccacauguuaaaugcugaauaagaaacauucaacauuuaacacagggccugauaggcaugagucaauaguucuucaacuuaaacauaccaucuauuuuuaugauuuauuuuuugggcaauccacuguagcaaacagccaacccuauguauauagauuaggguuacaggaauucaaaggaguauacuauggagcagucgaugccagagaaaaaaucauguagaauuugagucuuaaagugaaccuugaaccaugcacugaauuugggcagaguaaaagacacugaaacauguugaaggaccaggacuagacccagcuagauacaggggcauuuccuauaguagugggacaugaacuuugaagaguuaauguggaaaucaauccauagagagccuuaaauagcaaaaucagacacuuaaacaacaucuuacgggguaugaggcucauuucugcuaguauuucuaaaggaggcugaagagguggauugaaauucaagagcccuccacaaggcuaaccuuccuuuccuacucacuaccacagcugcaagagaaagagaaggggcuggaaaaaacaaggucaaaagagguaugccugaaacuuccuuugcaaaaauuaugacaguaaaagaaaugugaccuaccugacuccauccugcuucuaaccuccaggcugcucuuguucauuccuggacauaggccaaaccaacuuugggaggaguugauaguuuaaauuugaaacaaagaugauaacagccccuccccaaaacaaaccccugcuccuugcuuggggaccagaucaccuuuguaaaacuaauaaauuagccacaagauuggaaauuauggcuuaggaaucacgcagccugagaccacaagauuucuaaccuccccaauugcucccauagauaacauuacuauuauaaaaccuaagauaauuuucagacccugcauucugauggaucagcuggcaccacccagacagguaaacuggcucaucugaucuguggcccccauccaggaauugacucagugaaagagggcagcuucaauucccuaugauuucauccccaaaccaaccaaucagcauuccccauuccuuaggccccugccugccaaacuaucuuuuaaaaaccucugucucaaaauuuucagggagacugauuugaguaauaaaacucuggucucccauuuagcuggcucugaguguaugaaacucuauugcaauuccucuguuuugagaaaucggcucuaucugggcaguggguaagaagaacccauuggauagcuacaugcuugcuucuuugaggggcagcaaccacugcaaacccaccucccccaaccccugcauacacacacacacacaauugcuacaaacucuuaccagcauaucuuuguccagcuauaauaguaacaauaacuaagaauauaugauggggccuuuuaauuuuaaacauuaaaauccaccaaggccaacagaguuguguggaagcauguggggcccauaaaauccaacaaugcuauaaaaauugagaagaaaccaaaauauaucaaagucagaaugcaguucauucaaccaaguugcagcuaaauuuaugagcaaauucuccacccaaagaguauuauccagauaccuguuaaucauuuccaauucucuugcuaaauaaaauaaaaucagccacacguaauuauuuaaaacaaugcuuuuagcaugaaaggaacuauuacuaaaaccucuccaaaacucuuggcuugugaguugugaauucacacauucaaacucaaaacaacaaaacacacacacuuuuuuuuaaguccagugaugccaauugcuauuguuauucuaauugacauagcaugcaaaacuccauuuuugcacuauuagaguauuagcuugaaauuucaauucagaauucuauaccuuagaaacuaacgcauugagaauuuguuugauaugauguaacaguccauagggcacuuauuuaaaauguuugcccccaugcacacacacccccagacacuuacaaaaacuugagauuugccauuauagccucuuaagauggcauggcaaccugccuuugccauagugacuguguauugguacucagucucaauuuaaggaaauuagcaaaugucuuagcaaaugauaaaguuaggaacauaacuauuccuagauccuaggucagugcuccuuggcaucucaacucccugauucccauuccaccacuguuggaaagguggcagccaaauccagacucugcuucauaucaaauucaaagcuacaaucagcaccccuuccucguugcuaaaaauuggaagggcaauuuuaucacaugcauaaguugauuaaucaauuaguuaucaaggccgcuacagaaaccguaaaguuaauccaaacugagaagcuggcuauagucaucuacaucaggagcuguugaucuguuugcaaccucuauuucagaacuccagcacagcagucucuuguuucuuucuagccuacacucaaaagcccagaugcuugacaaccacaagacaaaggcagguagugugaggugccugguaagaaugggacagcuuacuagauaagccaugagcuagauaagccaauauaaaugucauuucuauugccacaauagcuaacaauuguagcacuguucuaagcacuuuagaagcauuaaacuuuuuuuuuuuuuugagacagggucuugcucugucacccaggcuggagugcaguggcgugaucacagcucacugcggccuugacuuccugggcucaagcuauccucccaccucagccuccugaguagcuugggacuacagguacacacuaccacacccugcuaauuucuguauuuuuuguagagacgagauuucaccauguugcccagacugaucuugaacuccugggcucaagugaucugcucaccucagccucccaaagugcugggauuacagacaugagccaccaugucuggccacauuaaauucucuuaaucauugggaguauuaaaggcuggaaaggggaaggagaggagguggggagagguugguuaacagauaaaaaauuacaguagauagaugaaaugaguucugguguucuguagcacuguaggaugaauauguuuaacuauaauuuauuauauauuuucaaaaagcuagaagagaggauuuugaauguucucaacacaaagaaaugauaaauauuugaggugauaaauaugccugauuugcucauuacacauuguauacacauauggaaagaccacucuuuaucucauauauauguacacuaagaaaaggaaaacccaacagaaaaaugggcaauggauuugaaaaggcacuuugcaaaaaaaggaaauggaaauagccaauaaacauacuaaaauauaguuaaccucauuaauaaaugagauaugcaaauuuuuuaaugcucuuaauccucagagagaaaaaucucugaguauauucuaucaucaucccuauuuuaugcauggagucugauuuuuuuuuuuuuuuuuuuuuuuuuuuuugagacagggccucacucuguagcccaggcuggagugcaguggcacagucauggcucacugcagccucaaccuccugggcucaagcgauccucccaccucagccuccugaguagcugagacuacaggcgcaugccaccacaccuggcuaauuuuuguauuuuuuguagagacgggguuucaccauguugacuaggcuggucucaaacuccugggcucaagcgaucugcccaccucggccucccaaagugcuaggauuacaggcagagccacugugucuggccuagauggggauucugagagacagaguuuuaguaauuugcccaaggucacucaacuaguauaaguggugaauccaggaaugcaaacccaacaccugagcccuuaagcaaugggccucauauucuuugugcuuuuugagaaaaguaauagaugucuccuuguuuaagucaucaggauugaauuguuacuuuugcuuuuggcaaauauaauagcaaaaacauccaccaugacccggaagggaggaaauagaccaaauaauuggaucuagacucaaucccuuaaaagcuggggaaguauuaaaagagagugcuguagaaaucccucuacagucaccagcaguuacuggaaauuugggaauugaagagagauaguuaauauuuaauauuucaauaaacauuaacacaacuuauuuuucuauuuuuuuagguuaauagaaaauuugauacagaauuaucuaaaacuaucauucuuagauauuucugccugaucagguucuggacuaauuugcuucuauucugugaauagugugggguuuuuuccucccucgucuaauauuuauuuuaaaaauucauuuauucuuuucuuuuuugcuguacuuucauggagaagaaaaagucauucagcagauacugugaaccucccagagaaaauaacaaaauugccucagguauagugggaucuaagaauguaagacuauaagagcaugaaagccaucauuacuuauuaauuaagcuaaaucacucaaaaacuaaccccaaaugugcaaauuaaaaaggcacgucaaagaaaaucucaaacauuuuuuaagcuaauuuccucucuuucuaaaaguaacuugaaaaaguguugugcucaugauucuuagccaucaacucaauauaacaauaagauugauuuuauacauuuaauaauguauuuaaaucaguagagugaaaaacaaaauuuaaaucaauaagaucuggagaucugcagaaucuuucucauaaggcuaugauauuuuugcucuaaauaauucaacuuaaggcaccaaucaauaaacagaauucuaaagauuuuacccaaaguaaguugaaaccacuggcucacgguagcugauucgugcagccauucccaaauuccuucucccuugcaagucuccauuuaaaaacuccagaaaaagcuacacacugcacuuguuuccucagccucuuuuuaggagucuguuuuggaauucuaugaaggauuuuugcucucuugagccaagggacagauacaggucacguuccccucauucaccucuucuugccuugaaauguauauaugaucccuggagcugcagcagccaucuugggauaaugggcaagauugcagaaaugcuggcugagacaaugcugagccucuauacaugugccagcagccaucuaccucugaagcaagagaauagggucuggaggcagggaaccuaaggccaauuuacgcugacuucuuagaacuaaaucaaaaggaaaaccacaacuuuccacaccuaaguaacaaaaagacccaagggaggcuacucccuuugcaaucuccccgugacccccaccuuuuucugcauggcagauggaaaauugaaaguaucugauuggcugcagaaagcaaaaaguaucucugauugauugcagaaaguuugcauaggaguguaacuauguaacuucacuuuagccucugauugguugcuuuccacaaccaaucagaugcuugcauaggguguaaccuuuguaacuucacuucagccucugauugguugcuuuccgcaaccagucaaacugauugcugggccacuacuucauuuacauagggucuacgucaaguaaccaaugggaagccucuagaagguauuuaaaccccagaaaauucuguaaaggggcucuugagccccuaugcuccgcccgcucccggacuguggaguguacuuucauuuuuaauaaaucucugcuuuuguugcuuaauucuuuccuugcuuuguuugugcauuuuguccaauucuuuguucacgaugccaagaaccugaacacccuccgcugguaacaccuccaggcuuccuacuuggugaaaaaaauaaaucccugcuucuuuaagccucuauuagucagguauuccauuacuuucaggagaaagcauuacaaacuaacgcaugcagucucuaaaagcuaucuuuuaauuuuuuuagcagaauaagauuauuaacugaccuaaagaguaauuuucuuuauauauuaggaaaaacaaaaaaaagacaaauaaucuugacaaagaaaaauaaagugggaggaagaacugaaccugauauuaagguuuacuauacagauacaguaauaaaaacuguguggcaauggcagacggauagacacagcgaccaauggaacagaacagacaacucaaaagacaacccacacgaauaugcucaaaugguuuuguaaaagauucaaaagcaauucaauggaaggauauccuuuacaacagauggugcuugagcaacugggcaucuauaggacaaaaaaguucaucaugaccuaaaucucacaccuuaaauaaaaauuaacuuaaaauggaucacagaauuuuuuuuuuuuugauacagggucaaacacugucccccaggauacaguacaguagugugaccacagcuuacugcagccuccaucucucaggcucaagccauccucccacuucagccucccaagcaguugggaccacagcugcaccccaccacaccgggcuuuuuuguauuauuauuuuuguagagucaaaguccccuuauguugcccaggcugguccugaacuccuggccucaagcaauccucccaccucagccucccaaagugcugggauuauaggcaugagccaccaugcccggcagaucacauuaaauauaaaauguaaaacuauaaauccuuuagaaaaaaacaacaacauaggaggccaggcacaguggcucacaccuguaaucuuagcacugugggaggcugaggcaggugcaucucuugaguucaagaguuugagacaagccugggcaacaugguaaaacccugucucuacaaaaaaaaaaaaaaaaaaaaaaugagccugguacgguggugcacaccuguugucccagcuauuggggggcugaggcaggaggacugcuugaaccugggagguugagucugcagugagccgagauugugccacugcacuccagccugggcaacaaaguaaaacuccaucucaaaauaaaccaucacaggagacaaucuucaugauguagggcuaggcagugaguccuuagacuugacaccaaaagcacaacucauaaaagaaaaaaaccgauaaauuagaccuuaacaaaaugagacacuuuggcucuacaaaagauacuguuaacaggaugaaaagauaagccacauacugggaggaaauaugugcaaaccacaucucaaaggacuaguauucagaaugcauaaagaauucucaaaaguuaacaguaaaaaaaacaaggcugggcacgguggcucaugccuguaaucccaacuacuugggaggcugaggcacgagagucacuugaaccugggaggcagagauugcagugagccaagaucaugccacuguacucuagccugggcaacacagugagacucugucuccaaauaaauaaauaaauaaaucuuaguaaaaaacaauccaauuagaaaugagccaaagacauaaacagacauuucacuuagcuggauauacagaugacaaauaagcacaugaaaagauauucaauuaauuaaccaucagagaaaugccaauuaaacccaccaugagauaucacuacacaccucucagacagcuaaaauaaaaauagugauaacacuaaaugcggaccagggugcaaagaaacuagaucacucauauauuguugggaaucuaaaaugguaauuugcucucaaaaauaguuugauugucuuuuuauaaaauuaaacauguaaguaucaaauaacacgcaauuacacucuugggcucuuauccuagagaaaugaaaauguaugcucacacaaaaaccuguacauacauguucacagcagcuuuauucauaauagcuaaaaacuagaaauagccccaauguccuuccaaaggcaaauguaaagaaauugugauacauacaugaacuacuacucaguaguaaaaaugaaugaacaguugauauacgcaaccaccuggauaaaugcccagggacuuauaccaaguggaaaaaacaaauuccaaaagguacauacuuuaugacuccauuuauguaacauuuugaaauagcaaaauuuuagaaauggaaaacagauucguuguugccagggguuaggaaugguaggguugggggaguugguggaagggagcgaggugugguuauaaaaggacaacaugaggaaucccuguggugauaagacuguuuuauaccuuuacugugguggaaauguauacauugcaccacauguguagguuagacuaaauacacacacacaaacauacaaaugaauacaagugaagcuggggaaaucugaauaagaucaguggaguauaucaaugucaagauacugauugugauauuauacuauagcuuugaaaaaugagcuggacacaguagcucacaccuguaaucucaacacuucggggggccgaggcagacaaaucgcuugaguccaagaguucgagaccagccugggcaacauagcaagacccuccaacucuagaaaaaauaauuuuuaaaaauuagccaggugugguggugugcaccuguggucccggcuacucaaggggcugaggugggaggaucgauuaauccagggaggucgagguuguagugaacuaugaucaugccacugcacuccagccugggugacagagcaagacccuaucuuacaaacaaaaagaaaagaaaagaaaaauguuaccauuggggcaaauggggugagggguaaauaggaccucucuguacucuuucuuaagugaaucuacaugucaauuuacaauuaucucaauaaaaacuucaauuuaaaaaaaaaaggaaagagaagguccacguuccuuagucacuaggagaggcucuacucacgugccuuuuauaaaguuuaggucugaacacagcugagcaacaaaugacuaaacucuaaccgaaaugauauggaaauaguccuguaagugauuaaacaaacaucugugcuugaauuuaacagaacaguauguuucaauuaccaaauucaugugaagaagaaaagguagucuaaauuacaguuaaaccaugcaauugaccuaaacuuccccccacccccaaccccaaaaaaaucuaguuguuuugaccauucccuccuuugggaugucaaacauaccauuaggaaagcaaagaauuuguucaguauucagcuggucaagcuguucacuuugccacacuggagucaccagguagaauuugagcacccaggggccuggguaagggggaaauaaaaaugcacaucccucaauacccuuugcuuuagggaauccccccucugcaagaaguuggcucugcccuuucugcaacuauagaaacagaauaaacucccccaggaaauggccuaagaaaucccuuuaccauuagcauagccggaauccuacugaggggagaauggucuccuuaggaguccugacugaugaauaugcauagacaaaccugcugcuuccaggaaaacccaaacuggaugccaauaagagagagaaaacuaucccucagcauggugcaagaggccacagagaggcuuugugucacaauuuagauagggacaucuucauauugcccuggcugcuguguauaaaccauguaucccgagagacuuaucuccuauuuaagccacaaaagcaaaugacuuucuucauccuuuauauucacuauugcuaaaacaagaacuauuuuguuccacagcagcagcggaagacauaagcaggaaacuaauuccagagaagauucccccaagcuguguuuauuuccaucuauguuucaaccaugguugcugcagguagaggcagcaauggacaaucaccuauuaaggacccgguuuguguaaggaaggcacugagaacgugaagggcaacccaaagagccaccaaucacaguuucuuagucaacugaggacugccacgaucacacauaaagaacacaaaacacaacgcaggaaauaaggcgguaaaugggcaauaugagcaugcaagcuuauguagacagaugguucuugcugagaugaucggggaaggcuuuaaugaggaggggggauuaaagccaaguuuugagggaaggucaggaucuagaugggaagaggaagaggcaugaggaugcugcuaucaggcaaggggacaaacaaacuaauaauugaguggaaaaguccaaaauauacccaaaggacaaacagugaacaugcuggauuaacuggaguauuaggcuuguuucccauuauggaaaagaagauaguuuacaaagaacaguauucuugguauccuucgcaauauugauauacucauguguuacuuguauaauuuaaaaacacaaauuguaaugaaagggauacuacuaagucugacaauaccagacucacagguauugucuguggcuggugugacaaaguuuguuggccacuauugaacccucuuuucccuuucccaccuccaaaaguagauggugaaaaaaaaaacaagauaauuucccagcauuccuuguaguaaaggauggccaugugcaucaauuuuagcaaauaagauggaaggagggaaucuacuggggggcuccuggaaaacauuuuguuuucucauauaagaagagcuguuuccccucccucuccuuccugcuugucuugaacaugguuacauguaguugugaugacuggaacugaggcaacuauuuugcaacuaugaggucacaagccuaagaaagaaaagccaauauucugaagauggcagaaugcagagauaaaaagagccuggguucuuuaugacauucaucagucacugccuaaaucugaaacugcuacaccucuaaaguucuuaugagaaaauuaauuuggcuuaaaccacuguuagucagguauucugugacuuauagucaaauguacccuaggugacagagcuacgaaguucaguacagaaugcauggugaccaaaauuagguguuugaauccuacauaggcaaagagacucuaauuccugaaauucaaaugaacauuuaggaauagcaauggaauauguuauuuccaaaguauggauggcagcuucaauaagcggcccaaucugaaauaauguaauuucaaggauauuuuaauaguuacugggaacaaagugacagaauucuuuauaucaaaacuauccugugaucuagcauaguagacagcaauuguuuugucugcccagcaaucccauaccaccaaaacuggauuauuugccuuuuuguuuguuuguuggcuuuuugaaaugaaguugcacucuuguugcccaggcuggagugcaauggugcgaucucggcucaccacaaccucugccucccagguucaagugauucuccugucucagccucccgaguagcugggauuacaggcaugcgccaccacgcccggcuaguuuuguauuuuuaguagagacagguuucuccauguuagucaggcuggucucaaacuccugaccucaggugauccgccugccucagccucccaaagugcugggauuacaggcaugagccaccgcaccuggccuauuugucuuuuuauuauugaguuuugggaguuauuuacauauucugaauauagucccuuaucagauaauaugcuuuauaaauauuuccucccacacugucagcugcuuuuucacuuuucugauagugucuuuugaagcacaguuuggcuauuuauugcaacauuauuggauaacaaaagacuggaaauaauguaacuguacaccaaaaggggaugguugaauaaacuauuguaagucuacaaaauggaguacuauguaacuauaaaaagaaaugaggaagagcccuauauaccacuaccaagugaucuccaagauauacuguuaaaaugaaaaaaggaagguucaaaagacuguguagauuaugcuaccaaguauugaauaaaaggggaacaugugaauaaauuuaacaauuugcuguuuuaaaaauuaaaaaaaaaagaaagaagagaaggaggaagagaaagaggauaaccucaaacuaaauaaaguuuuuucuuuaaguuauuauggagagagggagagaauaagauugaagagacagagauaaaagcuagagcucucugaaaguaacuuacuuugcaaauuugacuuugagaccauacaaaugccuuuuuuuaaguucagaaacaaaagcacaaugaaacaaaugaaccuaacuagauacugaguuggugacuuaaccauaccgacagcaaugauuuaaaugaaacuaaaacccaguaauuugacuauacauuccuggugggauauacucucacaacagaaauagcuauaaagaaaucuuaaacuauuuucaaaacucaaauuguuaauaauguuauuauuaauuaaaaauuauuauaugguuguauauuuuuauuuauguuaggauaaguaauucagcuaauguacuuaugaagcaagauuacauguaaauauauaaaaucaaagaaguaaaaacccuauaauccuuaauuugcauugaaaacaauaguuuuugaacucauguuauauuuuauccuuaaauauauguacauauuuuuuagccuugcuuuaagagaaugaaaauucaagccauagacuggaacaaaauauuuacagaccauacauucaauaauagacuugcacccaacuuguauccagacuauauuaaaaaugacuuucaaaacucaucaggcggaucgccugaggucaggaauucaaguaaggaaacuccccaauuaaauaugaguagaagacacgaacagacauuucaccaaaggggauauacggauggcaaauaagcacauaaaaagauguucaacaucauagccauuagggaaauaaaaauuaaaaucaagaggagauaccaggccgggugugguggcucaggccuguaaucucagcacuuugggaggccgagguggguggaucaccugaggucaggaguucaagaccagccuggccaacauggugaaaccccgucucuacccaaaauacaaaaauuagccgggcgugguggcacacaccuguaaucucagcuacucgggaggcugaggcagaagaauagcuugaacugggaggcagaggguugcagugagccaagaucgcgccacuacacuccccugggcgacagagugagacucagucucaaaaaaaaaaaagagagagagagaaaagaggagauaccacuauacaccuauuaaaauggcuaaaauccaaaacacuggcaauaccaauugcuuacaaggauuuggaauaacagaaauucucaaucauugcuggugggaaugcaaaaugguaauuucuuaucaagauaaacacacaccuaccauauggccaguucaaaauuuacauaaaaguaagcauccugccauucauaggagagcaaugaccauuuugcuauaauuuucaacuucuuauacauguaagcaaagcuuuccuuguuuaacaaguauugaaaaggccagaaaucuucucauuccaguugaaaaugaaauugaugugugcuuauuucaagcuugacccggaauuauuuauguggcaaaauauaaacacagauuucagaguggagagguaaauuuuauuauuuauuuuuagcuuuuaaaaaauaagacuguuauguacauacaggucuauaaagaaaucaagauuauaauuuuguaacugccuauauuuaagcccaaucaugucagucaguaaaagaaccuaauuuuuaagucuuguauaaaauuauaucuuagguuauauuuuuacucauaaugcuuugucauauaguuuuaguagcuuuauuauguaacauugucaauacauuuugauguugaaaacagcauuaauuacgaguuuacaaccuuuauuuaaauuaaaucaucuuagccuacuuuuugaaaaaguaaauuccaucuuagauauaaacagaaauaacuugaauuauuuaacauguuuauauuaugcugacugaaaaguuuuuugaauguauggaaaggaaagaaagguaagcuaaguuuaacuaucuguuuuggguuuuuuuucccucaaaaaagcugguaaaaaguccuuuucaguuuuuaauaggggagaaaacuacuuuuguucauaccauauaccauauaucauuccucaauagcacccucuauaauagaaacuauagagaacuuuuaggccuacuuggauaagguaaaaaggaaaaauaaaucaaguagaaaauuuuaccauaaaacaaccugaaguuuccucuucuacauucccacuugcuuuaggguugauaacccuuugugagaaagggaaagaguagguaaauaaguuggcugaaaucaagagauccacagaaaacuaccauuuuuuacuuuaaaaagacaauuauuauuggauuauuauagcuacaauauucucauuccaguugaaaaugaaauugauaugugcuuauuuugaguuuaacccagaauuauuuaugggaauuuauuuauuucacauaaauucggaacuggccauauggcagguguguguuuaacuuuauaagaaauuaccauuucgcauucccaccagcaaugagugagaauuccuguuauuucaaauccaugugagcaauugguauuguguuuuggauuuuagccauuuuaauagguauacagugguaucucaucuugauuuuaauucuuauuucccuaauagcuauaauguugaacaucuuuuuauguaauuacauauuuauuaucacagauugugcuaauguaccaugggcuauagauauaguuuuuaugcaggaguucucuaagaccucaaaaucauuucaaagacuccuccagggugaaaagauugagauuugaggugaugaaaauguucugaaacuaguuagagguguuaguuguugcacaacagugugaauguaccaaguaccacugaauuguauacuuuuaaauaguuagugguuaauuucauguuacaugaaauuuaccucaaaaaauuuaaaaauauacauuaagaaaggcugacaaggcucuuugaagggugagagaugagaucugaccuugaaagaagcugaagaucuaaauuuaaauaagaauugcccagucuggacaauacagugagaccgcaucucuacaaauaauaauuuaaaaaauuagcuggguaugguggugcaugucuguaguccuagcuacuguggcaacagaggugggaggaugucuugagcccgagagguugaggcugcgugcagugaacugugagcugugauccugccacugcaccccagccugggagaaagagcaagacccuaucgcaaaaaaaaaaagauggagauggcucgaaugaguguuuuucaaacacugauugcacaaccacaguaauaggcauauuuuagugcaggccaguucacauacauacacaagcacacacaggaaggacaaaaagguccgugcaacacuuaacuccucucaagcauaauacacucuaauucuucauucuaccccacucucuucuuuuucuuuuuuccuuuucaaaaaaaaaaaaagcuggucaugauucauuaaauuccuuuuuuuuuuauugcugcaaauucaaauauguuuucuuuuuucuuaaggaggacuuugcuucacuacaaauuagaugaugggcuauuuacagcaaacccuccuaagaugguggcaagguagcuucauuaaaagcagaaagagcggccaggcgcgguggcucacgccuguaaucccagcacuuugggaggcugaggcggguggaucaacugaggucaggaguucgagaccagccugaucaacaugguaaaaccccaauucuacucaaaauacaaaaauuagccaggcgugguggcacacaccuguaaucccagcuacucaggaggcugaggcaggagaaucgauugaaccugggaggcagagguugcagugagccgagauggcgccauugcgcuccagccugggugacagagcgagacuccaucuccaaaaaaaaaaagcagaaagagugagcucuucaucauucauuagagacacucaggaucaggaugggccacacaaccaucuguccaaaauacugcagaaaggauuuuuggcuuuggcuggaaaugucccuuuuaauuuuaauauuuucaauuuugauaauaugcccaagauucucuugcucaauacaaguucagcauggaaauuguuggaaaaaagauacaguguaucuagaauuuaguugugauauuucccuaagguuuucaacucauaucaaaauaauuguaaugucaucagagguacaaauguucauauuuuagaaggcaccauacuucuuguauuugagagagagaaauacagguugcguaucaccuagccguggacagaaaucaaucuauugcuuuugacugaccacuggcagcuaaguaaggggcacauaaguuccuuuucaauucuauggaaaagcaauaaaaguuagcuguguuauaauuuuaaauccaaacagccaaguaauuaugcuaucuacaggaggccaagguuuuucacuugguaauuuaauucagcaagcaggggaggggggaagggcaagacuaaaaggccagauauggcuuuacugacuuucuaaccauucuaugccagagaacauccaaucuuuuaacuaaguacaaguuuuuaaaauauuaauuugugggcaacacacaguacauuuaguaccaaggcuaguguaacaauuuuuuaaauguagucaccuaauuuuggcauauacuaggauacucaauaaauaaauacugauuuguugaaugaguccaagguacugucauucucuaguacacacgcacauacacacaugcacgcacacacucccauuguucucaggcauaaaguaaauaaauguuuuaaauauucaugagucuagaaauagacccacacguagcuggaugcuugauuuuugacaaaguggcucugcagagacauggagaaagagugaucuuuuccaaaaauuauucaucaaaaacaucauuaagagaaggaaaaggccaaucacagacaagaagauacccaaaauuuauauagaacuucuacaaaucacuaagaaauaggcagacaacccaguaaacauuagacaagagauaaguaaguacuacacaaaaaaguagugaccaauaaauggucauacaaauaaagccaggcacgguggcucacgccuguaaucccagcacuuugggaggcugaggcgggcggaucgccugaagucaggaguucaagaccagccuggccaacauggugaaaccccgucucuacuaaaaauuaaaaaaaaaaaaauuagccaggcaugauggcgcaugccuguaauuccagcuacucgggaggcugaggcaggagaaucgcuugaagccagaaggcggagguugcagugagccgagauugcaccacugcacuccagccugggcaacagagcaagacuccgucuaaaaaaaaaagcagugaccaauaaauggucauacaaaugaccaacaaacguguaaaacaugcucaauuucauuaggaaucaggaaguacagauuauaacuacaaagaguugcuauacccaccaaccaaaauaucuaaaauuuaaaagacuaacaauaccaaguguuagaaagaauguggagcaacaggaacauaaaaugcuguugggaauuuaaguaguauaaucacuuugacagcaucuacuacagcugaacauacgaauacuguaugaucuagcaauccuaccaaaaaacaugaacaaaaauagucacaguaaaacuauucuuaacaaccccaaacaagccaaauauuuaucaagaguaaaauguauauauaaaugaugugaaaaacauacaaugcaauacuacagaguaauaaaaauguacaaacuaccucuauagacagccacauggacaaaucuaacgaacauacuguugagcuaaaaaagccagucacaaaagaauaaacaccaaacauuuccauugauaaaagguucaaaggcaagcaaaaccuaauuauagugauaggagccagaacagugguuauaucuggagaguagagaugggguaaugaacagaaagguucauagguagaguugucacauaaaauacaagauucucaguuaaauuugguaaacaauaaauaauccuuucccauaaacagguuccaugcaguauuugagauauguauuuuuauucgcuaaaucuggcaaccccagucaagggugguauuuuuggagaacaggucauauuuuauuuuauuuauuuuuuugagacagggucuggcucuguugcccaggcuggagugcaguaaugcaaucauggcucacugcagccucgaccucccaggcucaaaugauucucccaccucagccuccugaguagcugggacuacaggcaugugccaccacgcuuggcuaauuuuuucaaucuuuuguagagaugaggucuuacuauauugcccaggcuggucucgaacuccugggcucaagggauccucccaucucugcuucccaaagugcugggauuacaggcgugagccacugcgcccagcccccauauuuaauuucuugauauucauuuugugaucauccauugugcaucuuucuguauauguguuguacuucaugaucuuaaaguuuuuuaaaaagcaaaaauauacgcagaaccuugcagauuuauuaauauuucauccauccacuguuuuuccuucccauccuuaaucacugcacgugagagcuaugauacuucugcaggaggcaggcacugguaaucagaguguugcugggcaaaaagcuguaggcuuuacuuucauuuuuuauuaaaauuacuuuuacacagcaugcuucuuuacuucuggaaucuguuuucaugucccgucucucaggggccuuucuuguuugcgugacuggcuuaaacuuaccaaagggcaaugcuaugcuggaaggccagccucugcccaucaaccaagaaaugcacaaaucaguguucaaaguuggacugaccagacguguaggggucagaauucaauggcgugaagcuacaaagaaaaaacuuguacuucagggccaacaacuuagauacagacaguguuuggaaaccauaaagccaaauacuucaaucugcugccugcuuucuaaaguuaucaaagguuuacacaauugccuugaguggcuccaucuaauucccucccaucuaauugggaauuagcuucuccugcagacacagauggcugacccaagugaaggguaguaaccaguauaaacaaaagccugaaucauuuuccugcugucguuuaaaugaggugcuauuuauuggcaaaaguucuuucaugcucaggguuuuuuguguuguguugcuuuguucuguacguucaucuucuuuugaaaugaaccccuccaggacaggcgcaguggcucagccuguaaucccagcacuuugggagaccgaggcgggcagaucacuugaggucaggaguccgaggccagccuggccaacauggugaaaccccaucuuuacuaaaaauacaaaaauuagccggugugguggcgggcgccuguaaucccagcuacucgggaggcugaggcaggagaaucgcuugaaccugggagguggagguugcagugagccgagaucgggucacugcacuccagccugggcgacagagcgagacuccgucucaaaaaaaaaaaaagaaaugaaccccucccaauuauaaauagagaaaaaaaaaaucccuccaaguuugggugccugucucuauaaaguuugggaguaaacuuuacaggcugauagaacucuuaucugccaccuaccccucuugauaagugccagauuucuucaauuugauaauugaaacgguaucuuuuuucacacaggauacuggggauaaugauuaggcuccugagcuguggagacaagguugcuugaaagaaacccagcuucaccacugagacugugugguucugugccucaguuuccucaauaguaacugggaauaaaaacuaccuaauucaaagggcuguugggacacuggaugcugcauaaggugauuaaagcacagcgccuggcacacauuaaacccccaaugguuaucgucacuauuauuuguuaccuuugaggguccugccaccuauaaggacucucucuauauauuucuaaauuaggaaaaacauucagaugcagcuggagagaugggagaagcagccuauaaaguuugguccaaguugccaccaacccagggcagcagcauggggccuccaggagagucugcggagguggccacgccacgacccugccuggaccccagacuccagccgggagcugugaccucggacgcccuuccuacucacguugcgguugaagcuguugcccggcagcagaggcagggccauggcgcucaguguccgaaaauccagggucccagaagagagggcccggcaggcagcggcgccucccggccguguuguuuggcccccacguugcc

SEQ ID NO: 18929 - RNA, 20551 nt, Homo sapiens
ggggcggagacaggacuacgcgccuggaguaggagaaggaggaaaaaagagaccauagacuuccauccuggccuagagcggcccuuaaagugccagggagaggagggcggguggggaccacuccagaauuggccgcuggcgguaucauggcgacccggaaccccccuccccaaggugagcggccagggcccgaagugguaucugggacgcggcucacagcucucgaccuugcuccuauggcaccucuuccuuccccugcccuaggauucuucgagcuccauuuuuuuuuuaaggcagccccuucgagcacccccuccgagcuagacuuuuuccuccccucucugcggaacucaagcggagagccacccccacccccagcacagcccuaccugccuccugccuuaccuucaccuccggcccuucaucucccaucuucaaauguauuauuuucuuuuuuuaaacgucuggacucaagugauuucgcugagcuccagacuaguucucucaggaggaccccuccccacccccauuccucccacugaugaaaauggacccugcucugaccuugacccuacuaagguuuggaggugggggugaccccucacuacugugucauucugaguuggcccuggcuucgugaccccaggcugguccccgggccuuugggaaagcagaugggggucauuguugcaggguccuuuacucuugaggcccuggucucaagaauugaguuaaauaaagucaguaguuucuaugugggcauuuuuagcuguaggccagaacuaaugaguuguaacagauuuuuaaaaagauguauagaacauuucugacuuuugauugacucuacauuuauuuuuugcauuuugcuauuuugaagacuaugaaagugaugacgacucuuaugaaguguuggauuuaacugaguaugcaagaagacaccagugguggaaucgaguguuuggccacaguucgggaccuaugguagaaaaauacucaguagcuacccagauuguaauggguggcguuacuggcuggugagaacaacgucuuuuucauuaaauuucauuugggggccugacacugcuguccuuucauacaugggcaagaaucaccgugcacaggcaguaggucuacacuguuaauuccagaagaggcuuuucucugaguuaaaauugauguaaucuacauucccaggcucccuguugaguuuuggcgauccccucccccaugcccaccacuguuccucuucucccuccucauccuucuuuugauucuuuauauaauuuccccauucucauguucagcaaaugucguggaucugauucagugauaguagauaggaagaaauauaugaguuaauuauauguaaauuuuuacauuucauucagugcuaacugcugaaaaaaccuaagaaacucccacgguagaacuggccucuaguauugucagcccuguacagagcaguguaaaaugcucaguaugaauuauuggugaugauacagaugauucuguuuuuugugggcucguucagauuaugauaacucuuugaaaaagagcuguagaacguuaauucuguguuuaaaggucugauugcuuacuugauaauauuguggaguccauuaagaaguaguuaauaaccaucagccugaccaguuaacauuucagaccacgugauaacacaauggcuacuguggaucuaauucuguucuuauaauaaaaaaacuagccagauaacaaggggcagaaacaaauuugacuguuuugaaaauguucgugacuguagagaaauuuuggaguuagugaggguacuuaacuugugcauaagcguuuuuucuuagauucuuauuuaaauucaucuuacauagauuuaauugaaauauuuaccuguuuccacuugauaaguauaacgaugaguuuuuugauuuguguuuuacaugcaccuuggaauaaugacccacucuucuaugccuuuuuuuuugcaaaugccauuuuaugauagaaguacucauugugaagauucuguggugcagaggugcggcauuuauucaugauauguacuuacuagugcugcugcaggaaaaaagccugcaauuagaagagagaugccugucagggccuggucauucagauaauucuccacaggcugauaguuccucuagcccuguaauucaggguauggcucugcuuaaauaagcucacaauuugguuccaugggugauugguuaaugucagucagggccuaaagcccagucuuaaaacagacucaaaaauaauugagaauagaauuaucaagucauuucauuguuucuccuuggagaccagacuccuuguagaugaagccccaucauuggcagaaguuugcucggaaagccuagagacagagcagcaggagauagguucauuuuagugacugaugccaucaagcaauggauacacaugcuuguggaacacaguccaagggacauuguggcugcugccugccuuuucuguucccuuuucugagccuuuguugcugacauauauguauauauacauacacacacacacacacacacacacacacaacacacacauuuggauuacagccagguguugguccaggagcuguauaauacaacucuaauaauuauacaggcgauuuguugcaaugacuauauucaguguaguaaauuuuugcaauuuucuuaggauguaaaacugaugugauauuaugguguauauuaaggaggaacaguuaauaggcacuaaccuaacaaguuagcaauuuagaccaauucaagacauguauaggaggcugaggagauuuuauuuugcuguagguagcuguaggcuuuugaucaugacaaaaaauuaaaacuauuaggauggguccuugcuaggagagaugggagguguugagaccaguuagagggcccuuaaaguguucuggaagcaagguaaugaugaccuugagaguggaaaggagaagacagucaaauaauguuuuggagauaaaauauauagaacuguggaggccaggugcgguggcuuacacugguaaucccagcacuuugggaggccgaggcggguggaucaccagaggucaggaguucaagacuagccuggccaacauugugaaaccccgucucuacuaaaaauacaacaauuagcugggugugguggcgggcaucuguaaucccagcuauucaggaggcugaggcaggagaauugcuugaacccgggaggcggagguugcagugggcugagauggcaccagugcauuccaaccugggugacagagcgagcuccaucuaaaaaauaaauuaauuaauuaaauuaaauaacagaaauuuauucucucacaguucuggaggcuagaagucugaaaucaggaugucaacaggguuuguuccuucuuggaggcucagagggagaaaucuguuuuauguuucucugcuagcuucuggugguugccagcaauccuugucauuccuuggcuuguagacguauuacuccagucucugccucuguuguccucacaugucgucuucccucugugugcguccuuaucggauuaaaggcccacccuguccaguaugaucucaucugaacuuauuacaucugcagugacucuguuuucaaauaaggucacauuuagagguuuugggaaggauaugaauuuugagggggacaccauucaacccagugcagaaggcuagaguuagaaauauaggauucauuugcacaguguggaucuggaaugcugaagggaaugugagcucacugaaggagcgaauuaaugacaaaagaaguaugagcugacacaggguagaugagacacaaaaaacauuuaauauaaaaauagguagauauagauaaggaggccuuuagaaaugugggcugaaguauaguuauugaguggaacaacagcuggaccugaaaggguaggaaugguaggaaagcuuuagauagguagagcuaggaagaaaccccuagaagcagggagauuaauagcuugagcaaaggugaugaccuauuuggagguuaaugggguuggagccgaaggugggggucaaccagguguauggaccaucuugacuguauuaagcaaaacaucacuuuuauuacgggagguuucagcuuauacaaauguaggaggaauauaaugaaccccugaguacuugucguuauuuuaguagcugcucuuuuuuuucuauaaauucuccuccucuucucuccgucccuuauuuugaagcaaauuucagacauuuuagauugugcauuuuugacuagccuguauaacugagggguuucugagaagguuucugagcagguaagggaugugaucaaaagaaaugcaaagacauaagauuuuauuaggaaagcaaugaaaaguagaagagggagaggguuuaguacauaauugauuguuuucaucuuuuguuauuugauuaaaggugugcaggauuucuguuccagaaaguuggaaaacuugcagcaacugcaguaggugguggcuuucuucuucuucagguaugucagagcuuuaagcacuugccuuugcuuucauagaagguggaauuuuucuuuuaggcaucaguuuauggaagagcuacaaugaguuuuggaagcugacuuuugucuugaaagauaacaauuuaaauacuucugaguuauuaagcauaguuugaucccagcuauuaaaaagacagccauuaccgagcgcauuggcucacgccuguaaucccagcacuuugggaggcagaggcaggcagaucccuugaggucagauguucaagaccagccuggccaacauggugaaaucccgucucuacugaaaauacaaaaauuagcugccaugguggugcacgccuguaguagucccagcuacuugggaggcugagacaggagaauugcuugaacccaggaagcggagguugcagugagccgagaucgugccauugcacucccgccugggcaacaagagcaaaacucugucuccaaacaaaacaaaacaaaacaaaaauccauaaucuuauaucugaggcagauagauuugaaguuuuaguuuuguucauauucuuguaaguauaagaucuaaaaaugcuuugccauuagaggauguuuaucagggcaucaucuggcauucaugucuguuuggcauguauuuuuucaaaaauaucauuccuugaagaucaaauauaguaaauccaaaaauugaaaaucucuacgaaugaaugugagcagcacuuuuaaagauacagagaacugucacuuguacuagauuuuaaaaaugauugauguucauagccaccagaaucugaauucagcaccuaagccaucgaucauguaauaacuaguguaguuguaguacaaggggacuagauuuguauguaugaagcacagauuuugaguuguucacuaaacagccuuuuaaaaauauauauguuuucuuucuuuuggugacauuauuacgaauaauugcuuauuacuugugguaagagguaaaaaaaaugauuaauaccuaaauuuaguucuuuggaugaauaugccagcauuaguacagaugauaauuuuacuuaagcugauuuugacuugguuuuauauggaaucaagagcauauuuuauuccauagcuauuuugaagacucaguugucauuucuguuaguguaaaaggguacuggacugaagcagaguuuccuaaaauguucacagaauggagagaaguguauauuuuaauccacucugcaugucaguuuuucagaaguccauuucaguucacucaauaugcaccauucaaauccacauuuugucauugccaccucccacuuuuccgcauuuaguacacguagucuuugaaguuuuuaaggcagagcaacauaggaccuaucugcaucaaaccaguuuuucccacaaauacgacuaaccuugaaaacucaguagaaggaaagugaaaggggaaauaaaguaacaaauggcuuuuaggcuaauugccuaauauucuuuaggcccacuuucauauuuuuaugaccuuucuuauauuuaaagguaaauauuaguuuauuuagaacuuaaagcuuuucuaguaacaauaucaaguguuuuccaauagauauuuauuacacugccaucuuaaaguacacagucucuucguuuuaauuuuuuggaguuauacauccuuauaauucaaagggccaaguacuugugcaaggcuuguuacagauuagaguaauccuccaccucucucacuacccccauuuuuccaucccuugagacauccaguuugcacucuuaacugauucuuaagguaguaaucucuuuuucccuaaacaaguuaauuggacauuucuugaucuuucaguuuuaggugugaacuauuggcuucccauuauggaaugggaaaauuuagcugucauuuauugaccuguuuuguuuucccuauacuuccccaaaucucacauaccugaaugcuuucuucccucucccucaaucgucugaguguaguuacuucccuuuuuucauaauuguguuagaucauucauuauauggaguucacugagauugauuacuuggaguucacugaacuucuugagccugugaauuuaugucuuuaaucauguuugggaagguuuuggccauuauuucuacuaggaaguuugggauuuuuuuuuuuuuuuuuucgagacagagucucgcucugucgcccaggcuagagugcaguggcgcaaucuuggcucacugcaacuuccaccucccggauucaagugauuuuccugccucagccucccaaguagcugggauuauagacuacagcugccugccacagcaccccgcuaauuuuuguauuuuuaguagagaugggguuucaccaucuuggccaggcuggucuagaacucuugaccuauugauccacccgccucggccucccaaagugcugggauuacaggauuacaggcgugagccaccacgggcggccgggauuauuucuuuucuucuucuuuuuuuuuuuuuuuagacaagaguuuugcucauguugccuagguuggagugcaauggcacaaucucggcucacugcaaccuccgccuccuggguucaagcgauucucuuuccucagccuccgaaguagcugggauuacaggcaccugccaccaugccuggcuaauuuuuguauuuuuaguagagaugggguuucaccauguuggccaggcuggucucgaacuccugaccucaggcgauccacccgccuuggccucccaaagugcugggauuacaggcgugagccaccgcgcccagccaggauucuuucuuuuuuuuuuuuuuuuuuuuuuugagacagagucuugcucugucacccaggcuggagugcaguggugcgaucucagcucacugcaagcuccgccucccagggucacgccacucuccugccucggccucucaaguagcugggacaacaggcgcccgccaccaagcccggcuaacuuuuuuguauuuuuuugguagagacaggguuuugcucuguuagccaggaugaucucgaucuccugaccucaugaucugcccgccucggccucccaaaguucugggauuacaggugugagccaccgcaccuggcccaguauuauuucuuuagacaacuacuaguuguguaaaucaccuuucauugucguauguaucaaauaguucaucaguuuaaccgucugggcaaacuuggucccagagucaucuguccuguuugcuuucuaggccugguauacggcucucacccugggaucucucuucaauaccuucuggauauucccuuuuuguuuuggguuguuucuuguauguuaugucuuuuguuuguuuguuuguuuuuugagacagucuugcucuguugcccaggcuagagugcagugguacaaucucacucacuacaaacucugccuccugggcucaagggauccuccugccucagccucccaaguagcugggauuacaggcgugugccacaugcccgcuaauuuuuguauuuuuguauaauagggaggucuugcuauguugcccaggcuggucucgaacuccugggcucaagcauuccacccgccuuggccucccaaaguguugggauuacagguguaagccacugcaccuggccuauccuaugucuugauguauucucuuguuuugguggacacauccuccaauagcuuucguagaaaaugagaaugggaacuauaguuuuugagacuuugcaugucugaaaauuucuucauuuuauccucacauuuguuugauaauuuauuaauagcuguguuuagguauugcuccauugucuucugacuuccaguguugcuguuaaaaguuuaaaguaauucuaauuucugaaccuuuacauguguggguuuuuuuuuuuccuuucaguuaaugcuuauaggauuuucuuuuguccucaguauucugauuuuucccagugaugugccuuacugugggccuauuuucauccacugugcuggaaacucaaggggcccuuucaguuuggggaaauuuucuuuauauuuauuuaguuaaugauauccugcucuuuaauuuucccaucuuuuuuucuguaguuccaguuauauggaucuccuggaccaguugucuaauuuuucuuucuuuauuuauuuuacaguuuuagacuuauuuuuaauuuuuuuuaaauagagaugaggucuugcuauguugcccaggcuggucucaagcaauccuccugccuuggccucccaaaauguugggauuacaggugugagccacugacugcuuggccuaauaauuuuuuuuuuuucuuucuuagauuugguagaacacuaauaaucuuuucaauuuuccacuucuaucuuuuuggucuauuuucugggagauuucuucaacuucaacaaguuuuuuuuguuguuuuuguuuuuuguuuuuuuuuugagacagagucucacucuguucaccugggcuggagugcaguggugcgaucuuggcucacugcagccuugaccucccgggcucaggugauuucuucacgccagccucccaaguagcugggacuacaggcaugcaccaccaugccuggcuaauuuuuuguauuuuuaguagagauggaguuuugcuauguugcccaggcuggucuugaacuccugagcucaagcgauccacccaccucggucucccaaagugcugggauuacaaaugugagccaccaugcccggcuguuguucuuuuaaugugacuuuagcauucuguuucuugcuuuuccuucauggaugcagugagcaguaucuuuuuuaaaaauuuuuaauggcuaauacuuggauacuauuuuuuuguuguuguuguuuuguuguuuuuuuuuuuuuuuuuuuuuugagacggagucuugcucugucacccaggcuggagugcaguggcacgaucucggcucacugcaagcucugccucccggguuugcaccauucuccugccucagccucccgaguagcugggacuacaggcgccugccaccacacccagcuaauuuuuguauuuuuaguagagacaggguuucauuguguuagccaggauggucucgaucuccugaccucaugaucugccugccucggccucccaaagugcugggauugcaggcgugagccacugcgccuggccuuggauacuguuuuuuuaagagauuggugggauguauuuauuaugugugacuuguccuccuccaacccauuguuucaaccaaugcaaugguuagaagaccgucccuucaauaagacuuuuagaaacacaucauauuacuggagcacuaacauucuuggaaaccauuuuaauugcaugucuauagaccaagaaggcuugugagagaugguauaguugaaugucuucucuaauucgaagauagaagcuucuuagaaaguggcagagacugaaaguuuuccuuagaucaccagaugcuaguuggaagugacugccuuaauagacugcagguucagaguguugauccaaauagucuguccuacaagcaauucuuagcaucuacacagaauguucaucuagcaguuuauuuuuucagcuuuacaaacaacucugcagugacuagccauuuauauacagcuuugcacacuugucuaagacaaagcaaaaauauacauauuuaggccaggcaugguggcucacgccuguaaucccagcacuuugggaggccgaggcgggcggaucgccugaggucagaaguucgagacaagccuggccaacaaggugaaaccccaucucuacuaaaaguacaaaauuagccgggcaugguggugcaugccuguaaucccagcuacucgggaggcugaggcaggaggaucauuugaaccugggaggcagagguugcagugagccgagaucaugucauugcacgccagccugggugacaaaagcgaaacuccgucucaaaaaaaaaaaauauauauauauauacacacacacacacauauauauauuuaagccucuugauugucaaguagccuuccagaaaguauuccuacuauccccauaugagaggauccaccagcuuuucccccuuuucauacuguacucuugggguuccuuuuuuuuuuuuuuuuuucugagacagaguuucacucuguugcccaggcuggagugcaaguggugugaucuuggcuuauggcagccucagucucccagguucaaguguuucucgugccuuagccucccgaguagcugcaauuacaggcgcacaccacugucuggcuaauuuuuguauuuuccguagagaugggguuucaccauguuggccaggcuggucuugaacucuuggccucaagugauccgccuuccucagccucccaaagugcugggauuacaggcaugagccaccgugccgggccucauacuguacucuuuggaagggagucacuguguauagcccacauuucaggaguguaauuaugcuccaccuuucugaaggcagaguagcuacauaaauuauuuagaaauagucuguuggaagguuugucucuuauuuauucagucauuuauuuauaucaauauggacucauggauauuuauuuuauacuuugguuuauaaucuaaugcucuuuuauugcucaaauuuuaccagcuuuggccauuaagagcucuuucaguugugcauugucuuuuuuaagcucucugaggacauaaaugaucaagcuucuguguguguguguguguguguguguguguguguguguguuuuaagcuucuuccuaccaagucccuguuugucuaagguguuuuguucccccuccccaaccuuuuuccugcuuguuuauuuugguuucuaguuuucaaguuaaaggccuuccuccaagucugaugauccuugguugucugcucauauuuaagaauugagcacuaaaaguugauggaaagcucuaaacaauauggacauguggauugggcuuucccuucucugggaaaucugaccaguccaagaaaaaugaucuaaagauaaggaguugggggugggcagaauuucccgcagugaaacagcccaauuagaucagcauauggugaaguucacaagcaaaaagccccaucuaccuguuuagagcuuucuggccaacaugaaucuucaucugaaagccgugugugugugugugugugugugugugugugugugugugugugugugugugugugucuggccaacaugaaucuucaucugaaagccguguguguguguguguguguguguguguguguguguguuuuucuggaaacagucucacucucuggcccaggcuggagugcaguggcgugaccaugggucacugcagccuugaacuccugaggcucaagcgauccugccacuucagccucucaaguagcugggacuacaggugcaugccaccaugucuggcuaauuuuuguauuuuuuguagagacagaauuucgccguauagcccaggcuggucucaaacuccugggcucaagcagucugccugcuucacccucccaaaguguugggauuauaggcgugagcaaccgagccuggccucuggcauuauuauuuauuuauuuauuuauuuuugagacagucucccucuuucacccaggcuggaaugcaguggcgagaucucagcucacugcagccuccgccuccuggguucaagaaccgccuccugauucuuguaacucagccuccugaguagcugugauuaggugugagccaccacacccagcuaguuuuuuguguuuuuaguuucacugacauaguuucaccauguugacauggcugaucucgaacuccuggccucaagugaucugcccaccuuggccucccaaagugcuaggaguacaggggugagccaccacgcccagccccucugucaucauuauuauuauuauuuugagacagugucucacucuguugcccaggcuggagugcaguggcgugauaucggcucacuguagucucugccuccuggguuccagugauucuuuugccucagccuuccaaguagcugggauuacaggcaugcgcuacuaugcccggcuaauuuuuguauuuuuaguagagauaggguuucaccauguuggccaggcuggucuugaacuccuggcauuagguaauccgccugccucggccucccaaagugcuaacauuacaggcgugagccacggagcccggccuggaauuauuuuauuuuauuuauuuauuuuuaacuuggaagcuuuuauucuaauaaaaguaccuuauguaaucccauuaaauauuuuaguguuauaggaagucaaauguucaaaaagcagucaucacugccccauucccuccccagucuguuggcuugcauuuccuuguaguugcagaugaauuuuguguggacaagacugaauuggguccuguauguauugguugguuaaguugguuguaccugaaccccacuuggggcagauugcuuguccuuggucaucucuguacuggagcagggugcucaauuuagacugguauucuucgguuugaucagaaguguacuucucagcugggugccguggcucacuguaaucccagcacuuugggagaccaaggcaggaggauggcuugaggccaagaguccaagaccagccugggcaacauagugagacuucaucucucucucucuuuuuuaaggcauuaauaucuuuagcaucucaagguuuuucauuuuuccugcaagggaacagauucucaagggaauuuguucagugaugguagaucacuccagcaucaaagaucauucucuuguuaguagacaugcuagguuggguccuuugggauaaucuagcucauccauuuuguugcugagagucauuauuugagccagguugguuaauacagcuuuugagauuuagucuuuauucauugucuuuguuaucauuuauuuacuaugucucauucaucuggcauuaguugggacucuagggauauagagauucacagcccauauggucagugcugagcuagaaggguguguuuagugcugagagagcagagggaagacgcucugucugcuuggagguguuagggaagucuucuuccaaagaggcguuaguaucuuuagcaucucaagguuuuucauuuuccuugcaacuguuugacauuuucccccaaaacguagagaauucuuuaaauuauacaaaaucuuuaucucagauaacacuggguuuacuaauuaucagugacaaauggcuauguaaaaauauuuuguguauagaaugcuguuugugagaauuuguuuaaucugucucauuaaaaugguuuccuuuauucauuugcuggggauugggggguggauaaggggucucacccagggaauauaguuaagguuuguuuuuuguuuuuuuaauuucacuuccaauuuaacucauggcaugaagauuagcuuuuuaaaaaaaacuuuguaacuuaaaauguuaagucuugaaaaugacaguugaauugggaguugcugaugaguggugguauagauaauauuuuuguucugccgggcgcgguggcucaugccuguaaucccagcacuuugggaggccgaggcggguggaucacgaggucaggagaucgagacuauccuggcuaacacggugaaaccccuucucuacuaaaaaacaaaaaaucagccgggcgugguggcaagugccuguagucccagcuacucgggaggcugagacaggagaauggcauaaacccgggaggcggagcuugcggugagcagagaucacgccacugcacuccagccugggcgacagagcgagacuccgucucaaaaaacaaaaauaaaaaaaauuuuguucuaaccaaaaaauaaagccauauacauacauaaaauauuuguacuucucacaagcuuuggauuaagaagaaauguuaagauucagcaaaaaguaaaauucugcaaaagcuucaaaguaaucaacuauuuugauuacuuagugcaagccaauaagaagucuuuucaauuuauauguagaauuuuccuaagguucaucaucaccuccaugccugugacucaaauugcuguaucaaguacuaacagaaaaagccuucacuugccauuugauuugaucaccacuguuuugcugaggcuggaguuugaagugauaguagaugaauaaauacaagaagaaaugcagauaaacaaauucuucuauggagucauucacagacaaaauagaaccuaagauuucuagucagccuguuuaugcaaaaucagauauuuuuauuauuuaaaguauuuucuguguggcuaaaagucaguguguucauucagggugcaaauggcaaaagaaaagugaugcacuaaaaaauuacaaagaaagcauaagcuugacagaagugauuuauaaugguauauauggcuauuuuauuauuuggaggcacugaguuacuggacuggcuugcacacacacuguuguuccuguucagauauugcagucucucaguaguaccauaugauaauuuuucuuaugauaggcauuuagcuauaguuuuauuaaaaggauuuauggcaugaaacuuguguagagugcaguuuguuuuauauucuacuuucaaaagcaauuaccagaaaguauucuuaauuuaaguaaagagagcuauuuaaauacuuaccaggcuacuuaaauuucuuuagugaucuaauaacugauuggcuuaugaucccuuauaauuaaagaucuauuuaauuaaaaaguauuuuuaaauuagcuauauaaucuagauaaucucuguaucuuuuuaacuaauucccuauuccaaaaggugugacagaaugauaguauaguuaaaagacaguuuuuggaaucauuuucccaucauguacuaaacacuguucaucacaucuaaauaauuaguuacuuacuuaugcuuaauaucuguuuucccuaacagaccugaagcucucugaggauaggggcuuaugucucccuuauucaguacuuagcauaggguaggcacuagugucuguuaaaugaauaaacuaguggagaaaaagcaauuucuuagcuauaaguuuuauagguuacuagaacucuuaaguguuuauauauucuuggcuauuauagucagcaaccuaguugguauaguauugauaauuuuuauuauauuuuuugcagauugcuagucauaguggcuaugugcagauugacuggaagagaguugaaaaagauguaaauaaagcaaaaagacagauuaagaaacgagcgaacaaagcagcaccugaaaucaacaauuuaauugaagaaguaagaugauauauaauuuugacuuuuuuuuuuuuuuuccuuuuuuugguuaauggguaucccuuagcagaaaaugugaccgggggggauuacugucuuuuuuaaaaaugguguuuuugguuauauaucuagaguguuaaguaaaauuugagaucacaccacuacuuaaaucagucauuauuuuuuuuuuuuuggugguuaucauagauuccccugcauaucucuagcucacuuugaucuuguuguaaaaacuaagaacauucuuuucaacauauuuccucugccuuuauaaaugaacauguacagguguaguaaaacuuaaaaguacacauuuuuuuucuugaggauaguuugaaaauauguuuuuuuaauaugauuaauauauuuuauuaauguuuucagguguaauuugacccuuuacuuuuguacuguuuaaaauggaauugaauacuuccuugccuuuguuuuuguuuuauccuuuuaccucccucaacuuuuuaguuugaaaaaauucaaaccaguuaaaaaguugaaagacaaauauagugaauaucucaauacccuucaucuauucaccaaauuguucaugauuugccguguuuacuuuaucugugugugggugacacacacagauaauuuuuuuuccaaaguauuuaagaugucauaacuuuucaucccuaaauacuucaguauguaucuucuaagaguacagauauucucuuauacaacuaugaauacgccccccccccuuuuuuauuuuuuuacugugugggaacugccacuucagaaacuuuuuuuuucuuuuuugagacggguucucgcccuguagcccaggcuggagugcaguggcguaaucuuggcucacugcaaccuucgccucucggguucaagcgauucuccugccccagccuccugaguagcuggaauuacaggcacgcgccaccucucccagcuaauuuuuuguaucuuuaguagagacaggguuucaccauguuggccaggcuggucucgaacuccugaccucaugauccacccgccucagucucccgaagugcugggauuaggggcgugagccaccaggcccggccaacuguuuuuuuuuguuuuuuuuuuuuguuuuuuuugagacaggucucauucugucucgcuguguugcuuaggcuggaaugcaguggcaucaucauggcucacuacagccuugacuccccuggcucaaaugguccucccaccucagccucccaaguagcugggacuacaggugugcaugaugccucggccucccaaagugccaggaucacaggcgugagcccccaugccuggccaaaugccauuauuaauaaaaaaaaaauguaacaugagauaauaguauuuccuuucuuuguuaauuuuuuuuagacagggucuugcucugucacccaggcuggagugcaauggugugaucacagcucacugcagccucgagcaccugggcucaagugauccucccaccucagccucucaaguagcugggacuacaggugcaugcccagcuaauuuuuauauuuuuguagagaugagguuuugccauguugccaggcuggucucaaacuccugggcucaagcagccugccugccucagccucccaaugugcugggcauuacagguuugagccaccacacccagccaguauuuucuaauaugcaguucauauuaauauuuuucuacaaaauaucuuguguggcuuuuuuuuucccaauuaagaauuauaugccagguacaguaguucacuccuguaaucccagcacuuugggaggcugaggcaggaggaucucuugagccuaggaguuugagaucagccuggguaagagagagagaccuugucucuacagaaaauacaaaaauuagaacgguggcaugcaccuauagucucagcuacuugggaggcugaggugggaggauugcuugaggcugugagacgugauugugccacugcacuccagccuggcugacagaaugagacccuguucccacucacccccccaaaaaaaauuauauauuguuuucgguuaucaugucuaugaagucucauuuagucuuaaacaguccuuucaucuguuaauuuuauucccccaucuuucauggcacugacauuuuugacaccucuaggcagaauaucccacagucuggcuuugucugauggcuuccucaugauuuuauucugguuaaacauuuuaccaaaguaauuuguuuugguuuugauccuguacauuuuuuuuucuguuggcuaaauggacuauuaauaaauaccauugugccugcugugacaauuuauuaaauaaucuguguuaauaacuugaugaugggccauucaucucuaccuuacagguagauuucuuuuuacuugugagaucauugcugcccauauacuuauuaucucaauagccaaggagcuuacugggcaugacuguguucucuagucuccuucaauuagucagggacauuucugggaucuugcaugcuauuugauaccugcaguaguaggugcacaggaauuuuugcugaauauuuauugaauugaggaaaauagcugaaacugcuacuuggcucuggauucaguaagaauuuuuuuuugugcaucuuuuuauugugguaaaauaguuauacaaaaauuuuaccaguuuaaccauuuuuaagcauacaguucaguggcauuaagcauauucacauuuuucugcaaucauuaccacuauuuccagaacuuuuucaucaucccaaacucugugcccauuaaacauuaauuuucaguuucccucucuccccagcucuuaaugaucuguauucugcuuucugacuacucauacgagcagaaucauguaauaucuguucuuuuuugucuaccuuauuucacuuugcauaauguuuucaagguucaucccuguuguagcauaauuaagaguauuuuuguuuaaacuuuguuucaggcaacagaauuuaucaagcagaacauugugauauccaguggauuugugggaggcuuuuugcucggacuugcaucuuaaggacaugaauauucucccauaacggauucaacuaugagaagagaaguggcagcaauaaggcagucucucaaaagucauacugccagagucucuagggcaaggagaaacaacuagcuggacaauacucaauucacaacuuagcauuuugccaucugaagcuuggcaaacuaguaucugcuguaaaacaaccuauaugguaugugaaccguaguauuccugagcaaaacguggcuuucaucgcuuuguaaaaauuugcaucuguuuagaaacuagccuauaaaauaucaccauuggauguagauauggagagaaaagaaauauguuggguuuauugcuuagcgaaauauucucuuuuuauuuaaauaaaauguucuucauuguguuuuaugguauguguccauaauuuaaaauucauguuauaguuucaguauuaaggcugacuuuuuuuuuuuaagauauguuugcaauaaguuaaaaaacuguaauacccuuuuguggaaagcuuuagaaaugauauaauuauuaaagauauuaaacagacucugcugauguaauaugauaccaauuuuuauguuguuuuuuuuccuggaguuauuacuuuguuauaaguguaauaauuguacauuucuuuuuuguuuuuuuuuuuuuuuugagacagagucuugcucugucacccaggcuuggagugcaguggcaugaucuuggcucacugcauccuccgccucccagguucaagcgauucuugugccucagccuccugaguagcugggaguacaggcacguaccaccacacuuggcuaauuuuuguauuuuuaguagagacgagguuucgccauguuggccaggcuggucucgaacccuugaccucaggugauccgcccgccuuggccacccaaagugcugggauuacaggcaugaaccaccaugcccagccauaacuguacauuucaaaaaaggcucuucugaggaaauacuauaacaugucuaaagcucuuuuuucuuuuuugaugucuguaguuuaaaaaauaucuucuuauauguaagcuucuaauuuucuuguuuguuuguuuauccuggcagucugggcagaauuaauuauuuugggguuacauauaguuagaucacugauucguuuaauuaaccuugaaugcaucugcuuuucauuucuaaaaaucauuauuuuggucccuucauuaccaagaggccaaagucacuuuaaaauacuuaguagcauaguaugaauuuacugucugaagaacagugauuuuauaaaaaauauaauugugaaauugcagcuuaaagagaauugucuccucgauguaaucuaguguuagaugucaauaccaagauuucaggcuuuugauagcauuauguugguuaaacacuaggccaguucacuuauuucucagggcugguaucauacuuccucagaggcuccuuugcccaaaaaagcuuucuguauuguuaguuuugcccauagaguucuagguuggaauugggaaaagcagcagaacaacauguauuagagucuucauauuagaaagucuuugcagauauucagaccaucuccuuuuuauaagaagucccuauaguauauuuuguguauuguaaacauaugacauuucaugcuuucaaguuugguuacaggcugcaugcuuucguuaucgugagacuccuuaacauuuaauguggccucuaucuuugguuucuuacucucguuagugccucagauacaaugcuaaauaaaacugggacuuucuuaauaggaag

SEQ ID NO: 18930 - RNA, 4286 nt, Homo sapiens
auuccuaagugcuucagguuaaauauuucguuguuuaaaagaaagucacauuauuuuccuauacuuaaauggguuccuucucuaauuaguugaugguacuuacauaaauauuaacauaauauugcuacaaauuauguacuuagucuguaaucugacuuagcuagauuuuauauaauuuuauaauauugauuuaucuauacauauauuagucguauuaauuugcuaaauucagauuaaacuuuccccagcuccugguguauuuagaauuaugaaaaagaaucaguacuaagugauauaaggaugaauguucuauuuucuuuuuuuuucugagauggagucuugcucuguugccgaggcuggaguacaauggcaugaucuuggcucacugcaaccucugcuucccagguucaagcgauucuccugcgugagccucccaaguagcugggauuacaggcaugugccaccaugcuuggcuaaguuuugcauuuuuuuaguagagauaggguuucaccauguuggccaggcuggucuggagcuacugaccucaggugaucugcccaccucagccucccaaagugcugauauuacaggcgugagccaccgcacccggcuuauaaggccgaaguuuagaauaaaugagagauguagcaauacugggguuauaugccucaaguauaaaguacuuaggacugcuuauguguugggcuuauagugagguuguggagggagaaggaggaagugauggguagaguaauaauaaauuuagaacccagauugugaaagcaagaaaaaauuuuggaaauuccagccuuccuauuuuauugagauuuuugaaucuaugugucuggcacuuuaccuaccuuauggcaucuaaaauaauguuauaaaguggcuguauuuucucuuuuucacagaugagagaacugaagcucaaauuagacuaacuuguugaagucugccuagcuaucaagugguaaagguaggaucugaaccuagagcuguaugauuccacaauucaugcuccuuuggcugcacuacucugccuuccggugggguuuucagauucacuuuucauggaaauuuauuauaaaaucauuuauuguaugucccuauuucucucuccagugaaauauguaaaccuuauaggcucuauaucuauuuuacauacauuugacagauaacacacuauguaacauguguaugauguaaggacuuauguuaccauaugaaauuugucccaugcuugaugauagauccuuguaguuguaauagacauagagcacuggccuagaggauagguaauguucucaaggucgcacagccuguguagagcaaggauucgaauccaggucugccucacuccaacucccacccauugcauccacuccuugcuguucugcuauuacauaguaauagcgggaagaaaaguguugagguguggagaguggguagccuuuuuuuucugagacggagucucgcucugucacccaggcuggagugcaguggcgcgaucucggcucacugcaagcuccgcgccauucuccugccucagccucccgaguagcugggacuacaggcgcccacuaccacgcccggcuaauuuuuuguauuuuuaguagagacgggguuucaccguggucuccaucucccgaccucgugauccaccugccucggccucccaaagugcugggauuacaggcgugagccaaagcgccuggcugccuuuuuuuuuuuuuuuuuuuuugagacagagccucacucuguccccagguuggagugcagaggugcaaucauggcucacugcaaccuccaccucccggguucaagcgauucuucugccucagucucccgaguagcugggacuacaggcgagcgccacaugcucgacuaauuuuguuuuuuguauuuuuaguagaggugggguuucaccacauuggccaggcugcucuccaacuccugaccucgugauccgcccgccucggccucccuuugcaggcgugagccacagagcccggccgggauugaguagccuuauaauccuugaaaaggaccugagucaggaacugcuaacuucagggagauagucaaauaccagcaaaaugucuaucugugcuugugcaaguguguguguauguguguguguguguguguguguaugagagagugugcgagcgaguuacuggggucaaaauuuccuuggcuuuaaaugucaccauuugugacaaaguuaacaauguauuaauuuagccguagaaaagauuuggcccuuuguacacacucauucaagcaaaauggaguaucauaaagggaaagguguuucagaggaaguaauuaaacaugaacuauaaucuauacaaaacuacaguuuguucgucuaguuacuagucucaggggaacaauuuaaaacugugugcaaaaucaguugggauucccauagcuucccgcugaauacugguaggaauuacugggucagcacugaauugucuucgucauauuuugaaauccaaguuuaaauauauaauuuuuauugguuacagguggaaaaccuauugaaaauauaaaaaacuccguuuauaaacagaaucuuguccuuauaugucuaucaauuuuuuccuaucccuguuauaagacauacagcuuaguaaauaaauuugccuuuugagaagaguagucgaaaggccuauuuuuuuuucaccuauaguaaagauuaaaagucagacuaaagccuuuccccugcaccugagagacagaacaacaaaauguuacuguugucuagggguuacaaaccugcagguuuugggggauagaaaggauuucuugggccaccagcugugaugauuuaauuaugucuucucucaggucuguccacaagcagccccuacuuuuguaagaaggcuccacugaaaucauggcaauagaacccaacauucugcagaucccgcuucacaauuucucauugcuuuuucuuguaagacuguaaugaacuacugauaagacacaggguaaacacagcacgaaaaucuggccccaaagugccgccaacagacagaccuuuggcgguggggagccauggucggcaagccaggccccgcgggcgacucuucauucccuccggccuggggcguaugggcgggggucaggggagcccuucccccuucacuuucggcgcgggugaggugaucggggcugccagcgcaggucuggccuagggcggcacccggaccgcggggcacgggaccggcagccgcuccccgagcgcccuccucgcggaggccauuauuuccagcagugccaaaagucugagccuucuucggagggcagaggucgagggccgugcgccgccucccggcuacgcgaccuguaccaggcccuguggggucccgggaccccuggagcgcgcgcgggacggccggagccgcggucugggcacaucccagagcucgcgggcaggcaaaugccguccuuggcgucuucgcccgccgcucgcgcccgccgcgggcggugccggaccucgcccuuccccaccacuccccucccccuccagagcccgccgcgguucccgaggugacacggcccggacccuccauucucugccccaguguauuuaaccagcacaaccuaacaggaagcucccucucggugacaacccuucccccgacagacgcgcccagcagccaaccaccggcuagaauuggccugcgucccgcucccaucucgguggcggccucggugggcggggcucgggcagcuagcaaguuaaguggagccacggcugacgugagucaacaaaggucacgugaggcgugcgggccgcgccgauugguggcgccagccgggcggggagggggggucacggcggcggcgugggguucgcugugugacacaauuacaacaacuuugugcuggugccggggaaguuugugucuccaacgaauccccucagugcuccccagccccgcgcgcuccggccguucccgccguccccgccuguggcugcccccugcccaaccccgcgaugugacccuacagccgaaagccgccgcugccgacccgggggcuccgcagccccugccgccgccgccgccgccuucaccgccgccgcguugggauuuuucgucgccgccgcccgcggcggaggaggaggcggcgauaaaguuggugugcuggucccgcgcgcagauugggggcgucacugcgggccccgguccgagggggggugucggcguuggaguugugaauucgcugcguuuccaugaaauccugcggagugucgcucgcuaccgccg

SEQ ID NO: 18931 - RNA, 239562 nt, Homo sapiens
ugguggcgccagccgggcggggagggggggucacggcggcggcgugggguucgcugugugacacaauuacaacaacuuugugcuggugccggggaaguuugugucuccaacgaauccccucagugcuccccagccccgcgcgcuccggccguucccgccguccccgccuguggcugcccccugcccaaccccgcgaugugacccuacagccgaaagccgccgcugccgacccgggggcuccgcagccccugccgccgccgccgccgccuucaccgccgccgcguugggauuuuucgucgccgccgcccgcggcggaggaggaggcggcgauaaaguuggugugcuggucccgcgcgcagauugggggcgucacugcgggccccgguccgagggggggugucggcguuggaguugugaauucgcugcguuuccaugaaauccugcggagugucgcucgcuaccgccgccgcugccgccgccgcuuucggugaugaggaaaagaaaauggcggcgggaaaagcgagcggcgagagcgaggaggcgucccccagccugacagccgaggagagggaggcgcucggcggacuggacagguacgggccgccgucacucgcccggucggcuccggacgggcaguagccgcucucccgggaggaccgagcgcggcuugucucuggcggcggcggggcgggcaccucgguuuggcgcucuucgcgccgccuccgcuggggccucgggcucgggcagggacgggucgguggcguucccugagcguuaacgaguaaacugugucugucuccacagccgccucuuuggguucgugagauuucaugaagauggcgccaggacgaaggcccuacugggcaagguaaggcagcugcgagucggagcgcggacaccgucucccuggccggcgccgcgcucgccccgggccccgcggccgggucugugcucauuguggccacggacgauggucgaggggcuuccggaaacuauuuccugccucugcucuccccccacccccggguacccugcuugcucccuugcgaaaucgcucuuuuccucuuguagcuggaggaacagagacgggaucgcuuuggggccgggcucaacugggucgacacaacugccugcuauuuuacagcuuuuugaggguaggccgaugaucuucgaggugccuguuuagggucaagggaucgugaguguguucagauuuucccaaauuucggacuuaacuugccucuacggguuuaaaaaaauucuuuuccuucaagcaggcuguucgugaugccuacugcuaaccaaauguuuuaggcuuucuuguguccccgcucccagaagggggaaguuucacggaguuuaggucggugaagaguuugcauugggcuguugacauguaucucgauugcaguguguguuaccugaaguuaggugacuuguuuacuuuuugggucuuuuuggcauagaaauaccguaguuauuuguaaacguguucucuuccuggagccucauuuccugugugucugacaggggaggcuggggaggauucgggguguagucuuuuuuuauuuguguggaaaguuguuggcacugucauuuaguuaaguaauggcugcuccuaucggcccaagauggcgggacagggugggaggagaaagugaagggggggguuagggggaggguguagagguaaacauggaaauaaauaguagccgugaauaagccuuuccuucggaguguguagcucagugguguuuaaaaaaaauuacccaagauuauuugcauauagaauucuuauaccuuucauaagcuuggaagcagcaugcauaagccugguaaaugcuuaucaaccuguagcacauuuaguuauccaucuguaagcuauugaacaaaggcuggagucucaaucuguaugcaucaguuuauauuuccugaccaaaaucugauugcaaugguauuugaauacuuucuucguaauugggaccgugaaaguuggagugugugcuauggguguuguauccguuagacauuuucuuuucuagcugaaaucauagcuuugcauuugacaccuagcuuuauuguugcaguugagacgcaaguuugaaauaagucuaacauuuuauucuuaaguugauuuuuuuguuguucugaauuuuugucuguagcuugguuucgcagagucaucaauuccuuuuuaucuguaauuacacauuuguuuuuauuucaaaguaauuauaagguguuauauugcauauaaucagaaaacuaaauggaaauaaugcuuuucaguaagcccggccccuuugaccgauacagaaaacuugaauuaaacuuugacuacguagguauuaauuggcuucauuacaauuauugcuguaaaaaugaacagugacuagcucuggaaagauuuaagcgucaguaauuguuggucuccugccuuaaaguuuuuuuuuuuuuuuccaauuugaguauuuaaaguauuuuauuuaaaaauauuugacugcugucaaaguugucauuauaaaagauuaaacaugauuuaaauuaaaagagcauuauuuuguuuuggagggauuauuguuggucuaacauggguuaauaaaauugcuugcaaagauaauucacguggaaaaguuuggccaaaucgauugcuuuugguuauggugaugaaaaaauaaauggaaucugauguuuuauguugagaauguguaaaaugcuaguugauuuuaugucuuagaaugcucauauucauauagauucacugcgaauagugcuuaacauuggauuucggauuguaauauuaaacccugcaguuaugcacuaacgaguuuaaauuuuaaaaaaguaaccauuuucaaauauucuuggcaaguugugcauuacuugauguuugaauacaucuuaaaaaugaaaaacuagugaagcuucacuauguuuggggccuucaugauauaugggguaauuugaugaacgauuaagcaguuuguuaaacuaaagaaaaaaaaaucuucacugcuucagacucagugcuugugagguguccuaccugcuuaggacaagauucaucagccuuaacauuaaaauaaaaccuucuguaauaugugcuugcaaccgcauauaguucuugguugcaucuuugugagccugaacauaccagugggguguguaauguaaagccugacauuauauaacuucgcacccucuguuugaauuggguucugaaugaagugaaugagcuggaguccugcuguaggaagucuugaauuauuuaguuucauccuucuuuuaacaguccucgaagcaguauuuuuuuguuuuuuauuuuuauuuuuuguggaauguugagcuauguugguuucagaauucuuauucccugaaagucuuaagaguuggcuuuccuuuacugggcagguuuaggcuacuuaccugagggcagauaauggaauugaauaacucccagaauucccuuuuuagcuuugauuuuuguccugccaugcccccccacccccaaccccccggccccaauuuagucugcacuuuguauaacguuuuccuuucuggcagaaauuuagcuauuacuacuuguuuucaaaaauucuuauuccuauguauauuauuggauuuucuuucaaguuuuuaaaauucacauuuguauguuaaaaaaaacucuugaccuaaaagcuuuagaaaguugaaagcauuaaauaugucucuuacuugucccuuaacauauguacguauacauauauacacacguguacauauacauauauacacacguauacauauacguauacacacauauacauauacgcauauacacacguauacguauauacgcacguauaugaauacguauauacacguauacgcauacguauauacacacguauacguguauacauauauacauguauauacauacguauguauaugcguauacacauauauguauauauaugcauaugcguauguauacguauguacauaucuauauguguauuccuuuuccaggugugcaguuuauucaaaccacugauuucucaucgucucccgaauguuuuugucagauucaguuauauuagagucauugaaagaauuuuuuguuuguaggauggccauuugauauacaaugccugggguuuuggauuaaaaaaauaagguaguuaauacaauguauuauuuuuugguaaugucuuuaagguuguaaacagcuagagccugcguaauuagaguucuugugauauagggugaucuugaacagugcucuugaaugcugacccuuaaucuucugguaauguaauaauucaagauucuuauuuuuaaaauuucaguggaguuaucgaaaacuaagcaaaauauuuuaacagaaauuaacuugugacuuuuuuaguacauuuuugaaaaccuuuuggguuuuuuuuuuuuuaaguaggguaaggauuugaguuaaaguagaauauauacgaauauauaccauaaauguaguaaguuuaaauauaguaguacuaccaaguauaguuauaguaauaaugcuaggggacuggggaaucuuaucugcgucagggaacuauugcuaaaauacacaguuuugaacaaaguaucuuauuuuuaaguuuuucuuaaauacucuuauuggaaauuuuuuugguaauucuauuaguagaaagauuauacaaaauacuuagaaguuauagauuguauaucacuuaaaaauguaugugcuuuuuuccguaggacauauuagcauuaaaacaguugguguuuuaaauuuuuuugauaauagaaguaguuuaagauccauugaaacauauuuucuuaaauuugguuugcuggcguguuugguaggggaaauuauuaggucaguucuagagguggcuuuuuuaaauuguaauauuuggauguugauuaaaaacauucucauuuauguguguuuuuuguuugcuggcacuuaaaggcauacagguugaguauccuuuauccaaaaugcuuggaaccagauguguuuuggauuugggauuuuuuuggguuucagaauauuugcagaauacauaccaguugagcaucccuaaucugaaaaucugaauuccaaaaugcuccaaugagcauuuccuuugagugucauguugguacccaaaaaguuuuagauuuuggauuuucagauuagggaugcucaaccuguaaauucauuuccagugcuaaagauggcuaguguuuugguuagaaaagucaugagagccugucucaaaaaacaaaaacaaacaaaaaaagaaaguagccauggaaauaaugucaugcuuuguguuuuaaagaguuuucuaguuuggaagauugucuucugaacacuugcagucuuaauuuuuuacguggacaaagucuuauauacuugguauuuccuaaaguuuugauuugugccugguaauaaagauauacuaagauuauagaacauauuugcauauuuggucacaaauuagaacugcagcaauacauaaacaggcacuuuuaaaguucugguuuucuuuuucaguaaauaguucuuucugucgaaucaauuacaaauugaaauaacuagagagcauuugacugccaccucuagauacuuuuuguuuuuuuuuuuaauuugagacagucucacacuaucccccaggcuggagugcaguagagugaucucggcucacugcaaccucggucuuccagguucaagugauucuuaugccucagccucuugcguagcugggauuacaggugccugccaccacacccggcuaauuuuuguguuuuuauuagaggugggguuucaccguguuggccagacuggucucaaacuccugaccucacgugaucagcccaccauggccuccuaaagugcuggcuuugcaggugugagccgccgcaccuggccaauaucuuaagcuguuaagaaaaacugccugagagaugaauuuuugugacuuaggugaagugauaggucaugcacuuuaaaccaaaaugaaaguucauugcuuggcuagcugcagaguaagucuuuuucugacuuaaauuauguaacauuuaguuuuuguuuacauaguaccaauauucugcaucuuugaaaggauuucuguuaaguuuauuuuuacuuugaaauucauugugaugcguugaacucuuugaaauugauguuaaugacugcuaacacugcauuauuaauaauauuuuugaaauguguuaucuagagagcuaauuuauguuaagaaaacacuaccagcuugucuaagaauugaaauggugguuaggcuguuuaggacucacauguauuauuuguagauuaguuaauuaauaaaguuuauuuaaugaaugcauaauugacagucuuaaguacucauauugaaacuucacauauaauuuuaucaguuuuccacauugguuuguaaauuaucgugacaguaaauuaaaacaguauauuaauguacacuaugugcaagccuucuauguagauaguaugaagauagcauagauauuucuugcccguguugaacuuaaauucuuuaagaggggugagauaaguuuaagggugacuaacacaggaccaucuuugggagaagaaaaaugugaaauauucugaaaguuuaugagaaagguaaauuuaacaauucacaaguuagaauggcucuuaaagauggggauuguuuguugauuguguuucuuggagaugguauuucuugauuuagauguuagcaaggcaucuuauaauuuuguuuaggaaaacaugauuuaaaaaucacauuuuaaggcugggugugguggcucacaccuguagucccagcacuuugggaggcugaggugggcggaucacuugaggucaggaguuugagaccagccugaccaauauggugaaaccacgucucuacuaaaaauauaaaaauuagccgggcgugguggcgugcaccuguagucccagcuacuugggaggcugagacaggagaauugcuugaaccugggaggcagagguugcagugagcugagauggugccacugcacuccagccugggcgacagagcgagacuucaucucaaaaaaaaaaaaaaaaaaucacauuuuagcuuuuagcagauguucaaaggaugaucugcuguguguucuguccuucuuugauuucauuuuguaguaauauuuaccuuguuaugaguucuuaacuugagauucuuaaaugaguguucaugggucaauuuaaauucucugacagaguuuggaaggacacucaggaugacuuaauggucaucuuggaguacaagacacuuuuggggugagaaggaggggagauuuuaaacuguuuuauagauuucuguacugcuuuuuuuuuuuuuuuuaacaccguagacauauauuaccuuaaaaauaauacaauaaggccaggcgugguggcucgugccuguaaucccagcacuuugggagacugaggcggauggaucaacugaggucaggaguucgagaccagccuggccaaaguggcaaaaccucaucuccacuaaaaacacaaaaaauuagccaggcgugguggugggcgccuguaaucccagcuacuugggaggcugaggcaggagaauuguuugaaccaaggaggcggagguugcagugagccgagaucgcgccacugcacuccagccugggcaacagagcaugucuccaucucaaacaaacaaacaaaaaaaaguacucugauaguacaccagaauguuauauuuugguugacuaaaaauggguuuaaacuaccaugucuauaguuagaagagauacuuguaaaggccuuucuugcauuuuaauuacagucugaaguugggauacuuuugaacuugauguuccuucagugaggguaggagugaauggaguagagauguacccaauuagguccuauuucuuuguguuuuagauggcuuugugacagucacugcgcucauucuucauuuugaucuuuagcauuucauugcugacuuuauuuugagucugauuuggcacaggcugauacuugggaccugauuaagaacuguaaccugggccgggcgcgguggcgcaugccuguaaucccagcacuuugggaggccgaggcgggcaucacgaggucaggagcucgagaccagccuggcuaacauggugaaaccccgucucuacuaaaaauacaaaaauuaucugggugugauggcgcguaccuguaaucccagcuacucgagaggcugaggcaggagaauauugcuugaacccaggagauggagauugcagugagccgagaucgugccacugaacuccagccuggcgacagagcaagacaccaucucaaaaacaaaaaacaacaaaaaaacugucaccuggaagggugggaguaaucccuuguuagacaguuuuagguuucugagcuaauuuguagacugcuugcaacuuucuucuauaagcuuuuauuauuuuuucucuuaccuauuucuuccuuauauuccaucauuuguuuacuucuguauauuauuaaaacuguuggugguguuccauugugaauguauucuuguaugcuuuuuguaauuuucucugugguacuauuuugucuuuuuuuuuuuuuugagauggcauuucacuuuuguugcccaggcugcagugcaaugucgcaaucucgacucacugcaaccuccgucuccaggguucgagcgauucuccuuccucagccuccugaguagcugacauuacaggugugcaccaccacgccuagcuaauuuuuguauuauuaguagagaugggguuucacuguguucgccaggcuggucuccaacuccugaccucaguugauccccccgcgucggccuccugaagugcugggauuacaagcgugagccaccaugccuggcugaguauuuugccuuuguuagaauaaauagaagaugcugcugcuaaguuuauucucaggaagaaaguugggguuauacuuaaggguauuauauaaggucaucuaauucauuuuaguuuagaacaguggaagaaauuguuuuagacaaaggguuauuuuuaaacuacaaauuuauuacguguucauuagauuuuucucucuuuuugaaaaaaaaguuuauuaggaaaaauuuucaguguuuucagaaaguauugcaaaucaaccaucacccagcuuuaauaguuugcaacucaugaccaguccuguuucaucuauauauauuuugccccucacucauguuauuuugaagcacaucucagcaaucagucacagcauuuaauccauagauguuuguuucugaaacauaaccgugaugcccuuauuacauguaaaauaauuucuuaaucucaaauaucuguggaccuuguuuuuugcuguauggaaguuaagaaauaauugcuuggaaaaugaguagaaaacauguuuagcugaguaugugaugugaauuuuguuuguauuuugauacugcuauaguguucugugauagaauauuacauaauaugugacacaagagguaauuuuuccugagaacuuuaugaaucauaguugcuugagucuggauaguuuuuauuuuuagggaaaauuuguuuucaagauacaguaguuaaauaaauauuuuagguuucugaauuucaaauaucagaaugagaacuacaaaagcuuuugcuuugcuugauugauuggugaaacauuuguugagcugcugugggugagggauugugucagguucuggggcaaccaauaagaccuggccucuguccugcagucagucuguugggagaggcugacagacugagugaucauaugauguauuaaguguaauaauaaagauacaugcaaagugcugugagcucugaaaugauggaguaauuaaaacauuuaaaacuuuuuauuaugcaucauuuaaaguauguacagguauugaagguaguuuaaugaacuccuguuuucaacgguucuccacauuuuggagcaguuaaguuuuuuuuuuuuuuugaggcagggucucacuaugucagcugucacccaggcugagugcagcgaugcuaucucggcucacugcaaccucugccucccaggcucaagcaauucuccugucucagccucuugaguagcugggacuauaagcgugaaccaccaagccuggcuacuuuuuuguauuuuuuuguagagacaggguuucauuauguugcccagacuggucucuaacuccugggcucaagguaucugcccgugucagccuccauagguccugggauuacaggugugagccacugugcuggcuggagcaguuaguuuguuuuuugagacagagucucgcucugucguccaggcuggagugcaguggugugaucuuggcucacugcaaccuccaccucccagguucaagugauccuccugcuucagccucccgaauagcuaggauuacaagcgugcgccaccaugccuagcuaauuuuuuugauuuuuaguagagaugggguuucaccauguuggccaggcuggucuugaacucuuggccucaagugauccucccgucuuugucucccaaaguucugggauuacaagcgugagccaccccgccuggccuggagcaguuaguuuugacuggagaagugacugagggaaacugcacaaagauucagcauuuagccuugguuaugaaacauguagaaauuuaccagacauguagauguagcaagaggaaaaagaggguaaagaguuagaaguauaaacugagcguggaggcucacgccuguuguaaucccagcacuuugggaggccgaggcugguggaucaccugaggucgggaguucgagaccagccugaccaacauggauaaaccccaucucuacuaaaaauacaaaauuaaccgggugugguggcgcaugccuguaauuccagcuacuugggaggcugaggcaggagaauagcuugaacccgggagguggagguuguggugagccgagauugcaccacugcacuccagcuugggcaacaagagugaaacucuaucucaaaaaaaaaaaaaaaaaaaaaaaaaagaguuagagguauaaaguuaaaugguguuugaggaauugugaauagucagguauggguagaggguagcauguuucagugggauugggaaaagauaacugaacaugugagaagccccaucacuauaggccguaggauguuuuggggcauuguuaaacugaacucucuaaucaggugaagugacaugaccagaaguagguuuuaugggaauauuacuggccacugugagaaggauaugguguaagggaaaggaacuucaguaccgauggguagauagcaaugcaugaauuuuaggauagaauucuguuccuaccacuuacuagaugugugauccuugggcaagcaagcaucuuucagagccucaguuuucuuaucuguaaaguagaaguaguaauacauuucccgcagacuauugcauuuuguguuaggggaaaaaauguaaaguguguggcauugggcuuggugcaugaaaggugcucaguauaagauaauaucuuggauaaugguaacgucuuggaagagacgaguuuaaacuaaggcugugguuuaggaauggggugagauggaggcagacuuaagagcucuugaaaaaggccuuuucuuggcuuucauaacauccuugcuacuuugacuuuguaucugacaacaucucagucuuugcaaggaugcuguguuuuagguccucuuuacucacccuguucccaauuuacauacauguuugacugccuacuugacuaccuugguaucuugaagguaucucaaacugaacauaugcaaacugaauuuauaauugucuuuaauauuccuugucuuaguaaaugucacuuaccacuacccaugccagaaaccuuggaauaguuguugacaucucuuuuucucaauuccuaaucacccgaccucaucauuucuauuuuuuuuuuuuuuuugagacaaagucucacuuuguuacccaugcugagugcauuggcaugaucacugcucacuacagccugaccucccaggcucaaguggauccucccacuccagcuacgugggacuauaggcaugugccagcacgugcagcuaauuuuuuuuuuuuuuuguagagaugagguccuucuuuguugcccaggcuggucuugaacucuggaacacaagugaucuucuggccuuggccuccaaagugcugggauuacaggcaugagccguugugccuggccuacauuucaaaucucaaauccguuucccuccauccccacugcccccauccuaauugcagccaugauauugucuuugacuuuugaaauaccuucaugcaauuuuuugaauauagguauacuugcacauaguacaaaauugaaaagugacagaaaggaugguacagugaaaaucacccucugugcuugcuuuggcaguacauauacuaaaauuggaacaauacagagaagaguaguauagccaaauauuaaaaaaaaaaaauucuggcugggcgugguggcucacgccugugaucccagcacuuucaggggccaaggcgggcagaucacauggucaggaguucgagaccagccuggccaacauagugaaaccccgucucuacuaaaaauacaaaaaaaauuagccgggcaugguggcgggcgccuguaguccuggcuacuugggaggcugaggcaggagaaucgcuugaacccagaggcagaguugcagugagcugagaucacaccacugcauuccagccugggugacagagucagacucugucucaaaaaaaaaauuccuacgucaucucucacuuacuuaguucuuuuuuucagaggcagccacugauaaaaguuuauuggguagcuuuucacuuuuaagcauauucuguuagauauuuuuaucacacaaaugagaucauauuguauauuguuaaaaugcuuuguuaauuuuaccucuugcuauaugaaaauacugguaguuuuuuuuuuuagauggagucuugcucuguugcccaggguggagugcaguggugcaaucuuggcucacugcagccuucaucucccggguucaagcgauucuucugccucagccucccgaguagcugagauuacaggaaugcgccacccugcccggcuaauuuuuuuaguagagacgguuucacuguauuggucaggcuggucucgaaccccugaccuugugauccgcccgccuuggccccccaaagugcugggauuacaggcgugagccacugcaccugaccuacugugagcucuugauuggaagaauuggcaaauuuugccuucauauuuugguuuuauugcucugacugauuaccaggccccaugaauauuaauucauuccgugaauguguauagaaguagccauaguuauacuacuuacuaucuuuuuuuuuuuuuuuugagacagagucuugcucuguugccuagacuggagugcaguggcaggaucucggcucacugcaaauucugccucccggguucaagcgauucucuugccucagccucccaaguagcugggauuacaggcaccuaccaccacgcccugcugauuuuguguauuuuuaguagagacaggguuucaccauguuggccaggcuggucuugaacuccugaccucaguugauccacccgccucugccucccaaagugcugagauuacaggcaugagacaccgcgcccggccuacuuacuaucuuguauuuguaagauucauuuauuuucauuauuucuucuugguuuuuauuauagaaaagagaaaauagguaaauuuggguucuugauuaguucaaaaaaguauagccuuuaguuuguuaacuuauagaugaauaucuuuuuuuuuuuuuuuuguaggcagggucucacuguccuccaggcugcaguguaguagugcaaccuuggcucacugcagccuccgccucccagguucagccucagccucccgaguagcugggacuacaggugcaugccaccacuccugguuuuuguauuuuuugguagagaugggguuuuaucaugucggccaggcuggucucaaacuccuaaccucaagugauccaccugccucggccucugaaaguucugggauugcagacaagagucaccaugcccagcccagaauauguuuauuuuuguuauaaagaugaaaaauuuggugauagagcuaggacaguagugcuuuuuuggagucauuuaccccuugagugucaguaacccuuuagcuacaaacauuuuauauaugauuucagagaguauagggaaucuuccuugaagcucaacuauggauauuaguucaauauuuucagcuaguuuaguuuacuaauucuuggguagagguguaaaugaugugaguaugucagggagaaagaaaagcuuuagaacuacuggcuugguuagacuaaaauggcauggauuuugccacauaguuuugugguguuccguggccacaucacauauucucucaaaaucucuauuaauaauaaggaugcuaggggaagacaauuuggauugauccuggagaaccuauggcuuuaacuggaaaaauauccuaagcacagucgccauuaacauaguuaauaggcuuuaguauuguuucuucagccugagugcucaaaaugcugguuugcuugggaggguaaguguuauaccuaggaagaacaauagauuggaaaacugaagaccugaggccaagaguucaggaccagacugagcaauauagagugaccccuggucucuagaaauuuuuaaauuuagauuagcugggcaugguggcauucguuuguaguuccagcuacaugggaaaaccgcucgagcccaggaauuuaaggcuguggugagcugugauugugccagugcacuccagccugggcaacacagugagacuccgucucuuuaaaaaacaaacaaacaaacaaaaaacuggcagagggcaguggcucaccccuguaaucccagcacuuugggaggcugaggcggguggaucaugagguugggaguucaagaccagccuggccaagauggugaaaccucgucucuacuaaaaauacaaaaauuaaccgggcgugguggcgggcaccuguaaucccagcuacucgggaggcugaggcagagaauugcuugaacccgggagguggagguuggcggugagccgagauccugccacugcacuccagccuaggcgacagagcgagacucccucucaaaaaagaaaagagaacuggagaccugaguuuuaggaccugcuguguauuucaaucacuuaauuuuuauguuucaccaguuuugccguuucuuaaaaugaagggcuaggaauuaggaauuuccaaaaugacuguauagcaccacaauuuuguagcuaguuuuucauuuguauuuuuaggguugacucaguucuugaagauuuugaccuagaaggagggcacaauuaaacuuuguuuuagauuauaauuuucuuugauuuuagccucaagcuuuuaagaccagaaacugaaugaaugcacauaaugaaauugagauuuguaugcuuuuguuaaucuagguugcauguuuuuguuaauauaagauuaaccauuuaguuaguuuuagacugguuugaaaguauuucuuuaguguuuugacuuccccaaaccacuucuuucuuacaguugggauuguuauuucuuaggucagaucugauguuuaaaauucuaggcauaaucacuguauauuccugcuugcuagaacucaugugauggcaaaguuaagugaauucucagguaugaauugauaagaaauaucacauugaauaaauauauauuagguacugggcauguagauauuacaaagaugaguaaggauccuuaguuugccuaagaguagcaagagucgcuuggcaucagcugagacacuuucugaucuauugaaaguaagcauuuauuuauuuauuuauuuaugauggagucuugcucuguugcccaggcuggagugcaguggcacaaucuuggcucacuacaaccucugccucccggauucaagcgauucucucacuucagccucccagguagcuggaauuccaggugcuggacacaugccuggcuaauuuuuguaauuuuaguagagacaggguuucgccacguuggccaggcuggucuugaacuccugaccucaggugauccacuuaccuuggccucccaaaguacuggaauugcaggugugagcuaccgcacccugccaaaaguaagcuuuuguuggauuuugcugugugagugugucugugugcauaugauuauacuuuuauuauaaaucuaucaguuaaaaagauagauuuggaguuuguaaguuagauucagaguauaacucauaacucuuaaggaaacacuuaaaaaaaauuuuuuuuuaaaaucggcuuuucaaagaugacaaauggauagaaaaaauuaagcaagucuucuguccuugagguugcccagguuugugcauugacccuauuggccaggauguuguaaacagcauucagacauucagaggauaacuuuuaauaggcuauauagguuaucuaauccuuaaauagucaugauucuaugaaaagaggugaguccuaucugaaggaaaguuggaguccuuaacaaucuaacguaaguuuuuuggcucuuugucuuguuggacuugguuguccuuacuuacagaaauggacaucacaugacagauuggauaucaugcauauauuucuguaaauggcaacacuuauguauugacuuacuuuaaaaaucugacuuuuuauuuugagagaauuguagauuuauaugcauuuuuaagaaauaauagagcuagugugugcuuuacccaguuucccccaacuguagcaucuugcaaaacugugguacaguauuacaaccaggaugcugauauugaaauauagucaagggacagagaaguuccacaccaaaauauaugucuuguuccccuuuuauagccauaucuacuuccuuccuucaucucuucccacccgcuggcaaccacuaacccauuuauccacaaauccauuuguauaauucugucauuucaggaauguuauauaagugggaucauacaguauauauccuuuuggaauucccuuugaucauugagcagauauccuuggagaguuaucuaaguuguauuguguaucaacaguuuguuccuuuuugaugcaucacaguuucuuuaaucauuuacccuuugaaagacaucugaguuauuuccgguuuuuggcuguugugaauaaaacugcuaugaacauuuguguacagguuuuugugugaacauaaguuuucucugggcuacgugcccaagaguacaauugcugguaguugcauauuuaguuuuauaaaaaccaucaaacuguuucccggagcugcucuaccuacauuucuaccagcaauguaucaguguuccaguuucacugcauccuugccagcauuugguguucaugcuguuuuuauuuuugacauucuuguuaggauguauugauaggucauuaugguuuuaauguguauuucccuaauggcuagugauguugaacuuuuuuuuuuuuuuuuuuuuuuuuuuugcgagauagaguuucgcucuuguugcccaggcuggauugcaguggcgcgaucucggcucacugcaaccuccgacuccugggguuaagugauuuuccugccucugccuccugaguagcugggauuacaggcgcccgccacuacgcacaucuaauauuuguauuuuuaguagagaggagguuucaccauguuggccaggcuggcucgaacuccugaccucaggugaucugcuuuccaaagugcugggauuacaggcgugagccacugcaccuggccugaacaucuuucauguucuuauuuuccaucuguauauuaucuuugguaaaaugucuguucgugucuuuugcacauuuucuaguuggauuuuuuuuuuaacuguucaguuuugagauuucuuuauauuuucuagaguguaguccuuguuagguacgugguuggauuuucucccgcucgcucuauaacuuugaaugauuuuaacagucuuuugcagugcaaagguuuuuaauuuauuguccaauguauuaauuuuuauuuuauggaucuugaugugaaguauaaaaacauguugccuggcccuagaucccuaagguuuauuuauuuauuuuucuaaaaguuucauaguuuuuuauucauguuuuauaucaggugugagguugaaguugagcuuuguuuuugcuguagauguucaacugcuccaccauuauuuguugaaaaggucauuuuuucuccacugaauugcuuuugaaucuuuguuaaaaaauaguugcguauauauuuguagggguuuauuucuggguucucuauuauguucgauuugucuacgugcuuauuccuccaccaguaucacauuaucuuaauuacugucauuguauaguaggucuuguuugaaaugcuuguuuuccggugcuguaaagaaauagcacuugaauguaaauuuaaauuccuuagcaaggccauuuuuauacuuucugcagaaaggguacacuugccagcaguuuugcuaugagacuacacccacagaacaaaggaggcagggucauuuauaaccugacgcguccacccuacugccguguccaguuuccauuggcuggaacgggacuucacauuuuuuauuuggcccgauuggcuagcaacuuagaacuuuuuuaaggaggcaaaggcagaggagaacaaaggaaggaggaaguaaccuguggaauguugagaaagguaaaaacaccuuuaaauaaggaagaggaacaggcuauguccuaaugcuugcuuagaccaguauaagcaugccagggcaaauaggcuuaauugugggagcuaagaacauaaaguacauugauuuguuuauuauggcuagcagauauuuaagaauguucgcacaggucuuucaauaaauuuugcuucuaagagaaguuacuauuuauuccuaauuagauggggaggaaagucuuugaagaggaaccucuacguuuuacagccuuaauaucagguguagugagucucaccacuuuauucuucuuugucaagguugauuuagcuauucugagaucuuugccuuuucauauagauuuuagaguaaguuugucuaugucuacauaaaagcuugcugggauuucgaggccggguacgguggcucacgccuuuaaucacaacacuuugggaggcugaggcagguggauuacuuagggucaggaguuugagaccagccuggcuaacaguggaacccugucucuaccaaaaaaauacaaagcugggcgugguggcucacgccuguaaucccaguacuuugggaggccgagguggguggaucacgaggucaggagaucgagaccauccuggcaaaacauggugaaaccccgucuccacuaaaaaauacaaaaaaaauuagcugggcuugguugccggcgcuuguagucccagcuacucaggaggcugaggcaggagaauggcgugaacccgggagguggagcuugcagugagccgagaucgugccacugcacucuagccugggcgacugagcgagacucugucucaaacaaaaacaaaaacaaaaaacaaaaguugucugggcaugguggcucaugccuguaaucccagcacuuugggaggccgaguggguggaucagcugaggucaggaguuugagagcagccuggacaauauggugaaaccccgucucuacuaaaaauacaaaaguuagccaggcgugguggcacacaccuguagucgcagcuacuugggaggcugaggcaggagaaucgcuuggaucugggaggcagagguugcagugagcugagaucgugccacagcacuccagccugggugacagagugagacuccaucuaaaaaaaaaaaaaaaaaaaaaaaauagccagauguugugguacacgccuguaagucccagcuacuugguaggcugaggcaggagaauugguugaaccugggaagcagagguugcagagagccgagaucgcaccacuacacuccuucagccugggcgacagagcgagacugucucaaaaaucaaaaacaaaaacaaaaaaaaccuugcugggauuuugauaggaauugcaucaaaucaaccugggcauaauugauacauauauauuuuuugcuauacugagcuuuccaauucaugaacaugaguugucucuuuguuuacuuaggucuucuuugauuuguuccaugaacauuuguuaaguuuauaccuaugaaucucauuuucuuuugagcaauugcaaaugaugaugcauuuuaaauguaaauuuccaggucuuuauuguuaguauguaaauuuuuguguguugauuuuuguauccugcaaccuuagugaauucauuuguugugggagguuuuuuuuuuuuuuuuuugauaugaagucuugcucuguugcccaggcuggagugcaguggugcaaucugggcucaccacaaccuccgccuccuggguucacgccauucuccugccucagccuccugaguagcugggacuacaggugcccgccaccaugccuggcuaauuuuuuguauuuuuaguagagacgggguuucacugcauuagccaguauggucuccugggaaagcauucaauauuuuguccuaaaguuguagauuuuuuuguagaugcuauuuauucaguugaggaaguccaucuccaccccacuccuuccuaagaugcugagauuuuuaaucuugaauagagguuggguuuuguuaaaugcuuuuuucuggaucaacugaugugauuauaugauuuuuuugcuucagccuguuaauauaacauugauuucugaaugcuaaaccagcuuugcauaccuagaguaaaacccaauuggucauggcauauacuucuuuguguacauuguuggauuacauuugcuaauauuuuguugagaauuuuuguguauaagaucaugacaagaauauggaugaguguaucucauauguaauaauagaguaugaguaugcuaguauuuuguugaggauuucugccucuaaguaucaugagagauacugguuuguagguaacauuuuuuguacaguaucugguuuuggugucaggauaauaccagccuccauaaaaugaguucccuucuauuucuggaugagaauguguaaaauagguuuaaauucaucuuuaaauguucauuagaauuguuugguaaaaccauuugagcuuuaucuuuuuggagcuuuugauuagaaaaucaauuuugguaguaguuauaggacucuucagauugucuuuuugacugaguuuugguaguuuguaguuuugaggaguugaucuguuucuuuuaaguugaauuuaugaacucagaauuguucauaguauuauucccauguuauucuuuuaauguuagcaaaaucuguaguguucucuuuguuuucauuccugacacgaugauuuguguuuucaugucugugagucuuagguuugucaacuuaauuaauuaauuaauuaauuuuuuuuuuuuuugagacagucuuguuuugucccccaggcuggagugcaguggcgugaucucggcucacugcaaccuccggcuccuggguucaagugauucuccugccucagcccccgaguagcugggauuacaggcacccgucuucaugcccggcuaguuuuuguauuuuuaguugagacggggcucaggcuggagugcaguggcgcgaucucggcucacugcaaccuccggcucccggguucaagugauucucccgccucagcccccgaguagcugggauuacaggcacccgccaucaugccuggcuaguuuuuguauuuuuaguuuagacgggguuucaccauguuggccaagcuggucucgaacuccugaccucuggugauccacccaccuuggcuucccgaagugcugggauuacaggugugagccaccacgcccagcaacuuuuauuuuauuuauuuauuuauuuauuuauuuauuuauuuauuuauuuauuuuagagacagagucucgcucugucgcccaggcuggagugcaguggcacgaucucggcucauugcaaacuccgccuccuggguuugcgccauucuccugccucaaccucccaaguagcugggacuacaggugccugccaccacgccuggcuaauuuuuuuuauuuuugcauuuuuaguagagaugggguuucaccgcguuagccgggauggucucaucucaaucuccugaccucgugaucugcccgccucggccucccaaagugcugggauuacagaccaugagccaccgcucugggccaacuuuuauuuuuuuaagaaccaacuuuuuauugauugcuuuuuuuuuuuuuuuuuauucugcuguucuccuggcuucaauuuuauugauuucuucucuauuuccuucuuucugcuugcuuuggguuuauuugcucuuuauauuuucuagguucuugagcuuggaaguuggauuauuaauuugaaucauuuccuuuucucugauguaacaauuuggugcuauaaauuuacauuucagcacuacuuuagcugugucucacauacuuuuguauuuguauuuucauuuugauucaguucugugcauuuuaaaauuucuuugauccauggaguauuuaguaguguguuaaguuucuaaguauuuggaggguuuucuguuuucuuucuauuauuacuugcauuuuuuguguguuucucauucaucugcuuuuuuuuuuuaccuucuuauggguuaucuuaauauauuuuaggauuccaucuugauuuuuaauguuuuugaauauauuucuuuguauagauuucuuagugguugcucuggauauugcaguauucauauguaacuuaccacugucuacugguauugguguuuuaccacuuucaguuaagcacagaaacuuuucuuccacuuagguccuuuugcccucuuuacuuuaaaaauaaauuuuuuuuuuuuuuuugagacagagucuggcucagucacccaggcuagagugcaguggcuggauuuccgcucacugcaagcuccgccuccuggguucaugccauucuccugcuucagccucccgaguagcugggacuacuggcaccugccaccacgcccagcuaauuuuuuuguauuuuuuuuaguagagacgggguuucacuguguuaaccaggauggucacgaucuccugaccucgugauccgcccgccucggccucccaaagugcugggauuacaggcgugagucaccgcgcccggccaaaaauaaauuuucuuaaguguacuuacauucucuacauacauugaacaacacaucagauggugugauaaauuuugcuucaaccagcaaauaugauuuaagaacucuuccuuaguaagcagaacuaaaaaaagauaaaaagaaacucaugcguaguaugauagucuguuauauuuaccucuauuuuaccuauuccaaaguucuuuuuuuuuucccugaaguuucagcauucuuccauuaucauuuccuuuuuuuuuuuuuuuuucagacagcuucuuuagcuguucuuucaggguagguuugcuagcaagaaauucuuaguuuuucugagacugucuuauuugccuucauuucugaagaauauuuugcuguguauagaauucacaguggacaguuauuuucuuuaaguacuugacaaguguugugcuauuuuuuuuuuuccugucugguuuagaugagaaauuugcugucauuugaauugguguuccccuauaaaguaauguaucauuucucucuggcuguuuucaagauuuuuuugucuuuaguuuucagaaguuuaauugugauguauuggugugggugucuuuuuuauuugggguuuacucaccuuuuuguaucuuuagcguauuucaccaaauuugggaaguuuucagccauuauaucuuugaauacuuuuucaguccuauucucucucaucuucugggacucugagaagagucuuagcuuuuucgauuuuuguccauaggucccugaggcuuuguucuuuuuuuuuuuuuuuuuagucuguuuucucucuuguuuagauugacauaauucuacugauugguucacugacucugucgucuaucauuuccacucuuuuauugagcucauucaaagaguuuuuauuuuagguuuuuuuuuuuuuuuugguuuuauaauuuccauuugguucuucuaaaauaacauuugcugagauuucuguuuauuuguuuuaagagcaguugcaauugcuuguugaagcguuuuguugacugcuuuaaaaucuuuauuuuugucagguaauuaaaaaaucugauuuaccucaguauugugucuguugauuguuucuccucauucauaauauacuuuccugguuucugguauggcaugagauuuucauuuguacucuggacauuuuggauaucauacauauuuugagaacugugcaucuuguuccuuuuuucuuuuaagagacagggucgugaucagucauccagacuggagugcagugaugugaucauagcuugcuguaaccucaaacuccugggcucaagugauucuccuaccuuggccugcugaguaacuaggacaacaggugugugccaccaugccuggcuaauuuuguuuuuuuguuuuuuuugagauagggucuugcucuguugcccagguuggucuugaacucuaggacuuaaguaauccgcugcuucagccucuugaguagcaggagucacaggugugcaccacagcaccuggccuauucuuuuuuauacuaggcaguucccuuguugaaguguagugcaaggguuagguggguguguucauucagcuucuugcuggguccugcugauaauuacuguggaaaaaguggggcacuaagucauauggccuuaaugcagacuggugggauggaaguucaauuccucccuuacccucacaucuuccuaacaaaaguugggcaccauuuuaugccaccuuguugccucugaguagggguauaagaugaacuuucugacgggccaugcugccucagcaagagagaaguagggaggcuaucucacacugcacugaugcugcagggugaagaaaaagcuccuuaccucauaccacuuccccugaguugaugccagguggggaauggaagcucagcccccucuggguaccacuggcauuugagaauggcugaaaugguugucagcuacucugucuuacacugcuucauuuagccuugauacugggugaauguggagguucagcucuucacugguuaccacugauaccagggguuggggcagggaguagaaagcugacugacucuaacucacaucuccuuguucagucuuguugauggcuggguaggggugcagguucagguucuugcuggguccuguugacaccaggccugugugugcaggagggaggugggaguggagugguggugaaagguaguggugacuaacugcuucacgcagcuuuauuaagccuccuugcuaauggguggugguggaagccuagcuugccccuagaccccacugacacuaucuuaaaugggugagucugaacaccgcuugcucuuacuggguggaguauggaagaucagcuccucuuuuaggcuugccacuaacccaacaggggaacuggagcaccccugugugggggauggaagaucaauucccuguuuugucuugccaacacaacccugguaggggcuccagucccacagccugcuuuugcuggguggaggguguaggagcacuuauccacucugcccuuccaguaccaccuggugcaaagcaccaccugcuucuucugcuuggugguggugguggggggguguuagauuagcuguaugcuuggcuccacugaaacugcggagggagggagagggaggguguguguguguguguguguguguguguguguguuuguuuguuuuccauugguauuuagcuugaguaagauggguuuugccagaaagguuucuuugguaagcuuacccuuuuaucugcuucugcuuuguggugggguguguguguguuuagauuaguuguaugcuuggcuccacugaaacuguggagggagggggaggaagggaggguguguguguaugcguguguguguguguguguguguguguguguguguguguguuuuccauugguauuuagcucaaguaagauggguuuugccagaaagguuucuuuugguaagcuuacucuuuuaccugcuucugcuuuguggugggggguguauguguuagauuagcuauaugcccggcuccacugaaacuggaggaggguguguguguauauguuuucuuuugguacuuagcuggaguaggauggguuuugccagaaggguuuccuuuguuaagcuuacccuuuucccagccuuuugacuaggaggaacaggcuuuucuuggaauuuuuuuuuucucugugacaguuggugauacuguauuggggucuucugaagcagcauccugucuuggaaauauggguggcaauacgaaaacccagggaucucauugccuuauuacuccucaaauuaugaagucuuuaggaaaucugcugcuuucuuuccacuuuucagauacuuucuaugcuuguuuguuguauuauguucaggguuuuuuaguuguuaagagggaggaccugggaagaaugaagcuaugguacuccauuuugguggaacuggaaggcuuauaguaauucaauuuugaauuaugaaaguuuugucuaaagauauuaugucgugaacaaaauaagucaaauuuaggagaaucuugugacaaaaucacaacauauccucauuuuaaagcuguuucuauuagggcgugacccauaacuguuauuucggggauaugguuuaaauaacuagaaggcuuacuuuugaauaucaaaugcuuucugucauauucuuuaaaggaaguagauauuuacaugcaaagaaagaaacugaaagauaaacuggauuauagcagaaugucacuguuaugguuugccaucaaacagcaguuacucuuuaguuuccuaugccaaauauaccaguauaacauaacauucugcuccuuucaacauauuaaggccagccaaacaaaauuuuuuccccaaaauucuuaaaaugcuuaaaauaggcaaagugauucagaaguuuuuaggaguaggaaggagaggcgguacguacagauauguuucuguaugaauuucaaaugaauaagcaagggaaaacuuaauagguaggaggcauuagucuuccuuaggcagggaauaauuauuauuucagcaauguacauguaguaaaguucuacaauuuuaauucauucuagcucuaaaaauucuaugauuuuauccuuuuuucuguucuuuuaaacuuguuccuguacaauuuauagacuuuuuuucugagaaaaaucuuccuggagaaaagauuguuaggcccuucaauaauagggaguuucucuuaaaauaaguuuagccguuuuguuauuuaagaaaugauuuggccgggcgugguggcucacgcuuguaauugcagcacuuugggaauccgaggcgggcggaucaugaggucaggaguuugagaccagccuggccaacacagugaaaccccaucucuacuaaaaauacaaaaauuagcugggcgugguggcaggagccgguaaucccagcuacucgggcggcugaggcaggagaaucaccggaaccugggagguggagaucgugucacugcacuccagccugggugacagagcuagacuucgucucaaaaaaagaaagaaaugguuuguuuauuuucuguguaauauguuuaauaauaauauucugcauuuuucuuugauccauuaguuauuuuggaguguuuaaaguuuuucauauauuugugaauuucuccaauuuguuccuguuacugauuucuaauuucacuacauuuuggucagagagcauagcuuuuaaaauuuuaauucuuuuaaaauuaugaggacggccaggugcaguggcucacgccuguuaucccagcacuuugggaggccauggcgggcagaucacuugagggucaggaguuugagaccagcuuggccaacauggugaaaccccauuucuacuaaaauacaaaaauuagccaggcguaguggcaggcaccuguaaucucagcugcucgggaggcugaggcaggagaauugcuugaaccugagaggcagagguugcagugagccgaggugacagagugagacuccaucucaaaaaaauauauauauauauauacggggacuuguuuuaguggccuaacgugguuugucacggauaguguuccauauacacuugaguagaauguguauucugcuguuguugcagggaguauucuauagguggcuauuaagucuuguuuuguagagcucuuggagucuucuauuuucuugugaucugcugucugauuauugaaaguuaaguauugaagccuccaacuaauguugaauugucuguuuuuccucaauucagcuuuugcuuguauuuugaguuguuuguuuuuaccuguuauauauucuugauaaauugauccuuucaucauuauagaauauucugugucccuaguaacaauuuuugucucaaaguguauuuuaaaaauuaauaauuuuugugacuacauaguauguguauauucaaaguucauuuuguaugauauuaguauagccacccagcucuauuuugguuauuguuugcaugguacauauguuuuacauccuuuuaguuucaaccuauuuuuguccuugaaucuaaaguauguccuuuuuagaaagcauauaguuguguuaugccuuuaaaaaaauucagacugggugugguggcucaugccuguaaucccagcacuuugggaggccgaggcaggcggaucaccugaggucaggaguuugagaccagccuggccaacauggcaauaccccuucucugcuaaaaauacaaaaauuaguuggguaugguggcgcacgccuguagucccagcuacuacuugggaggcugaggcaggagaaucacuugaaccugggaggcggagguugcaguggccaaaauugugccacugcacuccagccugggcaguggagugagacuccaucucaaaaaaacaaaaaugauuucauucugucgaucuuugucuuuuaauuguaaguguuuauuugcauuuuaugugaugauugauaaaguaggauuuacaucugccauuuuacuguuuguuuucaucauaucaucaucuguuguuuuuguucuguauucuuccauuucuaccuuuuuuuuuuugagaugaagucuugcucugucgcccaggcuggagugcaguggcaugaucucagcucacugcaaccuccgccuccuggguucaagcgauucuccugccucagccuccggaguagcugggauuacaggcguaugccaccacaccugguuaauuuuuguauuuuuaaugcagaugggauuucaccauguuggccaggcuggucuugaacuccugaccucaggugauccaccugucggccucccaaagugcugggauuauaggcgugagccacagugcccggccuauuuacauuaucuuuuauauuuaccugguguaucaauuuguucugcuaugacagaauacuacagacuggauaauuuauaaauaauagaacuuuauuucucacaguucuggggauugggaaguccaagaucaaggcacucccagauuuagcaucuagugaaggcuagcuuucugucuccaagauugcugcaucuuuaugugacaaaaagcaguagggcaaagggaugaauagcuuucucagaccucuuuuagguuauuaaucccauucaugagggcuuugcuuucauaaguuaaucaccucauaaaggccuuaccucuuaaugcuaucacauuggcgauuaaguuucaauauauuaaucuuguagggacacauuaagaucauugcaccugagaauuacuuuuacugguacucuuguuuuuucuugugaauuuuaguuauugucuagcacccuuucaaccuggaugacugccuuuuguauuuuccuagugacaaauucaguuuuuguuuauauaguaaugucuuaauuuccccuuuguaauuaaggauaguuuugcugaaucuagaauucuugguugacuguuuuuuccuuucaacacuuuuaccacgucaucccauugccuucuggccuccacaguguuugaugaggaucgcuuguaugugaugagucacuucuuucguguuuucaagauucugucauugucuuuugacaguuugacuauaaugugucucaguguagaacugugaguuuaaucuguuuggaauucauugagcuuuuuggacgugagauuaauuuuuuuuauuacauuuggaaaacuuucagccauuauuucuuuaaauguuuuuccccucuccuucuucugugacuucaauuuugcauguuuugguaaacuucaugguguugcucagguuucugagacucuguuaauuuuucuuucuuauuuucuuucuguuacuggacuagauaaucccaguuaccucucuucaaguuccuggauacuuccugccuguucaaauauucacuagaauauuugaggcugucgagccucuuuagugaauucuuuauuucaguuauauuuucuauuuuguccuauuaaaauauaauuucucuuuguugauauucuuuauucuuugauauauugaccuuauacuuuaguucuugagacauauuuuacuuuauguaaaagauguuuuucauauuuuuguuuacuugaggucauguuuauaauagcugacuuuuaaaguuuugucuaguaagcucaucugggcuuucccugggaugguuucuguugauugcuuuuuguucuauggcuggaucguuuuaugucucacaauuuuugguugaaaacuggacguuuuauuguaauguagaaacugaaagcagaagguucccccuuugcaguauuggcuuuuguuucuuguaguuguuucuuuguuuagugacuucucugaauuaauuuuuaaaagucuguguucuuuguuauguauuaccacugaauucucuccuuguuuauuuuagugagugacuuccucaacugucugggaccacuaagucucccagucuuugcugaaggguguucugugcagucaguugacaacauugccauagccauuauuuugauugugcagagccucaugguaaagcggaggugagcaccuggggacuucucagauuuuucugggcgugcacacagccccuuaucugugcuuggcuuucuugauuauuagguuuuucauauuuuuguuggagcuuuuaaaacucuuacagacaucucagucuccugcuuuuccuucugaaguuuuugguuggucuuuuguuugucucuguuguuauccacugcuuuagccagccucuaagcuaaacaauucccuggaauucuuuucaacaaauggccuucaaguaaagggauuucacacuggugaacucuauuuaugugaaauaccuagcuuugcaagagggaucuuccagggaacauuuauacaggugaauuuucugggaaugaggcuuugauggagcuucagccucauuguacucccucugcuggcuuuucaggcugcuggauuuuaccagaaaucuauuaugcuguuuguuuucaagucuacugcagagcuguauggagaaaaugggacuagggcaaauuaaaaagccacaaagcuuucuguuuuuacuaagauuuggccauuuuucuucacuaaacgcuuccaagauuccugcaagccuuugauucguuuccagaguuauuauaaaguuaauucugaaacuauuugcucguuuucucaugggagaggaauuguuagagguucuuaagccaccauuuuugcugaugucacgcuucauuucuuucugaagguuuuaaaauuaugauuucacacagaucuuucaguucaaauucaggacuacaauguuuuguuaucaauuuuaaauaugucuuuucuucuauguugaaaauuugguucucaaagacaacauaaugacucaguuucuuuaucacauacuacauacauuaacaguguuggaauaacaguaccagcacuaccaugagcuacagucaucugccauguaacaauauuuuggucaaugaugguaagguugguuccguaagauuauaauaccauauuuuuacuguaccuuuucuauguuuagauauguuuagacacaaauauuuaccacuguguuacauuggucuguuguauucaguacaguaacaugcugugccagauuuguagccuagguguguaguaggauauaccaucuagguuuguguaaguauacucuauuguguuugcagagggaugaaauugccuaauguugcauuuaucaggauauauccuggucuuaagggaugcaugacuguacgugguuucgaauuguagcuugaggauuuuuuuguaguucuuuuauuuuugucccuaagguauuuuccacugggaguauuugguuaaauugcuguuuuaaaguucuuugaaauaauuguucuaugucugguuacguuaucagcuggcuacauaguaagguuuguuuguuucauuuugcuuuuggcuuuauaaagauugcuuuuuuaacuucauaaagauugcuuuauuuauaguguaacauuuaaaauacauauaugauugugaaauauuuacauuguuccagaaccaaaucuaccaucauauucccuccucaaccauuuaaaaacaaguuuaugacuuuuuguuuuaaaaauuaaaggcaaauauauauaugcacacuugugccuguauauguggcuauaauuuuuuuuccauucucuuuuacuuugcucagguaguacaguagcuaaugcuucuuggguuuggucucuacagacaaucauucuuuguacuccucucagugauagauuuuuacucaaaaaucuucucaaagaaaaguaaaauuugaugucccucaacauuugggccuccauauaacuuuuaaaccccauccucaauacuucuccuccaucuuuucuuuuucuuuuuggacacagucuuucucuguagcucaggcuggagugcaguggugcggucauggcugacugcagccacacucuccccggauuaagcuaucuuccugccucagccuccugaguagcugagacuacaggcauguaccacgccuggcuaauuuuuuuuaaauguuuaguaaaaaugaggucucaguguguugcccaagguggucuugaacuccugagcucaagugaugcucccaccucagccucccaaauugcugagauuacaggugugagauaccguguauggcccuccaucuuuucuucuuauuuuuauuucaagacccuuaaauggcuuccuuucucuuuuuaugaagcuuucccuuaaucguuuagagguagaaccaauuccucuuugugcuuccagaauaaaaaaaaaaauucauucaucuuuucuuuuuuaauuuuauuuuuaaauauuguguguguauauauauauguagagagagagacuguauguguauguguguguauguguguguauauagagagagagagcgagagagagagagaugggguuucgccauguugcucaggcuggucuucaacuccuguccucaagugagcccaccucggccucccaguguugggauuaucggcgugagccacuguggugcugggcccaucuuuucuuguuaggagcagcauuauugauacauaauuugcauaaaguguacaguucuaguuuuacuuuuuaacuucucuuuccacuucccauucuuuagcgcuuucuucucuuauuuaucaucacauuucacauugccagugcugacauuucuucauuuuucuauuuuagacauuuuccuacuauggaagguaaccuuucccccccacucucuucuccauuugccccugcauuucccuucuuguccauaguguuguaucuuuguguuaagucaacauuuagauuauuaaaacuacauaaauaagugcuguucacuaugguuacuuuuccuuuccguguacuuuuuuugaggcauuaguuggcuuuuuguuacuguuuuaauuuucuguguuuucucucauauguauguaagccccaauauggucagacacaucagguaauuuaucaguuccuuuuuuuguuguuguuguugagauggagcuucgcucuuauugcccaggcuggagugcaguggugccaucucggcugacugcaaccucugccucccggguucaaguaguuccccugccucagccucucaaguagcugggauuacaggcgugugccaccacgcccggcuaauugugugugugugugugugugugugguuuuuuuuuucuuuuuuuuuuuuuuucugagacagcgucuuguucugucgcccaggcuggagugcaguggcgcgauccuggcucacugcaaccuucacuucccguguucucaagugauucuccugucucagcuucuagaguagcauguauuuuuuuuaguagagaugggguuucaccauguugaucaggcuggucucgaacuccugaccucaagugauccacccgucuuggccucccaaagugcugggauuacaggugugagccacugcuucuggccuccauuuuuuuuuuuuuuuuuuuuuuuaaauuaccuguauccuucaaaggugacuguuguuguauaggucacugggccuguuggacagcuggcauucugggacuuucacucauccuggggcugcaagaagcauaagccuggcagcuaguguuuugauagccaaacuguggaaguggacuugggccauucugcacccugaccugugcucagugugucuguuuuaauuuaacaucucuguugaguuaaauguuuaauuuuuuauugggguaggggaaaaaguaauagaggagggacaguucccugguaguguuuucuggaggaguaggucuagaggacuaauuaguucuuauucaguuuuuuucauuagucuucaguuccugccaucauuucuuuccaggauucugcugcuugaaagggcuuuugucuugguagcugaaaucuaagacacuuggcauuucauguacuuuuuguguuucauaauuuauggaccugcuuugucuguuguugucuucucucccuuucuggucugguuaucuuguugcauaacaaaccaccaccaaugccaccauuuuaugauguucacaggauuugugggucaggaauuuggaaaggguacagcagggauaucuucuuuuugcuguacguguuuggggccucaguugugaugacucauggcagagagagacugaaggauggcuucaucacauguguggcaccuuggcaaggauguguagaagggugggcucagcuguguugucaacccaagggccuguauauggccuucccagcguggcucguuuaagguaguuauauagaagcucagggauccaagagugaguguguaagaggaccaaguagaaagcugcauguccuuuuaagugaccugucgucagaagucacacagugucauuuuugcccuaaccuguuggucaaagccuacccagauuuuaggagaggggacagaaaccccaucucuugauguggaagaggcaaggccacacugcagauaaggaugugacaugggggauauuguggccauuuuuaggaaguauuggcuguacuucuaggguugcugucuuuuaauuccuucacuuucuuuucagagauguuggaagggaacagagauaacuccauuuucaaauugucauguuuaaccagaaguccuuugcgugaugauuuuuguuuuuaaggaaacuuguugaaguguaacaugaacccauuugaguucacauaucacaagugugccauucagugaauuaucacauaguaaacacauuugguaaaugcuaccucaaaucaggaaguggaacaguaguagcaauuugaagcaucucuugccccuucauaguuaauaccuuuaucuuccuccucaaggguaaccauuacaccgacuucuaucaucauagauuaauuuuguuuauuuuagaauuuuauauaauggaaccguauaauagguacccuuguguuuggcugcauuugcucaacaacacauuugagauucauccuucuuauucauccuugaguuugcaaaaacagaaacaucauuuguuuuuauugcugaauaguauuccggcguucaaauacaugaauuuaucccuuuugcuguugaugucuccuauagugguuaaaggucucuggaucuucacucuuauuuguauuguuuacuugcauggugggcacuuuaauaacuuucauuuaauagcuuaucuuugacuuugcugccacccuucacccccccacccaaaugauuauauuuugaucaugucuucuauacuauauggaggaccuuuauuuaccauucucuguuuugaaauguauagucaccuauagauaacuauacauuucaaaauacuaauaccguagaguauuagucaucuauacauuucuguaauguacugugaaauaagaaguaggacaaaaaggaaaggucuuuaagucaaaauguaucucacaguccaguuacugaguuuauuuuuauuucagaugcuagucuaauaaagauggcugcuuauuugguuuccuuucccguagaagauuagaacauguggauuaggagagaaguuguugcaugcuaguauacugaugucaaguaguguaguagugaaaaaaauuaggugacugugugaaaagaauaaaggagauaaaagcauagcacuuuguggcuguuuaggaucaauucuuaauggucuuguuuuuauuaaaauaacacaguauaauaaccuuuuuuucuuaaugauuauuucguuaaauuacacuuaauuuaacugaagaaaugguucaguuguguuuucuauacucuguuuaagaagacgaggaaaucuucaggaggucauauuugugauggcuugaaguagcuauaauggaagcuuucagucaucuuugucuuccuaauuagaaugucucauucucuaauauaggaaugaagguuacucuuauuuuuuucauaaacuuuuuuugagacgaagucucgcuccuguuacccaggcuggagugcaguggcgugaucuugguucacugcaaccugcgccucccggguucaagcaauucuccugccucagccuccgaguagcugggacucacagccguaugacaccaugcccggcuaauuuuuuuguauuuuuaguagaggcggaguuuugucauguuggccaggcuggucuggaacuccugaccucaaaugaucugcccgauuuggccucauuuuuuuaauaaacuuuuuuuuuucuuuagcuuauuuauuuuugcaaguagcuucauuuuuuuuuuuuuuaauuguucauucuuggguguuucucgcagagggggauuuggcagggucauaggacaguaguggagggaaggucagcagauaaacaagugagcaaaggucucugguuuuccuaggcagaggacccuggggccuuccacaguguuugugucccuggguauuugagauuagggaguggugaugacucuuaacgagcaugcugccuucaagcaucuguuuaacaaagcacaucuugcaccgaccuuaauccauuuaacccugaguggacacagcacauguuucagagagcaccggguuggggguaaggucauagaucaacagcaucccaaggcagaagaauuuuucuuaguacagaacaaaauggagucuccuaugucuacuucuuuguacacagacacagcaacaaucugauuuuuccauccuuuccccacauuuaccccuuuucuauucgacaaaaccgccaucgucaucauggcccguucucaaugagcuguuggguacaccucccagacgggguggcggccgggcagaggggcuccucacuucccagaaggggcagcugggcagaggcgcccccaccucccggacggggcggcuggccgggcgggggcuggcccccaccucccucccggacggggcggcuggccgggcgggggcugccccccaccucccggacgggguggcugccgggcggagacacuccucacuucccggacggggcggcugccgggcggaggggcuccucacuucucagaugggguggcugcugggcggaggggcuccucacuucucagacggggcggcugccgggcggagggacuccucacuucucagacgggguggccgggcagagacgcuccucaccucccagacagggucgcggccgggcagaggcgcuccucacaucccagacggggcggcagggcagagacgcuccccacaucucagacgaugggcggccaggcagagacgcuccucacuuccuggacgggauggcggccgggaagaggcgcuccugacuucccagacugggcagccgggcagaggggcucuucacaucccagacgaugggcggccagggagagacgcuccucacuucccagaugggguggcggcugggcagaggcugcaaucucggcacuuugggaggccaaggcaggcggcugggagguggagguuguagcgagccgagaucacgccacugcacuccagccugggcaacauugagcacugagugaacgagacuccgucugcaauaccggcaccucgggaggccgaggcuggcaggucacuccggguuaggagcuggagaccagcccggccaacacagcgaaaccccgucucuaccaaaaaaauaugaaaaccagucaggcguggcggcgcgcgccugcaaucgcaggcgcuuggcagguugaggcaggagaaucaggcagggagguugcagugaguagagaugguggcaauacaguccagcuuuggcucagcaucagagggagaucguggaaaggagggagagggagagagggggagagggggagagggggagggagagggagagguuauaaacuuuuuuuuuguuuguuuguuuuuugagacgaagccuugcucucguugcccaggcuggagugcaauggcgagaucuuggcucacugcaaccuucgccucccagguugaagugauucugcugccucagccucccgaguagcugggacuacaggccaugccaccaugcccagucaguuuuuuuguauuuuuaguagagacggguuucuccauguuggucaggcuggucucgaacucucgaccucaggugaucugcccaccucggccucccaaagugcuggaacuacaggcaugagccacuguuccuggccuuuucauaaacuuuuaaacaguguuuauuagaauuuucuuuuccaaucaugacagugggaagaaaugcauuuuacaucaugauccacuacacaacacacguauguuuuauaguuggaaauccuuuuuccauaaaacacuacuugggaaaaacagugcuucagagugccaagguaaucucuguucauuuggauuaucaugaauugcauaucauuggaaucuaaauuaaugaccuacugaacagagaggguugagcaagacauuuguggaaaggacuguugagaagaauauuuauauuagguccaaaggcccucagugaaccugagagagaaucagcuuauuuuccuuuuaaaauagguacuaaaauuucagagcaguugucuuuccuaauagcuucgucuacuucugauugucacacacucucucugcacuccugcauauugauuauuauauuguaacauuuuuaccaucuaccuggaggugaauuaauacaugauugugcuaagaauaaauauaccauguguuauacucaaaguuugcaauguuaucugcccucauugcuuuuaaguaagccuuuuaaugcucuaggccuuacuuuccucaucuguaaaauaaggauaauaguacaguugaucuuuggauaacaaggguuugaacugcgugggcccacuuacauacggauuuucuuccacacaugcuaccccuguaaacaggaagaguaacuucucuuucugcuccuccuccucuucaaaauggagaugacgaugaugaagaccuuuauggugauccacuuccacuuaagaauagaaaauguauuuuauguugcuuaugauuuucuuaauaauauuuucuuuucucuagcuuauuguaagaauacaguauauaauacauauaccaaauauguguuaacuguuuuuuuuuuuuuuuugagacggaguuuugcuguuuguugcccaggcuggagugcaguggugugaucuuggcucacugcgaccuccgccuccuggguucgagcgauucuccugucucagccucccgaguaaaugagauuacaggcacucgccaccacgucuggcuaauuuuuuguauuuuuuuuuguagagacuggguuucaccauguuggccaggcuggucucgaacuccugaccucaggugaucugcccgucuuggccucccaaagugcugggauuacagacaugagccaccaugcccggcuguguuaacuguuuauauuauugguaagacuucuggucaacaguaggcuauuaguagugugagaaaugggaaaguucuucaaagacuauaaaaagucacaauuucuuacuauaagauugcuauccacuauuugugugugugcguauauauauauauauguauacgcacacacacauauauuccauaucagcuguccuagcuugcuccagcaugccugggcagaacuagacaagucccagcccauagugcaugccauuccuuauuugaagaugcguccuuaacuaucccuggacaacuuccuuuucuuucuuucuucuguuccccuuacccaauuaaaaaaguuuuaaaccaguagccaauuggguaaaguguaaaaugugagauccuauuucagccaauggaaacuggacacagcaguaggaucgaugugucagguuauaaauaacccugucuccuuuguuuggugugcucuccuggcuggacagcuuauuuaguagcacccuuucugcagaaaguaaagcucgccuuucugagagaucauuuguucccgcauuaauucuuuuuuugugacaccaaaaacuuuauucccaacacuaguuauguuuugggggagucaaaaguuacaugugaauuuucagcugugcugggggggucagcacgccuaucugccucguuauuuaagggucauuuguacuuaccucauagguuucugugaauuaaaugagcuaaggcauguaaagugcaccguacuuagcagugaguaaauguuguuaauaauuaacaauucugauaaucuacuuggugaacaagaauaggauauguuagaaugaugucucauauauguuaaugcagaaguuuuuuaugucucagauaaguuuuuuagguagauaaaggaaaugaaggaaaugauuccaggaagagcacugugucaggagugaaucauaagaaagauguuacuauuagguuguggauucuagguauucuuugggauguuucuuuuucauauguucccugacccuaucccuagacuuugccacuuaccagcugugagacuguggauaggcuaaacuacucaucaaaguaccaguuuuuguaaguuauuuacuuuuggaaaagaaccagauguaauucaaaguuuucucuguaauaccacccuucuuauuuacaucuaguauacuuucuugagugguuggacaaaguggguggcauuagcaaagcuagcuuggaacugagcauaauacuggauacucuugugagaguaugucugaagugagagcauucuguggccaaaaagucauacagccacugucuuacacuauuuucuuggguuaauuuuugacccauagugguaaaccuaguuaugagucuguccugcuacauuuacauucuguguugauagaaacauuuggagcuggcuaggcuuuucuagaaucuagacaacugcuuuagucaguuguacauuguggauguuuccuaagcauugacccuagcuccaagguuuuuuucuugccauuagucaucugcuuaguaugaaaauucugugagcggugauaauacggugaauauguagaaaaauggcuauuuauuuuaaccuuuuuuaauguugcuggucauaaguuuauguugcuacuucuuuuuaaaugaacaagaacagaaagggcacaaacuuuaguuuuggaaaauguagguauuguagcuaaaaaugacaucccucuguuccaaugcuggaaaaagugacauuucuccuuuucugagaccuagcccaauuuauugcuuguguucaucacccucugguauuguacaccaguggcuggccuuggaucuguauucucccuguuggagauaagaaauaucugcugucaugaaaaaaccuuuuaucguagaagagcgguauagcuaaucugcuuuguaauagaguaguguacgcucuuauccacgguuucacuuugugugguuucaguugaccugugguuaacugcagucagaaaauauuaaauggaaaguuccagaaacuccuaaguuuuagauugcacccuuuuccgaguagcaugaugaaaucucgcacuguccugccuaggaggugaauuaucccuuuguccagcuuaucuacacuguuuacacugcccacuguuaguccacuuaguagccgucugaguuaucagauugaccguggugguaucaaagugcuuguguucaaguaacccuuauuugacuugauaaugaccccaaaacacaagagaagugaugcugucaauuuggauaugacaaagauaagccaugaagugcuuccuuuuaaugaacaggagaaaguacuuaauaaggaaagaaaaaaaucauauacugaaguucaucacaagaagaacggugaguacagugcaauacaauauuuagagagaaagaccacauugacauaacuuuuaucguaauuuauuguuauaaucguucuauuuuauuaguuauuguuaaucuauugugccuaguuuauaaguuaaauguuauaggcauguauguauaggaaaaaacauaauauauauaggguucuguacuaucuaaggcuuuaggcauucacuggggucuuggaacauuuccucugugaauaagggggacuacuguauuuuuugaugcccuuuuucccauaaaggacuggggcaucuuucauaaacauauacuuaauguucauuguugaccaagcaggcuagaaauaguaaguagucuucuguggggaggaauacuugugcccuuaugacuauauucugucaaaaggauagauuucauaguaauguuugagggaagaaagaaaggaaggaaggaaagaaggaucuguagcaauuuacuuaucaacacugaacuuuuugaauuaaauuuucccccuaugcuuuggcugccuuuacuguuuaaaagaggaaagaaugagaaaguuaaagaaaaaugcaacuuuuuucuugcuaauguguguuuccuuagacugcccaucccucacugcuauauacuuuaguaguauaccauauuuucucuguagugucaugcauuuuucuauuuuuuaaaaaauuauuuuuuuuauuuagagaccgggucucacugucaccuaggcuggagugcaguggcgugaucauggcucacugcaggcucgaccuccuaggcucaagcaauccucccaccucagccuuccuaguagcugagacuacaggugcacacuacaacaccugacuaauuuuaaaauuuuuuguagggacagggucccacuguguugcccaggcugaucuugaacucuugggcacaagcgauccuccugccucagccuccccaaaguguugggauuacaggcucaugagcuauggugcccagcccaucuuaccauuuuaaaauuuugucuuuccugcaugauugcuauuucugugaugacacggucugucuauauacucacuuuuuuuuuuuuuuuaauuuaaguagaguugcgcucuguugccaggcuagagugcuguggcccgaucuuggcucacugcaaccuccaccucccagguucaagcgauucuccugccucagccucccuaguagcuggaauuaacaggcacgugccaccauccccggcuaauauuuguauuuuuaguagagauaggguuucaccauguuugccaggcuggucucgaacucuugaccucaagugaucugccugccuuggccucccaaagugcugggauuacaagggugagccacggagcccagccauauuuucuugaucauauuugugauagcacaguagaauugucucuuuaaguguccccaccccucaacacacacauaccuugagagagcaugaaucuuuuaucccuuuauuuccucaguuuguuguaauaacagauguguuauaucuguguaguaaauguucaaacguagguuaaauucuuuuucauuuaaaaaugaugacaagauuguuacauuuuggucuuuuucugaugugagcuguuuauaugaguugaccuuuucuguccagaaggaauagaaaacauacuggcaauguggguagguuuuauuccuccugcgcuuccuuauaugagauaggcagaagaaauaguauaguauucuuauuuuacauaugaggaaacaaagguucagaguguuuuaaguggcuuuacuaagaucucacaguuaccagaugguggagcuggaacuuaaaccaagguuuguuaaguuuuauuuuuaaucugaguuuuaaggcuguuauugggguuuuauuuuuaaucugaguuuuaaagcuuuuaguuuaguuaauaaugucuaguuaagcaaaaguaucgcauucuugcaauucuuaaaauuaaguuugucuuuaaaauuacauguaaaguuacauuuaaaguuaaagauauuaaagugugaaaccuaaagcacaacuggacauauucuugagugaauguaauggcuuuucuuugugacuuuacagugucuuauaccaagggaaagguaaugguaaaaagauuucuuccagaaacuguguuggcuuguucaaacaucucugaauaaauuccuuauguguauuuuuucuacuacuagaaaacagauuuauaaauguaauuuauaaauuaaauauaaacugaacuaaacccaguacaaaaauugaaaguaacauuaauaugauggggaugauauuuugucauaauaaaucacuugauuaauguuagaauuaugacagcucaaguuucuuuuggcaugccuuuacuacugugugcuacuucauucaccuauagauuuuuuuccauuauaacuuguaugaaacucuucuauuuugcauauuaucucuuuuggggaaugaacaauuugcuacuaaaaguggcuuugcuuggcaucaguaugguugugaagguaaauauggguguuagcauugcuugucaguauuuugauauaggguuaucaaaauaugagaagaauaagaaugcuuuaucaggcauuucuaaaugauagaaauuuaaaaauuaaaaauuuuuccauagugaaaauucuaggagaauacauguggacuccaguuugaaagacacugcuuuauauaagugaaaucucauuuugauucuauuaguauaacaauacaguuuuugugugguugaagaauuaucaguuugaacuaauaaacuagaauaauuuguaaggaaauacaguugaaagguaucucagauuccugauuuagccauuaaauguuauuugcauauuaggaaacaggcuguauauuuaggugaaagugggagaggaaauggcaguuuacaugcuuacauuuuucauguuuacaaguuuuacauguuuacaaguuuacaguuugcaugugugauucaugaucuuugccaugauguaacucuuaaaaaugucaaagagguacgucauaaacaguagaaauaaauauucugacagaucauaaaaagggagggaggauugaaguuuuccuagguguaguauaauuuuuaaaauagacuuuacuuuugcaacaguuucagauuuauagaaaaauuaaagacagagcauuccugcacucaguuuaccuuguuaucaguaucuuaguaugaucuauuuguuacuauuaaugaaccaauauugauacuuuauuauuagcuuaaaguccauaguuuauuuagguuuccuuaguuuuuacuguuccaggaucucauccaggauacuacauuacauugaguugucaugucucuaggcucuucuuggcugacauuuucucagacuuuccuuguuuuugaugaccuuaguuuugaggaauacuggucagguguauuagaugcuccucuacugguauaggucugauguucugaugaugauuagacugggguugcgaguuuuuuggaggaagaucacagaagucagguaacaguuucaugucaucaaaaauuauacucucccuccuucagggcuagaauaauacauacauuauuugggaguuuucugaacaggagauuugucuuuuuuccauuuauuaaagcacuccuuuagcuucauucacagauuuugcuauauuguguuuucauuuacauucauuucaauauauaucuuuuuuuuuuuuuuuuugagauggggucccgcucuguugcccaggcuggagugcaguggcacgaucuuggcucauugcaaccuccacuucccagguucaagcaauucuccugugugcaccaccaugcccagcuaauuuauguauuuucaguagagacgggguuuuaccauguugaccaggcuggucuugaacuccugaccucaagugauccacccgccugggccucccaaagugcugggauuacaggcgugagccaccacgccuggcccaauuugccuuuugauuucuguuuugacugguggguuuuuuagcaguacguuaggggauuaguauccagauauuuggggggauuuccaaaauacuauuguucaggaaacauacuuuguaugauuugaaucuuuucaaaaacuuuaaaaguuacuuuauggucuagcauauggucuauguuggugaguauuuucugugcaccugaaaagaauguauauucuccugcaaaaauagcaguuaguucaacuuugguugauuguauuucucaagucuucucuauccuacugauuguauaucuacuucuagucuuucugugcugucaguuuuugcuuaauguauuuucaaacucauuuauuagguagaugaguguuuaggauuuauuauagccucuugauggauugauucguuuauaguuaaaaaaauggcccucuuuaucucugguuauauuuuuugcucugaaauucacugugauauuaauacagcuucucuaguuuucauuaauguuagcauaauauaucuuuuuacuuuuauuuuauuuuuuuuuuuuugagacggagucucgcucugucgcccaggcuggagugcaguggcgcagucuccgcucacugcaagcuccgccucccggguucacgccauucuccugccucagccucccgaguagcugggacuacaggcgcccgucaccacgccuggcuaauuuuuuguaguuuugguagagacaggguuucaccauguuagaggauggucuugaucuccugaccuugugauccgcccaccucggccuccuaaagugcugggauuagaggcaugagccacugugccuggccuacuuuuaacauuuuugugucuuuauauuuaaagagaauuucuuguagggagcaagcauauaguuaggucuugcuuucaugucaaaacugaugaacucugucuuuugcuuuuuaauuuuuucuuuuuuuucuuuucuuuuucuuuuuuuuuuuuuuuuaagacagagucucgcucugucgccaggcuggagugcaguggugugauuucggcucgcugcaaccuccgccucucggguucaagcaauucucuugccucagccuccccaguagcugggacuacaggcgugcaccaccaugcucagcuaauuuuuguauuuuuaguagagacaggguuucaccauguuggccaggcuguucucaaacuccuaaccuugugaucugccugccucggccucccaaaaugcuaggauuacuuacaggcgugagccacugugcccagcugcuuuuuaauuuuuucaaaaacucuuuuauuuugaaauaguuguagcuucauaggaaguugugaagaaauggacggggaggucuugugcacucuuuacccaacuuuccccaauguuagcaucuugcuuaacuaccguacaauaucaagauaaggagauugacauugguaaagcuuauuuagauuucaccagguauguauguacuuauuugugcguguuuguauggcucuaugcaauuuuauuagguguaguuucguguaaccacaacuacagucaagauauuuagcuguaccaucacaagauuccuuugugcugucccuuuauagccacaccaauccccacaaucaucuccccaccccauaccuaaccucugggaaccaccaaucugauggaaucauguagcauguauuuucugaugguggcauagucuccuuguuguucauccaaauuacuguguauauuaguagucugcucuuauugcugaguuauauucuaugguuauggauauaccacauuuuguuuaacuacucauccaaugaaggacauuggauagcugccaauauuuggcucuuauaaauaaacugcucugaauauucacauggaaguuucugcuugaaaauuuuuauuucccuggaaugaagguuaacccagaauguaauugcuggguuguauggugaguccguuuucaguuucagaaggaacuacaaaaugaucuuccccauuuuauauuccuacuaacaauguaugagugacccaguuuccuuguauacuuacuagcauuuguuauuaucaccguuuuuuuaauuuuagucauucugauaaguguaugcugauaaaauucauugugugugccuuuuuuuuuuuuuuuuuuuuuuuuuuuuuuuuuuuuaagagacagagccuguugcccaggcuggaguucaguggcacagucuuggcucacugcagccucugccucccggguuuaagcaauucuccugccucagccuccccuaguagcugggauuacaagugugcaccaccaugcccggcuaauuuuuguguuuuuaguagaggugggguuucgccguguugcccaggcugguccaggcuggucuugaacuccugaccucaggcgaucuacuugccucagccucccaaaguacugggccucauugugauuuuaauugugcuucucuaauaguggaugaaguuggacaccuuuucuugugcuuauucuugugcuuauucgccaucuguauauuuuauucaguaaaaugucuguugaugucuuuuguccauuuucuaauuugaauuuuuuuuuguuuguuugaaacagagucuugcucugucauccaggcuggagugcaguggcgugaucucggcucacugcaaccuccgcaucccgcguucaagugauucuuaugcuucagccuuccgaguagcugggauuacaggugccugccaccaggcccagcuaaguuuuguguuuuuaguagagacagaguuucgccauguuggccaggcuggucuugaauuccugaccucaggugauccucccgccucagccucccaaagugcugggauuacaggcgugagccacugcgcccggccuaauuugaauauucuuaaaauguugaguuuugaauguuuuaaaauguauuuuauauacuauuuuauauuugcucacauguuuacuauuucuauugcuuuuuaugccuuuauguagauuuaaauuugccugaacgacuuuaaguucuuaagugaagauuagcuaguaauuaauuuuucugucuuuugucugcaaaaguuuaauuuucuucuuuauuuaaaaaaauauuuuggcuuguuauauagaauucuagacugacuuuuuucucuccuguauucauaaagauggcacucuacuguuuucuccuuugcauuguuuuugaggugaaguuuucugucauccuuauuuuuguuccucuguaagacgucuccugccuuugacugcuuuugagguuuucucuuuauugcugguguuaagugauuugguuacguuauguguuauguguuguaguuucuuuuucuuuuugauguuuauugugcuugagauccguugagcuccuugggcauguggguuuuaaauuuucaccaaauucggaaaauuuuuugcucuuguaucuuuagauauuuuucuguguccucuauacuuuccacuccuacccccauucuaauuauauguuuaucaggauaucugaaauuauucuaucacuuacugugcucuguucauuuuuuuuucagucuuuuucuuugcuguaucucguuguggauuauuuguauugcgaugucuucaaguucacuaauaauuuuuuucuuuugcagugucuaaucuucucugcuuuuuuuuuuuuuuuuuuuuuuuugagacagagucucgcucugucguccaggcuacagugcaguggugugaucuuggcuuacugcagccuacacuucccggguuugagcgauucuccugccucagccuccugaguagcugggauuacaggcaugcgccaucaugcuaucaugccuggcugauugauugauugauugauuuaagacagucagucucccucuguggcccaugcuggagugcagugaugcaaucucggcucacugcaaccugugccuccuggguucaagcaauucuaaugccucagccucccagguagcugggauuacaggcaucugccaccucgccuggcuaauuuuuguauuuuuaguggagacagggauuugccauguuggacaggcuggucucaaacuccuggccucaggugauccaucugccacggccucccaaagugcugggauuacaggcaugagccacugugcccggccuaaucuccucuuuauuucaucaguauguuuuuuaccucaagacauuguaauuuuuguuuaggcuguuuuauauuuucccugucuuuaacauguuuauguuuuucuuuauuuucuugagcauaugaaauacaguuugacuaaugcugcuauuuguaucauuugugauuaauuuucuauugguugauuuuucucauuguggguuauaguuucuugauuguucucaugccugguaacuuuugucuuugauuccugguacacacuccuauuguucgcaucuacguucaauauuccggccgcaugcuagacagugaauuuuaucucauugcuuucuguauacuaucauuucauuuuaaguauuuuugaacucuguucugggaugcaguuaaaucacuuggaaauaguuugaugcuuuugaggcuugcuuuuaauuauacaagccucugggaauagagcaaccuuuagucuugggcuaauguugcccaguguggaggcaauauccuuguuaggauucuuugggaugccacuuguauuacaaguuuuuccacuuugacuugugggagcacaacuguguuugguacuguuugagccauguggauauuuccaguguuuguuuuaggugguccugggugugugugugugugugugugugugugugugugugugugugucuauguauuuauuuauuuauugaaacagggucuugcccuguuggcuggagugcaguggcacgaucaugucucauuauagccuuuaccuuccaagcucaagcugugcucccacuuuggccucccaaauagcugggaccacagguguguaccaccacgccuggcuaauuuuuaaauuuuuuguagcuauggagucucccuauguuguccaggcugaucuugaacucuugaccucaagcgauccuccugccuuggccucccaaaguguuaggauuacaggcgugagccacuguguccagccaauaguuuauuuuaagaaaauuuuuaaauuuuuauggguacauaguagguguauauaugagauacauuagauauuuugauacaggccuacaauguguaaucguauccggguucuaggguaauuucuuuaccuccauguacucauuuauuugaugauucaagagggagccuguguagaaucuccagaguccucucucugcagcccccuucucucucacuuccuaccuugugaacucuaaacugccuuggcguacccagauucccaguccauuuuugccucugggaaacagcacuucugccugcauuccccuaccuuugccuuugugucggaacucucuccauggaguaagcuggaauaguaguaggggucaccucguuugucucuccucucucagagaucaaugccuuguauugugucuacugucugaaaauguuguuucacauauucugcuugguuuauugguuaauguggcuggguaaaucugguucccuuuuggccagaagcagaaagccuugauaaauuuuuaguuuugauuuuguguuuauuuaaaaucugcuuaugcagaguacuuuuuacaaaagaacaauucguaauuuaucuuuacuguaagaauguccuauuugcuuaaauuugaauaguaugugacauaaaguguaauacaccaugaaagggaguaaggaaugguauaggagugaaaggaucaagugccacauagaauaaguguccuaaugcaaacacacguauuucuaguuuugaggccauagauuuaauugugguuaaugcaugcuuccauucuggcuuuccaccuacauuccauggaacacuguugucccacuagauuuuaauugguuuuuacaacaaacaggguuucauggaccacauguauuuaggacauuucagaguaacgaaaauuaaauuucgauugcagugcuuuucaaaauuaguaauacacuaaugaauucugugaaucaccagugaaacaguguagaguuauccaaucacuggacuucagugauccuuuucuggaaauucuuuagagguagguuguuauuaaguguuuaaggaucuuucccucccucccucccucccuuccuuguuuugcagcagagucucacucuguugcccaggcuggagugcagugacaugaucccagcucacugcagccuccaucuccuggguucaagcgauucucgugccucagucucccaaguagcugggacuacaggcucacgugcuaccaugccuggcuaauuuuuguauuuuuacuagagacaggguuuggucauguucgccaagcuggucuugaacuccuggccucaagugauauguucgccucggccucccgaagugcugggguugauugcgggugugaaccaccacucccggccaaggauguuuuaauacuguuuaaauaagauguauuuaauuaucauggguuacuuaccuaagcagauucaagaguucauauauuuaguaagccuacugauuccucuugauggcuguucaggcuccuuucagucuucuguuaguauaaucuuacauguuauuuuaugaaaugcauacauuuauauauaggaugaauucuuagaauugcuugauuaaaggaggaugauacguauaauaggaccauacauauauaugcaugcauuuguauuuuugauagauauugacacuuuuucuccauugaaauuaugucauuuuguuguuacaccccuuugaaagccucuguuuagagacauuugauaaauauucucuaguugcccucuaguauuauucauuuguucuccuaccaccuguguuugagugucugcuuaccguuccuaccaaacuguuuauuuccauuucuaccuaauaaguuuugaggcaguuuagaauaguaaugaaacauguggacucuggaguugucuuuuuccaauccuuacuuggccaguaauugugucucgguuucccagucuguaaaaugagagaauaaauaguuaccuugcgcaagggcuguuguaauuaaaugaauuaauacauauguagcacuuagugucuagcuuauaauagaugccauguaaguauugucuauuaucauugcauuuuaaaauuucacuuacagggcugccucccacccccgucauauuuacuggccaguaauguuucuuuuucugugaguugcaguuagucuuuucuuuaaauguuagcaaaguaguacaugcauauaguuuagagucaaaaaaauccuauaaaguuuacaaaaagggagcccuuaucucccuucaguagagacgcaaccuuccuuuuuuauuuccugaauauuuucaauaugcaguugguugaguccauggaugcaaaacccauugauacggagggaaaacuauauauaaaacaauagcaaucugaacaucaaaugacuaaaggauaacauuauagcugccugaagcugcaguguuggcaggggcaaucauaagacuagcuggagauuuuacuugguaaucuggggaauggaacagccauaguagaccuugauaagcucccacauauucaugggugucuggagagcugcacaugcucaggagagagcagagaggccuccagcugucuacucaccuggcucaaugugcagcuuugcucaagcagaaaguagaagucagaacugauucauaagccaccugaacuuugagugggguccaaaccaacacagagggagaugcuuugguaaaggacagaagccuuacuggcacaauauguuuaaacauaaccucuuauuuaucauuagccggucaccaaacuauacugaccuaggagugacuucuagaaagccaagcuuaaaaauaaaaauugaggaaaaaguaaaaaacagaagacaacuaaccagagacaucaguggucauacacuauugagaagacuauagaaauaguccaggcaagucuguaaacaaacagcaaccacaauaaucugggaggugucaggagucagaaucucgaguuguuauauuauggaaaauguacaauuucaacaaaaguuuucgagccaugcaaagaaacagacugaaaaaaagccuaggggacuauaaaggagacuaaaaugacaagacaauacaaugcaaaacauaauuccuaaaaugauucuguauuuaaaauacaacagcuauaaagaacacuaugggagagugaagaaauuuuaauauaggcuacauaguagauaacaguauagucaauguuaaauuucugaaaagugauaacuacauugugguuauuuuggacaaugcccuuguucuuaggaaaugcaugcuggaguacguagguaacuuucaagugaauuaguaaaauagagagggagugugugcacacauguggcaaaauguuaacaauuggugaaucuaguguauuacaguuccuuguacuaucuuuucaacuuuucugauggcuugauauuuuucaaaauuaaaaauaucagaaacaaacauccgacgauggggguuuaaugagauuccaguauguaaaauauucuagaauggcugaaaauaauaaaauaguaauauuuuugauaucggagagaccuucaagcaauguauuaaaaaggcaagcuauugaacauuguuuacauuuuguaaaagcagauacaaccgcaaacacaugcagaagcacugggacaaacuuuaacagaaauugauaauaauaaggagacggggaaaagcuuuuguuuuuuuguuucacauuauagcuuucuucacuauuugaauuuucuacacaugugcuaccuaccuuuuuaugucagcagcaguuaucugggugguaguuggggggcauuuuuuguuuacuuuauacuuacgggaauaaaagagaaaagaaaaaggaagaguggauaaagggaauucagcaaaccucaaaugcacuucuuagugaauacuuucaaauacuuguucuaugcuuucaguacuauaaccuucaaagucauuuuacuauauauuuuuuugagacggagugucgcucugucaccaggcuggagugcaguggcgcgaacuuggcucacuacaacgucugccuccuggguucgagugauucuccuaccucagccucccgaguagcugagacuacaggugcgcgccaccacacccagcuaauuuuuuguauuuuuaguagagacaggguuuuaccaucuuggccgggauggucucaaucucuugaccuugugauccacccgccuuggccucccaaagugcugggauaagucauuuuacuauguuuuaaaaagaaaugucuaagggacuuuuuuuuuuuuuuuuuucuuugaaagggguuggggagauauugucauuguuuuaaguuccucuguuuuggaauuugcuucucucugccauucucaagcaaccacugauuggcuuucuaccacguuagauuaguuugcauuuucuaaaguuuuauuuaaauggaaucauacaguauguauucuuuuugucuggcuucuuucagcauaauuuaugagauucaggcauguugugugcaucaauaauuuauuccccuuuauugcuaaguaguaauugagcauauggauauaccacagauuauucaguuauugauagguuguuuccaguuuuuggcuauuaaaagaaagcugcuaugaacauucuuguauaagucuuuguauggacacguauuuguuuuucuuuggguaaauaccuaggaguggagugguuggauuguaugguggguauauguuuaacugaauaaacucccaaacuacuuucuaaagugguuguaccauuuuaaaugcauuucuaccagcaguguaugagaguuccaauucuucuacauucuugccaacauuugguaugauuacucuuuuuuagacacuuuuuuuuuuuaaccuuuuaagcucagggguacauguacaggauguguagguuuguuacauagguaaacgugucauuggggcugguuguacagauuauuucauuacccagguguuacaccuaguaucgauuaguuauuuuuucugcuuccgucccuccaauuuuagacauucuaaugugugguguaguaguaucucauccucauuuugguuuuaauuugcauuaccccuugaugaugagugguuuuucaugugcuuaucugucauuuguauaucuucuuuggugaguaccuauucaaauauucugcuuacuuuauaaaaauuauuuuuuuuccuuuuucccccuauuuugagaguucuuuauauauucuagauauaagugcuugaucagauagaugcuuugcaaauauuuucuucaguuuguggcuuugcugucauucucuuaacaguauaauuuuuaaauuuugauaaagucuaauuuaucauuuuuucucugauguauugugcuuuuguguugaaacagaauauuaguuuuuguuuagaauucuauuuuuauaaauuugauauuuuguucuaaaccuccuguagaugaaaaguaccauuucacaagugagacagguaauaggcuucucuaaguagcuauauucaggauuucacuauaggaacucuaccuuuuuacauguucuguaaauuuugguucauugucugaaaaggguuguucuauucaagauauacucuuauuaaaauguauugguucuguauuugccacagugcaguuuacuacaugguaucuuauaauuuacucuuauuuggaauuauacaaaaugauuuucagggguaugaaauaguguuaauuaaagcuauuuuuaaaguauuuugguuaaguugaaagauacgcacuuuuaaaaauacauaugacuguagguguucaucuuuugaagcaaucugaaaaauuauggauaaucucuuauguaccuggaauuaaaacaaaugccacaagcauguauaacaaauguaauacuaaacagaaaaguuucuauccccauaccuccagucugaauaauauaugccaccuuuacauuugaauuuuuaauacuuuauuuucuuaucugaggaccaucccuccccuccuucauguuuugacccucugccuuauaagcagaagacauuuaaaaaauugaucuuauccaacaaccccacuucuguguauauguucaaaagaguucaaagcaagaucucuauucuacuuuuuuuuucuuuuuuuggagacagagucucauucacuccgucacccaggcuggagugcaaggcucacugcaaccuccgccucccggguugaagagauucuccugccucagccuccugaguaggugggacuacaggcacgcaccaccaugccuggccaauuuuuuguaucuuuuuuuaguagagacgggguuucaccauguuggccaggcuggucucgaacuccugacuucaggugaucugccugccucggccucccaaagugaagugcugggaauaccggcgugaacuacacacccggccuccaaagcaggaucucaaagagguauuaauguaccuauguucauugugacauuauucaaaacagccaagagauggaaacaucccaaaugagcaucagcagaugugaauggauaaggaaaacguggcauauacauacagugaaauauuaugcagcccuuauaaggaaauccugucacaugcuacagcauggaugaaccuugaggacguuauccuagaugaaauaugccagucauaaaaggacaaauacuguaugguucuacucauaugaagcaucuaaaguagucaaaaucauagaaacaggaaguagaaagguaggugucaagggcuggggggaguuguaagagaggauuaguguuugauguguauagaauuuuacuuuuucaaguuaaaguucuagagaucuguugcguaacaaugaauauacuuacacugcugaauugcacacuuaaaaaugguuaagauuguaaauuuaauauuaacagguuuuuaaaaaucacaauuaaaugauacagugugucugagaauccuauuuuaaaaauaucaucuuauuugguguucuuuuaguuggggaaccuuggaaucgagaaauggaugccugcuugaaccugcugauuugucuugaacugaagagcuugcuugaauauuccugugauaucuuuuagaucauugcuguuuuagcuagauugcugguccugauugcucuagguagccuuuuuuuuuuuuuuuuuuuuuuuuuuuuaagauggagucucgcucugucuuccaggcuagagugcaggggugugaucucggcuuacugcaaccuccaccucccagguuuaagcaauccuccugccucagccucccaaguagcuaagacuacaggagugucccaccacaccuggauaauuuuuguauuuuuaguagagauggugguggggugggggguggucucaccauguuggccaggccggucuucaacuccugaccucaggugguccgccugccugggccucccagagugcugggauuacagguuugagccaccacgccuggccaucuacguagccuuuugcuauuauuauuuguguuccaaugauauuuaggcauguggcagguugcuuauauuuuucuuauaucuuaguugacuuuuaaaaagcaacauaauucaugauagacuaugcuugcauucuuuaaaaacuuuuuucuccuuucaguuucuuugacauaccaaggucucuugauuuuucacuuaacugcccuuucuuuuucuaccuacuuauuucacuuagucccacagcuuucuccccauuuaauuguaaauauuuauuaagccccuuauucacaugucuuaucuauguauuguuuuuccuaauuuuuuuaaauuaagaaaaugcugguacagaauuuaaaaaacaaaccuggagugguucuaugagacuuaucgugaaaaacagcaguuuuucguagucucagaggugcuaccuucaaugcauagcuguuacuuugguauuugcuucuguauuucuuuuuucuuucuuuuuuuuuuuuugagauggaguuucgcucuuguugcccaggcuggaguguaauggugugaucucggcucacugcaaccucugccucccggguucaagggauucuccugucucagccucccgaguagcugggauuacagacaugcaccaccacguccggcuaauuuuuuuauuuuuaguagagacggggcuucaccauguuggccaggcuggucucgaaauccugaccucgugaucugcccaccucugccucccaaagugcugggauuacaggcgugagccauugcucccugccuucccuccauauuucuagauaaugugcuuauaaugcuguuucuguguccuucucuucccucacaguuuauguugauuuuuuuuuuuuuuuuuuuuuuuuugagacggagucucacucugucgcccaggcuggagugcaguggcgugaucucggcucacugcaaccuccgccuccuggguucaagcgauuguccugccucagccucgcaaguagcugggacugacuacaggcgccugccaccacgcccggcuaauuuuuuguguguuuuuagugaagacaggguuacgcuauguuggccaggcuggucuugaacuccugaccucaugauccgcuagucucagccucccaaagugcuggauuuacaggcgugagcuacugcgccuggccgauguuuuuguuuguuuguuuuugagacgaaguauugcucugucgcccaggcuggagucuagugaugcaaucucggcucacugcaaccucugccuucuggauucaagugauucucgugccucagccucccaaguaguugggacuauaggugcccaccaccaugccuggcuaauucugguaguuuuaguagagaugggguuucaccauguuugccaggcuggucuugagcuccuggcuucaagugauccgccuaccucugccuuccaaagugcugggauuacaggcgugagccaccgugccuggccuuugcuuucuauuauaaaggauaaugucgauauuuuaaaaucauauuuucccauuucuguaucuuuucaguauaacagcuuuaguuaaauaaacaauguuuacuauguuauugauguuucuaguuaauaagccaagaaauauuaagaugucuguuuacuuuaaauaauuucccuaaugcuaaucgccuuuuaucauuuuauuguuuucuauagguuccuaucacaaauucuugcccaacaacuguaagagugcuucuggauauuuuuccuuacuuuugaaauauauaaucuaucaguucuggugaacuuccucauaauccuuccagguucccucuuugcuuuauauuuggcaugccaucaucuuuaggggaauggggcuucacuauugacuagugucgagcucuguuucuuggaugcuuuguuuuucuguguucuucuacccucuugauugagaguuugucugguauuaaguuggaaauaauuuuccuucaaaauuuugaaauuacuguucuuugucuucuguguuuggggugggccauuuuguauguaauaugauuuuuauuuuaacuuucuuccuccuccaguuuuaggauuguaucuauaccugguauucugaaaaaucaugguaaugugccuuggucugucuggaaacuuucguuccuccggucugggaaauguauguuggauuaagcuuuucauuauuugguguuaacuucaugggaaaaaauuagguucuacucuuuauuaccuauaucuguuuggugaaauuaccaguagauagccuacgcccauuagaggaauuucugaugauuuagaauggcaacccuccaugugacuuggggauagaucuaugaaugagaauuagagagaaggggaggugauagaggcauacauguuagggguggugguaugauaugaagcaagugauuauguaaauguuagaauucuagauaggaguagauccuauauagaugagucaggaaaaaagaaucauuuuggcauauuaggcuuuauaaaccaaugcauggagcuaagaaaaaaaugauaugucuagggaacuguuaaagggaaagcaaggauuuuguaaggguguucgguaguguuauaucacggagguccuuggcauuuucucuuauuguggugcaggccaguaguucuccauuguuuuuaccccccucuauuaggauacaugcaguacuuacuuggccuuuucugggauuaugcacaauccuagaaagccaggucuuucauuuaaugaaacauucaagagggugauguuauagugaaugcauacauauguacaccuuagucgaagugauuugugguacagcauuuaaaauguguucuuaaagaaauccgaaaauugguuuuggaaagagcuaaauacacauacuucuaguaaggcuuagggagagggcaaaaggggagcauaaauauaaaauaucaagaaugagaaagggauauauacacaguuauaaauagaauaugauguacagccaaacuguaauuaacuucagagucuugaugaaauagguggguggugacaacaauacaaauugugaauugugauucauaaaguucacgguggcgauggguacaaguuuucaaaaauucugauuuuuccuuaaaaucuuaaauuaugguauguauuccuuuaauucuuacaauaauccuuugggguaguugcuauaaaaucuuccuguuuuauaaagcacaaagagauuaagugacuugcccaaggccaaacaguacgaagcuaaaauucaaaaccuagcccgucagguuucagagucuaucuacuacacuuagcucucauggcauuaaaaaaggcaaagcauuuggauacuuuggcacuauaaauaucauuaguaacugcaguuguccgcuagggaacucuaggcuaaauagucauucagacaaguaagaccugaucaggucgcgcuuggcaucauauugacauagaaggauauugcgcaggaaacagcaugccagcagagcaaugccuugcucuugcaggauuccuggggcuuauguuugguccaugagugacagcucagguaugugagaaugagaaucacaaaggugguugcagagcuacucugguguauuaguuuccuccuguggcuucuguaacagauaacuauaaacugggugauugaaaacacagaaauuuauucuuucacaguuguaaaggcuaaaaguuugaaauaaauguguuggcagggccauauuccuggaggcuccaguggagaaucaguuccuugccuuuuuccaccuucuaguggcuggucuuaacaucacugccuacuuugugugccugaaaacuccugcuaucuuauaaaaggacacauacgauuguauuuggggcccacccagauaaugcaggacaagcgccuccuuucaggauccuuaucuuaaucccaucuuuuuaccagauaagguaauauuuuuuuuuucagccuaccauacuugauuuagaaacacccucccuugccccaucacccccaaauaggaaccaauaucuuuuuuaacaguuuuguggucauacuuuccauguuuucucuauagagauaugcucaguuaaauaguauucugaggaaaucccaaagcuguggcauccuagcagauauuuauaguucauuugcaguucucugacucuagauuuauuucauuaaucagggauaauuuucaccauaaucauuguuacuacuacagguugaguaucccuuaucugaaaugcuugggaccagaaguguuucggauuuuggaguauuugcauaugcacaaagagagaucuuggggauggaacguuaagucuaaacaugaaauucauuuauguuuuacacgcacuuuauauacauagccuacagguaauuuuauauaagauuuuaaauaauuuuguuaaacgaaauuuuggcagugacccaucaagaggccagguguggaauuuuccacuuguggcaucaugucauugcucaaaacauuuuggacuuagcagcauuuuggauuuaggauuagggaugcuuagccuguaauacaacugacauacaaccuuuaucaggcuuuagaaguaaaggaugccaaggucaaauuuguucauagaagagaaagguuuuguugacccuucgcaaauuauuuaggauacaccaugauuacuauagauugcauuagaacuuuucaugauuuacugauacuauccuaggcccugggaguagcagugaguuugaugauacauugacccuuuuuuuuuuuaaagugaggauguggcauuauaaaauuuauguuuuagauuuuguagauacugaaaugauacuauaacccugaauaguagggaggagauguuuucaauggauuagagaaacauaaauuguaauauuuuugguuaggggcaaauggauuaacaugaaagaaggaacaggagaguuauaggcacaccuugcuuuauugugcuuugcauauauguauauauguaaacaaacggaagguuuguggcaguccuguguaucacaaaucuauuggaaccauuuuuccaacagcaugugcucacucagugacugagucacauuuugguaauucucacacuauuucaaacuuuuucauuauuauuguaucuauuaugauuaucauugaucagugaccuuugauguuacuguuguaauuguuuuggggcaccaugaacugugcgcaugugcaauaguaaacuuaauuaauaaacauguauguguucugacugcucuaccgacuggccauucccuggucucucucccucuccucuccuauucccugagacacaguauugaaauuaggccaaugaauaacccugugguaaccucugaguauucaagugaaagacagaguuggacauucucacuuuaagaucaaagcuagaaaugauuaagcuuagugaggaaggucaagauagaagccaagauagacugaaagcuaggccucuuagaccaaacagccaaguugugaauacagaggaaacuuuguuuuuaaagagacagagucucacuuuguugcccaggcuggagugcagcggcaugauaugguguaagcuaggccucuuacaccaaacagccaaguugugaaugcagaggaaacuuuguuuuuaaagacacagggucucacuuuguugcccaggcuggagugcaggggcaugaucuuagcuuacugcagccucaagcuccugggcucaagccaucuuccuaccucagccucucaaguagcugggaugacagguacccagcuauuuucauuuucguagagauggggucuugcuauguugucuaggcugguuuugaacuccugaccucaagccauccccuugccuuggccucacaaaguguuggcauuacaggcaugagccaccgcaccugaccgaaaacauucuugaagggaauuaaaagugcuacuccagugaacacaugaaagauaaggaagcagaacagccucacugcugacauagcaaacuuugaguggucuagguggaaaaucgaaccagccccacagcauugccuuaagccaaagccaaacccagagcaaggcuuugauucucuuuaauucugugaagucugagagaggugaggaagcugcagaaggaaagauugaagcuagcagagguugguucaugagguuuaacgaaagaaucuaucuccauaacauaaaagugcaaggugagguagcaagugcuaauggagaaguguagcaaguuauccagaagaucuaccuaagaucauucaucagugaucugcacugcacuaaacagauuuuccaucuauaugaaacagccuucuguuggaagaagaugccauguaggacuuugauagcuagaggaaaagucaaggcuuagcuucaaaacuucaagggacagccugacucauuuguuaggggcuaaugcagcuggugauuuuagguugaagcaauugcucauuuaccauucagaaaauccuagggaccuuuuugaauuaugcugaaucugcucuaccuauacuuuauaagugaaacaacaaagccuggauuacagcacaucuguuuacagcauagucuacugaauauuguaaguccacuguugauaccuacugcucagaaaauuucuuuucaaaauauuacugcuuauugacgaugcacuuguuuacccaagagcucugguggagauacauaaggagacaaauguguucaugccugcuaacacaacauccauugugcagcccauagaucaagaacuaauuuugacuuucaagucuuauuauuuaagugauacauuuuguaaggcuauauggcugccguaguuagugauuccacucauggaucugggcaaaguaaauaaaaaaccuucugggaaggauucaccauucuugaugccauugagaacacuugugauucaugggaugagguuaaaauauccacauuagcaggaguuugggagaaguugauuucaacccucauggaugacucugaaggguucuagacuugaguagaaguaguaaaugcagaugugguagaaauagcaaaagaaucaaaauuagaagugaagccugaagaugugauugaauugcugcuaucucgugauaaaacuugaauggaggaguugcuucuuauggaugagcaaagaaggugguuucuugagauggaacucacuccuggugaagaugcugugaauauuguggaaaugacaacaaaggauuuaggauauuuuguaaacuuaguuaacagaguaguggcaggguuugagagaacugacucuaguuuugaaagaaguucuaccaugaguaaaaugcuuucaaacagcaucacaugcuacugagaaaccuuucaugaaaggaagagucaauccauguggcaaacuucauuguuguccuaagaaacugccacagccacccuaaacuucagcaaccaccacccugaucagucagcagcuaugaacauugagucaggacccuccaccagcaaaaagauuacaacuugcugaaggcucagauuuuuaaauuagguauguacauuuucuuugacuaaaugcuacugcauguguaauagacuauugaauauuguuaacauaauuuuuauaugcacugggaaaccaaaaaauucaugugacucacuuuguugugauaauucuauuguggcggucuccaauuauccccaaaguaugcuuguacuaucaguuauuacugaugucaacaaacuuuuuuuugagguggagucucacccuguugcccaggcuggagggcaauggcaugaucucagcucacugcaagcucugcuuccuggguucaagcaauucuagugccucagccucucuaguagcugggauuacaggugugcacuaccaugcccggccaauuuuuauaucuuuaguagagacgagguuuucaccauguuggccaggcuggucuugaacuccugaccucaagugauccguccgccucagccucccaaagugcugggauuacagccaugagccaccaugccuggcugaugucaacacacuuaauuauacauuaucaaaaaguuacauucauugauaucaccaccaaucucaucagaaaaaacuuuuaaguuuugcgaagcugucaagcucacaguagugguggguugaaguuuuccaaaauucugauuuuugcuucaaaucucaaauuugaucauuggcaguaaauauuguuauuugcuuuucuuuaaaugaugggcucaucacucccauuuuugagaagaugucuucuaacuacccaaaucuggauagacauauuuugucauucauucuuucgagucaaagugaugcuccaugaaaaaagaggccaguucacuuaauuaaucauuguacaaaaaugcuuuaaaguucccauucuguuacacagcuuauuaauacaacauguacucggcaagguacggugacucacgccuguaauuccagcacuuugggaggccgaggugggcggaucaccugcggucgggaguuggagaccagccugaccaacauggagaaaccccgucucuacuaaaaaugcaaaauuagccaggcaugguggcguaugccuguaaucccagcuacucgggaggccgagggaggagaaucgcuugaauccaggaggcggagguugcggugagcugagaucaugccacugcacuccagccugggcaauaagaccgaaacucugucucaaauaaaaaaaaaauaaaacaacauguacucaaggguugacauuuaauaacauaacuuuuuaacuguuuuauugaggauauuauuaaaugaaacuggcauuuucuuuuaauaaaaaaaacaaggugguaugauuacuguaguguuuagcucuguuugauuuuugcugaugccagcaguuuugcucaccauugcuuuuguaucaguucaaauaacaucuuaauauuaaugaaaauaauuuugaccuagcagaccucuugaaaggguuuuagagacuccaguugucugugaaucauacuuugagaacagcugacuuagggauuacagcauguauuuuuggcuuaucaaagucuaguugguacuucugcccuuuucuuaggcaaugcaagauucuuagagccuuuaccccuccccucuuccaucguuguauauaugaauucuguaccaguuuuuuuuuuuuuuuuuaaaauagagucucgcuguguugcccaggcuggagugcaguggcacgaucucggcucacugcaagcuccgccucccggguucacaccauucuccugccccagccucccgaguagcugggacuacagguacccgccgccacacccggcuaauuuuucuuguauuuuuaguagagaugggguuucaccauguuagccaggaugaucuccaucuccugaccuggugauccaccugccucggccucaagugcugggauuacaggcgugagccaccgcgacuggcaauucuguaccaguuuuaaacacaaguuaucuuuaauguuguuacccauguauuuaacacccccccuuuuuugcuugccauuucuuacugcaucacugaccuuccuuuugagauauuuuucugcaugugagucugcuauauuuauauaucugaaaauauuauuaucacaccuucaugagguaugcauugagagguucuuuuuuugaggggguggaauucgagcauaugaacuuccaguucuaccaccauuuguugaaagacuuuuuuuuuuuuugagacagagucucacucugucgcccaggcuggagugcagugccugcaaucucggcucacugcaaccucugccuccuggguucaagcgauucuccugccucagccuccugaguagcugggauuacaggugcgcgccaccacgcccagcuaauuuuuguauuuuuaguagagacgggguuucaccauguuggccaggauggucuugaucucuugaccucgugaugcacccguguuugcuucccaaagugcugggauuacagguaugagccaccaugccuggcuuuucuguuuuuuuaagaaauugucuuugcacauugucaagaaccaguuggcuauauuucugagggucaguuucuggguucucugucuucuguugaucuguaucuucuguugaucuguaucuucuguugaucuguguguuugucuuuucacgaauaccauaccgccuugauuguuguagcuuacuguauuaagucuugaaauuagguaauauauauccucugacuuuguucuuuuucauaauuguuucggcuauucuaguuccuuugccuuucugcuugcugauacauacaaaaaaggcucacugagauuuugauuaugauggccuuuauaucucuauauaaauauauauaaauaaaaauuaggggggauugauauuaacaaugaguuuuccacauguagauccugcacauauuuugcuagauuuauaccuaaguacuccuuucuuccggggguuggggcagguguuacuguaaauguuuuuuuaaaauuucaaauuccaauuguucauuacuaguauauuggaauauaauugacuauuguauauucaccuugaauauuacacuuaucgguucuaguauuuaauuucaacuuuuaacuugccacagucuaccuucaaauaauauuuacacuaugucauguguagaauggacuuuacaagaguauauacuucauuucucucauuguggucuuuuguauugucauacauuuuauauccguauauguuguaaaccucacagcacauuguuacuauuuuuugcuuuaaacagucucauuuuaaaaaauaaacucuuuuugauguauaauuuacauauaccggcauaccuuggagauauugggaguuugguuugguuccauaccaccguaagaaagcaaauauugcaguacagugagucacacaauuuuuuuggucuccugguccauauaaaaguucuguuuacacuauacuguugucucuuaaguguguaauaacauuacaucuaaaagaaguguauaccuuaauugaaaagcaauauuuuauugcuaaaaaaagugucagcauuuuuuagcaauaaaauauugcuaagcacaugcuguuggaaaacuggugcugauagacuugccacaaaccuucaauuugcaaaaauuugcaauaaagugaagugcaauaaaaugagggaugccuguuuguaauuucacucauuuuauguauuugauauguuuagacacaugcauauacuaugugaucuuuugagacuggcuucauucacucagcauguguucgagauugacccauguguuacgucaguaguucauuccuuuuuauugcuaaauaguauuccauuguauagauguaucacaguuuguuuauccauuuauucauugagggauuauuuggguuauuuccaauuuucacugauuaugaauaaagcugcuauaaacauucauguauagguuuugguaugagcauaacuuuaaacuucucuggguuauauauuuaggagugggauugcugagucaugugguaaauguauguuuaacuuuauauuuaacugccaaucuguguucuggagugacuguaauauuuugcauucucaccagcaauguaugagaguuccacuuguucugcauccucauuaacacuugguauugucacuuuuugaaaauuuuaacuauucauauagauaauauagugguaccucauuaugguuuuaauugauuucuguagcuuuauaauaggucuuaaauuuaggacaugugggccgggcaugguggcucacaccuguaaucccagcgcuuugagaggcagagacugguggaucacuugaggucaggaguucgagaccagccuggacaacaugguaaaaccccauuucuacuaaaaguacaaaaauuagccgggcgugguguugggcgccuguaauuccagcuacuugggaggccgaggcuggagaauugguugaaccccagagguggagguugcagugagccgaaguugccccauugcacuccagccugggcaacagagugaaacucuguuaggacaugugaauucucuagccuuacuauuuuucaaaauuguuuugcuuauucuaguuuauuugccuuuccauauacauuuuacagucaucuguagcuacaaaaaaauccugcuggaauuuugauugaaauuucauuaaaucuguacaucacuugggagacuucucaucuuaaugcuauugagucucccaauuucaugaacacaguaucuucucugcgcuuauuuaggacuauuuaggacuucuuugacucuuuucaccaggguuuuguaggucuucuagcauauacagauucuguugcacauauuuuguuauauauuucauauuuuuggagcuguuguaugcgauaaaaaaauuuucuuccaauuguucauuguuaguuuauagaaauguaauuuauuuuuguaugcugacuuuguagcauauguccuugcuaaacucaguuacuaguuacaggaggguauuuggggauagauuucuugggucaguuguguuuuaaggagacuuucaaaauugagaaaaaugucuuauaauuacccaugagcuaccauuucagguacucuuuauuuuguuguguagaucaguauuuccauuugguauaauuuuccuucugccugagaauuuccuuuaacauuucuuagacuguaggucuucuggugaugaauucuuucagccuuuguauaucugaaaaaguauacuuucaucuucauuuauggaagauauuuuugcuggguauagaauuguagguuauauggugucaguuggcauuuagaaagaaaaaaauaggacuguagguugacagagucgccuuccccucccauuuauuaacuauaaggguauuguuccauuguauuucagcuuguauugauuccuccaagaaguuuucccauacaugugcuguagccugaaaaguuucuuuaggcaguaagcuugggguaauuagagcucacauucauuauuuucuguuuauugucauguguucugauauucaaugucuaaaauucuuuguuucacguuucuuuaguuauuuaauuguuauauucaggaguaaauuuggucccuuuuacugcaccuuggccugaagcagaaguccgaagacuuaagaaguuuuaaucucguaaugccuuauagaguggaugauugagaugccaagaauaucacuucaguaauucaaauguaugccuuguauggaaaauguuggguuuaagguuucuucugacacuaguggguugguauuuauuucacugguuuaaaauaaaaaauuugaauacgagcuuagacauucaagcuaaguugaaaugguauuuuggauggucaaauuucauauuuuauaugaaaguauuugaguauuuagugugauaaauuaugaguaguuaugacaguuuuccuuuaaauucagauuuuuggcaaaaugugauuuuaggacugguuuuucagaugagcuuuuucaaauuaguggagcacauuguuaaaacagccacuaauaaugagagauacuuaaauuugcccaauaccguauuaccuuuacccuuucacuuccuaaaugaacaaccuuccuagucauauuggaaaaauuuauagcugugauagacuggagcagggcuaccaccuagugguuuaaacagacacgggcccuuauggagcaucugaaugcguaaugcaacuauuuguccuuugaucuuuuauuaugaagaauuuguguuuugcuuuguuauucauucuugccauuuguggaucacaguggcagaucagauuuucuuuucuuucgagaugaagucuugcuuugucgcccagacuggagugcaguggcacgaucuuggcucacugcaaccucugccucccaagugauuauccugccucagucuccugaguagcugggauuacaggugcacaccaccauuccuggcucauuuuuguauuuuuaguagagauaggguuucaccauguuggccaggcuggucucgaacugcugaccucaagugaucugccugccucagccuccuagaguguugggauuacaggugugaaccacugcaccuggcccagauuuuccucauuaguauuuuuaaaaacaaauuugauuuuuaggaguuccuuauauauucuaaauaugaauccuuugucacuacauguguugaaaguauauuuucucaguuguggcuugccuuuauacuaauuuuuuuuuuauaaacauaaguucugagcauugagguaguugaauuaauguaucagccuuuuuuaaugacuuguacuuuuugucuaauuuuaaagaaaucccacgcuauccuaaugucaaagccauuuuuccguguuuucuucuuaaggauuuauauaguuucacauuagggccuuuaauagguuuuuuuauauguagauauaggaguccacuuuauuuuuuuucucccguuagaaauaacuugcaggcuugccaccacuuuuuuguuagguuauuguuugccaguugcguuaccagguuuccacacguacaaguucuguuucugagcucuuuauugcuaaauauauguauucaugcaccagcucucuugauuucuguaucuuuauugugacucaugguaucuggcacaaugccaacuuucuuuugauuauguuuguaguauuuuucugucuuuuuuaagucuuucuauguuauauuuuacgugugucuaaauugcauaaaucuggauuuaaaaauuuuguugaaagccauuuucguagcauauuuauuccauuuacauuuguugugauuaaaauauugcauuaaauaaauauucauuuaaauauaucuacauauugauuaccuucuuugcucugcccuaccccccaucuccccaccagauauacugaguuuuugaauauaaagacuuuugcgggggagaucuguaggauuucuuuuaggccaggaaugugauaguacuguguuugauuuuggccuguacuuuggauuguuauuaguugaagaccaucuauaguuaaauucucgucugaaguuuguguucuacccaggucagaugaauucaggcuuaugguuguguaaauaaucagaauuuuuuuuuuuuuuuugagugucucccaggcuggagugcaguggcgugaucuuggcucacugcaagcuccgccucccggguccaugccauuuuccugccucagccuccagaguagcugggacuacaggcgcccgccaccacgcccgacuaauuguuuuauauuuuuaguagagacaggguuucaccguguuagccaggauggucucgaucuccugaccucaugaucugcccaccuuggccucccaaagugcugggauuacaggugugagcuaccgcgcccagccaauacucagauuuucuuuuccacucauugccaucauggauuggcaguuuucuuuguccuucaagaacaguuuuaaaauaacauuuaaaaaauugguuuauuauuacauuuuaguuuuuacuuagauugaagguguucgcucauugaggcucaguguucugagcgguuaucuuauuugacucuucuucuuagguggcuuucaggccuuguguucugucccccaaauaagaccccagaacccaacacaggcuuucagaaugucauacaaaaagucacuuugauauucugucugucuccacuucucuuaguucugguuccccugaccgcccccaaaguccauucuuuguagagcuuaagaacuuaagaacuuuguguuggucgccugccauuguguuuaaucugacaucuuuaguuuucagcacaagguuucagugguuguccugaaguggaagcccuucccaacucuucauuuuauggcuuacauggaagauugauaguagcaauuacugagagaauuucuugagggcucuuaagauugguacauauacaagggcucuguuugaaagacuuuggcugcccuggcguccuggcuguuuuaugccugguagcucuagcgguuaaaagcucucucugucuugccacuccuauuacccauuaccaguacauuuguuggagaacuuugguuguagaauauaaaucccagaaacagagcugugugugcaugguuaaguuuuuuaguucaugagagaagggggaaauuaaagaucuugacucauaccuggccaguacaacauugcacagggaagaaaaaugcaauuaggugcuugcuuuacaguagaagaaaauauugguaaguguuuuacaucgggucagauucuggggauuuucuaauucugagccgaacuuauguacugugaaggaaauggugggugguuuucagaaaauagggaaacuuuuacaucaaaaacucuguaaagaagucaaagauaaauguaaucugggaaaaaauauucuguaacauuauauauagaaauccuuuauguauaaauagcaccugacaucauuuaggaaaagaacuauuuaugauguaguauacugagaacugugcacaauguauggacaggucuaguaaauauuagggaaaaaguaaugaaaaaacuugaaaccagcaccgcugguggaagguuauauugguucagcuuugcugguuggcuuaucagaagcuuaaauugugcuuuuaauuugacugugaggaacuuauccuaauaauagcaaaaacuugguuaacagauacucuucaguagaaacaaauuauaguuuaacuguucaauaaaaugcuaugcagauguuaauuuugagaucuauauguuuugacaugauaauauauuaaaucaaauaaaaauuuuauaaaauugcauauaaagauuuguacuaggccgggugcgguggcucaguucuguaauccuagcacuuugggaggccgaggcagguagaucacuugaguucaggaguuugagagaccagccugguguacguggcgaaaccuugucucuacaaaaaaaauacaaaaauuagcugggcguguuggugcguuccuguaguuccagcuacuuggguggcugaggcaguggaucgcuugagccugggagguccaggcugcagugaacaugauggugugccucugcacccuagccucggugacaaagugagaccuuucaaaagaaaaaaacaaaaagauuuuuacuguuugcauauaugcauagagaaaagucugaaaggguauauucgggccuauuaaaaaguuuuuuuuuuuuaaagcacuuauuuugggggaggguccuuuaucauguugcaguuucucuagauuuaagguuuuucauauguucaagaaauaaaucuaagugccuacauuuuagaaguuguagaauucaaggcauauuuucaguggagcucaugcucauaaacccuaucucuuccaccuuuucaugcaaccugaagugcuugcuuuuuccuuuuuaugugcauuuauuuaaaaauguguguaaggcaaaggaaugcauacuuugcuaccaaagauauuaauuugaacuacauauuuaaccaggguacagcaugcagaauaauguagucuuuuaccuucauaaagauauggucuacauaauuuugcugcaggcgggcuuucuuuauacauguaucuuuuuggaauucugaguuaaaugugugcagcuuaaaugacaggcauaaugauugcuguaagacuguuucugucaaccucuagguaaauaauagacccuguggaguagcacaagcaaauuaaauuaaaaaauaaaggguuauaaugccaacuuuuuuuuuuuuuugagauggagucucgcucugucaccuaggcuggaaugcaguggcgcgaucucugcucacugcaagcuccgccucccggguucaagcgauucuuuugccucugccuucgaguagcugggacuacaggcgcgugccaccaugccuggcugauuuuuguauuuuuaguagagaugggguuucaccauauuggccagccuggucucgaacuccugacaucgugauccacccgccucggccucccaaagugcugggauuacuuuacaggcgugagccccugcgcccggccuugccaacuuuuucauauggaaaaucacaggaucauucugaagugaaauuaucucucauacuguccuuggccccaaaauacaguuuuuaaaagaucauuuaaggcuuaauucguugcuuaauuugaguaaggagacuuuauaauguacuugaauguauuccaucuuuacaauguuacauuuaggaugcuacaaaaaaauuuggaaaauaacucagcuguugugucaauacagcuucuuuuuauuuaauguauacccugggugugagugugugugugugugugugucugugugugugaauauagaauccauuaauucaugugguugcaugcaucugagauaaguuuuggaguuaguaguaaacuagcaacuuguugacuauugagacaguacagcuuaguuugcuuuguugcagcuguauuugucauuucuuugcugugggauaugaugagguuucucuucaaauaaucugaucaaucuuuuauucuuuaauucauaguacccucccuucccccuuuuuccuuuuucuccuuuuuuuuuuccuuuuugccuuuguuauagaugcccaggcacgcaacaguaucaggcguuaucaguaccagcucacauuccuuuccuuauuuggaaagaggacuaacuuucuaccucauuacagauaccucuuccccuuuccucuccacuuucuuuuacgugcccaucuuaccuaaaaaaauucaaauguucagccaaccgggauuaguuuagauuguaugacccgaccccggccaaugaggaaaggguacaggggcaggacuugcaucaggaauaaaggcucucgugccccuuuguucaggugugcucucauggugacuggccaaggaggcaccccucugugcagagguaaaauugcuuugcuaagaauccuuuguucgaguguucaauuuccuuaggauuuugagcguuauuccuaacauuugccaaaaauacuaaagagagaaaaaucagcaacacaagguaaacuaaggaguugucauucugaagcugcaaaaagugggauaaagcuguuuaacauuuuccagauacauaccacacuuagucugaacugguguauuauuuuauacauauacauauguauauauguaguaguguuuuauuuuucugucacaguugucuuuugaauaugggaacuuaguuuuuuuugguuggguuacuuuuguuuuggauauguuuaugucuguuuauuuuuuauuuuuuguuauagugaugauugcuuuuuauaaugauuuaaaauaaagaggggcgaaaaaauaugguagagaacugaggcuaagucugggaaugguuugugagagcugggaguugaaauuuuauguguugcuuuucugcuugguguggaguuggggaggaggagcuaguguguaggagaaaaagcugauuauggagagggucguucuugcacaugacuuuaggucccugggcaugaccugagucaacuaccuuacugcucagaggcugugaagccauacuguuugaaucuuugcuaguuuguagcuuugugaccaugagcacaggauuuauuuaggccucaguuuuccugucagugaaguaggguuaauuacuguaauagaccccauuucauaguaauugugaggauuaaagaauaaguauauguaaguugcuuagaauagugcuugguacauaucaagagcucaaguauuagcuaucaacacuuuacuaaguugucuaguuugauuucaauaguguaauucuuugagaguauuuugcaauagcaaaguguuuuaaauaguuuauuugaaaagaaugguucuuaaagugccagugaugguuucuugaauguugaaugaugcuuguuuacucauuagcauucaacacaucccaugaaugcagaguaguaggcccaaagagacugaaaaaucugggauucagacuggcaucuaacuuucauucuacugaccuuuuuuuuuuuuuuuuugagacguaguuuugcugucauugcccaggcuggaaugcaguggcgcgaucucggcucacuggaaccuccgcuuccuagguucgagcgauucuccugccucagccuccugaguagcuggaauuacaggcgcccaccaccacgcccagcuaauuuuuuguauuuuuaguagaggcagguuuucaucauguuggccugguuggucucaaacuccugaccucaggugaucaacccgccucggccucccaccgugcugugauuauaggcgcgagccaccgcguucaaccccucugcugacucuuuugacaaaagauguguauuaauugaaaguaggaaauagagagacagacaggguagagugacaaauguuuaaguuccuuuaucaucucgaaaauguuagauaugggugacgauuaacuggguuuccuuuuuucuucccuccauccuuuuuguguguguuaaugauuauuucauuaggcaguuguuuuguuguuguuguuguugguuuuguuuugagacagagucucacugcauugcccaggcugcaguggcgugaucacagcucaccgcagccaccaccuccugggcuuaagugauccuaccaccucucagccuccugaguagcugggaccacaggugugugccaucaugccagcauaauuuuaaaaauguuuuuguagagaugggagucucccuauguugcccaggcuggucuccaguaauccccccaccucagccucccaaagugcugggauuacagguaugagccauugcaccgaacuuuguuuuuuuuuuuguuuuuguucuuaagcgaggaaagaggguuacacacacaucugucucuuaaagaauucucaaaaacagucaguucugggcugcacuggaacucuacuguuccaggaacaugggcuuccauuuccuacucugcggaucucagcuauggcaucuaccucuuaguccaggagaguuacugaaguucuugccaucuggaugauucuacccaaguaggcagaggaggggaugaaguggagccugucuuucccuuauauuccauugggcagaauuuaaucaccaagccacaccuacaagaauggcugggaaucucagccuucagucuguguaaaaaugugccuaauuaaauuuacggguucuauuaacaaagaggagaaaggguaucugagacaccuagaaucugaagcaagucacaaaacaguauuuauagaaauauuaaucagguaggaaaaguauaugugcuuacaucugcaugauauaaucucuuuuuucuuuuucuuuacaauauaaucuugaauauguuagaaauuuuaaauauuuguugcuccugggaaauggaacugggcggcuggggucaggacuaggagagagacuuuuuaguauauaugccuuuuugaaguggugauaaauagacuuucaaaaauaguaaaugaaauuaaaaggaaaaagucugcaaguuugauauauaaguucaggaguagauaugucauuaagaaucagcaauacuuuaugccuguaaucccagcacuuugggaggccaaggcggguggaucguuugagacccgccuggccagcauggugaaaccccgucucuacaaagaguacaaaaauuagccaggcgugguggcgugugccuguagucccagccacuugaggggguugaagugggaggagcaccuaagccugggaggucaaggcugcagugagcugugauugugccacuacacuccagccugggugacagagugagaccuugccuuaaaaaaaaaaaaauaauaauaauacuuaagauuauuuuaauuguaacucuuuccucauuaaaaaaaaaaaguauaauguguugacguuucaaaaaugguuuagauucagguaguuucaauccuuuuaaauucuuaaguguauuuaugguguuuuaaaagcagccaggcaaaggcauugccgaauacccgcaaacaggaagaauuuccuucugauuuacgacacaucuuucuggaaaggauaucaaguuuaaugaugcauacacuuuuagggauuuguugggaacaggucagaagaauaguaauauuauacauuagauacuaugucucuuuauacauaauguaaaguaagaaaacacucuaauaacuaagucggugguggugaugguaguggugcaguagagaaacaucuuuucuugauauugucuggauuacugcaacaaauucuuuuacugaucugugucagaaguaccaggggugaucugcuauaguuacauaguuugccaccucuuuaggaugucugaauaacaagcuguuaaaaauguaggaaguuagugggaugagaguuugaugugggguuggaguagagugggcuuuguguuggggaacagggaaagaaaaaauauggauguguaggcugggacuggagccaaguacucacuguuauaggcaguaggaaauaauuggaaguuuaagagcugggaagcaugacaauaaauagcauugcuggaagaguggguuuuguuuguuuaggguaugaguugggcuguagaaacagaccagucaaggagcaacaaguggcaguaacgguguaguacgggcauucauuggaauuugcggaaauaauagguaaaaagaaaaaggggaaugguuaugggagaaguguuagggaagacuuagcaguaaucaauuagauguguaggcauaaagaaaugauuugacuaggugcuguuaaugaaaaggaaaguuaaagagagaauuuuugaacagugccagaaacuuaauuuuuacuuggugaauuuaagaugauguugggauguccaaguggaaaaagucugauaaguuguuuagaguuaaaagauuucuucuuccuucuuugucuuucuucuuauucccuccccaccccugcuucucuuguguaaacagaaguuuauagugcacaaaagugacucuugggaaaguaucuuuaguuaaggaucaagauaguaagguagaaccaaggaagaaagaggagugaggaaggcagauggguuagaaaagaggauccaggagaaaaaaaagauauacaggagaauaaaggagacaggaaccaguuugucuucacuuuggauaccuagcagccaauaaaagugaccaggauggaguaggugcucauugaugagugacugguauaauacuaaguauuuuuaauuauccacagguauuaucuaguuuaguaccuuaaaaaaaaacuagugcaaaauauacauaacaugcaauuuaccauuguaaccuuuucagauguacuguucaguaguguuagucuccagaacucuuuucaucuuguaaaacugaaacuuuauacccauuaaacaacugcuaauauuucagugauuuuaauaaaaauguuugcaauauuuauccccauuagguuaauauagggguuuuucuuuuucccuaaaauagucuuauuuuaaaacugcguugucuugaguagucuuuuauugagaaaguuguaagcuucuaaaaaccauaauucuuuuuuaauuuuuaauuuuaucuuauuuuuuauuguauaaauuuuacaggguuguacuuagaaucauagaguccaaggauauuuuuuuaaaaaugcaaauuagaauuguauccaaaauaagguaucuccuuuguaacucccacuaaaauagcuuaguaauauaugcuuuaauucuuuguauuuauaugaaccagugauggcccauuuaauuuuugguguguuuaauuuuuccuaccuucugaaugagcugaauuaaguuauacucauucauuggcacuauccaaagugcaauuaaucuucucaucuaagugacugcuuuuuaaauauuuaaguaaagcuucaauccuguugauuuuccucaguuaaacuuaguuaagguaguuuucauaugacaguuuccacauccuuuaccaaacuuguagcccucuuuguguuaucaccuguugaaaugugcuauucagaacugauaaugcuagagaucugaucagacuagaccuuggugagcugauuauugcuguugauauguauaauauaauuuauuaauuugggccaugaauauuuuuuaaauuuccuuccguuuccuuuucuuuuuccucuuccucuuccucuuccuuucccuuuuccuuugacagggucuugcucugucgcccaggcuggagugcaguggugcaaucauggcucauuguagccucaucuucccagacccaagccauccucccgcuucaagcuucccacguagcugggaucacaggcaugcaccacaccaugccuggguaauuuuuuuuaauuuuuguagagacgaggccucgcuauguugccugggcuggucucgaacuccugggcucaaggaauccuccugccuuuugcugggauuauaggcgugcugggauuauaggcgugagccaucgugccuggccaaauagccauauuucauggaugauacauugaccuguugucugcuuaaaucccuuaaucuauuuuaaggagucugcugguugcuggaugcucaaccauuguguaugcguaugguuggcuuuuuaaaaauuacggguagggcucauaauugguggcucacaccuguaaucccacuacuuuaggaggcugaggcgggcggaucacuugaggucaggaguucgagaccagccuggccaacauggugaaacccagucucuacuaaaaauacaaaaauuagccgggcaugguggugggugccuauaauuccagcuaccugggaggcugaggcaggagaaucgcuugcacgcaggaggccgagguugcaaugagcugagaccacaccguugcacuccagccugggcaacaagagugaaaccccaucucaaaaaaaaauaaauaaauaaaaauaaaaauuauaggcaggacugcauauuuguuuuuauuauauucagccuaaaaguuucacucauuuaaaaccauugggguauuaaaaucuguauuuucucuaccauuuguagucacccagcuacugcaguuaaucuuuuaaguugaaaagaaaaaaguuuaaauguugcauauauuuaacaauucuaaaauauugacagcguccuguuuuagcaaggcacugaccaaguucaucauaaaagauuaauacugcacaugaaaaaaauuaaauuaguuacaugucuguguucacaagcucaaaacuucaccugucagaguuuagaaauacgggguaaugguaacguuacuuuucugggauagcugauuuuuaaaauaauaacagugcagcagauaccaagcacaaguuauauugaauguuguggaauauggcacuaugauggaaauaaaaaacacaccuaagcuuucuacguagcugggaggaucuuaguucauuuauuucccuuuucaguguuuuuuucccuaguagguaguaaggauuauggaugugcaauccaccagcuauaaacaauuagaggauguaacaauuuuuguggaggguauugcuuuuauccuccuugcugcaagauauuuuauuaggcuuuucauuuauaaacauaagaaauuuugcuuuccuaauauuuaguauacggauugaauauuaaguuguuuuuaggcuuuaagaauuaucuaggucuguacuguccaguaugguagccauuagccacauguuuguuuaaauauuaaaaugaaauaauuuaaaaauucacuuguccacuugcacuaaccauguuucaaagugcucaauaaccacaugugucuaaauggcuacuguauuggacagcacagaucauaggguauuuguaucauugcagaaauugcucuguugauugcugaugcaaccacaaaugauuuucuuucaaauuucugacaauccuuacacuaaagguauaggaugaguccucaggggaaagcauaauaauucuuuaaugaauuuuuuuuuuuuuuuuuugaggcugagucuagcucugucgcccauggcuggagugcaguggcgcaaucucggcucacugcaaccuccgccuccuggguucaagcaauucucuugccccagccuccugaguagcugggacuacaggcgcccaccacuacgcuuggcucauuuuuuguguuuuuaguagagacacaguuucacugugauagccaggauggucuccaucuccugaccuugugauccgccugccucagccucccaaagugcugggauuacaggcaugagccaccacgcccggcccuuuuaaugauuuuuauaagaauggaaaugauagagguuaauuaugaaaaaaaucuaaaaaauauagaaaaguaaaaugaacaaaauacaaggaagauucugugugggacaacuauauagaccuuuuuuuuuuuuuuuuuuuuuuuuugcugugacacagcccucaggagauccugagaacaugugcccguagacuuucuuuuuuuaguaccuguuuuauauuccaguccuucuucucugcaguuguguacaaagcuacuguacagggauaauuuuacuuguguacauuuaaaauuuuaaaagcaagaaauaaaaauaauccuauugacuggagauauuuuugcuuuauggaaguuuaucugaauguuguucugaaucuaaacaguauguaucuucuguuaucauuagccuuuugaguaaaaauauaaaaauucuguguuuuauuguagauuauuguaugaguuaggaauauuggaaauuaucucaaguuauuuauuuuccuuuaaauguucuuuaaaaaguguguuagauauuuggcuguaucugauauuagaauuaccugagauacuucaaauaaauucaugaaguuucacuaugaaguaguaauacagagugcuuggcaacuuucuucugccuuuuugcucauuuucaucucauuugauguuuggcucugucagcaucauugaccaccaacguuguuugguaggugcauggcagcuuuauggggaaauuauuaagaauuuguuaaucaggccugaguguauggguaccugaauuuaaaaucaaccauucugguuuuuaccugauuuuauauuucaugaugaucagcauuauguauaauauuaauuuugguguguuccuuaguuuuaugacaaguagaagauaggcaauugaugaucaaggcaguggcaugaagggugauaagaggaaguagagaauguuggcaucuuuuuuguuuauaucauuaaaguaaauuuguguuuaugucuugaauccuuuuuaccaugaaaacauaguugcuuauaaauuuaauguuaaucagccauaugaagcucucagaggaguaggaaagguuuauaaauaaccuaagaguuuuaaaaaaaauacgcucacuauuaugagaacuuuauuuacaauauucuuauucauuaauguaaaauuaagaauuguaauguaucccaauaauguuaugaauuucucugauauuauaaagcacuguaauaaauuguauuuuuauacucuagccaucugccagauaagaauuauauaugacuuaaauaaaaaggauuuugaaauuucauaccuucagauuauaguaauuucugagacuucaguguagcauucagacuuuuuuaauuauagggaagcagaaagauuaauuuucagugauugugauuugguacauauagcuaagaguagaacaggaauugaagacaaguucuuuuguaaacccuuaggcuuuaaggauaauagacucagccuagaauucgccuuguuuagaauggauuauccaaacuuguugaauauuuaugugcuuaggauagguaaauguuaggauauaaauuuuuaaacucuauauuaaaggcucuguauuucacaggagaggaaaaaugaaggcauucgaagugaguacucugucccacaucacauuuucuuaucucaacaaaguucuugaaaugguagugaaaguuuuuuauugugauagaaacuaaccaaguuucuuucuuuguggauaccaaacuugcaaguguuccugggaguauaucagagauuugagaauucacacacauuucuuacuuuaaugacucugggacacauuauuaacagagcaauguuacggagcacuuaauuguuaaugggagaaauuuugacaaaauuauugggaaccuugagagaauuagagcuuuguuauuacccgugaagauaaagaaacaauuaaguaccuauuguguccugaacacugagauaaagccuuagagaaguuuucuaguuuuaauccuuuuaucagcucuuugaguguuacuaaaauagaaaggauaaauuccccaggaucuccuguagcaaaugacaacuggaauuugucaucaagcccuagaacuggguucuuuccguuguucauuuucuccugcaguuguccuguguuauaaaaacgaauuuauauuguuaaaauaguguuauuuuuuucuuugggagaggaaaugugagagugagagcaugugcaugaauuggaguuaggaaguaagaucagaagcaguuggugugugaaguauaucauguggagaagacaauggaaaggcaguauaugguaguuuaaaacugguagaggucuggcaaaaagucaguaaaagcaguucaguguaaauuguagguauuuuuauuacucuagagauucugugagaucucacauaauucaauaaaguucuucucaccugugggaaagaugcauauuauuuauauuugagagcaguuuuguuuauaucaacagggaccacaguaauaauuuagacuuucaacuuaugaauaaaauuaucaaagugcuccuauauuaucuuauuuggcaaguauuguuuccauguauagaugggaaaagcacuuaugccauaacuaguggcucuuuuaauaaauacauagggaagcuguuccuucuauagaauguuguauugaauaugucuaagauagaagugaaauuuucaauauugacuucuuaggugaucgaauggaggcuauaugcauuaucuuggggaggaaauguauuuuagggcuuuauuuuuugcuuacauauuuguauuuuuuuauuucuaggcuguucgcugcuaugaaucucuaaucuuaaaagcugaaggaaaaguggagucugauuucuuuugucaauuaggucacuucaaccucuuauuggaagauuauccaaaagguaauuuuuuucuuguucauuauuguuugauuuauacauguguuggauuguaauuauuugugcuuuaucaagaggauuuuccuaagaaauuguaagugcaugagcaaacuaaacaaugaggaagaaaaguagaguagauggaaauggaaaucaucaauaaguuggcuauucaguaaaagugaaaaccaccugcauguucagugcaguuuuguucugccuugugaaaauccuugcucuugaaaggccuucccauaguagaaagugacccaguuugauauagauauuuguacauugauggauacuuuggaaagguaacaaaaacucaccauuuuucuuuauccuauuuaaaacguuuccauuuuagcucaaaaauauuugaaugaaaaucugaucguuaaguagccauguuauuguaaacaaguaauacagagagaugaucacagaugagccuuggauaaaaccaguuuuuaaaauuuacuugaaauguuuuuccuuuaagaaauaagugaguuaaauaacugaaaguagucagcccccuaagauuugcccuuuuuaugguaccaagcugccaacucagaccauuacucaggaaguuaaaagcacccggaaaccccgcccuuccaauaccaaagaaaaaauccacauuaaaagaaaauuauuauuaugaccaagaacauuuuaaccuuuugaugauaguaaacauuuugauguggaguggauggauguguuaugcuuguuuucaacaaguguguuuagagggcaaaacaccuggcagauaguuucagggcuaaagugaaggauuguuaguauuucauauugauguuuuauuaugcgacuuuuauguuaggucaagugaauguuuuccuaaugaaaaugcaauuuuagucugagacaggcauauucugugagguuugaaauuaggcuuauuucucagcuuagcucuguuauauacagcugcacuaccuuuaacagauuauauauaaacaucgcugaguaucuguugucugaucuguaaaaggggaggaggugagggaugacgccucauggauuuucagauugugugacacugguuaguacuuagcaaaaugguuucaguccaacaggguaauggguguuaauaguuacuuaauacuccguuagauauuuuauuuuuaauuaaaacuggaaacuuauuuaaaggaaacuauuguaccaaaaaauagauagaggcauaccugggagauauugcagguuugauuucagaccccugcaauuuauugcgaauauuguaauaaaaccaaucaaacaaaauuuuuuuguuuccuauuacauauaaaaguuauguuugcacuguaagugugcaguagcauuaugucuaaaaaauguacauacuuuaguuaaaaaaaacuuucuugcuaaaaagugcuaacaaucaacugagcuuucaucaaguucuaaucuuuuugcugauggagggucuuggcaucguuguugauaugugcugagugaucaggguggugguugcugcagguugggguggcuguggcaguuuguuaaaauaagaaaacauugaacuuugucgcaucaguggacucuuccuuucaugaaagguuucucuguagcauaugaugcuguuugaaagcauuuuacucacaguagagcuucuuucagaaauggagucaguccucucaacccugccacuacucuguuaacuaaguuuacguaauauucuaaauuuguuguuaucauuuccacaguguucacagcaccuuuaucaggaguagauucuauuucaagaaacuccuuuuggccaggcacgguggcucacgccugugauuccagcauuuugggaggccaaggcaggaggauuacuugagcccaggaguucaagaccagccuggacaacauagcgagacccccuaucuuaaaaaaaaaaauuuagcugaguaugguggcaugcaccuacccuggaggcugaagugggaggaacacuugaaccugggagguugaggagguugaggcuauggugagcugggaucauaucacugcacuccagccagggugacagagugugugugugugugugugugugugugugugugugugugugugugucugucugucugucucugucugucugucugucucugucucucucugugucucuuuuuuaaagaaacuacuuucuuugcucaucuauaagaagcaguuccuuauccauucaggcuccacuucuaauucuguuucuuuugcuguuuccagcacaucuacaguuacuuccuccauugaaaucuugaacccaucaaagucaucuauggggagggaugggaaucaacuucuuccagacuccugcuaaugucgguauuuagaccucaaauguucuuguugccuaggcuggagugcaguggcgugaucucagcucacugcaaccuccgccuccuggguucaagcgagucuccugccucagccuccugaguagcugggauuacaggcaugcgacaccaugccuggguaauuuuauauuuuuaguagagacaggguuucaccaaguuggucaggcuggucgcgaacuccugaccucaggugaucugccuacuucagccucccaaagugcugggguuacacaggcaugagccacugcgcccggccuuuugaccucaaauguucuuaauggcaucaagaaugaugaaucuuuuccagaaggcuuucaauuuacuuucccgagauccaugagaggaaucacuauuuauggcagcuauauagucuuacaaaauguauuacuuuaauaagauuugaggccgggugcgguggcucacgccuguaaucccagcucuuugggaggccucgguagguggauuaccugaggucaagagucgagacccaccuggcuaaccuggugaaaccccgucucuacuaaaaauacaaaaauuggcugggugcgguggugugugccuguauucccagcuacucaggagguugaggaaggagaaucacuugaacccagaagggggagguugcagugagcugagaucgcaccauugcacuccagccugggugacagagugagacucugucucagaaaaaaaaaaaaaaaaaagacuuggaagucaaaauuacuccuugaugcauaggcugcagaauggauguuguguuagcaggcaugaaaacaacauuaaucugcuuguacaucuccaucagagcucuuggguaaccaggugcauugucggugagcaauaauauuuugaaaggagucuuuuuuucugaacaauaguucucaacagugggcugaaaauauucagucgacugugcugugaacagaugugcugucauucagacuuuguuguucuauuuauagagcauagacaguagauuuagcauauuucuugaggucccuaggauuuucugaaugguaaaugagcaauugcuuccacuuaaaggcaccaccagcauuaguuccuaacaagagugucagucuguccuuugaaacuuugaagccagauguugaugaaaguccuacaucugaaaguccuacauggcaucuuccucaauagaaggcuguuucacggagauugaaaaucuguuguuuaguguagcuaccuuuaucagugaucuuagcuagaucuucuggauaauuugcuacacuucuccaucagcacuugcugccucaucuugcgcuuuuguguuauggagauggcuucuuuccuuaaacuucacgaaccaaccucugcuagcuuuacacuuuucuucugcagcuucuucacuucucuuggccuucauagaacuaaggagagaguuagggccuuucacuggaguaggcuuuggcuuaagggaauguuguggcugguuugauguuuuauccagaccacucagaccauguccauaucagcaguaaggcuguuuuugcuuccuugucuuuugugcauucacuggaauagcacuucaaauuuccuccaagaauguuuccuuugcauucguaacuuggcuguuuggcacaagaggccuagcuuuuggucugucucagcuuucaaagugccuuccucacuaagcuuaaugauuucuagcuuuggauuuaaagugagagaugcguaacucuuucuuucacuuguacacuaagaggucaucguaggguuauuaauaugcauaauuucaauguugucauguauuagggaauacagaagcccaaggagagggagagagacuagggaauggccuguugguggaguagucagaacacaugcaacaguuaucgauuguuuacugucuuaugugggcacaguuagugauuccccaaaacaauuacaguaguaacaccaaagaucggugaucacaggucaucauaacagauaacaauaauaaugaaaauguauggaauauugguuuaccaaaaugugacacagagccauuaagugagcacauggcuguuggaaaaaugacaccgauagacuugcucuacacaggguugcugugagccuucaauuuguaaagaacgcaaauaucugugaagcacaauaaagcaaagugcaauaaaacaggguaugccuguagaauucuaugcaaucugcuacuuuuuuauugcugcaccuuuauguaguuggaggacaugcuauuuugagagcauguaaagagagaccuagacuugaaaauuagguuuacauaugaggcuacguguacuugcuacuuagugguuguuaaacaauaaaucuuuuaacuuuuaacacuauguuagacugugacuauagcuuuauuuuucacauauauauauauauuuuuuuuuuaauuuuauuuuuugagacagggucuugcuuugucacccaggcuggagugcaguggcagaaacaugguucacugcagccccaaacuccugggcucaagugauucuccuaccucagccuccugaguagcuggaacuagaggugcgcgccaccacgccuaacuauuuuuuguacuuuuuuuagagacagaggucuugcuuuguuucccaggcuagucuugaaccccugggcuccagcgauccucccgccucagccucccaaaguguugagauuacaggugugagccaccaugccuggccacuuaaaaauuuugguuaugaagguaaugaauccaaggagauugaucuuggauauguguuuucuuuuuuggaagggagggcauguggcaacuagacuguguuagcaaacuagcuggugagaguaaucuaguaaggugagagaagagaaggauaaucuaaggauuuaaguccuugaaaacaugugcuucauuuaguguuguguagaugaccugggcauugauagguaguuagcagcuugauuaauguguaauagggggaagaggaaggagaaaauggaugcagggguaugcaaauguauucaguauauuuuaauauuucaagcuggugguuucuauuuccuagauguguuuuguuauuuauuuuuugaaauccucuuugaggcuuuuuaaggcauguugccacuuaaaauaaauucucucucucucucuuuuuuuuuuuuuuuuuugagacagagucucgcucugucgcccaggcuggagugcaauggugcaaucucggcucacugcaagcuccgccucccggguucacgccauucuccugccuuagccucccgaguagcugggacuacaggcgcccgccaccacgcccggcuaauuuuuuguacuuuuuaguagagacgggguuucacuguguuagccaggauggucuugaucuccugaccuugugauccgccugcuuuggccucccaaagugcugggauuacaggcgugagccaccgcaccuggcuaaaauaaaauucucuaucuguucucuucauugucuuucuccaaguccaaaacuagaaucugucucuaauagcccucucccuuccucuccaacacauacucauacccucaagauuaccaguuuauagagacauuuguuaccuuuggcuaccuccuucuccucucuuuggaucuaguacaggauaagagaacuacuaacccugggcaaauagacauuuauuuuuagagaacacauuauaaaccauaacuuccugggaguaaaccauguaguaaauguguaauucugugagugaacugcucagguauauguacauaggcgacuuacuggccuuguucuucugaagacagcccuguaauuauuugcccugauucauagucaucuuuucuguguaaaguuuucugagcuuggcauuucucuugaguuuaguuccuuuaaaaaaaacaaacaaaaaaaggcuucuauuucuauaguagaaaaugguagaaccuguuuuguguguguuuugggcugugguuuuucuuacccuuaauugucauuuugcucucaucuacuuucugucuuacaagaauuccaagaaacaauuuuggucugaagaugguauaauuugguaaucauuuaucuuuucugugauuccagaugaauuugaugcagaaggaaaaaaggcuuuguaaaauauuuucuuagcuuuucuggcuggugauaugaaugaagaguuuaaaaaaaugucaugucacuuuauuuggucauuuuacuuguaggaauuuauuuuaagucuuaaaauaguaauuggauaggggauugugggaaaauggaggcucacugcagucagucuauuguuguagguuauguuccucaguaaggaguuuccuuuauguucaacagcuuuggaagguggaggguagaaccaguauuggacagaaggagaaguuaagcugugacagccuuuacuaacuucaugggaugcucuggagccagaauggcccuugagagcuauaccaaguugggccaagauagccaggccuuuauacuccaauuauuccauauugaacaugggccagccugagaagaacugugaccagggacaaguuggcucucugcaacugaggcagcuucuguagaaucucacagauagaggcuuucagcaagcaggauucccagcaguucuuucuugaagugggauaugagugcuucuuuacagugucuacuauaccuccuuuuuacuccuaacucuaaagcuaacccaugaaccuccgaagccaaauugcugauggggcucucagauagcuuauaagccuuaaaccauggagauuaugcagugauuucacuucuuuggguuggaggacacccugagagauacauaacccugggcugaagcccaagcauauguauuuagaugaauauaugugauggaucuuaggagcaguuaauagaaaauaaguguaaauaucuauaaauaugugguaaaauauagguaaagagagucacggagguuaaauuaguugauuagaaaaucagguagcagcugggcacaguggcucacuccuuuaaucccagcacuuugggaggccgaggcgggcggaucaccugaggucaggaacucuagaccagccugaccaacauggagaaacaccgucucuacuagaaauaaaaaauuagcagggcgugguggcgcaugccuguaaucucagcuacuugagcggcuaaggcaggagaauugcuugaacccaggagguggagguugcggugagcugagaucacgccauugcacuccagccuggacaguaagaaugaaacuccaucucaaaaaaaaaaaaaaaaaaauuagguagcagauuauuucaaaguacauagcaaaauuauaaacagaaauuacgaggcaggagacuuaaaggauagacaguaagaacuucagaaguaaaaaauuagaggaguguaauaaucauuccugacauuaauaugaaaaccuugaaacucuuaaaaauuguuucuucauauuuuugagcuggaaguuuucccaauuauaaguucccugaaauucuagccagugauagauuuuucuugcauucuuccuucccucaaguaauuggucguuuguugcauuucugucacuuuugggcaaaauaugcuuugguuguuucaauucuuaagcaguuacaaauggccagggcaaguuacaugccaagagcugccaauguggagaagccuuaaguuagagcuuggaggguuuucuuucucuuuuuaucuuuuuuuuuuuuuuuuuuuuuuuugagauggagucuugcucuguugcccaggcuggaguccaguggcgcgaucucggcucacugcaagcucugccucccggguucacgccauucuccugccucagccuccugaguagcugguacuacaggugcccgccaccacgcccggcuaauuuuucuauuuuuaguagagacaggguuucaccguguuagccaggauggucucgaucuccugaccuugugauccgccugccucggccucccaaagugcugggauuacaggcgugagccacugcgcccggcccucucuuuuugucuuuuguggguugaaugacaguacucuauccuggaauauuuauaguauaagaacaugaaauguguguuuuccaaucauagauuuuguuuggcuucuccaaaauugucaauuuuuuaauccauuuucuguaaucauucuaaaacagguuuuaagcauuguaugaggauguccaaauaaaugauuucccucauucuguauuaaggacuuuagaaaauucuaguuacaguagacuaggaauuuuuuuauggauaacuaccuuaaagauuagaaauaaggacugugcuuuggucaaaaggauuuuacuagagagacuuuggugaggugauggguacuugcauacugcaccuuuagaguuuuaaugauuuuuuuucugauuaagaaacagcacguuaagauccuucuuaaaauaagaugcuaagcauaaugaggguagaguauaauuguuuauaaaauguguaaacgaguagaaagaucacuauggaagaaauggaacaaaugcucauggaagaaauggcucaauuacaaaucuguuccugccauuuagaguauuaacuuugugacuuugaauuugagcauucauauuuauuucucaguucaccauauuuuuguauggaugccauguuucucccaacugauaauuacauggacuucuuuuuuaaaauauuuuauuuuuucucuuuaauuuuuuauuucuuuggggguuuuuuuguaacaucuuuucacaucacauggacuucuuauacuucaguuuuauuugcuuuagaagacaucauacugucuuuuuaaagguuccccaauccuaaaagagaauuuuaugaagccagaugauauauauaauuaaucaaauuauugaaaguaugcccuccaaauuuguggaaauucuguaauaucauuacaagggcaaucuccagguuugauauggugacugcacaaaauugucagggaccaagucuucuguuuucagcauguuuuuagguacaaguauuaaauaccugauucuagcuuaaacaauaaggacauuuauuaccucacauaauaggaaguucauagguggauuuuucuccaggcaugguuugaagucuagaaggauccaguuacuuuucagucuguuucuucugugcugugggcuucaucccaagauaguucccucgugguggcaguugguaauauaugcuuccuuguucacauccauuaguagacagagaaccuuuuucaugucugucaucuauaaaucaguggugauugggccaccugagcucaugugcccauuucuggacuaaaacaaucaccgagauugccaggaaacugauaaccuuuucaaaucaauaacggggauugagagugugguuagaaaugaaugugagaaaaucagccacaccauugacuacacaaacucuugcuugacuauuuuuuuucuacagcugguuugauaaauuugguuugcuuuucuuuuuagaagaccauuaauuaaugaccuuuauaaacuagcuacccucaugcaugaagaacuaggaaaugggagauggcuuaaaaccaguucuucaccacaacuggaaaaauuucucauagucuaacguccuuccagugauagguugguuggcaucaucuuuaugcaaaaaagaugagcauuauucauauguaaaaguuauuuuuucagauaugugaugauguuuuuggguaauguuucuguaauuugaacauauucagaauguucuuuauaugauuuuauauauauuuuggcaauuuacaguaaaaugaaaacauuucauauagaguuucagaaaacauuaacuuccauuuuugguaaaucuucuuuuauucagcaucucauauauuguaaggucagccgagagaaaggaaaaauagacccaaagucaggcgaguaaguuuauugaaccugcuggcugcuccaccacagacagaggaggcagcccugagcuuacaaaaugagggguuuauaugggggagagagacccuggggucguuuguugguuaacuuugccauauauaaccuugugacauuuaugguagcagccagaugaaggaacuuacaggaggguuuagguaaaguuuguuuaugcuucccacgaccuccccugugcagucuggaugguuuguaauugggguuugcuuaucgcagcaaggucugauaagugaagucugcuggcuccacuggggcgccuggauaagagcuuagaaaaguaaagaggcugggggaagggugaacggcacagagaaggguugcagggcguuaaggcaaggggugggcaguacgcagggguuuggggggaguguuggcaauaccaagaagcuuuuuuggggcgguuugucccuaacauauagucagaagauaauguuuuauuuacugcuuuguugaagaaacaacuuggucacuagugaaggguaacaugcaguguguuguaaaauguuuuuugcuaguuucugauccuuaaauugagcagcauauuauacuuaaguagaaugucuaaaaaccuauauaugguuuaaagacuauuaaaauugacaccugucuaccuacucuacaaguuaagaaauagaaugauacugcuaccacaagccuguguucucuccaguugcauccuccucccuuccucuguagguguaacccaugccuggcugugauguucaguguucucuugccuuucuuucuuuuuuuuuuaauccacugauaaaaguaucccugaacaagauaccguuuaucuuuggaaagcugaauagcaggcacgaacauagcuauguaaggaaggggccauauugucacuauuuagaggaggcucuugggagaaguaaaacuaaagaagagauuuuagcguuauaauguggcuucugguuccucaauaguuuacaagagccacuuuuggggaaggcagugugcuggggcaugugugacucuuggcaaacauaauacccauaauuaggacauaugacaugaccaauaugaaccaggaaaaucuggucaggaauaugaacagagagaguggguuauucagaaguaaaucaaaucaggccggucaugguggcucacaccuguaaucccacacuuugggaugccaaggcagguggaucacuugaggucgggaguucgagaccagccuggccaaaauggugaaaccccgccucuacuaaaaauacaaaaauuagcugggcaugguggcacgcgccuguaaucccagcuacucaggaggcugaggcaggagaaucacuugaaccugggaggcggagauugcagugagccaagaucaccccacugcauuccagccugggcaacagagugagaccccaucucaaaaaaaaaaaaguaaaucaaagcagaacacuuaacacuucugggagccuucacaucaucuauuuuguagaauauagaggggagaauagaaacuuuaucagaacauggucaaaaaaaagccaagcccaguuaagaaucugggccagguuuaucuggguauuugguccucagguugagaagagguuacaagagcagcagaauuuuaaugauaagccucagugacuuggaucuggggcauagcugcuguccugggaucacccuuuuucuucaucuuggguauucccauggccucuugucucuguugugucuccugcuuucaauaaaccauaucuucuucuuucuuguauauacucuccuuuaaggggagcauauuugucagauuuuucuucaggaaaguuauuugggagauaauuuucuuuggagacuuugcguaucagaaaauaccuuuauucuagccuccuaauagaucgcuugacuggauauauaauuuuagguuggaaauaauuuuccuucagaauuuugaaaacauuguucuguugccuuauuucuagaauuacauaucuguuguaggacccuucaaacuaccaagucauagccuucuuuucugggaauauuuuuggaauuauuuccugaauuuucuuuuuuccuuuuauucuuucuuuuuggggcucuauuauugauauguuagaccuccggggcacaguuuuucuaauuuucuguuuuuguccuuuuuguuuauuuuuugagagauuucuucaaauuuaauuuuaaucuuuuuauugaauuauuuauuucugcuaucguacuuuaaucuaccgaauuuaauuuuuuuuagagcauccuguuuguucuccugcacacacccccuuuucaucccccucaaugaaaacaauauuuucccuuaccuaagacuaguaagaauuuuuugaaguauauuuuccccugcauaguagucauuauuuuuucuuuuagguugucuuuuuuucuuuuguguuaguuucuucuugguuagaggcuuucuuuagaugucugauaauucuuagcuguccauauuucauaauuggaauaauugagaacuggaggcucugaacaugggauugcggaucucugaauaugauauccauggccuuuuguuggagaaucucugcauuuuuuggucagauugccugaacaacaucaaguguugagugagagaguugagggagccaauugcuucucaaauaguuuuuauccuggucuuccauaucuuagcuugugaauuguaaaccacaaauuaaaaaaauccuuuucuagcugaucagaaaaauauuaugcccccauguuuucaucuaguagucuuaugggcuucuuuuuauaucuaacucucuuaauccuccacgaguuuugaucuuugaggaaggucgaguugaucuaagggguuagccuagaugcuguucaagugcagaucugagauuugaccaugguuuuacguuucugaacugaggggggcccagaauuuuaaguuguuuggucugaaauaucacuaucuacugggagguggguguggugggaaucuuguuaccguguuuguuaaguguauuauugacuuuaaagugagacauaauuaugacucauaauuauuuuccuuucagcauuaucugcauaccagagguacuacaguuuacagucugacuacuggaagguuaguguacauuugcaugcugauuucauguuuguguuuugggcagauuauugccaauuauacucaaaauuaauugagcucuugcuuuuuuuuguuaauuacuuaaaauauugcuucuaggggaaagguauuggaaaaggguugagaguauuuauguuugugcugucuuguaugacucuccuuguauuuuauuaagaauuagaguccucugacacauuuuacuggucaaauguaauagaagugugauaaguaaaaaucaagcaaaacuaaacaaauaacaauaacaaaaugauuccuugguuuucuuuucuaaaguugguaccugggaguaaaagaaggcugaagacguguauaucaggcuaaaaugggaagguguaaugggaaaguuaugauaaacucuuucuugguguacucuguuuauaauuggagcuuugaggagagcugaaccuauuuuuuagaagaccuaccuaaaugaaagacugugcauagcagugaaacaauuaaucauccacuuucuuaucuuaauuuaagcagugauuaagcaugaucuuuuacaucauguuuacuuuuaaguuuauugagcagugaguuuuuuuuuuuaaaucugaauugcuguuucagauuuuuuguggauuuuauuuuucuauugguuaauuugucuuucuuuuugaaguagguacuuauuccagucuuauauagacuggcuuugucuggaaaagcccuucaacagucagccuaugcagagauuuugagaacaccguguagagguuuuagacauauauguauauauauuuuuucuuuuuuaagucuuuugaaaauaucuucucuaaucucuggcuuuuuuuuaaaagcuuuaucacaugcuauaaaauuauagcuuaauucacaugcuauaaaauuauagcuuuauucacaugcuguaauucacaugcuauaaaauucagcuguuuuaacuauacaaaucagugauuuuuaguaaauuuucagagcugugcagcugauagaggcaggaggcagacaaaggucuagacagauagggaagggucccuggagaaucacugauccacccagcccacagguguuuacaccagauguuuugugcagauaagggaaccugcacagggggcuugccugggcaugccugcaguggacuggagguacacaugcacugggggaaugggguggagccaccaauaauuugagccuuauacaggggaggauccuggccucuucaacugugugcuggggcccugguauucaguuugugagguggaaaccugcuggcaggacccccuuucuuugcugauagcuuuccuuuugcuuaauaaauuuugucuuccucacccuucaauguggcugcaugccuaauucuuccuaguugugagacaaaaauccagauuagcugagcuaaggggcaaaaaauccugcaucacagccaucaucacagucuuauuuaucucccuggaaugaaaccucacauauauccccagcccuggcaaccaccagucuacuuucugccuuuauauauuugucuuuucuggauauuucauauaaauggaaucauauaauauauggucuuuuguggcuggcuucuuuaacuuagcauauguuuucaagguucauauauguuauagcaugaauauuuuauucuuuauuuccugauaauauagucaccccucaguauccguggggcauugguuucaggaccccucauggauaccaaaauccauggauacucaaguucuuuauauuaaaugauaaaguauuuguauaucaccucuacacauccucccauauacuuuaaaucauuucuagauuacuuauaauaccuaauaaaaugugaaugccauguaauugauugcuauacuguauugcuuuuuaguuuguauuauuuuuuauuauuguuauuuuuuuccugaauauuuuugaucugcagaugcggaacccauggauacaaagggcucacuguauuccauuggaucaauauaccacaguuuguuuauccuuucaucaguugaugggcauuuggguuguuucauuuuuuggcuauugugaauaauacugcugugaacauuuguguacagguuuuugugugacauaauauuuucaguuuucuuggguagguacugagaaauggaauuguuggauuauaggguaaaucuguguuuagcauuuugggaaacugccaaaacuuuuuuucccuaugucuguaccauuuuacaucccugccaguaaugugugaggguuccaguuucucuguauccuacucagcacuuuuaauuaucuaauuuuugaguguacuaguuuuuuagugugccuagugggguagaaaauaaaguuuuaaacuuugauaaaguccaguuuaucagcuuuguaacacaacuuuuuauugcuuguguuuuuguuguuguaccuaagaaaucuuugccuaacucaaggucaugaagacuuacuccauaguuuauuuaaucaggugcuucagugcuuugcuuuuacagagugcugcaguaaauagucuaguaaaagugucucucucucuauauauauaguuuuuuagagacaaggucuugcucucuugcacaggguggagugcaguggugcaaucagagcucacugcagccuugaauuccugggcucaagugaauccuccugccucagccucucgaggagcugggacugcagaugcacaccaccaugcucggcuaauuuuuaaguuuuuuuuuugcagaaauagaaucucacuauauuacucaggcuggucucaaacucaaucacuggccucaaguaauucucccaccucggccucccaaagugcugggauuacaggugugagccaccgcacuuggccugucuuuuaauacuuuuguuagugauucuuuaguauagauuccuuuaaaagugggaucauuguguugaaggguauuugcuccuuugggauugaaccauuugcauuuauuucaacaauguaugcaagugcuuguuucuucuuggucuuaaucaagaaccuuuuugucagcagacuugccaguuugauaggugagaaaugguauuuuauuauaauuuaaauuuacauuuucuuaguuguuagugagauugaacuuuuuaaaaauugaaguguaaagacuauuugaauuucuuuuucuuugaaauauuuguucaugucucuugcccauuuuuuuuauuaggucauuguuuuacuguuuuauguagcuauauaacauguauuaggcauauuuauccuuuaucugugacauuaguugaagcuacuguugcccaguuugagauuuguuguuuugcuuuguuuuuguguguuuguguuugccugugcagaaguuuucuauuucuguguagucagauugaucagucuucuacauugcccuuguauuuugaaucauaggauggguuuuuuccucauucccagguguuagagaaauucacccacauuuucuuucaguacuugaaugguuuaauauuuuacauuuaaauuucugauccguuuggguuuuauucuugacuuacagugugaacaauauuuaagauuaucuuuuuucuuaugacugguuaucccaaagauauauuuuuuaaaaauucauuuuuuccucugcugauuugagauguugccuuaauuguauacuaaauauucauaugcaguuuugucugugcauuuuguggcaugcuuuguucaugaacuaauacaaaaguauuuuacuaacagagauuuuauaauauguuuuaauguaugguagugcuagggcacccuuuccccacuguucuugcuucuaggauuuuccuggcugucguugguggcuuguuuuuccaaauaaacuuucuaauuaacuugucuagcuucacaaaaaauaccugauaauuuauuuucuguagcuuuuuugagauauauuuagcauuauuuuaagcauuuuuugagauaugauuuacauuauuugagauuugacaacuuaaauaguuguauaaccauuaccauaaugaagauauagaacauuuuccaucacccaaaguguucccuugugccauuuuccuacucuugaucucuggucccaggcaaccacuucucugcuuucaucccuuuaguuuugucuguucuggaauaucauguaaugggguuuaaacagcauauauucuuuuguuuuugauagcuuucauuuggcaugcuuuuacugagauucauccauguuguguguaucaguaguauguucuuuuucauuguuaaguaggauuucauagaauggauaugccacaguuuuucucaguugauaaguauuuggguuguuuucagcuuuugguuaugaauaaagugcugugaauauuauuugucuuuguguggacauggauuuucauuugucuugguauauauaccuaugauuugggaaugcugaauugcuuugcaguuuuagguuuaaccgucagacuuuuucaaggugguuauaccauuuuauauuccaaccagcagugaaugagauuucagauguuccauaucuucguuagcacuugguauugucagucuuuuuaacuuuagcccaucugcccauucuuguuuuuucuucuuucuuguuuucuuucuuucuuuccuccucagucuuuuuaacuuuagcccgucuaccuauucuccuucccuuccuccucucccucccucccucuucccuucuucuuucuuuucuuuccuucucuucuuccuuuccuuccuguuguucuuccuuaucuucuuccucuucuucauugaguuuuauggguucuuuauauacucuggauaaaugcccuuugucagauacuuguuuuggaauuauuagucucugguucaucuuuucauuuucuuacuagugucuuuugaagagcaaauguuuauuguuucaaugagguccauuuaauuacuuuuuuuuucuuuuacaguuugugcuuuuugugcuaggaaaucuuuguguaucccaagaucauaaaauauuuccucaccuuuuaaauucuguuuuggccugugauacauuucaaguuguuuaugaugugagauagcaucagugguccccccacccccuaccccaauagcuaccuaguuuuuccagcauuauuuguugaaaagacuacacuuugaaaaucuagcauuucuucuuugaaaaauaucaacguacaauuuaguuuucuguuucuagauucucuguuacguuccagugaucugugugucuguuuuuaagccaauaucauaguuuuguuuacuauguucuugaaaucaagcaauguaaguucccuguauuauuuuuuucuuucuuucuuuccuuuuuuuuuuuuuuuugagauggagucucucucugucgccuaggcuggagugcaguggcacgaucuuggcucacugcaaccuucgccucccggguucaagugauucuccugccucagccuccccaguagcuggaacuauaggcccacgccaccacgccuggcuaauauuuuguauuuuaguagagacagguuucaccauguuggccaggauggucucgaucuccuggccucgugauccgccugccucggccucccaaagugcugggauuauaggcaugagccaccgcccgcaucuggccccaaguucccuguauucuuuuucaaaauugcuuugguuuuucuaggucuuuugccuuugcauauaaagugcagaaacgguauaauucaguauaauucugcuaggauuauauuggaacuacaugugcuaaguuaggaagaauuugucaucgguaauauugcauuugcuuguucgugaacauggcguauuucacccuguauuuagccuucuuuaagacucuacagcaauacuucauaguucuuaucacauauguuuuacguuuguuuuuuuuuaugcuauugugauuggagugguuguaaaauuuuauuuccaauuguuuuauugcuauuauauaggaacauuuauuauugcaugcugaucuaguauccuacugucuuacuaaauuauauuguucuagucauguuacucuagauaggauuuucuacauacauuaugcggucugcaaauaaagaaaauuuuauuuuuuguuuucuuauuuguggaugcccguuaguuuuuuucuugccuuguucaacuggcuaggaccucccauacaauguugaauggaaggggacauccuuguuuuguuucucuggggaaaacauuacauuuuuacuguugaaugugauacuaccuguaggguuuuuguagacuaauauugaagauguucccuucuguugcuaguuuacuucgagggcucuucccucuucccccuacuucauguuuuuauaaugaauagugugaggauauaggaaaaaacucaguuccuccuauacucucacaacacagaacauuucuguaacaaaauguguguggguuuucccccugcauaccuggcaagcaaucaguucugcaguggcugcugguguccucuaauucaguucaauucugacauuaucuaccuggagauaguuucagaucccacagagugagagcuaagucccacaagacuacccccacuucagaugccauugcaggccuccggaacuuuugaaugacuggcuauauaaaucgggguucccaugacccucuccuugguuccauuaaucugccagaguggcacagaccucagcaaacaguuaggguuuacuguuuuauuauaauggguacagaugaagagaugcauaggaugaggucaugugggaaguggcauggagccuccaugcccucucugggcaugucacccucuagggacuuccgcuugugcagcuauccagaagcucuccaaacccuguccuuuuggguuuuuauggaggcauuauuauguaggcaugacugauuaaaugauuggccacuggugaucagcuuaaccuucagucccuuuccucuacccagagguuggagaauggggcugaaaagucccaacguucuaaucaugcuuugcucuuugcugugaccagcccccauccugaagcuacauagggggcugccugcccugaguuaucucauuacagcccccaaccugaagcuacauagguggcugccugcccugaguuaucucguuagcauaaaagagacacucagggcugggcgcaguagcucacccaguaauaaucccagcacuuugggaggccgaggugggcacaucaccugaggucaggaguuugagaccagccuggccaacauggugaaaccucaucuccgcuaaaaauacaaaaauuagcugggugugguagugcuuccuuguaaucccagcuacuggggaggcugaggcagagaaucgcuugaacccgggaggcagagguugcagugagccgagaucaugccacugcacuccagccugggcaacagagucuaaaguaaacaaaaccgaccuuuuucuuauuuuuuuuuuccacuuuaagaaaagaaagaaaagguuuugaauucuggaagcaaugccuaucugaauagaaccauugauuaaacguuaugguaacauggaaggauggagaacaguguuucaguuugaaaaacuaguuggucuguuacaagauaugcaggauauguauuuuuuuguacauugauugauuaaaguauuuguggguacaguuucuuaaaauagugaucaauucauuauuuuuuuauaacccuaauuuuauaaaggguuugauagaguugugcuaaaauuuaguuugggacaccgaaaaaaauugauuauuaaauuuaacauacauacuaucuauaugaauguaaauaucagcuuuauaauauuacugcugaagaauaucacauaguauuagguuggcgcaaaagugauuaugguuuuugccauuacugcaguuacuuuugcaccuaagauucaguuuguugaagagauuaauucacauuuuuuggguaugcuaauuauagauaauucuuauccuuaaaacaguuucacuaaaaaguucuaaauaauacuguuuuacugccugauucagcauaugcuugaaaauuauacuguacuucuuaccagcccugaauuugugcuggccguauuuuccuaauugggccugauugguaagguuuucuucuguauggucuuauuuuuucaucaguauuguacuggugugggauuauggguuaaugucagguaggagagaaauguugaagagagaauuuuuguaacaggagaacucaagguucuucuaauucagauuuguuuuuugaauucagaaauauauucaguauuuaaauguaucagucuggaaaugcuucauaauaugaaaauauuuagaaccuguaaggaagacagaacuauaauuaauauuucaacaaguuuauugcuuaaccugaauuuuuuuuaaaagccuaacuuuuuugcuuagaagagaccaagagagugagcucuuuuaaagaaaaguuaaaaagcaguauauuuuggaauaaggauuagauucuuuggaaauuuuacaaguuuagaagcagaacacaucuuagaaauuauuaucuaauuccuuuacuuuauggacuagacauggugcaucccggugauuaaggaagccccccaagucagcacaaauagguaguggauaaacuaguggaaucugugcucauuuucugacuuuccgguggcuuuuucaguuauacaguuuaggcuagucuggcuuucacauuuguugacagggucucuuuugacaaugcagaaaugaauaagauaguuccugcucucccuuauuuauuuauuuauuuauuauacuuuaaguuuuaggguacaugugcacaacgugcagguuaguuacauauguauacaugugccauguuggugugcugcacccauuaacucgucauuuaacauuagguauaucuccuaaugcuaucccuucccccuccccccaccccacgacaggccccggugugugauguuccccuuccuguguccauguauucucauuguucaauucccaccuaugagugagaacaugugguguuugguuuuuuguccuuaagauaguuugcugagaaugaugguuuccagcaucauccauguuccuacaaaggacaugaacucauuuuuuauggcugcauaguauuccaugguguguaugugccacauuuucuuaauccagucuaucauuguuggacauuuggguugguuccaagucuuugcuauugugaauagugccgcaauaaacauacaugugcaugugucuuuauagcagcaugauuuauaauccuuuggguauauacccaguaaugggauggcugggucaaaugguauuucuaguucuagaucccugaggaaucgccacacugacuuccacaaugguugaacuaguuuacagucccacuaacaguguaaaaguguuccuauuucucuacauccucuccagcaccuguuguuuccugacuuuuuaaugauugccauucuaacuggugugagaugguaucucauugugguuuugauuugcauuucucugauggccagugaugaugagcauuuuuucaugugucuuuuggcugcauaaaugucuucuuuugagaagggucuguucauauccuucacccacuuguugaugggguuguuuguuuuucucuuguaaauuuguuugaguucaucguagauucuggauauuagcccuuugucagaugaguagauuguaaaaauuuucucccauuuuguggguugccuguucacucugaugguaguuucuuuugcugugcagaagcucuuuaguuuaauuagaucccauuugucaauuuuggcuuuuguugccauugcuuuugguguuuuagacaugaaguccuugcccaggccuguguccugaaugguauugccuagguuuucuucuaggguuuuuaugguuuuaggucuaacauuuagaucuuuaauccaucuugaauuaauuuuuguauaagguguaaggaagggauccaguuucagcuuucuacauauggcuagccaguuuucccagcaccauuuauuaaauagggaauccuuuccccguugcuuguuuuucucagguuugucaaagaucagauaguuguagauaugcagcauuauuucugagggcucuguucuuuuccauuggucuguaucucuguuuugguaccaguaccaugcuguuuugguuacuguagccuuguaguauaguuugaagccagauagugugaugccuccagcuuuguucuuuuggcuuaggauugacuuggcaacgcgggcucuuuuuugguuccauaugaaguuuaaaguaguuuuuuccaauucugugaagaaagucauugguagcuugauggggauggcauugaaucuauaaauuaccuugggcaguauggccauuuucacgauauugauucuuccuacccaugagcauggaauguucuuccauuuguuuguauccucuuuuauuucauugagcagugguuuguaguucuccuugaagagguccuucacgucccuuguaagguggauuccuagguauuuuauucucuuugaagcaauugugaaugggaguucacucaugauuugacucucugucuguuauugguguauaagaaugcuuaugauuuuugcacauggauuuuguauccugagacuuugcugaaguugccuaucagcuuaaggagauuuugggcugaaacgaugggguuuucuagauauacaaucaugucaucugcaaacagggacaauuuuacuuccucuuuuccuaguuugaauacccuuuauuuccuucuccugccugauugccauggccagaacuuccaacacuauguugaauaggagugaugagagagggcaucccugucuugugccaguauucaaagggaguguuuccaguuuuugcccauucaguaugauauuggcuguggguuugucauagauugcucuuauuauuuugagauacaucccaucaauaccuaauuuauugagaguuuuuagcaugaaguguuguugaauuuugucaaaggccuuuucugcaucuauugagauaaucauaugguuuuugucguugguucuguuauaugcuggguuacguuuacucauuugcguauguugaaccagccuugcaucccagggaugaagcccacuugaucaugguggauaagcuuuuugaugugcugcuggauucgguuuguccguauuuuauugaggauuuuugcaucgauguucaucagggauauuggucuaaaagucucuuuuuugguuguaucucugccaggcuuugguaucaggaugaugcuggccucauaaaacgaguuagggaggauucccucuuuuucucuugauuggaauaguuucagaaggaaugguaccagcucguccuuguaccucugguagaauucggcugugaauccaucugguccuggacuuuuuuugguugguaagcuauuaauuauugccucaauuucagauccuguuauuggucuauucagagauucaacuucuuccugguuuagucuugggaggguguaugugucaaggaauuuauccauuucuucuagauuuucuaguuuauuuguguagagguguuuauaguauucucugaugguaguuuguauuucugugggaucgguggugauauucccuuuaucauuuuuuauugcgucuauuugauucuucucucuuuucuucuuuauuagucuugcuagaggucuaucaauuuuguugauuuuuucaaaaaaccagcuccuggauucauugauuuuuuugaaggguuuuuggugucucuauuuccuucaguucugcucugaucuuaguuauuucuugccuucugcuagcuuuugaauguguuugcucuugcuucucuaguucuuuuaauugugauguuagggugucaaguuuagaucuuuccugcuuucucuugugggcauuuagugcuauaaauuucccucuacacacugcuuugaaugugucccagagauucugguauguugugucuuuguucuuguugguuucaaagaacaucuuuauuucugccuucauuucauuauguacccaguagucauucaggagcagguuguucaguuuccauguaguugagcaguuuugauugaguuucuuaauccugaguucuaguuugauugcacuguggucugagagagaguuuguuauaauuucuguucuuuuacauuugcugaggauugcuuuacuuccaaguauguggucaguuuuggaagaagugggguguggugcugagaagaauguauauucuguugauuugggguggagaguccuguagaugucuauuaggucugcuuggugcagagcugaguucaauuccuggauauccuuguuagcuuucugucuuguugaucuggcuaauauugacagugggguguuaaagucucccauuaucauugugugggagucuaagucucuuuguaggucucuaaggacuugcuuuaugaaucugggugcuccuguauugggugcauauauauuuaggauaguuagcucuucuuguugaauugaucgcuuuaccauuauguaauggccuugucucuuuugaucuuuguugguuuaaagucuguuuuaucagagacuaggauugcaaccccugccuuuuuuuguuuuccauuugcuugguagaucuuccucuauuccuuuauuuugagccuaugugugucucugcacaugagauggguuuccugaauacagcacacugaugggucuugacucuuuauccaguuugccagucugugucuuuuaauuggagcauuuagcccauuuccaauuaagguuaauauuauuaugugugaaucugauccugucauuaugauguuagcugguuauuuugcucauuaguugaugcaguuucuuccuagccuugauggucuuuacaauuugucauguuuuugcaguggcugguacugguuguuccuuuccauguucagugcuuccuucaggagcucuuuuagggcaggccugguggugauaaaaucucuuagcauuugcuugucuguaaaguauuuuauuucuccuucacuuaugaagcuuaguuuggcuggauaugaaauucuggguugaaaauucuuuucuuuaagaauguugaauauuggccuccacucucuucuggcuuguauaguuucugcugagagaucagcuguuagucugaugggcuucccuuuguggguaacccgaccuuucucucuggcugcccuuaacauuuuuuccuucauuucaacuuuggugaaucugaccauuaugugucuuggaguugcucuucucgaggaguaucuuugugguguucucuguauuuccugaauuugaauguuggccugccuugcuagauuguggaaauucuccuggauaauauccugcagaauguuuuccaacuugguuccauucuccccgucacuuucagguacaccaaucagacguagauuuggucuuuucacguagucccguauuucuugcaggcuuuguucguuucuuuuuauucuuuuuucucuaaacuucucuucucacuucauuucauucguuugaucuuccaucguugauacccuuucuuccaguugaucaaaucggcuacugaggcuugugcauucgucacauaguucucgugccuugguuuucagcuccaucagguccuuuaaggacugcucugcauugguuauucuaguuagccauucaucugauuuuuuuuuugaagguuuuuaacuucuuugccagggguucgaacuuccuccuuuagcucagaguaguuugaucaucugaagccuucuucucucaacucguugaagucauucuccauccagcuuuguuccguugcuggugaggagcugcguuccuuuggaggaggugaggcgcucugauuuuuagaguuuccgguuuuucugcucuguuuuuuccccaucuuugugguuuuaucuaccuuuguuuuugaugauggugacguacagaugggguuuugauguggauguccuuucuguuuguuaguuuuccuucuaacagucaggacccucagcugcaggucuguuggaguuugcuggagguccacuccagacccuguuugccuggguaucagcagugguggcugcagaacagcggauauuggugaacagcaaauguugcugccugaucguuccucuggaaguuuugucucacaggaguacccggucaugugaggugucagucugccccuacuggguggugccucccaguuaggcuacucgggggucagggacccacuugaggaggcagucuguccguucucagaucuccaacugcacugggagaaccacugcugucuucaaagcugucagacagggacaucuaagucugcagaggauucugcugccuuuuguuuggcuaugcccugcccccagagguggagucuacagaggcaggcaggccuccuugaccugugguggguuccacucaguuugagcuuccagguggcuuuguuuaccuacucaagccucggcaaugggggcgccccuccccagccucacugcugccuugcaguuugaucucagacugcugugcuagcaucaagugagggucccugggcuuaggacccuccgagccagacacgggauauaaucugguaugccguuugcuaagacuguuggaaaagcgcaguauuagggugggagugaccugauuuuccgggugccgucugucaccccuuucuuugacuaggaaagggaauucccugacuccuugcacuucccgggugaggugaugccucgcccugcuucggcucacgcucagugggcugcacccacuguccugcacccacuuucugacacuccccagugagaugaacccaguaccucaguuggaaaugcagaaaucaccugucuucugugucgcucacacugggagcugcagacuggagcuguuccuauucagccaucuuggcuccacccgcucucccauauuucuaugaggaggaaacacguaaacauaauuaguuuuugguaaguaauacauuggaaguguugagggcugugccggaggcagaagugcacaugcuuuguuugagggguuugggaaagucucaguggggauuaggaaagacuuuacagaaaaggugaaacuucagggaaggauuagugggaguuuucaagauacaagaccuggucaaguuuuccaagaagagaagugagagagcagugcauagcaguacaguagguguuuuggaaacucccacguucucggucuagagcagagguccacagacuuuuucuuacagggcaaaauaguaaauauuuuagguuuuguguaccaagaggcaagaucagguaauauauaggugcuuagauaaucuuuuauauaaaaaucauuuuuagcucccaggccuuaaaaaaaggauuuggcuggcaauaguuuauagaccacugucuuagagccugucaugauuguugggcguuauaggacucaaacuggggaaaaggaaggcaaaggccagaucauaaaugcguuugcaacaguuagcacuguuuugcaaucuuagauuuguccauaucuugugaaauacgauagugcuggagaucagauaaaguuaaauaaaacacaguuauuuuuuagggguuggauugggauugcauugacuuuguauuuuaaaaacaaacugucgcugggcacagugucucaugccuguaaucccagcacuuugggaugccaaggugggcggaucaccugaagucaggaguucaagaccagccugguuaacguggugaaaccccguuucuacuaacaauacaaaaaauuagcccaaugugguggcacgcgcuuguaaucccagcuacucaggaggcugagggaggcugaggcaggagaaucgcuugaacccuggagguggaggaugcagugggccgagauugcgccguugcacuccagcuugggcaacgagcgaaacugugucucaaaacauaaauaaauaaauaaauaaauaaauaaauaaauaaaagcugucaucuuuugucaguaaaguuuuguaacuuccucacaaaguucucgugcuucuuauaaauaauguauuuuacaucuuacacuucuauugcuauuauacaugccauuuuaauuuuauuuuuuaucucugcugguauauagaacugcaguugacuuuuauguguuaaauuuaucaagcaacuucacuaacuuucacuaauuuggguuauuugacuauguaacuuuggauuuucucuguagacuauccuaccuuuguaauuagugacaauuuuguuucuucuguuaucaguauuguaaacauuucauuaaaaguguuuggaauguucucaucuuguauuuucugaaauaguaaauauuuuagguuuuguggaccaagauauaaucuuguaaaagugguuucuugcauguuugauaaaaccaaccuguuaaacucucugggauugguaauaugucuuuuugggaagauuuuauacuacugguuuuauuaguuaccaguuacuuuuuuagguuguaaaucucugcuacauuuguuuauggucacauauaccuauaguuagguccuuaauuaauuucugauucuuaguugugccuucuguuuucuuccuugcuucaaucaaagguuuguaaauuuuaauacugauuucaaauaauacaguuuugacauuguugaucaucucuaguuuauuuccuucuuucuuuggacuuauucucuuuuuuucuuuuucucuucucucucucucucucuuucucucuuucucuuucucucuuuuucucaccuaauuuacuccauaaugccuccuacagucuuuuuguccagaccacuaucuaguucaggaccauagguuagaacugaguaugucccuuaggugucuuuuuaagcauugucuucccuccacucucaucccuuuuguguuuuuguuuuggucucuggcuuaaagagaccagcacaguugucuuauagugugccauuuucugacuuuguuuuauugcuuucuuuugguauuguuuagcucauuucacuaucuucuguauuucuuuuaauuaaguugauaguuaaccaacaacuguuugcuuaguggguguuuuuguuguuguuguuguuguuguuuugagacagaguuucacucuuguugcucaggcuggagugcaguggcacaaucucaguuuacugcaaucucugccuccuggguucaagcgauucuccugccucagccuccugaguagcugggauuacagcugugcaccacuacgccugacuaauuuuuuuuuuguauuuuuaguagagacgggguuucaccauggccaggcuggucuugaacuccugaccucaggugauccgcccgccucagccucucagaguguugggauuacaggcgugagccacugcaccuggccugguuagugguuuuuaaugccccaucagggcuuauaaaaaaauauuuucccuccauauauauguauauuccuuccuggguauacuuuagaguaaauuacagauaacaugacauuucaauccuuaauauucuaaauaccuuucuacaaaauaagaaugauuccuuaaauaacugucagaucuuuaccaccuaacgaaauuuagcaauacugucuucuucuuuuuuuuuuuuuuuuuuuuuuuuuuuuuuuuuuugagacggaguuuugcucuuguugcccaggcuggagugcaauggugcgaucucggcucacugcaaccucugccucccggguucaagcaauucuccugccucagccucccgaguagcugggauuacaggcaugcgccaccacuucuggcuaauuuuguauuuuuaguagagaugggguuucuccauguuggucaggcuggucccgaacucccagccucacgugaucugcccaccuuggcccccaaagugcugagguuauaggcgugagccaacgugccuggccagcaauacugcuuuuuauuccuucaaagaugcacuuuuuuuuuuuugagauggaaucucacucuguuucccaggcuggagugcaguggcuugaucuuggcucacuguaaccuccaccuccuggguucaagcgauucuccugcuucaaccuccugaguagcugggacuacaggcgcaugcuaccaugcccggcucauuuuuuuuuuuguagagaugggguuucaccauguuggccagaauggucucaaucuccugaccaugugauccacccaccucggccuuccaaagugcugggauuacagucaugagccaccaugcccggccuacccuuuuuguuuaaaucuuuggagcaagguaucuaauaauauuuuaagucuucauuggcugggugguagucaugauauauaguugucaaugccuaugcauacucaucuuuguuguuuuuccuccugucaugauuagauagcuguagccuauuguuucaguagauaagucacuuauggagcaucugaggaaagaauaugaguuuugauugcugacuaaaaacuuuucauugucagcuucugguaaggucaaaaaagugaugucaaaacuugcagaaaugggguuuguagacaacaguggaagaaucuucuaagaaaugcuauaucaccaccuuuuuugaugucccaguaguugauauuguguggaaaaacauggacgagaguaugguuaacaggauuaaaaaauuauucagaauuggacacuaaggauaucuuaaugaaauuuuuucacuuaaauuuuccuuuaugugugaaaaaaagaaugugauaaaaauuuaucuuuaccauuaaaaauaacugaaaauaauuuuaauugcuuuuuuuuuauuugagaugaggucuuacuauauugcccaggcuggucucaaacuccugggcucaaguggucugcccacuucugccugccaaagugcugggauuacaggugugagccacugcacccagcuucuuacugaauuuucacugacuccuaguuuuccuggauaguuuuaaaaaguuguuaguguuguuuuagcucuuuugaugcuguuuugaagcuguuuuauagcucuuuuaaugucuuuuaaaagcucuccucgcggaucacgaggucaagagaucgagaccauccuggccaacauggugaaaccccgucucuacuaaaaauucaaaaauuagcugggcaugguggcgcgugccuguagucucagcuacuuaggagacugaggcaggagaauaacuugaacccaggaggcagagguuucagugagcugagaucacgccaccgcacuccagccuggagacagagugagacuccgucucaagaaaaaaaagcucucgucuuuuucuucugcaccuucccuuugugcauaggauuugucuuccuuuauucaucuuucugcaucuggggaguauugccuucagcacuagaaaauuuucagccacuacaucuucaaauauugccuguguuccauuuuauuuuuugacuccaucuacauuugguuuuagagauaugauagauuuucccacauacccauaaccucacuuacuuguuuuucuuggugaauauuugaaauauacucucaucaauuugaaauauacaugauuauuaacuauaguuaccaugcucugcaauugaucacuagaauuuauucuugucuaagugaaacuucguacccuuugaauagcaucuccccaauucccuuuccccacccucccugagccucugguaaccacugcuguucucuuuacuccuaugagauagauauucuuugaguuugacuuuuuuagauuccacauguaagugagaucaugccguuuugucuuucugucucuggcuuauuuugcuuaacacaagguccuccagauucauccauguugucacaaaugacagaauuuccuucuuuuaaaggcugaauaguauuucaagguguauauauaccacguuuucuuaauccauuuauccuucaauggauacuuugguugauucuguaucuugucuauugugaauaaggcugaaaugaauaugggaguauagauguuauaaauaaaguuuuagugccgcaaaagaaauagcacucgaauauaaaguuuccuuuuuaauucucaacaaggcaagguacuucuauagaagggugcacccuuacagauggagcaauggugagcgcacacuugggcaagggaggggaaaggguucuuucccugacacaccuggccccugcugcugugucguuccccuauuggcuaggguuagacugcacaggcuaaacuaauucugauuggcuaauuuaaagagagugacggggugagugguuuggcaggaaaaaugguuaugacagggcagguaauuggaaugagucaggguggagcagguagucgaaaaacguugcuuuacgaggaagugaaguuuaaaaguagaaggcaaagaaaugaacauacugauuccuuggaaagaaauuuagaacucauauauaacauagauaucucuuugaaauuuugauuucaauuucuaugauuuauagcuaguagugggacugcuggaucaaauggugguucuauuguuaguuuuucgaggaaauuccaacauuuuacuaagaaagaauccccagggguucagauuuaugugggaaaucuuggguacaacucugugugguaccuaauuuguuuccuaagucucagggcauuuuauuggcuuucaguguuggcuuaccuuucuguauucuccuuuuuuuucagccuuuuuccuuuugcggccagcucagccauucauuuauaaagauccuuuuaaaauaugucaucuaauauuuuaaauaauuuuguauuaggaagguuuuucaguauguauacugcuugccauuggccuuauuuuuggaaauuauacuauaauuuaaggaaauauaaaugaaauuguugggauacuauuuauuuauuuuuauuuauuuauuugagacggagucuugcucugucucccccaggcuggagugcaguggugcgaucuuggcucacugcagccucugccuccccuguucaagcaagucuccugucucagccucccgaguagcugggacuaaggcuaccacaccaggcuaauuuuguauuuauuuuuuaauagcgacugaguuuccccauguugccaggguggucuugaacuccugaccucaggugauccaccugccucagucucccaaaguguugggauuacaggugugagccaccaggccuggccuguugggauacuuuuaaaaaauccuuugugcuuuaauuauaaucauuucuguuuuugaaccaguuugugguucagcagcacggggaaggaaguuguugauguuauuagaugcauugccccguugucacaaaaauucuaaaugccagguaguauuuuuaaguauuuuacauguaucaucucauuuaauuccucagacaacccuuugaaauagguacugcuuucuccauuuuacaaagaugaagacauugagaucagcuaacuuguuucaugagucuuucugaaauuauuuauuuauuuauuuauauuuguuuauuuguuuuaauuuaagagauagggucuuccucuguagcccaggcaggaauccagugguacaauuguagcgcacugcagccuugaacuccuggacucaaacaguccuuuuuagccucucaaguagcuaggacuacaggccugccccaccaugcucaacuaaguuuuaaguuuuuuguagagaaugagagucucacuauguugcccaggcuggucucgaacuccuggucucaaacaauccucucacauuggccucccaaagcggugggauuacaggugugagccacugugcuuggccuuucaugauucucauaacuaguaagugacaaggcuuugauucugacucaggucucuacagucuugggucagaaucacagccuugucacuuacuaguuaugagaugacuucuacagucugauugcauuauugcuguacaauacuacacauacacuuuggaagcagaacuucugcuucaguguugugauuugggcaugaugcauauaauaaaguuuugccaaccucuucugcuagauuaucuuaacuguaaauguucuuuuaauuguccagaagguaauucagacuauaauaaggaaaugauucuguauaaauugaaucagcaaaguaucauucuucuaugaaaaauauguaacagguuauuaaagacuguaagauacugauuuacucagcggcaagacuuuccuaauuaacuuacauaugcugguuacuuugcuauagggaucaaagcaugacuuggguucguuuucuaccauuuauagggucauauucuaguggaggagauaaaugacauacuuacaaaagaugugaguauucauuuggaagugaaaugggagagauucccuugccccccucgcagggcaugugauggggguguggcucgcuucuucagugccccacugcucaaaccucuaggggagcauacagacuggcaggcuguggggcucccaccccacggcaaugucugucuaggggugaauguuacagcugaauccccagugggcauguguuagagggugcucuuuuaguuugcugucuguaggcggcuuguguucaccagcucaguuagacccuauaccuugucgcaaggacagaggguuuccuguaucccggguucuugccuugguguacuggaagaaucggaucacaugugggcuuggagaauuaguguaaaguuuuauugaguggaaaguagcuuucagccuaugggguagccagagggagauggcugcuuggcagccccagcucuccuccgacugcgcuggccaaacucugccuagucccacuggucaguggccugccggugugccagcguuugugggugugcucuuccgccugcaugcuccccucaacauccucucgauguccagccacuugucuucuuccaccgauguguuccucucgccaucuagcaguuucugucucugccuugcuagggucuuggguuuuuauaggcccagguugggggcguggcagguaggcagaagugccugucuucacuuaggucugaggggguagagcccuagccagggaccacacccuccucuacccagcacuucccuucucccauucuguaucauuuaaagggaccacacucuucccuucccagcagucccguaucagaagcauguauuagaaacuauaacucacucuggguuuuugggaauaugucaaauaauacuucuggaaggaagaggugaauguugcuuuuuaaaggauagacaggaauuugcccgauuaaggagugaguugagggaaagauggcaauggcuuuuuuaaggcagaggaagcaaacaugguuaaaaucauagaaauguauaagguuguauuuuauucacagaucugcauguuauuuguccugacugaaguggugguuaugagauugggaacauuucagcaagagucauaaaaugaaggcccuuauaaaucaagcuagauuguggggacuuuucagaggaguuuaaaauagaaagugcauguuuugcacuucauguuugaguuuucgaaagcucacuggcagugguuuggagggcagauugaaagaggaggaaauggagagagagccuacaguuugggagacaaguuagaaaacuguugaaauaggccaaguauguaaaguugagguccuaacuaaccuggagaaacauaguaggaauggagaagggguggauucaaaggcuuuuagauuguaaaaugaacucugugaauagaaggaacaugguuuauugguggagaagaggugagagaggaaaaguaggacuacuguuuggcuuggucaacugguaagauuguuaccacuaucuaaaaucugcaguaccauuagacuuucuuguucaguguuaagauucauguaauuucagauauucaugguauauguaacagauggggguaauuauaaagaaaguauuuggaaauucauaccuuuauaaccuucauuucuauacccaccuucccccuuuuuuuauuccccaguagguuuuguuuuguuuuauuuuauuuuaucauauuguguuuuucuuucccagaucugguagacaaagguacucagaggguuaauagcagauuuuuuuccccaacuguguaucacuagguuugugaauuagagucaugauacaguaaaauuaagacauuugauguuuuuguaauauuuuggcaugguuuuauuuguuaauauccuagcauaaaaauauaauagucuucaaagaugauuacugggguauggggugcuuggugguggcuacagucaaauucuuauuccaaccccaaauuggcaacguuauaacaacauagaaucuuauuauuuagaaccuaauuacuguuguuccccuuacccaugagggauauguuccaagacccgcaguggaugccugaaacuucagguagaacugaaccuuauuauauacguuuuugucaacaaaaagagucaaacucuguaaaacauuuuagcugggaguuguggcucaugccucuaauuccaguacuuugggaggccgaggcggguggaucacaugaagccagucuggccaacauggugaaaccccaucucuacuaaaaauacaaaaauuagccggccauuguuauauguaaaguuucggugccgcaaaagaaauagcacuugaauauaaaauuuucuuuuuaauucucagcaaagcaaaguacuucuauagaagggugcgcccuuacagauagagcaauggugagcgcacacuuggacaagggaggggaagggguucuuacccuugacacacguggccgccgcugcugcuguguaguuccccuauuggcgaggguuagaccgcacaggcuaaauuaauucugauuggcuaaagagagugauggggugagugguuuggcgggaaaaaugguuaugacagagcaggcaaugagucaggguggaguagguaaucaaaaugagucaggguagaguaggugauugaauaaggguggagcagguaauugaaaaagguugcuuuaugaggaaguuaaguuuaaaaguagaagguaaagaauugaacauacugacauauugauucuuugaaaagaaauuuagaacucauaucuaacaaccccuccccuuguauuuccucacagcuuucuuuucaaacuuuuuuuaaacaugucuuggcuuaguuguuuggcuugauuuuccaaaagaagaugcuucucuggauaagguggaggauaguuaagggagguuugaguaagugccauuuuuaugagccucugcaucaaccuuuggaggcaugguaugacacagcaccugacaagaauaaguacacccauuacggcugcgagggaaguaagaauugaggcuauuauuccuuuccauuuacugaacuacuuuucuagccauccuguaaaggggucauuuaccccugaguuguuggcuaacucauuggacagagcagucagaccuugcaaugcccuuguuauacuuccaucagugguggugguguuugggaugaaaguacaacauugaguuuucaucaugacgcaaacuccuccucuuucugcuaauaucaugucuaaggcuauccuguuuuccccagccaucuggcuaguugccccuaguuguucagcuauuccuuuaacagcaucucuaguguaguuaauaaauuauuguugguuguaguagaugugguuuauccaaucuacauuuuuauuaauugucaccuaccaaaauauugacuuaaauccugcagcuauuugauuucagguuuuaaauugaucugguauuccccgugggacuccaguugcgucuaaauagacaugagaaucgaaagacccauaaggggcuucucucacuguacgaugucuuauuuuuccuuccucugguugaugaagugccagggugaaagggguugaugaagugccagggugaaagggauagccaguuggacuaaagcauaagugccacuccaguuauuuggcagaguguccaguaaagguccaccacaauaccaccacacaucugcucggggaugaacaagggcugacugacugauaagcucuugaaaauucuuaagcucacugcaucccuucaggucuccaaggaacgccguuucuucccugucgugagagacacgaagugaacuuaguguugggagacggaaguuggauggcccucgggggcugggagauggaagcuggauggcccucgggggcugacccgcagggugccggacuucgggauauagcagagagagcuuggcaugacuuacuacuccaggcuguagaauccuggaaaagagcuaccaugcagcccacaccaggucaacuggaggaccaccuuaguggaaaggggacaaucugggccucuggccugcuaugcgcacaagcauagcaauugcuuuuguucaaccuguggacggaauauuugauccauuccaaccaggcauuugcaucuugauauccugucuuaauugccaaaguuuguuuuaagucuuuaacuuuuacuauagcuaucuuggucuugucguuagauggaggaggagcaauuguucuguugugagagguuuuggaaggaggcuuagaggaaggugcaggcaguaggggaucaaagaaacucauuuuaaagaauuuaauaggguuugcugaaaccucagcccccauaccauaaaaccggcuuaaagaagggaacuggcuuagaaaaggggaagaacuuugagcguuugagauaauaaccuguauagaauuacacugguuuagcugacaguggggagggcuguccuucuaguaaaauguaugguuuuaggaaauuacaaaaaccgguuggggcaguccauucuuguucuuuagugcuccacagaauguuggacuaacuacagcauaaaagcucugcauuggggagcaagacuccugguugacaccggggucuuuaucgaaaucuuucuggauuaaguggucccaauuuacuaaggcccagucugaggagagucaggagggacagagguacuuuucugaaguagagagcugucuuugacuuggcaagcacccacggguauaacaaggcaagcaucaaaugcaauaguuugaggcaaaauugacuugguuauguuauaacuagauggucagcaauagaacggggaaagaagaaaguaauagaauagaugaaagagaguuaaauuuuucuuaacuuuaguuugauaguguuuuccccugagacuauggcccacgacucuugagggagcggugcuuucuugccucgggugugaugagucuaucccccuuccgcuguaggaacagcagucuccguaguuagcagcacaagguaggguccuucccaggcuugcuugaguuuuccuucuuuccacccuuugaugagaacgugauccucaggcuggugcugguuuaccggaaauucuagggguggugccugugcuaaaagacuuuuaguuuugaaggaaaggaaaguggaagauaaaccaaguauauaaauucuaagaaacugaucuuuuguuuuaaauguggggacaucagcaguggucuuuauagcccuuggugccuucuuacugagaaauuucccuuagcaccuauuuuuguuaguuuuuagaccgaagaaagccaaacaccguuuuauauuugacagugcuuccuguaugauuuuuauacuagauaagcuaaauuucaccuuuauauuaguguguuauuaauguuaaacucaguuuuaauaaaaccuuguagacauauuuauccaauuuuaaugucugaccauaagguaaaauuuuuauagacucuguuuaaccuuuuauaauuuuuguuaaagagcagguuagugcuuuaagaaaaaccuuuugugcuuuuauuuuaauguccaguucacagaaagacuggaugauaccucuuuaacuuuagccaguauguuuacacacagaauuuccuuuacaauuaacauuuuaaaaauugcucaaaccuuuaaaacaaaauauauuucuuuaaccuuuuaauguagguaaaaaugcacauucuuaugccuccuuuuaauccuuuuaccaaagguauauuuuacuuuccuuacaaaccuugcacauaaacuguuucuucaauaguuuuacauucaggaggccuaauuacuuuuaaauuauauaacauuucuugcauaaauucccuuuuauaacauuuuuuuucacgacuuucacagacaauucuuugacauaccucaacuuucugacuuguugcaaacaucccuuucuuuaaacaaccaguuaauuuauuuuaggacaagaauuuaccauauaacauucuuuuuauauaaauucuuccccuccccgccccccccccccuuuucauucuucuccaaagugaacuuccuuuaugucuguggacuagacugccuaaggccacaagauuagaaguuaggauaauacauguuacacuguuaauuuuuagcaaacuuuacuuuuguugaaaaccuuguaaguuugggauuucaguuauccuuugcuauuaauaagaccuuguuuaguccaaauuaacuuagaauugguauagaugguuccuuccugguucuguaaguacuuuaaggcuuggcugagugcaaacagcucccauauuugagcagacuaauuauuaggcaauuuuccuaauucugcuuguacaagaguugcccuaucaauuacugaauacccauugugucuuuuuccgucaaucacccaggaggagggaggaacugucuaucguccuguccugaagggaguuccuccuaggucuggucggaccuuuguacaguaauuaagauuuagauccuguuaggaaaccugcuggguuaagggaauuuuuagugguuaauguugaauuauccuucuuuuuuuuuuuuuuuuuuuuuuaacagaauagccucauacuuucuuguguuagcaaaacaguugucgcuacagauugaauguauuagggccaucugcggguuacuggguuaaggauuuuugauaggaaggcuacgaguugucaguggccucagugcuuuugggcuaugcccuuguuuacacugacaaggugguauuggaguguuacagugucacggagaagaccuucaauuaucaauuauagguuuuaaauuuacccuggcuuuuaaaggaauaggguacacuguuuuuuccuuuacuacuuaucucucucucucucuuucuuucucucuuugacugucucucucuuugacucccucuuugucucugucucuuccucucucugucucucuuugacucccucuuugucucucugucucuuccucucucucucugccuuuuuuuccucucuccccugccuucuccucucucuccccucucucucucuucucccccuucucccccuuccacccccucuuccacccccgcuucucucucucucuuuccuuucugcugguuuuucccugccucugccagacgcuuaugcugcuguucuccccucucuuuccccuuuuaccccggagagggacucaagauaaaagagacagagccccugaccucccuauucuucguugaaagucaugagcggaagggcuucuuuuguccuuucuuaguucaggacauccucucuugaaguggccuguucuucgacaucaauagcaccuaucuuguccuuccuccuuaguucugggauucuuuaacccugcuccaccauacucuuuagggggccugguagaugaggaccuugguccuccagauggagacugggguccuuuaaaagaggguuuggacccuuuauaguuucuagcucccuggaaacugucuagaaguaccuggguuuggagccaucuguuggaagguagaaaacguaaguuuugucuuuuguuucuguuuuucuucaucccuuuucacauauacuuucugagcuucccugagaagcucacuuaggggacggucuucucaacugucuauguuuuguaacuuuuuugaaaugucuggccaacuuuuagugacaaauuggaguuucaacauuccuagcccaaggggaucauccaaauugaggccugcauauugccucauuugcucccucagucugucuaggaaucucauaggcccuucauccuuuuccuguuguaugucaaaugcuuuagaaagauuucggguucgggguacugacucccgaauuccuuuuauuauugucucucuuagauccugcauauuuuccuguugaucugcuuuguuauugucccaccaggggucucaggcggggaauuucugguccgcgguaggaacguuuucaccaggaggaugcucacauucccaaacuaccauagcagcccuacaaaucauacuccuuucuucuccugaaaagaggaugcccaagauggacauuaacucgacccaaguguauaacugagguccuaagaauugggcaauuuggucugccacuccauaaggguuaucuaguagugguuuaagcuccuuuuuaaaauucuagacuuugguuaagggagcauuuacaaagccaguggccccccccuccuuaugguaccucuuucaaagggaagaggguugggccucuuagguauggagggaaaugggaaauucugaauaucuuuuuuacauuguucuaccucacgcuggaguccuuuuagagaggggucuuuagguugggagggaaugggcuggugggacgguaauucccaagagucagaguuauaaggaggagggauaacgugaguggagguggaauuuggaaugggaucugaggaggcaguggcugucugaggggaaagauuggggacacugagugggggaagauagucuaggggaucccaugcgcuggagucuuuaggcaugagagcuggcuccucugacuuuucauuuugaggugccagauuggguucuucccuauuuguuuuuaagggaaaaaggagggcagguccaugccuccaacagagggcauagccuaguucuucugagacacucgacuuuuaucauuaacaugucggauuagaagcugacacauuacauccucauucgaucuaaacuuuggccagaagauugaggguuugaggaugggucuuugagucuaaauuaaacagcaauauuuuaucauuuguugcuuuuuccuauguuuaguccuuucguuauccuuccaguguuuuagcuugagaccuagggggcuaucuggggggauaucuuuguuaccaucuuuaucccucuugcucccugucuugcuuggguuauuucccaucuugaugguuuugggguaaguuucaagguucaauuucccuuacugaaaauuugucaccuuuuguggggaggcucaauuucccccacuggaaauuucucaccuuuucuacuacuggagguucgugugaaguucaguccccuccaaugggcaugucucaccucuuuuuaaccuguaagccaccccaaccaaggaguacuucaccucacccccccacccccccaccccccccaccccccaccacccaccacccaccacccaccacccaccacccggcuuucuuaccuuggucccuaccaccaaggaaauacuuuaccggcuccuguggcuucuccuuccuuggucuguguacagucaucagugugguaugugagaauccuuuaagcuagguuacuggccagucccccccagcccugcgcccccccccgccgccauguugccaagagcuuggguuauuccucgcacugggugaguucugauuucucaccccugaggugaccacaaggggcagggcaugccuccucaugagggagaaccagagacugucgggaggggaauguaaucaugggugagcccccaaauuguuauacauaaaguuucagugcugcaaaagaaauagcacucgaauauaaaauuuucuuuuuaauucucagcaagacaagauacuucuauagaagggugugccuucuauagaagcaauggugagcgcacacuuggacaagggaggggaggggguucuuaucccugacacacguagccccuacugcugugucauuccccucuuggcuaggguuagaccgcccaggcuaaacuaauuccaauuggcugauuuaaagagagugacggggugagugguuuggugggaaaaaugguuaugacagagcagguaaugagucagggugcaaucaguaaucagaaugagucaggguggagcagguaaucgaaaaagguugcuuugugaggaaguuuaaaaguagaagguaaaggauugaacauacugacauauugauucuuugaaaagaaauuuagaacucauaucuaacagcaugguggcacacaccuguggucccagcuacuugggaggcugagucaggagaauugcuugaaccccggagguggagguuacagugagccgagaucacaccauugcacuccagccuggggacaaagcaagacucuaucucaaaaaaaaaaagauccugagcauuucuucaaaggauuguaacaggaggugaaacuuggcuuuaccaguaugaucuuaaugacaaagcacaaucaaagcaauggcuaccaagagguagaaauugauccagucauagugaaaguggaccggucaagagcacagaucaagacaacaguuuuuugggauucucaaggcauuuugcuuguugacuuuccggagagccaaagaaugacaauaaccucugcuuauuacgaguauguuuuaagaacgccaaagcuuuagcagaaaaaugcccagaaaagccucaccauggcagugccucuacucaguccucucaucaaacaagggcaauguuuugagaguuuucaugggaaaugauacagucuugauuuggcuccuuccagcuucuuuuuauuuccuauuuuaaaaaaucuuuaaaguaaaaucuuuaaagggcacccacuuuuuucuucaguaaauaauguaaaaaagacugcauugacauggcuacaucccccaggaccccucaguuguuuagggcuggacuaaauggcuggugucauugcuuacaaacgugucuugaacuugauggagcuuauguugagaaauaauguuuauauuuuuaucuuuuaauucuguuuuuuuccaugaacuuuuugaaguccccuuguacugggugauuggauuaguaaaucuuugggcaucuacucuauggaagugcgcccugugcuaggugauaacaaggaauacaggcagugaucacuccugccuuuauggcauuuuuauuugaucggauggaguuuagucaacacacaaguaacaaauauaugguguaauaguuaagagugagcucuggagacugaccuaguuucaguuccuaugucugcuaguuaguaccuguuuccuugaguaaauugcuuauucucugaugcaguuucuucauucuauaaaugaagcccucuaccaccacauaagguuuuuuagaaccuuuugaaagaguugauguuagauauugcauaaaacuaaguuuuuacuguuacauaauaaugucagaugauagagacguugcaguaagaccaaauuuagagguuggaaaaaucaccucuaguuugaggugggacaagaagcaaagcuuucauggggaagguggcauuuaaauggaucuugaaugauuaauagaauuuauagggugguggggauugaauaagauuuccuagagggagaagaaugaaguugggagaauguacaguguguccugaaaucagaaaugcccgucucuacuaaaaauacaaaaaauuagcugggcgugguggcgggcgccuguagucccagcuguucaggaggcugaggcaggagaauggcgugaacccgggagguggagcuugcagugagccgagaucgcaccacugcacuccagccugggcgacagagcgaaacuccaucucaaagaaaauaaaaaauaaaaaaaauaaaaauaaacucauauuucuauaguacgcucacuccacccuguccaggcaguugccuaaauagauguuaagauguugcucccuuuccuuucacaaccacccucacccccacacccccauugucuuucaaaucuugacuuuuuagguagaacacuaaaugacucuggauuaacuauuaccacuuuuaccacauucugaauauccaugccuccucucccccacccucuagauugcauacuucuugagagcaggggaaguauauuuuauucagauugguuuguuuaacccuugagaauugucccuggcaccaaguaaaugcucagauuauuucaggggaugggauaguagaugaaugauccugauuaaaaacaguuucaacuaaauuuaaaauuaaaaaaaauuuaaacaggaaauuuaaaaauggauguugucugagaccuuugugacuccuggaauuugugaauacuucuguaauauaauuuccucauucggaaaauuggggguaaugaggacuuaauaaaaugaaauuaccauauuuuuacauuugacaauguauuuaagaaacuuaguguuucuagaaagauacuuagaauucaaaggaaaugcacaauauaauuuuaggacaaacuuuagcauuuuuaaaaagcaagaaaagucacucagcuuguuacuggaaagggguccugauccaaaccccagguuggaucucacgcaagaaagaauucgaggauaauccagaguaaagugaaagcaaguuuauuaagaaaguaaaggaauaucugcucaucugacaauacuuacaguuauuucuugauuauaugcuaaacaaggggugaauuauucauuaguuuuccaggaaagcagugggcaauucccagaacugaggguuccucaccuuuuuagaccuuacagaguucugacguugugauagugcugcuaggagugucuuuuagcauacuaaugcauuauaauuaguguauaaugagcagugaggacgaccagaggucacuuuuguugccaucuugguuuugguggcuuuuggcuggcuucuuuacugcaaccuguuuuuaucagcaaggucuuugugaccuguaucuugugccaaccuccagucucauccugugacuaagaaugccuaaccuccugggaaugcagcucaguaggucacagucuuacguuacccagccccuauucaagauggaguucuucugguucaaaugccucugacaagcuguuuacauuuugggcuuuaaacaucauugguucuuuuucucaacuaaugaauuacagaaguuguaguauaauuacccuaguuccuucauacuuagggcaagaugacucugagaaauguuccauacugucucccagagaucuccagcaggcuugagucccaguugccuagagucauaaucagcuccauaaugcauccuuuauuggcauacuuuccuuuccugacucacuucuuuacuucauuaaagguauuuccucagauacuucucaaauaaacuacuuguacaaaaaccuuuaucucacagucuuucuugggagaugcaacgcaggcagcaugacaagcauuguaauaauaguuaaaauuuugaaguuuuagaaaucagagacauuuguaauuugaagcuuauaauuucgaagaagaaauuuguucacacagaucaguaugaaagcuuuaccuucuuuuuuaauagggaagauuuacuaaaauagauuugcuugguuauugauaaaacauauacuggguacucaaacauuugcuguuuuugaaaauaaggaguaggaucugggcauggugucacaugccuuuagucccagcuacuugggagacugaggugggaggauugcuugagcccaggaguuugaggcugcagugagcugugaucgcguuggggugacagagcgagaccuugucucuuuaaaaaaaaaagaaaaaaaaucauggaguuauauaaauauaaauuauauaaauagcuggauccuauuaggaguccagaggucaaaguuagucaggauaaguguugacacaugucuuguuucauacugcaaaaggagucaaugauauuuaaagcacaagauguuaaugccuaggugaugauuggcaugaugcuauuuuucuuaaauacuaaaauuuguuuuagguuuauacugugcauuuccuuugaauucuaacuaccuuccuggcaguacuaaauauaaaauuaaauccaauucaagaaacaaaaagaaccagaggaagaauguagauacaagcaagagagaauaggauaacauaggcugagcauucucuuauuccugaagaauagauuuuuaauuuuagauuugaccauagaauuucugcuaguaaauauuuuuauuucagggcuggaauaccucucuaaguugauuggaaucugugccaucugaucacuguuauuuugguguuuuaaaaauauauuguaaugcaugauagaauuuuaggacuuaaaacaucuuggauaccguauuuuacaauaauaacaucauauauguuagauacaaguauuuuuccuaaaaaucuuuuucccuuccuuuacagaaugcugccuuuuuauauggucuugguuuggucuacuuccauuauaaugcauuucagugguaaguugacauaaaaccaguaauucagucauuuucaguaaauggcuuguuugcuuguuuuguuugugcuugauuuuuuguguguguguguaauaaauagaaaauuuagugucauuaaaccuacacuuuucaguaaucuuuugaaaugauuagauuguuccuugaaggguguuggcucaccuuagauuuuuagaguuguauguuuuccugaaagaaucuaguauaagauucuguugaagaaggcuuagauuagaaagcuuuuuggaauuucuuagucauucauuauggacugguguuccccaaguuauuugaacuggugaaucacugugaucucagaagucaagauauguggguaaauggucuaugauggcuaguuuucagacuucuagacaagauugaccacuucucccuuccacauaccagcuagcacuuuccaauauccaguaacuaggcaccaacucauaaacucucaguucucuguagaauaguaccacuucagaguuggagauuaaauauaauaauaguaauauauaagauuuucuaaacuguaaagugaaguacccuguaauauuauggccuuugccccauuguuguuuuucuguuuaccagacaauaguaugcacuaaugggguaaaaaggcauauaguuuuaguugaaagauugguauuguugucacagcauugccacuuaguuugaucuugaauuaaauaacuucucuaggucuguuuccucuuuaguuuguuuauuuauuuauuuauuuauuuuauuuauuuauuuauuuuuugagacagggucucacucuguugcccaggcuggagugcaguggcgagauugcagcuuacugcagucucaaucuauuguguucaagcaguccuuccaccuuagccucccaaguagcugggaccacaggcacaugccaccaugcccagagaguuuguuuuuauuuguagagauggggccucccccuauguugcccagucuggucuugaacuccuggccucagggcaugcucccaccucagccucccaaagugcugagauuuacaggcaugagcccccacgcuggcaucaucauuuguuuaaaaaacaaaacuacauagcagucacuugccuuuccuauagaguuuugaugaucaagugagauacaguacauuuuauaaaaugucaacccaauguagauuuuuuuuuuuuuuuuuuuuuuggucagagucucacucugucgcccaggcuggagagcaguggcacgaucuuggcucacugcaaccuccgccucccggguucaagcgauucuccugccucagccucccaaguagcugggauuacaggcgcccgccaccaugccuggcuaauguuuuuguauuuuuaguagagacggaguuuuaccauguuggccaggcuggugucgaacuccugaccucaagugauccgcccaccucagccucccaaaaugcuaggauuacaggugugagccaccacaccuggugacauuuuuuauuuuuaguguaucugaccuuuucagagucccuucugugcuccagaauuuuaagcucacgggugaguucugugggaguccaaaggaaggugauugaguggcaaaauguuacaacucugucauauaccuauugggcacccugaauacuuauuacagagcauuuacauaugcauugacagugauuuuauaugguuucccuaaagaggaggcuuuauacauggaugguuuuuccuaguauccuuuuucuucccucuuagcuuuuggucuuguuggcuuuugaucauguguggaagcacugcuuuguuagagaauaccuguguguauauaguguauuauaaugauucagaucacugguuuucuuuguaaaucuuaggaagguauaauugauuuuuaugaagaagcuuuguaauuuuauucucuauuaaauuauccuaaauaaagccuccuaacuucauguucaguguauuguauuuaaaaccaaagauagauuaggacuguuuuaaaaucuuucaguuucuuuaauagccuacuuauagaauucaaauucuaaacuucuagaauuagaaguagucuuagagauaauuuaguuuuucccccuuaauuuuguagauggagaaagcaaggggguguguguguguguuagucaguauuacauaacuguugaguggcagaagcaagcuuaugcucauagucuccaaucaaauauuuuauuguacucuguccccagguuuuaagauugagaggugguuauuauuuaaucaguauuugucauuguucacuugagcacauugauauaaucuuuauggccaacuagaaauaauuuaggugacaccugaggggaggaacucuucuguucuaccucauaccagccaguuuucgcauaccuauggcaauuuguaagccucucuguguacugggguuaagaacauaaaauuaguaaugaggugaaccugucaauaguucaaauguugauugcuuuaauaagcauguggccauguuaaguuagcaggcuuguagcugugauuccuuaucuacauaugauuucuauauuuuucaguugaccuaagaaaugaaacugaaugauauaaggacaaugcaaugucuacauuaauaagugcccccugcucuguugauccuguucugguuaccaucauuuucucaugucuugaguuucaauucuuauagcugcuuccuaaaaugauacaucucacacccuaucuuaugaauucacucuggcuguguuuuucucuugcuaaucaaauguucuuucacaaauuugccucacauuuuugcuuuaacuugauauuucuuuaacagcuauaaaauuagaaaguaugggguaggugcuuggugauaguuuuagaguacagccuuaauugauuggagcuuauuuagguuaaaacuacuuuuguguuuuauuuguagauacuugcugauuacugggaucaggaauguuuuaguuacaugucagguucuuugggaucuauugagaaauguuucuggggaugaguauggguucuuguuuuguauugucagcaugaagaaucugccuaugauguuucagaguguuguaucucugguacauuuauaauuuaaguaaaauuugguauuugcuaauugugucuguuggcauuuguugagguuaagcauuuuaugauaaugugugugaccaacgugugucugaguuggugacuuaaaauauugagagcaauuuuauuaguuauaguguuacucuuaaccuauugucaucuuaugcuaccuauuuuuuauuucagaguugauuuuauuggucagccucuagauaguucaauuauuuggucaguuuuuccaguaucaguugcagccucuucuuagacagaggagcccagucaacuguuccauccucauuggacuuacgguaacagcuaugcuguuauuuuacucaguaaucugggaccaaacuuaaaagaugcccagaaggauaaaggaagacauagaagcagaguguaaaauauaugcagcagagugcuagaaaccagucucuaaaaagccauugcuuuacaugugcaugcaugcaagccccugcauucacuuguucuuauucauuaagguggcucuuugcuaggggauaccuugaacugagcuccuugccuuuggaaggaaaccuauauccuagggugagaguaagugaaauacaaagcaaggaaaaguuagacuaaaaaaagauaguugggggaaaagauaaagucaguacaauagaaaucauucuuccuuguauagcuuauagccaucucucuaaauauaucuuccuaagaauccuuauuaacuaucucuguccuguaaccuuuuuccuucuuuccauuccauugaucaauaucagaauggucuuauggcagcaaauguaagagauacugugcuagaagcauaggauuuuggaaauuaagcccccaaauauaauugacaggcuuaauaaggaaaugugauaauuauuacuuugacauaaaaaaggauuaggagaaugagguagaaaugaauucagaaagacagaaauauuaacaaauuacuacuaaaguuuucuuuuuucuuuucucuucuuuuuucuuucuuuucuuuucuuuucuuuuuuuucugagacaggaucucagucugucacccaggcuggaguguaguggcacaaucacggcccacugaagucucaaccucccggggcucuagugauccuucuaccucagccucccgaauagcuuggacuacaggcuugaaggcuugaaccacuaugccuggcuaauuuuuuguauuuuuuuuuguagagaugaggucucacuguguugcccaggcuggucuugaaccccugggcucaagcaguccuccugccuuggccuuccaaagugcugggauuauagaugugagccacggagccugguguaaaguuucuguaggauucauuuucauagcacuguacuagucacaaguguucuuagggguguaggaauuucuacucuccuguauagucacugcuuuggguucaguaaagaaaaagaauagugguuuuaaugauguucuuacagcuuuuugauggaacgaaagaauaaugcaacauagaccuaaugcauggugguaccauugauucugaggcuugucuagcauggagccuggcaaacguuguauuuuugagcuaucaugauacaaacauacucuuacauuuccauugaaauuaagcaguuaauguuaacauguuuugaguuuauuauauauacuuuuauuuuggaaaauagcagauuuaaggcaguucugauaaaguuacacuuaaacagugauacauagauugccagauaaauuuuggaagggcuuugauuaauuaggcuucagggaaauugugaauaaaaacauaaaucuugcaauaggguaggggaaagaaaauaaucccacuccugaagugaugaaaugaagaguggcuagagaggagaaaagaaccaggacaggugauauauuagcaacugucagugugaauaauccaggguaugacauuucuaauuuagccucacauuuaaggucauuucugauucaaccucaaaugauccuucuagccuacugcuccccuaaauauuaauauauucuuugugccagucacaguguauuaacauuucccugaaaacaucuuaagcauuuuuuuuaaccuaugugacuuuugccuucuuccaucucaaccuuuuaaaaucuuaccuaccugucccuuacuucaucaaauguuucuaauuauuuagaaacaacuucuaaauuuccuaauauauauguauaucuguguuguguauguauguguuauaacuaaauuagagcuaaaauauucuuuuauuaguaugaaaauuuguggaauuaguugauuuaucccuucauauaucucugugagaaaucucuuguucagccuguuagccucagagaacuuaaaguuuuauugauuuuauuuuauguauguauguauguauguauguauguauguauguauguauguauuuguuuauuuauuuauuugagacagagucucacucugucgccaggcuggagugcaguggcacaaucaaggcucacugcaaccucugccuccuggauucaagcuauucuuccgccucagccuccugaguagcugggacuacaggcgcgugccaccacgcccagcuaauuuuuguauuuuuaguagagaugggguuuuaccauguuggccaggauggucucuauuucuugaccucaugauccacccaccuuggccucucaaagugcugggauuacagguaugagccaccaugcccagccaacuuaaaguuuuauuaugugucuuuccaaauguacuggaacugugcuaagaauauuaauacuauuauuuuuacuauaguuuuagaggaggcuuuaaaaaugacuuuguggaagucuuauuaaaaaugaccauugugaaauauauucagcacauguauauguuuuuuguagguaguguuauugagguuuuagcuuuauaucauuuucuuuuuaaaaugguuaacaguggcaaacauuaaaugaaaaauccuuuaaacugaaaaucuauagaaacuauuuugaugauauaaaaacuauauuuuucagauuuuaagaaaaaugccaaugauaccaugcagagcaaugugcauuucuuuuguuucguuagagaauaugcuuuaaguauuugaaaacuguaaaccuuuccagggaauuguaucauaaaaguauuuaugguuucugguagcuauuucucauguucuaaaauuccaucagucagaauucugagguuacagaaauugaauguguuaaugauuuagucuaguuugugccauagagaucauguuguggccaccugcauuuuggugaaauaugaaugcaguaagcugaugaccaaaauuagaauguagucugaguguuaccuauuuucucuacccucccacucccucaacucuuaacucuaaacucuuaacuccaaauccaccuucccuuguacuuccuucucccccucccccaguguuuuuauuucuuauuuauuuacuuguuuuucuugggauggauaaaccugaagacgcacacaggagaagaacauggaaaaguuuagaaaaggaaaugaacuuacauguucgaauaauguguuuuguguuagaagaacugaucaguaaagaagucccaucaauuaacuguaaaugugauggcaccaguaaacaucuauuaaauuuaaacccuuugcuguauuauuuuaggauauuaaacauagaagagaaauauaggccucaaggaauacacuuggaaaaacuggagacagcacacugauagguagugaaugaaaugauuugaucguaaaguagaccuaacugcugguuuacacuaagcaaaaauugucguugaccaguuuggguggugugucuugacgauaauaguggauuuagagggcagcagaugaaucaaaauauuagagaucaggagaauuaguaaggaaaagcagugaagucaggagaaccaguauuuaagaauuccugagauaagccaguuuauagcugaggaggagcaauaauagggguagaagaagaaauggaguugaauaaguacugcucacccaucuuaagugcaacauggagauuuuauuuauaguaucauaauuguuaggcaaucacaggagccacacguuugagggaauauguacaagccagagcagagcaaggaaaguccuuaaggagacuauuucaguaaucuaguaaugagauacagaagcagaagauugggucuauaagguuuucgauuagagauaaacuuagaaagaacaacgaggagaacuuugauuauauauauauagguugcaccuuguccugggcacuuaauagucccuaaagaguaaacguagacaacugcuguuauuuggaacauguguuuuuugcuuauagauuaacaguguguuuuuuuaaccucaguuuguuaacagacauagagaacauguuaaacccauguuucuuugcgcccgugugacauugugaacuaaguggaaaagaugucugugcuaaaggcacccauggaguaaaacauauccacaaauacuguguuuagggaaaaggcuagaaauagaaacugagaguaggaaauauugcaccugaggggcuguuauuguacuguguuccuucuccuucucuuccugacauacccuuuguuauaccuuuuuccuuuccugaauucuuuguuauuucuuuauucuuuuccacuuucauucuuuuucuuucauaucuuugacucaggccugccuggguuuuuuauuggcauguguggacauugcuuaguucugacccauuccauuagagaguuuucugguccuauaagguaagguuaagaagcauuauccauaauuuuauuauuauaaaauauaacauaccuacagaaaaaugcauaaaucgucauuguauaucuuaacauguuguuauaaaauaaacauucauguaaucaccaccuccaucaagaaauaaaauacugcuaucaccccagaagcuucuaaaagucuuuguauacccuuucccagucacaccauauguuuuaauuggcagcauuuauugcugcaguuguccucguccuaacccuuuugaugccuuuuccaaacaugugacuugccccaaccccuaaguguacauugauuaaguaggaagcugccuuuaaaugagaaugguaauuuaccacaguuuuugccugucagugcuuuaacucuccucuccugccucaaagccuauauacaucagauaauaacacacauaccccaccuacuuaaaaauccaccuaacagauggauacccagcuccccuucagaagaaaguacugucauaaucaggguaaaggugucugaugccagaccuguguuccaccccucacugccaucugcaauaaacacuaccuuuuaggacucuuaauuuuauagcaaaaguguacauaaccauucacacuuuuuugggaaguaaauaauguaugaauugaugaaaguaaaguuacuaaauacaugaaguauuauuuugcucuauuuuguggcuaugauguuucgaacuauuuuauacaaaagauuguuuuuguuuugaaagcaucuaagauucuaaauagccacuuuaaggucuguagggguagagauaauugauuaaaaguuuugcaaauaauauauuagcuugugcuuggaagaagcuuuaaaucauguagaggaaccuaaaaugauacugaauauacuguuauaucugauauaaccuucaaaauucaaaguagacauuuuucuuugucauuauuuuaauauuuauuuuugaguaggcaauacagucauaugaucaaauuaaacaauauaauaauguauucaaugaaaaguguuucuuuccccaaccccugaacuuguucuauuggugaucaaaaccuuuuauaaaagauacaaugugaauuuggggcaaagaugaacugauagacgaagaaaagcggaauggaauagagaaguagaccuacacaaauauggguauuugauuuaggacacaguagcaacauagaguuuuggaguaaggauggucauuucuacaaauggugcagguacuauuggauaucaguuuggaaaauaugaagaccgucucuuaaccgcacauaguauaaaagauaagguacagaugguuuguaagccuaaauaugaaagacaaaaauguaaacuuuuagaaagaagacuuauuuuuauagaguagaccagaaacaagauuaaucccauauccuuaaaaacuuuccuguuugccccacccuguuuuccucuaggaaauuucagaaacaaugaaaucaguuauuucuacugauaauuugauuaaaccaugaaauacugucuguuugaauaauuuagaauaaauucaaccuaucuuccuuccccuuuauaucaaauuagauuauauacguuuaauuauauaaaagguccauaugccccuuuucaauuuuacuuuuuuaguauuuauuaacaucauuuuuauaaaaccaacauuuccuuuaaaacaauauugcauaaaacagaaguuucaauguacuaccaagcaagaauucaugcacguguuaaaaaguuaagauaucuuaugucuauauucuuucagggcaauuaaagcauuucaggaggugcuuuauguugaucccagcuuuugucgagccaaggaaauucauuuacgacuugggcuuauguucaaagugaacacagacuaugagucuaguuuaaagguagguuguuggguuuuuucaagauacaauguuuaauuuugugguuuuuuuguuuuuguuuuucuuaaauauuagagcauugagaaauguuggaauuuauauuggcacuuuaaaagaaaauuugaaaauucaggugacagaacuguuuaucaacugugaaguagaguuucaagguacaaaguaguuaugcuaagacuuccaugguaacauuauacaauuacacuuuaaaaaaauaguuuuaacuaagaucugucaucaggaaagggugaagguuucagucuguuuggauauguaaauaacuccucuagaaaugauuugccacuguagaguucagaaccagcugaaugguucugaaaggauguuuuucugugacccaaucauugacccuguuuccaugggucucaguacuucuaccagcagaagcacaucuuauauuuaaauuagaaaaaagaguguucucugcaaggcauuuggacuguugguuugugagcauaaacguugugggaaaagaugauauguuguugauuaacuucguauccauggaaaugugauauuucuccaguuuuuaauuuuucauugaguuuuuuaugcuaucugaaccaucaauuuaggucuugcugggcuuuuucugaaaauagugcuuuccugcccaacagaggaauuauguuuugaaaggaguagcaguuguaggaaaaaguuuaaguuuuugugaauuuauguuuauuguuuauaaugguuguuguauucugaaucuccauugcagacuaucuugauucuaaaggaagggugguuggggagauaaagaaugacauucaaguagauuguaauuugagcucacuaauaaggaacuacugaagguuaaaaauaaaaaaaacuguacucaagagugucuaauuguucuagauuuuuaaaguagaaaacuaugcaaguacuguuucuaccuuacaugaguuaaaagaacaauacugaugauguuaaagagagagggagguacaaccaaaaacacuaaaaacaguagauugcgaagaauuuagaucacacagugguugaagguaagugcagucgaggaauaaguuccaggguaagugcagggugcagguaguguggagaaugagggaugccuggaaguuaccacuuuuccucaagcuuagaguaguagcauuucugacaccauacugugggacgucagcggauaugaacuggaaaauaaguuuauaaagcugccucacauuuuuuuugcaguuucuauuagcuaucaaagacucuuuaaaaugucuuauaauacagaauaaacauuuaagcauuucacaugcuuauuauguugcagaaguguuuuugguagcaguuugguaaauguugcuuaggaaauacauuugaagggaaaagcaaucagaugugucccacauuauggaaugugacuaugcguguaucaguacagugauaccuuaaguaauucuaaagaugcaaaauuccauuuaaaugaaaguggcgauauuuaaaaucuccuuuaaucaagggaaacaguguuucauggccgauugaaaguguucuacuuaacuuaagcuuggugggaacauuccugcauaccacuuuuauuuguucagguagaaagucuaaaaagucaagucauggugaucuuagcaaaauugccuuaagugagggcagccuucuuuugggggacuuuuaccuuuaacgaguccaugauauuucucgucccuagagugugaagguuucauuugauuuuuaucucauccugacuuuggcuuuuucagcccucucucuaguauuccuuaucuauuuuaagaagaauuugggcaugaacauuuuuagucaaagaggaggagguauuuuaguuuauuacuaaagugcuuagcauucagaaugagugaagguaggaauagaaggaaugauaucccccuuuaggugguuuuccauuuuucuaauacuucaccuucaucuggauaaauguggaaccucugauggcuuuuccacaacauuaagcuguuuuguagcacaguguguugguauagaugcuuuuuaggcuguaaccucagggacuccaacucaaauugguuaaaauaauaaaaaauaugcuccuaugugaagucuagccuucaggauugguugauucagcugaucuaagguuucaucaaggauucauuuucuucucaguucuguauuggcuuuuucuaaaggcugguugcucugcuuaguguaaugcuggcauauaagugcauaguaaaugaugaugaucauuucauguaggagaaagauccugguugccuguugaucucuucaaaaauacuucaccuugcaucuuauuggccagaaauaggccacauggccauuccuaauugauuucuuaucaaaggaaaugugguugcucuuagacuaguuaugcccagucuuugagaauuguucaaaucuguaaguaguuguuauccaguggagggauaggguggguaaaaaggauauuuugguauggggaguggugugaacagucuguccguuacagaucagaucuucucuaucccauuuccuuucccucugcccaaguguguauaauacuuuuuggaugguaaacuauuuaaauaaaauacagcguauuuucauaauagauuccuuuuuuuuccucccaauaugaaaugaauuguagggccuccuguuguguuucugucacuggugauaacuuucucacaaaaugugucucugaaauucuguguuggugcuguguaaacagcucucagagcaaaccaacuugguuuucaaaacuuugacccugccgcauaucuucgugaccuugaguaagauuucugacucuugauuuucucugugucugaagaacuagaauaauuauagccacccacaugauugauauaaaggugaauauauguguguguuuguuuuuauauguguguaguuuuauaucacuaguuuugggggaacaggugguguuugguugcauggaaaaguucuuuaguggugauuucugugauuuuggugcacccaucaccugagcaguguauacuguacccaauguguagucuuuuaucccgcacccccuugccucucuuccccgaguccccaaaguccauuaucucauucuuauaccuuugcauccucauaguuuagcucccacuucuaagugagaacaugugauguuugguuuuccauuccugaguuacuucacuuagaauaauggucuccaacuccauucagguugcugcaaaugccauucuuuccuuccuuuuuggcuaaguaguauuccaugauguauauaccacauuuucuuuauccacucauugguugauggguauucaggcugguuccauauuuuugcaauugcaaauugugcugcuauaaacaugugugugcaagugucuucuuuauauaaugacuucuuuuccucuggauagauauccaguagugggauugcugggucaaaugguaguucugcuuuuaguucuuuaaggaaccgccacacuguuuuccauaguggcuguacuaguuuacauucccaccagcaguguaaaaguguucccuuuucaccacauccaugccaacaucuguuauuuuuugauuuuuaaaucauggccauucuugcaggaguaaggugguaucgcauuguggauuugauuugcauuucccugaucauuagggcuguugagcauuuuuucccuauguucguuggccauuuguauaucuucuuuugagaauuuucaauucauguccuuugcccacuuuuugaugggauuauuuguuuuuuuuucuugcugauuuguuugaguuccuuguagauucuggauauuaguccuuuguuggaugccuaguuugcgaacauuuucucccacucuauugguuaucugauuacucugcugauuauuuauuuugcugugcagaagcucuuugguuuaauuaggucccaucuacuuaucuuuguuuuuguugcauuugcuuuuggauucuuggucaugaacucuuugccuaaugucuagaagaguuuuucugauguuaucuucuagaauuuauaucuuacaaauaaauaguuucagcccuucuuuagucucaguuaucuaucauguaaaacaaccauaauugggggccagcauagauacuguuggagaaauaaauguuccugucuuagaacuuaauccuuguauuuuugucccucugcccauccucagaaaugugaagcuaaugcucagcaaacuuuaugauccuaugguguuauuuuuacauuaaauugaccaauaaagauuguauguguuuagugagcaguggagauaccaauucuuaauucgugaacuaguuuaauauuaucugaaccagaguccauuucagggugacagguauuuuguuguuuuucuucucugcuucagcuaauauccccuaagguggguuugguugccuaguuaaugccauacaguuaauucaggauuuuuuuuuuuuugagacggagucucacucuguugcccaggcuggaauacuguggugugaacucggcucacugcaaccuccgccucccaguuucgaacaauucuccugucucagccucccgaguagcugggacuaccggcaugugccaccacaccuggcuaauuuuuguauuuuuaguagagacgggguuucaccauauuggucaggcuggucucgaacuucugaccucaggugauccaccugccucagccucccaaagugcuggaauuacaggugcaagccaccaugcccagccuaauucaggacuuuuauuucauuauccuuuaaugauauuaaugacaguuacuuauuuucaguauauauuugaagcagugugcuaccauuacuuuaauaaaaggauauuacuguugacagauaguuuuauauaaugucccuaauuuucacauccuggcagacuauuaaaauuauuuccuucaugugaagaauaagauacaaugacacccuuauucuucagucaguuaaugccugugcaucuauuuagaggaagcuuauauaggaauuuucccuaauguuuacauauuuaaauauuccuaaacuaugucaacuuagaacucuuuugggauuuuaaaguuagguaaccaaaaagggugccuuuuuuauggaaaccuguagaucauuggcugagaugccaauuuaaguccccuuuuauaauuugguauuugaauaugauaagugcugauugaagggguuaaugugaaagggauaggaagaugagaauuauggagacaguaaauguuucaaaggaaauggauugaacucaaaugagacuuguguguuagcuugccauuuuacuggguguugguguuucuugaauggguagauaaauaaaauggaagaggcuauaaaaugagaaaaugccuacuuauagaacaggcuggaaaauuugaagaaaagaaaaaaagcugguuuuauucaucaucacuuaacagaauuuuuuucuauacaaacugacacugcaguuguuuuuuccagauggcucaguucaccaauucaugcaguaugcuugccaucuuauuauacucgacaugaaacuucugagugaaguggcagcuccacugucuuuguaccauacucuucuuuaggaacuacuucauuacgaggugucucauuugaucuucuacccuguauaaacucaggaauuuuauuguaauauuuuugaugccaagauauuuaggcagaaggaauacaugaagacaugaucauguauguguaccuccuuuuagaaaccgcuuuugaaaucugaaaugccuccugucuuuuauuauuuuauucauguagaaugcacagaucauuuguuucauauaauuaaaauauugugggccgggcgcaguggcucacgccuguaaucccagcacuuugggaggccaagcggguggguccccugaggucaggaguucgugaacagccuggccaauauggagaaaucccgucucuacuaaaaaaaaaaaaaaaaaauuuagcugggcaugguggcgcgccuguagucccagcuacuccggaggcugagacaggagaacugcuugaaccugggagguggagauugcagugagcugagaucgcaccauugcacuccagccugggcaacaauagcgaaacuccaucucaaaaaaaaaaaaaaaaaagauacugugaacuuucuguauuuuagaaauaacuugcugaguuugaaugcuagcuauuaaauuaauuuuauccaugccuuauguuucuagaauauuuguaauguuucuuuauugacauuuuaauaguauauuuuuguuaguucaguagucugaagauaaugaaaguuuagggcugggcaccauggcucaugccuguaaacccagcacccagcacuuucggaggcugaggcggguggaucaccugaggucagaaguuugagagcaucuugggcaacauagugagagagagacacacacacacacacguuuguuaguucaguagucugaagauaaugaaaguuuagggcugggcucaguagcuuaugccuguaaucccagcacuuugggaagcugaggcagguggaucaccugaaguuagaaguuugagagcaaccugggcaacauagugagacacacauacacacacacacacgcaacauagugugaaacacacacacacacacacacacacacacacacccgcccgucucuuaaagaaaaaguuauuauuucuccauacuugcucugcccuauuuccuuuaugaugcucaauagcucucaccucuuucagcuggcauuuugaaaauuuuaaucuugagugguuugauuugagagaaagaauggaggaaggcaucucacucauaugacucaauuuucuuaggggauuagaaaaguccuauccccuugccacccccaacagcuuggaauaauuggugguaguuauaaaacuauaagauuugguguuuauccugagauuuggcuuagaacaugggaccgggaagggaaagaaauucuucaagaaaggaucuacagaguauuggcauaucauggaagcugcauuuguagaaucuucauaggaauugguugggauguaaaaauggugaggccuaaucguuguuuuuugguacuuuuuuuuuuuuuugagacggaguuucacucuuguugcccaggcuagagugcaauggcgcgaucucggcucacugcaaccucugccugccagguucaggugauucuccugucucagccucccgaguagcugggauuacaggugcaugccaccacgcccggcuaauuuuuguauuuuuaguagagaugggguuucaucguauggucaggcugcucucaaacuccugaucuuaggcgauccgccugccuuggccucccaaagugcugguuggucccucaaagugcugggauuacaggcgugagccaccacgcccggccuguacuuuuuauuuaauggauuuccuccuggaguaacagcaacaccacacagcaacagcaaacuaaguuuggggccagaaccacaaauuaacaucauuuuucauugcuaccauguuuaacauuuaaaaugcuucacugaggcaguucuuaauacauacuauuuuuggauaaaccaccaggcagauaccaaaaaauauuagcacacuauucuggucaucuuaagaaaagaagaacauucuuuuuuaguauuaguuacacuguguauuucuuccuuugguauaacuguugguucuuuauacauaaaauucauauagucagauuuugcuuggcuuuuuaugguuagcaguagauuggauuaugauugaggaaacugcaacccaguuuauuuucuuugauuuaaaucuuccuuuuccuuucagucauugacaguagaacucaguuucaccugaguguaacaucacuguuccuuuuggcagaggauggucauugcuguuuauuuuguuuucuacuuuuucucacuuguagaaaauaaucauccuuucucuguucuuuucucuuuguacuacucgucagcuuguacuuuaccaauuuccuagauaauaguuucugauacgaggcaaccuccuaauuaauuuaucuggccacuuaauaaugcuuucucuauuucacucugccugcccaacuuugguuuucuguuugauauuauuucugcccugaguucuauaacgugccuucaagugugaauuaguaaaaguggccgaaauacuucaauaccugcaaaaugcauguuugaaaaguacauggcugcucauauaugugcaguaacaccauucuuucucuuugaaacugaggaguuagggugauucuagguucccuguguuacaguuucucucuucuaguauauuuuaacuacagaagucauuucuaaagugauuucuggugcuaacuuacaacaacuuaagggcguuauagauauuuggucuucaaaggcagcuuuauaaagcagucacuguauugucacauuuagaaaaagguuguguggcugggcgcaguggcucacaccuguaaucccagcacuuugggaggcugaggcggguggauugccugaggucaggaguuugagaguugcuuggccaacaugaugaaacccuaucccuacuaaaaauacaaaaaauaagccggcaugguggcaggugucuguaaucccagcuacucgggaggcugaggcaggagaaucgcuugaccugggaggcggagguugaagugagcagagaucaagccauugcccucagccugggcaacaagagcgaaaccccaucuaauaaauaaauacauacauacauacaaaauuuagucgagggugcuggugugugccaguaaucccagcuacuccagaggcggaggcccaagaaucgcuugaacuggggagguggagguugcagugagccgagauugcaccacugcacuccagccugggugacagagugagauugucucaaaaaaaaaaaaaaaguuauauuuuaaaaggauauucuacagugcaaauuuuugcaguaucccccuuuauaaaacaucauauucaccuuguauuaguuauuuguguacauaucagucucaaauaugaauacaaauugcucacuagauagaaauaccuuggaaauuaaguuggcucauauucugaucauuuuguguacauagguuagaugcaaacuaggaccaguuuuuaaaaauuucuagucaguugcauaccuauacuuuuguaaaguaugauagaaaugaagaguuggaagacuagguaggauacagcuacaggaagaaagaugagcaagagcuguaagauaaaugguugcucauaggauggaugggggcaagguaaugaauguauccuagagaucuuaaagagauuuauuaacugacuugaugugggaagagauucccauuuacgggcucagaccacuuuacuauguuaaauaaaguaggggauaaagaaaguagcagccgguuuuggguuuaggaggugaaaaggcucugaauggcgauaagucauuugggaguaaauugauuuggagguaccugagggauaucagauauucaugcacacagacauaaaucuggagccaaaaagaagagcuagaacuaagauuuugaacaucuucaguauacagugcguuuugucccccaccccccaccccuuuuuuuuguuaaagaaauuuuuagaaaagaccggcugguaaacuucaaaaaagaagccucuuuuuugagcgaagauugucaggauuuguuagcuauuagcaugucauugguaugcaguagauucccuccuggaaacaguuguaauaaccuuguauuacaaagaguaucagaacugaguuuugagggcuuugggagaaccucagucagaucaucuugaccaggaacguggcucacaagcccuaccaaaacuuagccguuuucaguucuguaucuuauuuuagagaccacauuuuuaaaguaaguaccauggcauccuagggcauuucccuauucuuacccauagacuauucauuuuaggaaucaaguuuguugguuuuaauuuauacuuuuauuuuauuuuuuaauauuaauuuuauuuuuuugagacaaaaucucacucugucgcccaugcuggagugcaguggugcgaucuugggucacugcaaccuucgcuuccuggguucaagcgauucucaugccucagccaccugaggcaugugccaccauacccugcuaauuuuuguauuuuuagaggagacuggguuuugccauguuggccuggcuugucucaaacuuuuggccucaagugaucugcccgccuuggccucccgaagugcugagauuauaggugugagccaccaugcccugcccuaaauucauaauuuuagaaauguggcagucuguaacaaugaauaagaaaaaaaugauuuaucuuugacaugcaacaguaccuggcacaccuuuccuuuucucacuuaaauggucauuauaacccuguuuuauaaggcucuguaaaaauaacuucagugguuuccucagccugaaguaacucuuuucuuacuuuccucaucuauaucuuuuuggauucuguuauggaguugucuuuccuguguauucucagagcagguuaaaauuuuaaaaauccuauuaaggcauuaauuucagugaacauuguauucuguagauguauagccauagaagcgugccuggcauagauaaaagcugguugccagcaugucaguccuaaaaugccauguuucuaccuuaauuggauauagacagcaguaucaacuauacauaccuuguuuauauagucugaaauaaagguuucuggggcaagcacauaauuuaaaaacuucaaaauagaauagugugguuuaacucuguauauuagaauagcuugcauaaguuuuuuuucugguuugcagguuguugccuacaacccacugaaucagaacauucuagauugguacuggaaucuaaacauugcuccaaauuaauaacuuauaaccaaauacauaauuugucaauugcaaaaaguuaucccauugcuuguuuucgggauugggaauauaguugaaggguucuacaaguaaaaagauucaugagguaaucagacuauauacagcuagaaauaaaacaauuuaaagggaaauaaagucuugaaacucaaguuuuauguguuaauuacaugaauauagauuucuccccccuccccauagaaaucaaguuccauuggcuguauuaggcaaaauacuauaacauuauuuugaaauauugaacacguugaaggcuuuuaaaacaaaaggugacuuuggugauaaagaugucaacagaaauaguaaugaaucaaacuuugcguuaaauugggccagaagugcuccauaaaaagaaaaucucuauaacauuaaaaaaaaaaagucauaaguaaaucuucuugcuuggaaacuaauuuucuguagacugcuuuccgccuucagguuuguauauagucuuugaacugcagaggccucuucugcauaauaauuauuucacacagcaguagccaguuucagcacugcaguauuucagugugaggcacagauguuuccuagcugccucuguugguugcagggaaaggugcuggauauuuuaccaugguauuuucagguuugugggcugguuaucauaauugauaguccuuucuacugguguauauguuaauagguauaucuauuuugcaucugguuuagguccuggaaaugaggcuuuguggucauguuaucccuaccccgguucuucaucucucuugagagugcugaacggcauaucaguguuuuucuuuauguggaacgguguuguuaguuucuuauaaacacuuaguaauuauucuguaaguucuuucauugucauaguggauguuuuugaauguguauucguguuuuuuuuguuuuuguuuuuugaaacgcauucucauuuuuucugccacaggcacccgccaccaugccggcuaauuuuuguauuuuuaguagagaugggguuucaugauguuggccaggcuggucucgaacuccuaaccuuaggugaucugcccgccucggccucccaaaguacugggauuauaggcgugagcuacuguacccaaccaauguguauucuuuugcugaguaauuuuccuaugucuucacuguuuggaaauguuugguauuucauaguguuguggguuugaaauggugcaucaguaacuugauugcugcguuuaagauuguuuuauaauuacacaaaacauggucaagaaauacuccugccagguuucacugcagaaucuuaaauuacugauagaugaaauguaggcuaggcuguuugaauucuacaucucuauucuuccuugugggguuucagugaaauaguaaaacuaaaauauugccauauugaaggccguuucuucucauuucaguuuguacccuuugauggcucaguuaggaaugguggucuguguucuucuaucuaaauauuuaugcuuacaggacaaauuagacuuagaaauauaguacagucugaaugugugacuacucuugugcucuuuuugucuagaggaaagcaauugauuauaaagcaugcuuugcuuucauaguacucaaacguuuuaaaauagucuguucucuauugcuaugguagcacacuaaagggauguuugaagacacagucugcuuaguaggccaagggaaaauaaaagcaguuuucaaaguguucaaauguuagauuuuuuucauucagucaacuauggcaaaugauuuuucaguuuuauuuuguugaccauugcaucccuagugucugcauuguccuuagggcauuauagacucuugacccauugagaagauguaaucagcuuuaaguuuaagaauauuacaaguguuggucagccuaauuaugcaugcacaucagagacuuuuauuuuauuuuauuuuuuuugagguggagucucugucgccuagguuggaguggaguggcacacucuuggcucacugcaaucucugccucccggguucaaggaauucucccgucucagccuccggaguagcugagacuacaggcucucaccacuaugaacggcuaauuuuuuauuuuuaguagagaugggguuucaguauauuggucaggcuggucuuaaacuccugaccucaggugauccacccaccuagaacucccaaagugcugggauuacagucgugagccaccgcaccuugccaagagacauucuugagugaauacauuaauaauagccaguguucauaccaagugauguuuucuaauuuuccuucuuugugacuuuuggguagccaacaucaauaacucuuuagauuuuuggauuguggauaggaaugaauuuauuauggucauuuuuuuuaaugcuuuccacuuuaauuacuuuuaaugcuaaaaauuuguggaggcucagaaaauuugaauauauauuuguaggaauauuauuuagaagaguuuaaagagauuuacucaucuuuuuuaacuuagauuuuauaccaacucuauuacuuaucuuaauuuauauaccuuguuuaauguugauaaacuagauauuaaaugucacccaguguucuugaugauaauaugcgcuccuaaaaauuaguguuaugcauugauguuaacgugcuuauaugauauuauuacaaguggauucuguauuagugguuuauuguugacuggaaaauuauacaaauucuaugcauauaaugucacauuguaaaaggacaguuauauuugguagaugaacuuggacacaggcuauuuuaaaaggcacuuaaguacagugauuauugaaagaucaauaaagacagaaaguuuuacccucuaugacaauacucauagugauuuuuuuuguuucagaaguccaugucucauuuugagauaagcagugguguucugacaauaccauuagacuucuacuuggauuuucaaaaauaaugauauguucucuaaauauuuaaacuguuguauaacacuuccuguuuacuugacuuaaaaaucuucaccuuuuucacauaaauaaaaauauacauaggauaacuugauaaaauuaauucuuuuucaaauucuccauucucagcugucucaagaaaauaacccccacagcaugucaguugucagcaguaaauguucaaaguauuucuaguugguaggcuaguguauuuuauuugcauagcauguauuuauuauuauuuuagaccuuacauaccugaaaaguaucuuaagaugcuuuugugugacucuaaauugacugcauuaauuuucucacucucgucuugcagcauuuucaguuagcuuugguugacuguaaucccugcacuuuguccaaugcugaaaguaaguauuauuaaguacuguaguuuucuacauguauuccgaucacuucauggcaaauaacaauaauguuagugauaaauucugugcaauuuuuucuuuuagaauuguuuaauguaacuguauugguugccauggcuacuuacauaaauggaaccugcaagaccagauauugugaacagccugugucuaaaauagauaggccagugaagugaguuguugaauuaaaaguaucuucacuaauaaacaagauugauuuuucucugucguguauuauauuguagaugacuugguaggauuaaaaacagguuuugcuggucuuuuaggaaacaugaguauauaaagauucuuaucugauagcuuacugauuccuacugcgugggauaaaaauuauugguaauuaugaagacauuugugacuuuuaugauaguuuuauauaucauuuagaaagcuugaguugacauuuuucaauuaauuagaaaggaauacauuuacgaagcauguucuaacaaaguauuuuuuuccaaacaauuauuuucugcuucuauguaggugucuuuucaaaagcagauuggguugauuauauguuuaucgauauguauuuagguauauuuauuuaauauacacuaaaguauccaguaaaaagguuuaagaauauucguugaugcuaaauuucuuaaaaaccuucuuacuugaaaaauaaauuauuauuauuauuauuauuuucuuuuuuuugagauggagucucacucuguugcccaggcuggagugcaguggcgcgauuuuggcucacugcaagcuccgccuaccggguugacgccauucuccugccucagccucccaaguagcugggacuacaggugccugccaccaugcccagcuaauuuuuuguauuuuuaguagacaugggguuucaccguguuagccaggauggucucgaucuccugaccucgugauccucccaccucggccucccaaaguucugggauuauaggcgggagccaccgcgcccguccgaaaaaugaaauuuuuaauugguauaagaaaaaucgagcaauuaaugacaguuucagucauacaaaggauuccggguuuuagaaagucaguguuuugcuguaaguuacuuuuuuguuuuuguuuuuuguuucauuuugagauggggucuuucucugccacuuaggcuggagugcaguggugucagaguagcucagcuacagccuccaacuccugcacucaagcgaucuuccugccuuagccuccuguaaaucacuugaaagaguauagagagauauuagugaaaaguagucuuagucuuuagaaaugcccuaggaaauuguugaaucagcgaaaacucuguagaauuuucaguauaacguggauuaagaaauaguauggauuaaaucaucauuuaagccagaugaauuaugucauacuuuuacuaaagguaauuuccugugaaaaucuaaaggauuuuuacuuucuuaaaugaaauucaggauccaguacugauuaggguguuuguagaauaaacgguagaauaauaacaaaugcagcaguauuuuauaguuucuaauauaagguuagauuugaaaaaauugacucauugguuuaguaauuuauaaaguuuuaauuuauaccuuuuucuuaauuauauauccagguuauaaaccaucuagaauauauagaugcuuaaaauucuuuucaaauuaguuuacgagaauaagaaaacaaccgauuaucuuuuaauucauuauggucuaguaccuaaaagguaacuuugguaagucaguugaaugauaacuuuuauggaugucucauaaauaucaaacuaaauauuuugguaaauccucauuuuauucuacucuguuuaaaucucaguuguagaucauuacucuugagagaaaaaugucugcauagguaggaugagugccacauggcauaaaacuguugaauuugaaacaguuugaaccaucaugagugcuacaaggugguuggucacucaaacgggagagcauauuuucuauuuagagacuuuaggcuauuacaguuuaguagauuuggauaguuuacuuuagacagucuacuugauuacuugauagcuauaauaaugccugaugucacaacaaauguagaguaccuacuuugagccaguauuacucuuuucaacaccaggcuccuuauugucuuuguaaaacuuauuuuucuuugaauuuuuacaucaucacugauuuguacuuugguuuuaauauuuuuuaauuaaauauugauuuuacucuuuuuugacuugggauucaguuuuuaaauacuguguuuugaaauguauagauuauaaagguuuucucucuuugcuuaauguugccauuuugaacuuuguaaaacauauauucacuugcuauagauuuaaugcuaauuuuaauaauugcauugacagaaauuucauuugauaaugaccaacaaugaauacaugugguuucuuaucaugauuguguucuuuaguguguuuguuuguauauucuauuuuaguaaaagcaaauaaaaguuauguuuuucuauuacuuaaaucuauauaguguagacugugauaauguuugaugcuuuguuauucuuacuuaauuugccccaaauucugcuguauuguuacugauuuuuuugucuuuccucauccuuugcaguucaauuucacauugcccacuuauaugaaacccagguaaguauuuuaacuuauucuauuuaaaacaaaagcaaacaaaaaucauuacuccuaucaugcuuuacugaaaucagaaguguacagauaauuuaauggaguucugggcguuacuucuuagguaaauuuuguauuuuauacucauuaaaugugaucaagaugcugcuuaguaaaacaauuauuccaaggagugcuugcuguguacaaauuaauuccauuuaauauuuuccuuuaaacuugauccauuugcggcugggcgcgguagcucacaccuguaaucccacugguuugggaggccaaggcggguagaucacuugaggccaggaguucaagaccagccuggccaacaugacgaaaccccaucuuuacuaaaaauacaaaaaauuagcugggcaugguggcaagcaccuguaaucccagcuacucgggaggcugaggcacaagaauugcuugaaccugggagguggagguugcagugagcugagaucucgccacugcacucuagccugggcaacagagugagacucugucucaagaaaaaaagaaacaacugaacuugauguagaucauuugcaagcucaaauggcuauauuuaagauuuaucuuauucuugaugccagaugccuuccuuucuuuucagaauguuuauagaugguuguuguaaugcguuuuuuaaagaauucuuuugcuuuuucuuaagacugaaauaacucuucuaugugucauuauuggaaaggcaucaagagucaccucuugauguccuugccauuaauuucauggcuccuucacuuuaaaaaacuuuuaaauuuuagaacaucuugguuuuguguguguugauuaauacacggucaagauugauacaucuugauuuugcuuaguuguaugauaaaaguauaacacauuugggggggggugguuggaggcaaggggagggagagcauuaggacaaacaccuaaugcacguggggcuuaaaaccuagaugaugggguugauaggugcagcaaaccaccauggcacauguauaccuauguaacaaaccugcacauucugcacauguaucccagaacuuaaaguaaaaugaaaaaaaaguauaacacguucauuuuaggcagugguauggaaaaucaggaauaaauuuguaugagacucaaaauuaggucaucauaguuuacauaaauuuuuaacagcuuuuuaggaaacaaauacuguugguuuuuuuuuuaugccuacauaauuuauaaggucuguuuugauguuuuggcccaaguguuacaauaaggcauauaugugccaugcagaguucauacccaccagauacaagauccugcuacaucccguuauuuauauuguuauaggauguaaucagacaguuugagaucauuuaugcuggugguucccaaacccagcucuauggcagaauuauuugggaagcuuuauaaaucagcugucauggggaguuuuaaaaaauuaacaucagauuucuggguaccucaacccuccccaucugcacuuugccuccccauccccccucugccuccccaucccuccucuaccccauacucuaguuuuucuaguucucuaugagaucacuggucugucauuagcuaaagaagcagaaguuuuuuuaaccuuuauuuuuaaugaguauuuuugccggagauggaauucuguuuaucugacugcuuugaaauucacaauacauugucuuuuggcuuucauuguuucugauguggaguugucuguuggucuuacuguuuaauccugugaagguaaugugggcacagggcccuccucccauugauucauuugauaauuuuuuuuuuuuuuuuuuuuuuuuuuauugaucauucuuggguguuucucgcagagggggauuuggcagggucauaggacaauaguggagggaaggucagcagauaaacaagugaacaaaggucucugguuuuccuaggcagaggacccugcggccuuccgcaguguuugugucccuggguacuuaagauuagggaguggugaugacucuuaaggagcaugcugccuucaagcaucuguuuaacaaagcacaucuugcaccgcccuuaauccauuuaacccugaguggacacagcacauguuucagagagcacaggguuggggauaaggucacagaucaacaggaucccaaggcagaagaauuuuucuuaguacagaacaaaaugaaaagucucccaugucuacuucuauccacacagacccggcaaccaucugauuucucaauuuuuuccccacccuucccgccuuucuauuccacaaaaccgccauugucaucauggcccauccccaaugagccgcugggcacaccucccagacggggucguggccgggcagaggggcuccucacuucccaguaggggcggccgggcagaagcgccccucaccucccggauggggcggcuggccgggcggggggcugacccccccaccauccucccggacggggcggcuggccaggcagaggggcuccuuacuucccaguaggggcggccgggcagaggcgccccucaccuccuggauagggcggcuggcccggggggugggggugcugacccccccaccucccucccggacggggcggcuggccgggcagagggguccucacuucccaguaggggcggccgggcagaggccccccucaccucccggacagggcggcuggccaggcggggggcugauccccccaccucccucccagacggggcggcuggccgggcggggggcugaccccccccaccucccucccggauggggcggcuggccaggcggggggcugacccccccaccucccucccggacggggcggcuggccgggcagaggggcuccucacuucccaguaggggcggccgggcagaggcgccccucaccucccggacggggcggcuggccaggcggggggcugaucacaccacuucccucccggacggggcggcuggccgggcggggggcugaccccccccaccucccucccggacggggcggcuggacgggcggggggcugacccccccaccucccuccuggauggggcggcuggccgggcggggggcugacccccccaaccucccucccggacggggcggcuggccgggcggggggcugauccccccaccucccucccggacugggcggcuggccgggcggggggcugacccccccaccucccucccggacggggcggcuggccgggcagagggguccucacuucccaguaggggcggccgggcagaggcgccccucaccucccggacggggcggccggccgggcggggggcugacccccccaccucccucccggacggggcggcuggccgggcagaggggcuccucacuucccaguaggggcggccgggcagaggcaccccucaccucccggacgggguggcuggccgggcggggggcugacccccaccaccucccucccggacggggcggcuggccgggcagggggcugaccccccccuccccccucccggacggggcggcuggccgggcagaggggcuccucacuucccaguaggggcggccgggcagaggcgccccucaccucccggacugggcagcuggccgggcggggggcugacccccccaccucccuccuggacggggcgacuggccgggcagaggggcuccucacuucccaguaggggcggccgggcagaggagccccucaccucccggacggggcagcuggccgggcggggacugacccccccccaccucccucccggacgggguggcugccgggcggagacgcuccucacuucccagacgggguggcugccggacggaggggcuccucacuucucagacagggcgguugccaggcagaggguuuccucacuucucagacggggcggcugggcagagacgcuccucaccucccagacagggcggcggggcagaggugcuccccaccucucagacgaugggcggccgggcagagacgcuccucacuuccuagaugggauggcggcggggaagaggcgcuccucgcuuccuagaugggauggcggccgggcagagacgcuccucacuuuccagacugggcagccaggcagagaggcuccucauaucccagacgauggggggccaggcagagacgcuccucacuucccagacgggguggcggcugggcagaggcugcaaucucggcacuuuggggggccaaggcaggcggcugggagguggagguuguagcgagccgagaucacgccacugcacuccagccugggcaccauugagcacugagugaacgagacuccgucugcaaucccggcaccucgggaggccgaggcuggcggaucacucgcgguuaggagcuggagaccagcccggucaacacagcaaaacccccucuccaccaaaaaaaaacgaaaaccagucaggcguggcggcaugcgccugcaaucgcaggcacucggcaggcugaggcaggagaaucaggcagggagguugcagugagccgagauggcagcaguaccguccagcuucggcucggcaucagagggagaccguggaaggagaccguggagggagaggggagaggggagaggggagaggggagaggggagaggggagagggagagucauuugauaaauuuuaauacugauucagauuaaacaaaacagaauaaacucauggcaaacaguauauaauuauuaggugacacuguaaguauaugaaaggauuaaaaaaaaacucuacaccagugauuauaauauggauuuucauuuucaagugaaaaauuaagagaagcaagauggccugcuuaccuaccuauuaaaaguuaguuuuuauaguuccaccaauuuuuaccaauggacccuauuuaugaauauggauuuaggaaauuuaagugagauguauuuaauggcuacugcuagguaaacaauaguucaagggaaguuucucuacuucucuacauaggaagaaguuuccccacuucucuacauaggaagaaguuuccccacuucucuacauaggaagaaguuuccccacuucucuacauaggaagaaguuuccccacuucucuacauaggaagaaguuuccccacuucucuacaugggaagaagucuuccccacuaauaaaugaagaaggaucauuucauaauccccgagggcccugucccgacauuaccuucacagguuuaaauacuaagaucauaauuaaaacuaaaguuauggaauaccacuuuaccuagaaugguguuaaagaaauguuagcaaguacaauggcuuugugguauugagcuuauaauguuugaaaggcaaaaaggucguggccgagcgcagugguucaugccuguaaucccagcacuuugggaggccaagguggguggaucacuugagcucaagaguuccagaccagccugggcaacauggugaaaccccaucucuaccaaaaauacaaaaauuagcgggauaugguggugcaugccuguagucccagcugcuugggaggcugagguggaaggaucucuugagccugggagguggaaguugcagggaucugagaucucgccacugcgcuccagccugggugacaaagcgagaccccgucucaaacaaaaaggaaacgaaaaaaaaggucuuuuguagagauaugaguaaaggauuaaaaaaauuuuuuuguugaauuuaauaauaggcauuuggguuuguuuaauuuuaaugagagcucauccccuaacccuguauuuuuaucuuuuaugaucuuauagacaaagcuguuaauacuuuaguagauuaaaaaauauuuuaguagauuggccggguguggugacucacaccuguaaucccagcacuuugggaggccgaggcagguggaucacuugaagcccagaguucaagacuagccuggggaacaugaugaaacccuguuucuacuaaaaauuaaaaaauuagcugagugugguagcaugugucuguaaucccagcuacuuggguggcugaggcaggagaaucgcuugaacccggggaggcggagguugcagugagccaagauggcgccacugcacgccagccuggaugacagagugagacuguuuaaagaaaaaaaaaaugauucucauagguuucuauguauauugucauaccaucuauaaauaaagauaacuuugcuucucuguacaugugccgcacaaugauguuuugauuaacaaaggaucacauauaugaugguggucccauaggauuauaauagcauauuuuuacuguacuuuuucgguguguguuuuuuguuuuaacugaaccuuuucuauguuuagauauuuaccauuguauuguaauuguaguauucuguauaguaacaugcuguacagguuuguagucagaagcaagaggcuauaccauauagcuuagauguguaguaggcaauaccaucuagguuuguguaaguauacucugauguuugcacaacgaugaaauuguuaagugacacaugacuguauaaugucauaucuccaaauauauugucaauuauucuugaacauuuauauugaugaauuaauuuaccuucccuguuuuauuagcugggaccuccagcucauuuuuucuacaguaauaauaguauuaacggggcuucuuuucuuuuucuugaauuuagugaaauaauuugagcaguucacuaucuugauucuuauagccuuuaagguuucaagauagaggauuucucccuuuucauucuguuacugaaauguuaguuauuuuugaauagauaauccaaaaugaaaaguuuugaaagaauacacagugaaguauccucuuccuuccacuuccucaggcaucuacuccccucccuaaagccaucaauguuaccagugguuuuuaaauccuuccagagaaacucaguguauauauaagcaaguccacauauguuugcauguuuauuucuaguauuuaauuuuauucaaaugauagccaauaauguauguucucuucugaccuugcuuuaaauuuuaacuuaaucuuguaucuuggaaaucauucuguaucaguacguguagagcugcaucauaucccuuuacauauagauguacaguuaacuaauuuaacuacuccccuuugaggaauaauuacaaauaauaauauuuugaauaacacuguuuauaagaauuguuucauuuuuaacacuuuucugucaagcauuaauauauuaccaaaacacuauagacuuguguauguuauuauacuauagcaaaauaauauagauaagugcuauaauacuuaucuauauuagacaucuauaauauaaguauuuuacacgaauccaagaacucuaaauaaagaaaaaaauuccagcugauacauaaguuugugauaaauauguaggguuuauuucaugaauacauaggauuuuaccauuuugaccaguuuuaaguguacaacucacugacauuaaguaaauuuguauuguugugaaucugucaccaccauucaucacuaaaacuauuucaucaucucaaaguauccauuagguaauaauuccccauuacucccuucacugggcuccuagcagccacuauucuacuuucugucucugugaguugaccacucuagguaucucauaaaaguggaaucugccaggcgugguggcucaugccuguaaucccaacacuuugugaggcugagggauggaucauuugaggucacgaguucgagaccagccuggccaacauggugaaaccccgcuuuuacuaaaaauacaaaaaucagccaggcaugguggcaggugccuguagucccagcuacucgggagacugaggcaggagaaucgcuugaauccaggagguggagguugcagugagccaagaucccaccacuguacuccagccugggugacagagcaagacucugucucaagaaaaaaaaaaaaaaaaaaaaagugaaaucauacaauauuugugcuuuugcaucugacuuauuucacuuagcauaaugucuauaugguuuagcaugugucagaauuccauuccuuuuuaagaccgaauaauauuccauuguauggauacaccacauuuuguuuauccauuucaucuguugauggacacuugguuugcuuccaguuuuugucuguugugaauagugcugcuugaccauggauguguauauaaguuguuagaguuccugcuuucaguucuuuuugcaauauauccagaaguggaauugcuggaucauaugguaauucuauguuuaauuuuuugagaaacagucauacuguuuuuccuuuuuguuuugaagcaaguauuacauccgaaccuaauaaaagacaguauaauaagagagucaauauacagacugauaucaugaugaauauugguguaaaaaugcuaauaaaauauuaacaaacagaauaccuuaucucauuaaacacagcaauauacuaugaccaaguguuauucauuucaggaaugcaagguugacugaaucuucggaaaucuauuaauauuguaauaauagagcuaaagguaaagucaaauuauuaucaccauagauucugaaaaaaucuuuaaauucaauacccauuucuaauaaaaacacucuuauacauaggaauugcagguuacuuucuuaucgugauaaaaugcauaugcuuuaguuucaaagucagaauuuuacuuaaggccaaauucuagagaccuuuucacuagaaucaggagcaaggugaagaugccuacuauuuccauuaguccuugguauuauacuauagguauuagccaguguaguuagauaagagagagaagucaguuacaggcacaaauuaacauacagaauuaauaagcuucaacaacaauagucagaacauaacaggaaaaaauucuauuuagaguguucagcaaaguauauuaaauacuuaggaauaaacuuuagagagauacugugacucagcaguauaaagauguugauucuccuuaguguaacagaaauguaauacaaaaauaccaacaaacuuuuguuaggaguuagcuaaguugauaugguaaaacaugauaaaacgggugggaggauuguguaggauauacuaacccaauaaaacuuguauaauuaaaaaugugguacuggcaugugaauagacaaauuagugaaauauccuagaaagcccaggaauagacccaaguacauguagaagcugaguauaucauaaagguauuguucuuaaauucuuggggccuguaauguccaucccauaaguauaauguucuuggcucuuacuuuuguagcucuauucuggcagucucuuuuauugguggugaugaugguggugguggugguggugguggugguuuggagugucuaguucauuuauacuuaauuugauuauugauaugguuggauaaaguuagcugucauuccuguuguauucuuuguauuguauuguuuuucucugguugcuuuuaaaagguuuuucucuuuauauuugguuuucaaaaauuugacuucaaugugcucagauauuuuuuuucuuuauaauuauacuaauaguauuuuaagucugggguuugauuuuuuuuuuaucaguuuuggaaaauucucagccauugauuugucaaauauuuuuucugcuccaccguuuuucucuucuucucggacuccaauuacauguaugguagacuauaugcuauugccucaaacaucuuagaugcuuucuuuuuuuuuuuuuaacuuuuaacuuuuguguguuuguauguguguguuucugcuucaaucuguaugcuuucuagugacuuguuuucaaaugcauugauuucuuuuuuuuuuuaaauauacuuuccaaucugcuauucaauccauauagugauuuucuuuuuuaaauuucagauuaacauuuuuucaauucuggaauuuccuuuuguuucucuuucuggaguaugauuuuuuauacauuaauucauuaggauuauguuuuucuuuuguccacauucuucaaauaucugcuugcuuuuuuuuucuuuuuuuuuuuuuuuuuuuuuuuuuuuuugacaggaucuggcucucuugcccaggcuggagugcaauggcauaauuuuggcucaccacaaccccugccucccagguucaagcgauucucgugccucagccuuccaaguagcugagacuacaggcgcgugccaucacacucagccugaauaucugcuuuaaaauuaucuacagggcuaggcgcaguagcucaugccuguaaucccagcacuugugagagaccaaggugggcagaucaccuaaggucaggaguucaagaccagccuggccaaaauggcgagacccccaucucuacuaaaaauacaaaagauuagccaagugugauggcgugccuguaauccuagcuguucgggagacugaggcaggagaaucgcuugaacucaggaggcagagguugcggugagccaagauugugccacugcacuccagccugggcgacacagugaaagugcgucucaaaaaaaaaaaaaaaaaaaaacuacaaauuucaacaucugaguaauuucacagcugguuuucauuaauuuucuuuucuuuugaauauaggugaaauuuuccugaucuucauaaguuuaauaauuuuuauccugcauaucaugaguaauacauuguggagauugacuauauuuuucugaagauugauauauuuuugcuuuauuagccaguuaacucacacucuaaacuuugucacccuuguaauggcagcaacugaaaucucucucuaguucuuuuaggcugcucauuaucuguucuguucaugcauaauucggcagucagagcuuugggcagaguuuauguguggaauuugguguuuccacucucugucuccugacugggauuucuccccucacuuccaacucuuuaugguagccucaaaagcuguccuaugauucuucagccuaguaagacugccauuucuauuugaguucuagccagccaaaguaccaguugaagccugccuucaggugaaaauccaagaaaaagggaguuacucaucuagugccguuuccuuccuuuaagugugaacuuuuccuuugguuuugccugauuuuggucucucuccagugccaucugguaguugacuuuuauauuuuauccagaaugugaagcuguguguggaaugucacuccaaauauugucagaggcaaaacuucuacucaacacuauuaaagauaaacucaaguuacuuuuuuacacaucguuuauaauugcuaauuaauguacuacuauaagcauccauuguauuuugcuucuacuugucuagugacagacacuuagguugccccccaacuucuccauacuacaagcaguacuguucagaacauuaccuguggaaagguuuccuuggcauacauauuccaagaguaagauugcuagauuguagcauauuuguauuccuaauuuuuugaguaaauccccuuccaccaggacgugaguguucuccuuuacucacaucucuacaauacuuggaauuacucaaauuuauguuugccagucuuaaagguagaagcuguugugucauuuaaacuuguauguucugauuucuagaggaguauaguuacucacauuguuuuucaccuuuuauguguuggauuacuuauguccauugccuguuucucugccuaugcuuuuugagucagaucuuuacucuuccuuaugauuuguguuuuuuuggucauguccaauaaauucucucccaucucaaggaaacauucuucuacauuuucuucucuuaacuuuauacuuuuaccuuucauauucaggucuuuaaugcaguugcugguuuuguuguauaugguaugagguagaaaucuaauuucauauuuccaaauaugaugcuaccauuuuuucaaguagaucauuguuuuuauuacaguguugggagguauauuuuaacauuuguuaagauaauucaugaaggugguuuuccuaaaauuuaaaucugauuacauuacuugaaaucauucagugguucuccauuguuuuaggauacagucaguagucuuuaaauggauuagggaggucuuugugaaguagucuuugcauuuucuguccagccugcuaguacucuaaacuuaauaugcgcucguucuuccucugagaaguauuauaauguuaucauacacagcacaauaugcuuaauuuguuuuucuuguauauauuuuucacuacuguguagucuuagcaguuccuguuauguauuagguguuuaacaaauauuuaucaauugaaggaauugaauaacuuggcccuuauccuuggccuaacuaucuaauuaacuuuuuuuagaccagaugaguguuuugggggaacuaguuuagcugauaaguaaaaguugauuuaauaacucuggaucgcuggacgcgguggcucacgccuguaaucccaacacuuugggaagccaaggcgggcggaucaccugagguugggaauucgagaccagccugaccaacauggagaaaccccauuucuacuaaaaauacaaaaguaggcgggcgugguggcacaugccuauaaucccagcuacucgggaggcugaggcaggagaauucacuugaacccgggaggcggagguugcagugaacugagaucgugccauugcacuccagccugggcaacaagggcgacacuccgucucaaaaaaacaaacaaacgaaaaaacugaucaucucaauagacaguucuuucaaaucuuccuuauguuagcgguguguguguguguagcuccuuaauuguuuccaucauuaggacaacccuguagguagcaagauuggauauuagcucuuguuuuauugcaucaguuuuuuauugauguugaauccuaguuuaagugaauugccugagguucauacagccuaguuuuguauuucuaccuacuuuuuuuugaaaauauuuguuugcucaggcaguuauauacugguaaugauaugaauaaaagccacuucaauccauuguucugccaaguauguuuuacagguaauauuuaugagccuuucuuuuguuaguuuuuuccuuuuguuuugggggaguugucuuaagguuuguaaccauagcaauaaagaguuucaguuauauuaguacucuugagaacuguggcuaaaugguuucauuuagacauuugccugugaaauccuaagucuuacagacauuguuaggcuguaacagaguuuugaugucuuuaaaaucauauguauuauaaauauuuuuauaagauauuuuauauauacuagaaacuguaucuuuaaaauuuagauuuuuaacuacuuuuguacuuauuuagauuuugucuacagcauuuuugacaugugcuuuauuuauuuauuuagagacagaguguugcucuguugcccaggcuggagugcaguggugcaaucucggcucaccgcaaccuccgccucccgguuucaagcgauucuccugccucagccucccgaguagcugggacuacaugugcgcgccaccaugccuggcuaauuuuuguauuuuuaguagagacgugguuucacuauguuggccaggcuggucucgaacucuugaccuggugauuugccugccucggccucccaaagaguugggauuacaggugugagccaccacacccagccugacaugugcucuauuuauugaguugcuugggagcucaguguuucuaggcagacagauaugcacuuggagguagaauacgucuaauguuauuaaauaaaauugagaccacuuauguuauuaaauuucagaugauauuggcauuuggaaaauucuuaaaagucauacuuuaaugauacuucguuauagugaaugucaguuuuacugguguuagguacucuggaacaaggcuuauuacucaacugucugauguuaaagaaacauucaauaauggaaucagcacuuuuuucuuuuaguuuuaaaaaauaugcuaaaacaucaguauuguauaauucuuaauauaugaaguaguuccuuaaagauuauguuaauuuuucuccaaaucucuuuuucuguucuuuagaggaaauaucauucugcaaaagaagcuuaugaacaacuuuugcagacagagaaucuuucugcacaaguaaaagcaacugucuuacaacaguuagguauguaauaguauacauuuaguguauuauaagugcuucucuuuauguuuuuuccaugucgaguguggcaaauauguggcucauauauucuauuccuuugcucagaguugauaaaauuauucugaacccagcauauuuguauccucugcccagcauuguccuucccacagucugucucaguguaauucuuuaguacagcugguccuuuuaaauuaucaaaauuacucccuaguauuuaacccaaggaggauugaauacuucguuugugccagauauaugcuuaagcacuuaaugaaguugugauuuaccuaaugucacuuaaugguuggggagcuugcuuucauagcuuuauuaguuauaaugacuacaaaacaauuuaucuaaaaacuguagaacgucuaacacugugagcaugcaguucuauucuaaugugggacaugagggaaucuauucauuuggaugucauguguaacuaucaccaaaaagauagugaaagaacuccccagccuuuaauuuuguugcuuaauuauugagucauguuucuuguuuguauuugauauuuggguuguuuuuucaguuuuguuuuuggucugggcaaaucauuuauucuuaauuuuuagccagcauuguagcaguaugaauguuuucauaauguaacuauuuuuacauaguuuuaaagucacuuaagcuuagauuuuaucauuaucuuuagauaauauacauacaaauuuaauaauuauaaaucacugaauaaaaacaaauauuuugacacuuuuauaacucuuaaaaguauagacaacuugaguaaaauccuaauggaaaaaauuauaaacaaaacuaaggcuuuauuaugaaggcaauguuuguuuuuucagucaucaaauacuuuauaguuuguuugcuuauuuauuuuagacagagucucgcucuguccccuaggcuggaauacagugucgugaucauaacugcagccucaaacuccucgggucaggugaucccaccucagccccccgaguagcuagggcugcaggcgcaugccaccacgccuggcugauuuaaaaaauuucuuuuguagagacaaggucucucucuguguugcccaggguggucucaaacuccuggcaucaagcgauccuucugccucagccuccccaaauucuaggauuacaggugugagccacugugccuggccuauaguuuuauauagggugcgaauauauguagucagggccagugagguaggauuguguguauauuuuuuaaucugaauuaucguugauucuauagccuuauauuuauuccuuggaaauaaacauuuuguuaaugggauaucuuggagauucuuaauuggcucggugugguggcucacgccuguaaucccagcacuuugggaggucguggugggugaaucacaugaucagaagaucaagaccaucugggccaacauggugaaacccugucucuacuaaaaauacaaaaauuagcugggugugguggugcgcgccuguagucccagcuacucaggaggcugaggcaggagaauugcuugaaucugggaggcggagguugcagugagcugagaucaugccacuguacuccagccuggcaaaagagcgagacucugucucaggaaaaaacaaaaaacaaaaaacacacauuaauuuaguuuuacauggaauaguaaauaagacguaacaucuuuauauuuuuuguuucguaacuuggaauuuuuucagauaucaaaauuagaaaagucugauuuauaaucuguuauaucaguacuaaaaauuguuuuaauuucucuugaaugaaagcccuuuguagcuuuuacaguaccuuacugugagaaacugacuuucuuaauggccagaauuggcaguucuaaauuuuggaaauauguacuccaaacuaaauuaauaaauugacagaaaagaguacuuuuuugguuuguuuucugcuucguauucuuaaacauagaagaacaauuaagucauuuauguaaauuuuuuuaaaucauuuacuguagguuggaugcaucacacuguagaucuccugggagauaaagccaccaaggaaagcuaugcuauucaguaucuccaaaaguccuuggaagcagauccuaauucuggccaguccugguauuuccucggaaggugagacuuaccagacauuuauguuugauuuugucuauuccagcuaagagauuugaauuacaauuuaaaauguuaguuuacauauguaaccugaucaguguauuuucucuucuaaauacauuauuaaccaagauuccugaaaguuaaacaacaagauaaaguuuccaaauauggugguuuuuuuauagcauaaucuggucuagcaggacguuucuuauuuugguuauuggauuuuuauuugauuugaguuacugcuaguuuuaaaaaagucuuauccaauaguaacuuuuaaugaaguauuuaaaugccuuuccuucagacuuccaguauuuuuuucuauaugucuguuuuauaaaacagaggauuaauuucucaucugccugaugacuacugguagucaauggaaccuuuauaauuuauaauuuugauucaugauauuuaccuuagaauugacauaauaguaaaucucaaaucacaguuauacuugaaaucuuacagugagaaagugaauacauuauuagauuuguuggaauggagaagugucauguaacaaaaaucauuuucugcaagucuguaaccauuucuccauacuauuuauccauugaaugucugaauuaugcuuagugaugaucugaacuauaccucaugcauaaguaucugauagauuauaguuuuagacuaucaucagguuguauuuugauuccuaaucacuuuucgcuuucaugauauggugaaaagaucaauguacuaggagccaggacacuuagauucaaguccugauucagcuacuguuuguggaauuguggaugguuuaguuaaaccuuuuaaagccucaaauuuuguuuaacguauuuagagaauuguauuagaucagugguccucaggggcaggcuauuuugccacucuugccccggccaaggacaauucacaauguuuagagacauuuauuucuuucaucacagcuguaaagugugcuacuuucauauaguggguagagacuagggaugcugcuaaacauccuacaaugcgcaggacaguccucuauagcaaagaacuggcuggcuccaaaugucaauuaugcuguaguugagaaacccugaguuagaugaucuguuacguaucuuccugcucuaaagguuccaauuuuaugacuucuuuagaaauuauccuguuuuaauuuuaaguuuuguucuauuauuguuuacauagaauacuugauuguaaguaaauuugccauauaaucacauuaaauuuuaauuauauggcuucauuuuuccuuuaaggaaaguauguuuguaugagacauuaauuuuaauuaauguaauuuuaauuaauguaauauuacuuuaauuaaaguaauauuaauaugguuccuucccuaaaaauauuugauuacucauaguaugcuuagaagguuaaggaaaaaaauuuuuaaaaacauuugauuaacucauuauuaacauacaauaagaguugacugaaaagguaucuaauuuuuggugaggauuuccuaaucccuccccaggcuuauaaaagagccuaauuuggauugcuucuaaauaaagcuggaggguccaaacuuuuguguuucucuucuacaguagcagaaacuggauuuuauuauuuuuguaucuuuuugccugacaaaguggcuauucgauaaauggaugacaugaacuaacuaaacuccauuugcuuuuggagcuagcacuauuacuguuaguguuguggagugugaggcuuuauauagugacuguaaaggaggucuggaacugggaaacaguaggugccugucucuuguuuucagguuuauauaugaaaauuucuuuuagcauagauuaaaacgaauguauacuagaaaguauguuccuucugaccuaagauaguuuaauacaguaguguguagaugucuuuuuaguauagguuuuuaaauuuaaauucuaguuacguaaaauuauaaugaaccauguguagaauuaacuaucauagucaugcuguaauuuucagcuucgaugagcaguauuuaaucaucaguauuucagugagcaguauuuuaucauuuuuuuccaguuaacuaauuuuacauuguaaaacauuaugaugcuuuuaauuuaaucuuuuuggguaaauuuuuccaaauauacaauauacuuuuccugacuaaauaaaggauacuuaucacaauuuaacuugguuucggguucaagguuaucauuuuagacauauuauuuuccaucuguaauaauaaaauucuaaaucuuuuagacuuuucauauucucuuucacugccuucuaauguguugcuucuaaucuguuucuuguaagaaacauuuuaugaaugaauuauguuuuagaaguuuuuaaagcuccaaaugaagaccucaauugucaguaagaaauuuugggguuugaugacccucauauuuguuaggauuucuauuaaccucugcauucaggucuguguugaagauggacuuugcuugucauuuggcacuuguauuucaaaguaaaauuguaaugugauauucuguuuugcuagcaccaaucauugacuguguuaucacagaacuauagaauauuacaacugggagggaccagggaggucaucuaguuaaccuuguaaauccugucacuucaaagauuuagaaaguggguucauaaucacagauaauuaguaugagagcagggauuagacccuagauucacccaggacuuuuuuaguuacaugagacugucucagaggaaccuacuuucauuagaggaaaagugguugaugguuggagugggacaucuguaucugggcacauugguuuccuacuuugacuuuguaggaauggaauguuaaaacauugguuuugggaagaacugcuuauuucucccagcaguuaggcaaauuugucuauaaaucugaaauggcuuugauuucacaacaacuacagaagagcauguuuucuacuaucuguuaagcauucccuuucacgcuggugucuguuucuguuuggcauuguagcugaucucuucuuaugaauuuuuccuucauaaaacaguuuguagaugcucucugaaacugccuucucugucucaaucacggacauuucuuacaucuuucaaaccacaggauuagugauuccuuaggcuuuuacuucucccuuuagauguccuguguuuuuacagccucucuuccauauggaugaauuccaaaucuagauuucaacauuuaaagguaucuuaaacaccaggacaacaucuccuauucuuuacuuaacauuucccauuuuaauguccucacaucaugucaaagucagcauauuucaaaccauguucaccauauucuuccccagaccagcucuuuucuccuuuuacuuuugccaaaagaucaccauuuucuuuuuaucaagguuaaauacuaaguuacagcccccacccugugaacaucuaaucaauuaaucacaaagccuuuaucaaucuuuugguuucuuguuucucuuaucuuuuuuuucuugccgcuuccaguacuuucacuccaauuuuggccuguucuaaaccagugaauguagccacccucuuuuuucacuguccauaacuauuuuccuuucagucugcccuacauauuguuagaaaauuaauauuccuauaaagugcuuucagugugcuauucugcuuguuagaaaagcaaacuuuaggguaaucuuuggcuggauuuaaaauucucuacuguuuugugucugugcuuucuuguauauacauuagguuuugcucaugcuguucaaacccauuuaaaacgccuuuucucaucuucucugcccgaaucagugguuccuagaauuuuagguuacauaaaucaguaaaauuucaaagaauaauuaugaggauagaaauaugguguuugggcaaguaaaaacauuaacuuuuuuugcaauuuacugucagccaauaauauccaaaauaagagaauuacagcauaaauauuaauucauuuauuggaaaaacuuuauguauguauauguguguguugucuuuccaauuuguuugcuuggcaaacgugccauauacuggcuggcaauuaggaaucacuaaauaauaugcaucuuuacauauucaaaucccuuacucuuacucuccccccccccccuuuuuuuuuuugccuuuccuaaaucuugcagaauaugauggucucuucuuauccuaaauucucaggccaauuauugucuauacuggccauuugauaugacaucaugacauuuuuaauguaucuucaguccucaacuaaauuguaagcuucaugaaaauagggacuggguuuuuguuuuuuuucuuuuuccuuuagugccaagaauaagaagauaauuucaguauuuauaauuucaacuguuaucuguguauccaucauguccaucguguauauucacauuaagaaaauuacaguccuugaaucguuaaucuuaccuugcuaacuuuacuagucauaaaauauuauacuuuauauuauuuuuacuuuuuacuuuauacuauuuuugauacuuaguuugagauuaacuaugucuuacaugugcauuuuuuuuaugaauuaaagaauuauugcccucaguguuguuacuugggaaaggaaaauugaaaucugauacagcaaaucuuaccaacguauauaguguuuuuguuuuuaacucuguauuuugaccauauaggaaacuagaggucaagcuguauaagaagaguggaagagugccgugugugugugugugcacaugugcaugcagcucucaguauuauaauauugaagugauauguccccuaaucauuuuaauagaguucauuaaugcagcaugcuuuuuagcaccuauaagacagacuauaauaugguuuguuggagggcaaauuauaauauucauuauaguuaacaaguauauacauacauacacauaaauauauuaacuuauuaggguuuuaaaaaaauuugcugugauauauaguccauccuuucagccgauuaauuuguuucaguauuaauggaauucucuugauuuuuuuuuuuuuucccuucccuucucaggugcuauucaaguauugggaaaguucaggaugccuuuauaucuuacaggcagucuauugauaaaucagaagcaagugcagauacaugguguucaauaggguaagccuuuguauaaaaauaguaguaauuuaauugauauacaaagaugguugcaucacauauaguacuucauaguuuaaaucauuauaaaaccaagcaguucuucugaguugacuuauuuuuucuuaauuucucuuuccagugugcuauaucagcagcaaaaucagcccauggaugcuuuacaggccuauauuugugcuguacaauuggaccauggccaugcugcagccuggauggaccuaggcacucucuaugaauccugcaaccagccucaggaugccauuaaaugcuacuuaaaugcaacuagaagcaaaaguuguaguaauaccucugcacuugcagcacgaauuaaguauuuacagguaaaauuuuuaaauggcaguuuuuuaaagccacauauuuccccagaacacucaggcagaaggaggguggcuggaaaguuugucuaguuguguuuugaugucuauaaucuguuuccauauuuuguaaacauaccauagcuuguaauauuauuuuacuuuucauuuuaaguaagauaugcaguauuuuuaaagaugcucuuuugcacauuuacucuguugaugcauauuaauuuacauaauuuuuuucuauguacugucuacauuuuuaaguugucauagcauuuuauagaaaacacaaacagucuuucacucuugcuuggaguuucuugagaagacagcuaugagaacucugaaaacagagcucagcuuuguuuugauucucacaaagguuuauauuccgguuacccuguuuauacuuagugucuucuaaagccccaaauuuagaaucuauuuucuuuuaaaaacaauuagcuauagcauuuaggaagauuuaguggacuugcucuuacucaaguaggcuuguguuaaauuugcuuuuuacauaauuuuuccuaggcucaguuguguaaccuuccacaagguagucuacagaauaaaacuaaauuacuuccuaguauugaggaggcguggagccuaccaauucccgcagagcuuaccuccaggcagggugccaugaacacagcacagcaggugagaaguuggguuauguucugcaggugcccagcuuuaaggguucuuuucaauucucuaguggucaagcuuaauuuacuaagcacaggaggcuuuuaguaaugaaaagccuuuugauuuaauugcaaagggaaucuagaucaaaauaaaauucccucuaauaugggaagagauuuugggguaccaacuuagaaccuuugugcauuuucaugauuuugaaggagauuucuuaaaauaaugcuacagugguuuguuuaauuuuuaaggcaaguuuuucaaaggaagguacacauuauuccauugaugaaucauuuaauuuugauuuucaaucauugcaaucagcgauguccacauagcuuugaaaaguaugcagcuuguaaaguuuuauaauuugaaggaaugaauuaagaauauauagaacccuauuuuugucuuccuucugugauucuuaggcauguaaaccucaucauccaaauacugaaccuguauuaggccucagucaaacaccaauuucacagcaauccuugccacuacacaugauuccuucuagccaaguagaugaccuguccaguccugccaagaggaaaagaacaucuaguccaacaaagguauauguuuuagagaaauagaaaaucccagucaaaaaagaaguuucagcugcccugaaauugugcaguuugaacauuuccuguccuuuauuuuaaauuuguggacaucaaagagugaaagguuugaguuuuuccaucccaaacccuuaguaucauauuaaauauagaaaguagggauaaauuugcauucaucaaaucauuuuauucaucucccugccguuaagaucccagcacacuuuucaucaucacuuuuuacugacauugaaauaaauuuaauguuggaucuaguggacagugugguguuuaggcuagccguuugggccauaguuugagggugggccuuuuuggguggcuuauuaaauagucaguaauuuuuaaauguaugauuucuaaguuuaauaugcauguaaaauuauuuuuuaaagaauuuaauguuauaacaucuuuuuaacauguaaauauuccaauucauagucauuuggccuccucuaaccauuauuauuaacuguggauuuaaccaaauauucuuuaauuuuuuuuuuaaaucgauuuuccucagaauacuucugacaauuggagugguggacaugcugugucacauccuccaguacagcaacaagcucauucaugguguuugacaccacagaaauuacagguauguaagauguuuuugacaaauuguuuauuaaaaaggaguagagguagcaaacaaguauuaauuuuuuuuuuuuuuuuuuuuuuuuuugagauagagucuugcucugucacccaggcuggaguauaguggcacgcucuuggcucacugcaaccuccgcguccuguguuaaaguuauucuugugccucagccuccagaguagcugggauuacaggcacgcaccaucacaccccgcuaauuuuuauauuuuugguagagacuggguuucgccauguuggccagacuggucuugcacuccugaccucaagugauccaccuaccucagccucccaaagugcugagauuacaggugugagccacugcacccagcccuaaguauuaauucuuauaaguuaaauggcaguacauucaauuaaaaugcacaaaaguaaaaugagccugcauuuaccagaauaaugaagagcauucauucuuguuuuuaauuucuuuuuuuuuuuuuaaacaggacaugguuuacacuacauaaaguauaaauauaggguauauaggguaaaguuuucuucuaacucuggccccuacccacucaaaauguggcugguauuacuaauuuccuaucuaucauuccagagguauguuauguauguacaagcaaauauacaucccccccuuucucacauguauuauuauuuuucuucuuuuuuacacaaaugauaggauucuuauuugcuguuaacaacauauuuuacagacuucugcaugucaauaugugaagagcuuccuuguucuuuuaugguuacaucauauuucuuuauauagauguaacaccuuuauuuaagcagaucaguaauuuuggacauucagguugucuucagacuuugcuuauuccagacagugcugcuuuuagcauacuugucaauauauuuuuaagcuucaagaguuuucucugugaauaccuaagaauacuguauggaugaguaaaauuucaugcccaucuauuacaaagaacucauaguaaaucuuguucagaugaaugcuuaguucauucuuauauuucucaagcuuauuaaaggacuucaucuuggagugugugacuguuggucagaagacaguguguuugaccagauagugguucugaguuuagucauuucagggaaagguugcuuagaauaaugaucuuauuuccuaaauauaucuuugacuauauucucuuuuuguucuucuucuagcauuuggaacagcuccgcgcaaauagaaauaauuuaaauccagcacagaaacugaugcuggaacagcuggaaagucaguuugucuuaaugcaacaacaccaaguguguauagcauauuuuucccugaaauuuguuagcauuuugaguauuuuuauugacucuaaugucauuuuagagcauguuuauguucauuuuuacuuucuacugguauuugacagaauuuaguaaucucuguauuuuaaaauacugguaauugacggagauuuuuagacaaaagcaacuauaauuuugaagaagauacuuuguauuuuauuuauuuacaugauauuucacauguauucuaaggguuuguuuacauuauuuaguacugaggcaagguuuuuagggcuuauuuaguuuacaggaucuggcauauauguaacagaaugaaauuuugagauguccccucuuuugugauugagagaaggaccuauaaguucggggucguuuucuauaauuuucagcugcuuccuuuugucauuacuaaugggauuuuuuuuuuuugaaaccgacuuuugcuuuuucaaggaaguuuauuuuaaaaugaacaaauacaauuucuuguuuuuaaaguauguauuucucaacuuagagaaauuaagcauuuggguaaaaucacacauucccuaauuauacaucuucauauucaucuggggauucauagagaauccccuauagauucucuucccuauagauuacacaaccagcauuuacuuuuccuuuguuuuuuugacagaugagaccaacaggaguugcacagguacgaucuacuggaauuccuaaugggccaacagcugacucaucacugccuacaaacucagucucuggccagcagccacagcuugcucugaccagagugccuagcgucucucagccuggaguccguccugccugcccugggcagccuuuggccaauggacccuuuucugcaggccauguucccuguagcacaucaagaacgcugggaaguacagacacuauuuugauaggcaauaaucauauaacaggaaguggaaguaauggaaacgugccuuaccugcagcgaaacgcacucacucuaccucauaaccgcacaaaccugaccagcagcgcagaggagccguggaaaaaccaacuaucuaacuccacucagguaauaggaggacuagcuuccuuguuggcuuuucacauaaauguuuuuacuggguuuuauacacuuugagagaagaagagagaaguguuuggggaacugguuuuauaagaauuuuguggcacuacaauguuacuacauugugauucauuauguacauacaugaguauaucuuuguucccuuuguacagucucuaccgacauagauaacuuagcaaauuuacaaaggaagaaaauagaucauauaaaucacccaaaaugcaccauuaauuuacaguggcaucauaagcacauuuauguaauauuacuuaguucauuucugcauaaacugccuacuuaagaucaggcacuaaacuagguguuagguauuugcuuuagugggagaaaaagaccagugaauaaguauuuaccauaaugacugugaagugugacuuuggugggaaaguucuaucagaguaccuacgagagcacauaaccaagaugucagagucuuccagaagcuagaguuuaggggaggagagggcuggugaagugugccuagaagauagguuaugaagaggggagggugaaauaagaggcugagggagaggccaaauuuaucuugaaggcaaaguugauccacuaaaguuuuugaaacagaguaaugaauugcaugcacauuauuuuugucaaggaaaugggucauaauguauucaacguuagcacauucguuagacauuuaauuucuaaguuuuuacuucugaauguuuaugugcauaguauuucccauauuuuggauuguuuccaugauauggguacucgcugaggugaaacugaagggccaaagaguaaguuuuaagaaaaugcucucaauauguauagccaaauugcuuguacuuuuauuaauuuacuaugagaaauauuugacuuaaaaagagaaauauuuggcugauugucgguuagucuuauauuauugauaaaacugaaauaaguucuuuuucuaagauuuuuaaguuuauucuugaauuaauauccuuggugggacccugaucuaaagugauuaguacuuuauucauucuuagagaaauacugaguaccuacuagguucauuuccuacucaaggcucugggaauacaucaauaaagaaaauauacugagaugucucuacuugguguagguaaauagauaguaaacaaauaagcaauacauauauaacauuagaugaugguugugauuagugcuauggaaaaaagcacuaauagaaagggaacagcagaauacuagagauuggugguaggagaguugcaguuauaaaucagaagggcagggaaggcuucucugaaagauagcauuuggaugagaguuacaggagugagccuugaagcuauuugugauaagauuguuccaggucuagggagcagcacggagcaauggacccuaagguaggauugugcugugcacauuugaggagaaucaagguggcaagcauggcagaacaggacaggcaaggagugagaagagagagaaaugugcuccagcuggaaacaggauggcuaaaucaugaucagccuuauaaggauacuggauuuuauucugaguauccaggaaaccguagggggauuuugaacagaggagugaugugaucuaacuuuguuuuugacuagguccucuuugguacucuguggauagacugaaagaggcaaaaguagaaaugguaugaccauuuuagagauuauaccuguaauccagguuaaaaguugaugauggcucccagagugguaguaguagaugguggucagcuucuggguauauuuggaagguacagccaacaggauuaguugauauagagugaugugugagaaaggagucccagcuggccugaccaacuagaaggauggaugaaacuggaugguaucaccaaucagugagaacagauugagaaaagaacucaagauugagccuuagggcauuccaguguauuaggcuaggaaauugaagaacuagcagagaagaauagaagagauugaccugugacauaguaggagaucaaagacaaugugagugaugcccuggaagccaaaugaagaaaguuucaaggaggaggacaugaucaaauaaugcucauaggucauauaaagugaggacugaaaacugaccaucugagauauuugcugacauuauuggaguaaggaaacuacagguuacaggcaaaauuuaccccacgaccuguguuuuuuauaacccgugagcuaagaaugauuuuuauauuuuugaaggguuguaaaaaaagaauaauauaugauacugggugacccacaaagccuaaaauauuugcuaucugauccuuuacagaaaagauaugcugaccauuggauaagggcaauuucaguggauuguuggggugcaaaagccuaauuguaguucgcuucaagauaauauaaaaucggcagagaaaaacugaaguagcaaguauagacaguuccagcacacaugcuuacaguuguuugggcuacacacugcacagugccaaggcuuccauuuccauauaccguggcauaaaagagaacaacaaccggguguagcugacagggaaaaugggauuaggaguuguugucuuguuguuguuuuaaauuuaaaaugagagaaauaacaguaaaagucaaugggaaagauucaguagagagggagaaaauggcaaaggagaaaggggaauuguuagaaugggugagaggaugggauuuuggggguucauugucuuuaagcauuaaacaguuguuaaaaggauaacacgagauuuuuguuaaaaugccuaucauaguucuaagguauaacuggcaguuaauaagugaaagccuuuguuaugauuguaaagcauaguucuauuuucuuuucucucacaucuacuucuuuggcucacuuaguugcugaaguuuucaauacucucuuaacccuguuuuggaaaugugggauucuuuaaaaacguaauucguaauucuaauaaaaaggaacuccucaguuggcaggccacgaggcuucuguaauuuaccauacuaaguagcagggagcccccagccuuugcuucacacgcccuucaaagccauuaucuguaggaacuuuacaauuuaaguaaugagguugagagaguuguuuagaaaaugauguugaacugauuccaggucaaaaguuucccaaaugaaguuucugcauaucacuacagcugggaagccucugucucugcuguugauauaugguauuaauaucauagacucuaaagaggccuuuuugguaacuugucuuauacaaaccuauuugaauaauuuuugaaauuguaaugaaaacuagacaacugguagaccuauaugguauaucuaccuuuuaguuuuugaucaagggaggaauuuacauuacaguguggaauggguuuauucagauugcuuuugguagcaaggguauaauuuaagauaugaaaguaaaauuauauuaauuguaggugauuauucagcaaguacucuaaagaauuuguagcuuaaaauaccuugauuugcagauagagaagauguaauaaaauaguuacuuugucacauuucugcauauuguaaucaguguauuuguuaaauaauuggccucugaauuaaauauuuuacauuugaugaaauuuuaacucaccuacccagacuuucuuggauaauauuuuaaauauugauaugauuauaauaugcaguguuuuugcuuuaugagaaauuuucauguaacuuacaaauuucaaccuuccuuuauuaugauugaacuuuguuacuuauuaaaucauuuacaacuaauugcacuccuuuacacacucacugguguguaucuuuuuuuuguuuuuuuuuuuuuuuuugagauggagccuggcucugucgccaagccuggagugcaguggugcgaucuuggcucacugcaaccuccgccuccuagguucaagugauucuccugccucagccucccgaguagcugggauuacaggugcccaccaccaugcccggcuaauuuuuguauuuuaauagagacagggcuucaccauguugaccaggcuggucuugaacuucugaccuuaggugaucugccugccuuggccucccaaugugcugggauuccaggugugagccacugcgccuggccaauguguaucaacuuuuaauauaucuaguguuuuagguagauaagccuauugaguaaaaacauuaguuuaaaauuuucagcuucagaaacugauuuuaggggcaugcuagcugacuuuaacuagaugauuaaaugcaccuuuuaguauauaaauaucuuguuaucagcuauaguuuuauucuuuuauagcuuauuacugacaaaaugcucuaaccuuguugcugaaguaaucucaacuccaaauguaaacucguuuuaugauuccaauguuacuuuaaucaguguugcugaaaaauuggcuguccuauuuaauuauuuuguaaguaaaaugaaaugaaaauauucuucuuaaagaaguuucucugugacaccagaggcaaauuucagguaaaaauuaguuccaguuaucauauuuucauucuauuaaaugcccuaagugaucuuccucuagucuuaaaacuucuauuaacuguuaguauacugcccccucagauugcuuuaacaguagcaguguauuuuucuaaguuuucaaauucaggugaugaaaaauaaaguuuaucucaaagucauuaguggagacuuaaaaugucuuuuucuccccuuuuuuuuuaaaaaaaaaaaaaaaaaagagagacacaagguucugcucugucacccaggcuggaguacaguggcaccaucuuagcucacugcuggcucaaacuccugggcucaagagauccucccaccuuggccuccuguguagcuggacuacaggcacacuugucaacacaccuagcuugucugccugcuuuccuucccucucuccccucucucccuccucucuccucucucuucuuucucuuucucuuucucuuucucuuucucuuucucuuucccuuucccuuucccuuucccuuucccuuucucucucucuuuuucuuuuguggagacggagucucauuguguugcccagccuggucucgaacuccuggccucaaacgauccuccugccucggccuuccagagugcugggauuacagacauaagccacugcaccaagccuaucuagucuucuaaauauguguggauggauagauggggaaacuuuagguauuuuuugaaauauuuucauagauuuaauaguucugcccuuaauuuugaggauagcuacuuuaacaauaggauuugaauuacagaagauuauauuuuaaugauaauuuuaaaggcuuaaugaacucacuuucuauauuaaucuuuuaacagaucacagaccagugagaguugguuuauguugauccauggucauagcuuuuaauuauuaaugaugauauaugucuauccaugucugauuuuagagaugaaaauauguauauuggaacuuaaaauuuguaaugcuucaucugaaguaguuuauucuacacuaauaauggagucauuuuagauagcaaggaagaaaaauuucucuaaagauguuaaauacugauuagcuaaguugcagguacuuuuugauaacuuuaggacuugggucaaauuaucuuauacaguuagauauuuauuuuuaguggcuuuucucuuuaauauuuuaaauucuguauauucugaguuugcuuaauauuagauuuaaacuauuuuucuuucuuuuuaggggcuucacaaaggucagaguucacauucggcagguccuaauggugaacgaccucucucuuccacugggccuucccagcaucuccaggcagcuggcucugguauucagaaucagaacggacaucccacccugccuagcaauucaguaacacagggggcugcucucaaucaccucuccucucacacugcuaccucagguggacaacaaggcauuaccuuaaccaaagagagcaagccuucaggaaacauauugacggugccugaaacaagcaggcacacuggagagacaccuaacagcacugccagugucgagggacuuccuaaucauguccaucagaugacggcagaugcuguuugcaguccuagccauggagauucuaagucaccagguuuacuaaguucagacaauccucagcucucugccuuguugaugggaaaagccaauaacaauguggguacuggaaccugugacaaagucaauaacauccacccagcuguucauacaaagacugauaacucuguugccucuucaccaucuucagccauuucaacagcaacaccuucuccaaaauccacugagcagacaaccacaaacaguguuaccagccuuaacagcccucacagugggcuacacacaauuaauggagaagggauggaagaaucucagagccccaugaaaacagaucugcuucugguuaaccacaaaccuaguccacagaucauaccaucaaugucuguguccauauaccccagcucagcagaaguucugaaggcaugcagguuagugugggaaaguucaucaaagugaaaauguuugacuuacuggcaugaucagaaugcugaaauuuggaccguuuaagauaugggaaguaagcaaaagaugguguagucauucaucuaagaguuugacagaagcuuuauuuugcuuagauguuguagucaaaucagaugugagaaguauuccuguaaauugcuuauuuugagugggugugucugauugugcuguuacugcccucuacugguuacuagguugucagcuucagugugauugacuucgcucuggggauuuaaacaagagaauggguuaaaucauauuuggccaaauacagcaaggcuggaaaacccuauggguuuuuuuuuuuuuuuuaucagagccuauuaaauguuaggcuaggaauggaccccaucacuuaucaaggcuagucuuugcuuacaauugagaaaacuggacuguuugaaucuagaagagguuauaaagcaggcagaagaggaaggaagaggucaggggcaaugggcaguggagagacaugacagacugucagccauucuggaaggagccagacauauucugcuagucuaggaagggcagggccucagaaauuuaugaagaaaugaaccuccucugucccacaaaagaagaaucaaaggaucaggcagcaucaucuuucucugauauuuggaggacauauagauucuuacuggccuuuucauuguauaugacacauauauaauuuuucucauuuacuuguaguuguuguccucuauaagugacuaaaucuugaaugaaauuuaguuaacauaacuggaacaaacaaauaauucuguaauauuuucugauacauuaaauguuaaguuugagcagacauauaguagauuuuaaaaagaucuuuuuuugguuguagauugucaugauauauagaaaauaaccauucuauaaauagaaauuauaaacauuaguucuaguuuggcuacauugaccauuuaauauagcuuuuacauuuuaaaguucaaaacaauucuuauuuauagccauauaaaccucuuccugcaguugcuaguacuuauaugucuuauuuauuguuauguaaaagugugauuaucuuuucuguuguucagauuauuuuauuagaagguauccugggucuaccguuaaauguuugucacugacgaaugauugaggugaaauuaaauuuuauuuauauauaaguuugcugcuugggagggaugugggguaggagcaauggaguauggagaagaaauuucaauuaauuuaaauuuaucgcuuuaauugugacacuagaacuuuacuauaaauuacacuauagucauuuuucuuuaaagaguuugaguguuaaaaauaccuuuuggucuguguuuucuuuucuuuucuugucuuuucuugucuuuucuugucuuuucuugucuuuuuuuaagacaguuucgcucuuguugcccaggcuggagugcaauggcgcgauuucaacuuaccgcacgcucugccucccagguucaagcgauucuccugccucaagccucccaaguagcugggugggauuacaggcaugcagcaccacaccuggcuaauuuuguauuuuuuaguagagacgggguuucuccauguuggucaggcuggucuugaacucccaaccucaaguguuccaccugccucugccucccaaagugcugggauuacaggcgugagccacugugcccagcuggucuuuguuucauuuucuauuaguuucuauuucuguuaguuucuauuucauuauuuccugucaaauuuuaacuauuuaguuguuauucugacauagacuagggcagaaauuacauccuuuuuuauauuuuauuuuuuucuuuauuggguccacguuguuggcagcauuuuccuuagugaccuacaacauggugauugcuguaauuaaucuuaacugucuuacaagauuuuuuaaggucaguaacuuaagaggacauuggaugaucucuaaaugaaauucuucuaaagcauauagugagguucuugaguuccuaaaauuuguuucuuuagaaauuuuuauauuauagguuuuuauauuaguuuuuuuuuugaaguuaggcuaucauucaguucaacucugggccuacagaaaauagggaguguucagauuaaaugcuacacuuggcucuccuuagacagugccuugauucacugccaguuugacugucuucuaccugcuccucacucaucugcuggggccucuguccuguuuccuagguacugcugcucuaacugcuggagcaggggcuuucucucucauccacucucuguagacucaggacaguugcuagaaaauggggaagauuuggagguucaaaacuaacaucaugaacugcaugggaccuaaggaggaauauugucagaaagaguuccauggagcuauguucuguuccccaaguuacaaacuguguauaguagcaguuuucauaaguuuguauuaauaaauuguauauuauuuaaaaaaauauaauaauauauauauauauacauauauauacuuuaaguucuaggguacaugugcacaaugugcaggcucguuucauagguauacaugugccaugcuggccagcugcacccaucaaccugucauuuacauuagauauuucucccaaugcuaucccucccccugccuuccaccccacagcaggccccggugugugauguuccucacccuguguccauguguucucauuguucaguuccuagcuaugagugagaacaugcaguauuugguuuuccguccuugugauaauuugcucagaaugaugguuuccagcuucauccaugucccugcaaaggacaugaacucauccuuuuuuauggcugcauaguauuccaugguguaugugugcugcauuuucuuaauccagucuaucauugauggacauuuggguugguuccaagucuuugcuauugugaauagugccacaauaaacauacgugugcgugugucuuuauaguagcaugauuuauaauccucuggguauauacccaguaaugaaugggauugcugggucaaaugguauucuagcucuugauccuugaggaaucuccacacugucuuccacaaugguugagcuaguuuacacucccagcaguguaaaaguguuccuauuucuccacauccucuccagcaucuguuguuuccugacuuuuuaaugauugccauucuaacuggugugagaugguuaucucauugugguuuugauuugcauuucucugaucaccugugaugaugagcauuuuuucaugcgucuuuuggcugcauaaaugucuucuuuugagaagugucuguuauauccuuugcccacuuuuggaugggguuguuuguuuuuuucuuguaaauuuguuuaaguucuuuguagauucuggauauuagcccuuugucagaauggauagauugcaaaaguuuucucccguucuguagguugccuguucacucugaugguaguuucuuuugcugugcagaagcucuuuaguuuaauuagaucccauuugucuauuuuggcuuuuguugccauugcuuuugguguuuuagucaugaaguccuugcccaugccuaugucgugaaugguauugccuagguuuucuucuaggguuuuuaugguuuuaggucuaacguuuaagucuuuaauccaucuugaauuaauuuuuguaaaagauguaaggaagggaucccguuucagcuuucuacauaugaccagccaguuuucccagcaccauuuauuaaauagggaauccuuuccucauuucuuguuuuugucagguuugucaaagaucagaugauuguagaugugugguguuauuucugaggccucuguucuguuccauuggucuauaucucucuuuugguaccaguaccaugcuguuuugguccaaaaucugcuucuuucuucaacuccuuucuccacuuuggauuuuuauaugaaaguuuuauuauuuggcuugagguguucuaaacaguguugggcauuuacauagaagauaaagucuauuccuguuaucacagcccugcccuuugcauuaggauuggucaauauauuuuaaguggaaauagcuuauauuugcuaugcagagcacuauagauaccaucaguuccuucagggaaauuccuauguguuugaaaauugaccuuaauaggcagguagucagcauuucaaacacaauaagaaacugcuagguaugacuugaaugcacuauuggauaccccuuuauuuccauauauguaguuaaagugcugguuauuuuuaaaucugauucuuguuuaguuuaucuuauuguugcaguggucagugguauacauuaaaaggcaguuauaauacuuuugcuucuuucaugucuaaaauuguaauugcaacauucaagugauugaauuguugucagcucccuuagucaugccccaccuuuuucuuuucuauuuuaaaauauuggcaacaacauuuuccauuguuuuacuuugucauuugucucuuuuuuaauuguuacagaucuguguaaaugacagagacagaauucuacuaaucugucaaaccuuguuuucuagucucaucucucaauguccaguauguuguagaagcuuaaauuuaggugccacauuuaauuaguuugagaugcucuuguauagcacaguuuuaauacaugguucauauacuucaauuucuucaaaauaguaaccauuuacucuacaguaguauauccaucuccuuuccuaaaagacaguuucuguauucugagucauauuuugcuuauauucgauagaguggcagauacacaauucagcaugaaaacuauuauuuauguagauauuguaacuguuuuaucuugcauugguuuaaugauaauacuugaguuguuucuuucccagucucgccaaaaauuuucuacauguuaaaagcaaaaauuugauggaguuuauaaauugguaccaacuuuauacccaaaucuaaaagcuuaaguguauaucugucuuuaaauguacaaggcacaugugcuuuguggaaagagauugaaaacuaguuuuggacagaaaauuuauucaaccuuuaaccuuacuuguuagcugaauguaaaauuucaguuuaauaauauuuucauguauuuuuauuuaaaagucaauuauuuuaaauguaaaucauuccuuugagaccugccaugaacuuuguuguuuuuacuuggaguuguaguugaaaaaauuaagaaaguaacacccaugaugcuauuuaguauaacaucuuaaaagucuauggcagugaagguuuaagcccuaguuuucauuaguaucaaccaaaacaggcuaauuuguaacacuuuguucaguguagcaagauaaggaaaauuaauuuuguuucaaccuguuuuauucuuugugaugaaaauagcuaauuccuucuuaaguuacugaguuuuugaguucccagaauaauugaaaauuucaaauuauuacuugaaauuuaauauauuaagaguacuuaauauuuuaaugcauugauugcuuuugaacuuguaauaauucggugggguaaguuaguuaaacuggagugguuugaaagcucaaaauuauuucuuguugauuuucuaaguuuaguagaaacauuggaaauaucuugcuuguacugaaagaauuauuguuagggaauaauucuacacuaucuuaagaauuuauaauuuuaacagagugauaccuucaucaaccuaaauaccaguaaguaauaauuauauacagugucagagaguagauagcaguuauaugcauuguuuaaaaagaaguagcauaauuugcuguauagucaaggaguugcauaggaaauuuuuuucugauuugagaaaaaggaaaaaaucucagguuugagaguuguuacaaagauauucugauuauaauugcuaagaugagacacaggaaaagagacauucuguuuuuuacuauuaccuagaacuuuuuuuggucaaguuaauauuuuaacauugauggaaaagaaugugaugguagagaggaaauuguaagcucauguuuguuguuuaggugaaaauaaauuggaaaauuacgagcaaaauaaggaaugucaucaauaauuuauauguugugauaucuuuuauuuuccuucaguggaggauauauaggaaucaagucuuugcugaaauuaauaaucauucuuaguguuuuuccugauggauccacaucccacaucucauggacuugugcaaaugccuaguaauuuaauuaggacuuaauucaggauucuuuuuuuuuuuuucuguuuuccaaauaaauguacaacugauuaucccuuuuuuuuuuuuuccaggaaucuagguaaaaauggcuuaucuaacaguagcauuuuguuggauaaauguccaccuccaagaccaccaucuucaccauacccucccuugccaaaggacaaguugaauccaccuacaccuaguauuuacgugagucugaauugacugacuagaaauaaaacaguguuugcaacuaccugucuuucauaaaaucuuuaaauuuacauggaugcccuuuaggaaacauuacaauuauuggcagcagauuaaauaguuugggggcgggggggaagauauauucaagaagauuuuguaauagcauuuuuaaaggaccuucucagcuauuaacugugaugauauuagaaucaugagaaacauuuuuuauugcccuaauuuugagcagcguuaggaaaaagcuaccuaaaaguguaacuuuuuuuaguaaacuggguuuuaaauccacauucuacuuaguuauguggaccuuaacauucauucuguuuuauacaucuacccccccaaaaaagauacuaccuucaaaauaaguguuugagaacauaagugugauaguagauauaugugacuaaaaaaacuuaauagguuauuuaaaacauuuaaaacuagauacuaguuuuacuuuauagaaauauaggaaucugauauaggaagucauuagcaguucaaucaaaacaauuccuauuucuguuucuuccaaauagaucuuccuauccuauuuccuuucauuuuccugcuucuaucccaaauuaaaauuuuguaaguauaaaguuaggguaguauauguauaaugaucuugcaucuauaaaaugguacuagaguuuguuuuauagauuuaacccccuugcccucuagaggccaaauauuaucauauuaauucuuccuccaaccaguuguuguuuaucccuuacuauguaagggaagcacugggauagacauguaaaaaaacuuguaaagugagcucugaggagaaaaaaaaaugcaaaauuaaguuuuuaucuuuuauggguccucuucagucugcuuucuuugauaauauuuguuuaggcauaauuuuuuuucuuuuccucucuuauauugugauuuuuuaaaaacacauagcauaaaauuuaccaucuuacccauuucugagugugcaguucaguacuguuaagcauauucacauugguguccaaccaaucuccagaacuuucucaucuugacaaacugaaacuacacacugaacaacuacccauuucucccuccugccagccccuggcaacuaccauucuacuuucuguuucuauaaauuugacuauucuagauaccucauguaaguggaaccauacaauauuugucuuuuugugacuggcuuauuucacuuaacauaauguccucaagauucauccauguugcagcaugugucaagauugucuuuucauuuuaagacugaauaauauuuaaaacacuuugauuuugaaguuuaauuucaguuucauuucuccuacauauuuuugucaugauaaaauggaaaggagaaauguaugugguuacuaucugauuaaaacuagaaucaaaagucacagugauaagauacugucaaauagaaauaucaccccauaaaaugcguuauuuaaauugugaaaaauaaugaauauuaauuuggagcauaauauuuaaauaaaagcucuguuuuccugagaucuaaccacauauuuuaauuuuacaguuggaaaauaaacgugaugcuuucuuuccuccauuacaucaauuuuguacaaauccgaacaacccuguuacaguaauacguggccuugcuggagcucuuaaguuagguaagccuuaaauuaaaaaaggaaaacguuugucucuuuguuuugcuaucuuuuaacuuuuccagcacuggcagauacuuuucuuuuuuuucuuuuuucuuuuuuuuucuuuuuuuguauuuuaauuuuacuuuuuuuuaguacuaagaaugagagagaguguguguaucacuucuuuaauccaugaugugaauauauuguuggugauacugguuacugacaauuugguggagguuuuuaaauuuagcuauuacuuugguccguuuacauaauugugauuuagguuaauagaaaaaauuugauuauaaaauguaggugaaauuugaugcuacuaauaaauacuauagccccauaaguauuuccuggcaucugcagaaauuaaauaaauaagugaaauuucaguccuuucacacuuaauucuuucucggaugggaugacauagcaguuagauucagggcuucagcguaugguucugcaaacuuggcacauagcucagguugugcagaggcccuaguuuuuuaugggaacuggauacagugccguaaaaugcuuuaccuucuuccuuuaaaaaaaaaaagcacuuaaaauauuaucccaaauauaauuuucauuuuuuaacuacauuuauguauucaugaagaccugggacuuuucucuacuaaaacuuugguggaagcuaacaaugaacauaugguagaagugaggacacaguuguugcagccagcagaugaaaacugggaucccacuggaacaaagaaaaucuggcauugugaaaguaauagaucucauacuacaauugcuaaauaugcacaguaccaggccuccucauuccaggaaucauugagaguaaguauuuguauccuaaagauuauuuuaggauuuuaaagaugauuuuacuuuggaguuuugaaaggacacauuacuuuuauaugcaucucaucauuuuauguuacauaaaauacuuuguaaguguucuccaguugucucguauguauauauguauguauguauguauguauguauguauguauguauguacguacguauguguauuuugagacggagucuccaucugucgccuaggcuagagcgcaguggcacgaucuuggcucacugcacccucugccucccagguucaagcgauucuccugucucagacuccugaguagcugggauuacaggcaugugcuaccacgcccagcuaacuuuuuugcauuuuuaguagaaacuggguuucaccauguuggccaggcuggucucgaacuccugaccucaagugauccgccuaccucggccucccaaagugcugggauuacaggcgugagccaccgcacccacccucaguuugcuuuuaguaaaaucuaaacaaauugauggauucaugaaguaaauagcaucauggggaaauagaauuacugucuagugaaaugucucauuucugggauacuuuuuuuagagcaggguuucuuaacuucgauacuauugacauuuuggacuggauaauucuuuguuguggggggacuguccugcaccuugcaggguauuuauuagcaucucuggcuucucaaaaauaucuccagacaugucauauacccccugaagggcacauucacuccugguugagaacuacugauuuagaggauaaacuaagucucaaguuuauuuuaugcuuguaaaauccgguuuggucuucucauuuuuuucuuuagugcuaucucauagacaacuccugcaggaaacauuaguguucuucuuaccaaucuuaggcuguaagagaaaucugaaggaggaaauuaaaaaacaaaaauguaaaaauaaucaggauuauuauuauuaaaagacccauauagcccuuucagcacugaagcauuacaaaaauccucuagcacuauaaugagaacuuugugaauucucuuacaaagugaacauaauacauccaaacaaaugaguuuauuaaacguauuacucaaauacuugucugcacuaaguuguuuuuucuucaaauguccuaccacugacaguauguggcugaaagucuuuaauuugugauucauuagauuugcuuguugucuuuguuuaaaauucugccaacucauauuuucaaucaagauagcauuucugccuguaaauuguauauuugucuuccuuucccccugccgcucccuauauauuacaaagaaauucuucuaauaaaaacuauccugugacuuuacugaguugcagugaauucauuguccauauaacucuguaguucagacuuucaagauacuucaaguaccugguaauauuauagucagaagagaauaaauaguaagaaggagucaaagaucaucaaagaaaaauuuggaggaagaguugaaaagcaaagauaguaagaggcagucuauuuaaauggggaggguuccauagccaaagaaagcuugggguuuuguuguuguuuuuuugagacggaguuucgcucuuguugcccaggcuggagugcaacggcaugaucucggcucacugcaaccuccgccucccagguucaagcaguucuccugccucagccucccgaguagccgggauuacaggcaugugccaccacacccagcuaauuuuguauuuguaguagagacgggguuucuccauguuggucaggguggucucgaacucccaaccucaggugaucugcccaucucggcuucccaaagugcugagauuauaggcaugagcuaccgugcccugccagcauggggucuuuuaguaugcuuuaagacauggaccauuacaugugaaaaguuugacaaauguucagacacuauacauuuaaaggaauggaagccaaaggucagaaguauugcuaacucagaaaucauaaaacaguguuaacagauaucaugucugugacucaagaguuguaaauaaaaguaauauuugcauugaaaaauaccuauauguauccagcaauguucuaaacauuuugucauuuguguguaauucauuguggaauaaauauccccuggaagaacuuuuccuuuguucauaaucaagaauaaaaaguaucuuaucuuccacuauuacacauauauagcuauguacacauacauacaccucugcuagcuuauaucauuuauaaucaagauugggaugcccuaggccuuucagcuuuccucaaguuuucucuccucuugaaaauggggcagguaugagaaucuguauuauaacuuuguggcuaguggaggaaguuggauaccaugccggugagauucaacuuuucuuggguauuuauuuauuuuuuauuuuuuauuuuuuuuagacgagucucacucugucgcccaggcuggagugcaguggcgugaucucagcucacugcaaccuccaccucccggguucacgccauucuccugccucagccucccaagaagcugggaccacaggcgccugcccccaugcccggcuaauuuuuuuguauuuuuaguagagacacgguuucacugugucagccaggauggucuugaucuccugaccucgugaucccucugccucggccucccaaagugcugggauuacaggcaugagccacugugccuggcuuucuuggguauuuauuuauuuaaugugguguuugaagaaauuuucauguguaagaggccuauagaaacuuaguuucaaggccaggcauggugauucacgccuguaaucccagcacuuugggaggcugaggccgguagacagcuugagcacaggagacuagccugggcaacauggcaaaaccccaucucuaccaaaaauacaaaaauuagcugggcguggucaugcgcaccuaauagucccagcuacugaggaggcugaggcaggagaaucguuugagcccaggaggcagagguugcagugagccggggucgcaccacugcacuccagccuggucaacaggagucaaaccuugucucaaaaaauuaaaaacaugaaacuuaguuucaaaacacaaauaauacuauucaaucuagauaugaacuuuuuuucaguuguaugguggaaaggauugccaguuguagaacacuaaacuagacugcuuuuugcuuaaucuauaggaagaaaaugaaaaaagaagucaucauaaagaccacucagauagugaaucuacaucgucagauaaguaagucauuuuuaauguccacuuaguauuucuuuuuaaaaggcauguuucuaauacugugucucuuuuuuaaguucugggaggaggaggaaaggacccuuuaaaaccauaaaguuugggaccaauauugaccuaucugaugacaaaaaguaaguccuuguaguaauauuucugugaacugaugcaaagaguuauccugugcuagauugggaauucucuacaauuuccucuucuguuucauuuauugucauuuuuuuuaaguugacaugaauuuaagcuaaacuuuuuuugcuacauuuuacaauuaaaauuuuaaaauuuuuuuuuaaaaauagagauggggucucacuguguugcccaggcuugucuugaacuccugggcucaagggauccucccaccucagccuuccaaaguguugggguuacaguugugagccacugcacccugccaaauuuuuuuuuuuacuuaaaacuuuucugcaguuuuucaucaagacucugacuauaugcuaauuacauaaucacaaauuauauuuuuaauuauaugaaauaguuacgugaaaauguauuuauaaaauauaauuguacaacuauuaaaauaguuuuuuucuuuuauuggugaauaauuuuuaugccuauuuuuuguugggaaguuuucuuuggaaaaaauuaaaaauuuaagcauuuucuuauggaaaaguaaaauauuuauagacuuaauuguuuuuucugauuggaacacaaggguuuugaagaaaugguaaacuuccacagguauuuguagcagaguuucacuuuugauguguuauuuuauugcagguggaaguugcagcuacaugagcugacuaaacuuccugcuuuugugcgugucguaucagcaggaaaucuucuaagccauguuggucauaccauauugggcaugaacacaguucaacuauacaugaaaguuccagggagcagaacaccagguaauuuguaugaacuaacauaucuuguuaaaauggaaaacaaaaucaaaauaugaaacaugcaaagacagccagaaucuugucauuuauaaugaauaaaacugagaguuguuccuguuauaagacuuuuuaacugggcucagauuaagauuuuuccccuuuucauuaucuuuuuuuaguguaauagcccagaaacauuauaacaauuuaaucuggaaaggggucauuggagcaccacugggaaauaaguucuuuuggccugaagacucuguugucaaucccaucuguugcagagagugauggggugcaguguuuuugaauuuuucuuuuaacccaaguaacaauaaaaaguauguuuuauauguaaccgaaugcacauguauguauacagcagcaguuuuauugaacaauacguuuuccaaucuauucuauucuguuucauuuaaaaaauaaaguguagguugcaguuuucuaaguggaucacaacucacgguuuuaaaaaaacuucaucauguggagacauuacuagacucauucuaauaacuagucuagacuuugccacuaauuaggcuugucacuuuuggcaaguuacauuucuucuuuaggucuuuuucuucauuuauaaagugaauuacauuguuuuuagacuuaaauuuuccauccaguacugaaguaccaucuucuuugugcucuuuugcauugacaugaaauuucacagggugauauucaaaauauuuaacaauugccacaaucgcagcacugaucaauuagaagagauacuguugaugaccaguucagcuguaccaauguacuuggggcugcaggucucccucaggugcuucucuuugcuacuugaugcagccaugguuugaaaaccagacugcuuccuucuuuguucacauucuuacugagucgugcuuaagaauuuuuucagaauagggcuaugcuugcuucuggguaaaaugggucagugguuccccauccuggcugcugauuugauucucuuguccuuuuuucuuuuuucuuuuuuaagagacagggucuugcuaugucacucaggcuggagugcagugaugugaucauagcucucuguaaccuuguuuaacuccugggcucaagcaauucuccugccucaaccucccaaguagcuaggacuacaaguacaugccaccaugccuggcuaauuguuuugagguucacauaaugacuucaaguuauucuucccucuggaccucccaaagugcugggauuauaggcuugagccaccacaccugguagcuuuuuaaaaguauguaauuaauuaaucucuaggauucagauccaggcaugaggguagguggguggguugguugguuuuuaacugagguccccagaggauucuaauauacagccaggauuagaacuauugguuauaauuguuauccucagaccauuagaagcccaauucugugauauuuuauccauagucagguaaagugcaaagaguucuggaauaaaugauagaagaacuauguucugcucuguacucugucauuggacacugauauaaauguugggcaaaaaacauuauuuugaguaccuuguuaugggguaaacacuguuccuggagauuaguucauaaggaaaaaaaugguaaugauaucuauaauagcuaauauuuauugcuuacuguguacagauggucccugaguugaaaugguucaacuuaccacuuuuggacuuuaugguggguuuaucagaguauuaaaugcauuuucaacuuaagguauuuuucaacuuacuauggguuuaucaggauguagucccaucuguaaguuaaggagcaucuguauuaagcacuguuauaugcauucauuaguuuauccaucuucaaaacaacccaacaauuuauagagauuauuauuaucuguucuuacauauagggaaacugagucagaaugguuuaccaacuugcccagguucaauuaaugacuaagccaaggagucuggcuccagagccuaaucucuuaaccaugauuauacugccuaucauagaagcucuuacugaguauguuaggaguugacacaaaaaugcuacagugaugaagaacuaaauacuacuagaguguucucuguugagcauuuguaagguuuuguuuccaaagacccauuuuucuauagaauuauagugugaugauuaauuuuuuucuguauaaguaccgugugcuaaccaauugcaccacuggagcuccaauuuuuuuucuuuucacauuucaggucaucaggaaaauaacaacuucuguucaguuaacauaaauauuggcccaggugacugugaaugguuuguuguuccugaagguuacugggguguucugaaugacuucugugaaaaguagguuuccaaaguaaauuuucuuaaaacauauauuagaaagcaguaauuguaaacgacaacuuaccaagcuggaucuccuaauggauacauugccaguauucacuuaccauucagcgaagaauucauuuuaaauuauuugauuccaaaccucauauuuuguguuauuggaaauacuuuaagaaagaugccaugaaacaacuucaugcaguaguaguacccaugaauuaagaagauagaaaaguugaguuauuaguuuaauuuuuaaaaugaugcauacuuauucauuugaaauguguguauuccaagaaaaauuguuuuguuauaaaugguuuuaggaaguagaaggaauucuuuauugagcacccguauaggcugugaauaacucaagcuugaccauaauaccuuuugccauaucaugauauaaauucuuuuuaaacugacaacuuuuucuaugaagaaauuuuauaaaauguauuauuuauuuuuuauuuuuaaauagagaugggguuucaccauguugccuaggcugcucuugaacuccugagcucaggcgauccaccugccugggccuccuacagugcuggauuacaggcaugauccaccacauccagcccagauuuuguuuucucuaguugaaagaacuuggauaguuccuuuccuuaagaucccagaaauagcuuuuauuuacuucugugucuuguguuaaaaaguacuuuggaauuuuuuuuuaguugguuucaauuugaucauuugucuagauagaaccuuacucucuucuuuucuagaaccuuauucucuucuuuucuagaaaguacuucauuauauaaggaccugguauuuucauuuaguaauaacauuagcaaauuaguauaggaugaaaauauacauuauauacacauuugguguuaugcccccaccccaauuaaagggggaaaacacccacagaaaacauuuacaugagauuacuuugaaaacuaauuauacacauauuccacauacuacuuuauuuuuauuuuuuccuuuuuuaagacggagucuugcucuguugcccaggcuguagugcaguggcacaaucucagcuuacugcagccuccgccucccagguucaagcaauucuccugccucagccuccugaguagcugggauuacaggggugugccaccaugcccugcuaauuuguguauuuuuaguagagacaggguuucaccauguuggccaggcuggucucgaacuccugaccucgugauccacccaccuuggcuucccaaagugcugggauuacaggcgugagccaccacgcccagccccauacuaacuucuaauuucuuacuuugguuuaagaaucuuugcuguaaauauuuggauuuaguaagaagugcaucguaguugaaaaacaaaaaaauauauuaauccacaguuuccuuauauaaaagcaagagauaauuaccuuauguugucuucucuauucauauauugguuuccuucaauguaagaaagccaaagauacagaguuuuaaagcuucuaauguacugaugaaauaaccugauuacuuuaaucuguacuuuuuuuauggaccaguagcagcagagaaagaacauuguuauaugggaaaucuccauugugcuauagaaagauuuuuauuucuuaaacuuugaguuaauacuauauuguugcagcuauaguacaggaauccuuguucauuguuucugaguagggacuggcuauuuuuaggguguaguuuuguuuccuaucuaaauggagaggugucuugggaaaaaagauaauuagaauaagcagaugauguccaaaaagcuugagcguagggauaauaaaaauaucaaguuagaaggaaggguuagguaaaucuaauaacucaguugugaaaguaguacuugcuucuucagcauuucacuguaauuuuguuucacauaaagauuguugcuuuugauagugacuguauacuguaucuguaguuuauuuuauggcuuuaaauaauaccugucuugaaauaaccauucuuuugaauauaugauuaaaaugaugcaugcuuuuugguaaguuugauuuuuggggcggggggugucuguuugggauuacuugcuugcuuuuggauaaaaaguuuucucuaauuuuguaauggcaauacaugggugaaauaaggcuaggauuugugucuauagccauuuuuugcuuuauaggcaacuuuuucuggacuguaucuacuuggccuugucacacacaauaagccaauccuuaucccuuugcaguuaggcuaccauuugcacucuagucuaaacuuucaagaguagccuugcauuuuucaagagagaaaaagagagacuaagguucuuucuagaucauaguuuggcgauuucuuuuccaugaagggccagauaauaaauauuuucaccuuuccuggucaugcgcugucugucacaacugugucauuauagcacagacacagagauaguacguaagugaauggacauagcuguauucuaaugaguuuuuuuuacagaaacaggcagugggcugaauuuggcccgugggccauaguuugccaacccuugaucuagauaaaaaauuaaauuuaaaccaguaaaaacaauuguaaaguauacuuuaucaugugcuauagcacaagacaaauaaaguaagauuauuucuuagaucuuaaggaaaggaacauuuuuacuguguaaguucuuccuuccccaaaauaugaaauuugaagugguuaauucaauuuuauaaaguucuuuuaugggaaagguugcuauguuguuuaaaaaguacuucauaucaugauggagaauaagaagccagauauuaaaauaaaagcuuaauaauaucuaaggaauguuuccaaaguauauugguaguaguggucaugauuauuugugcaugugcgugauuguuuguuuuugcugaaguuguuuugaacugcauaguuuuaaucagcuaaucaucaaacuauauggagucugacauccagucuccuuuuccucagaaauuaagggaaguuccugguacuuguauugccacaguguuccuguuuauggauuuaaaugacuugaugucaacuccaccuuccauuuaccuuuuagggauuucuaggugcuccagggagaaggcuucagucaaaaauagucuuuguugaaaugaaauugaaagugaauuuauguguuacuugaaaguagcuuuggauuucauuuggaucuuugaaaaaucaauuuaagaugguaaugcugggccgguccacuuacuacagguauuauaauuccuguaaucccagcacuuugggaggccgaagcaggcggaucuccugaggucaggaguucgagaccagcuuggccaaccuggugaaaccccgucuguacugaaaauacaaaauuagccaggcgugguggcaggugccuguaaucccaguuacuccagaggcugaggcaggagaauugcuugagcccaggaggcggagguugcagugagccuagauggagccacugcacucccgcccaggcaacagagcaagacuuugucucaaaaaaaaaaaaaaaaaguaacacugaucuuuaguaauuuaguacucaaccauaauuacacacucuauauacauacagcagaucuuuuugcacaagcaauuauguuucaauaaaaugaacaaguguuuauuuaaaaaauuugugacauuuucuuccagucuuacuaggagcuucuuaauguaguugauccauuugcauuauuuuuuucuuauuucagaaauaauuugaauuuccuaauggguucuugguggcccaaucuugaagaucuuuaugaagcaaauguuccaguguauagguuuauucagcgaccuggagauuuggucuggauaaaugcaggcacuguucauuggguucaggcuauuggcuggugcaacaacauugcuuggaauguugguccacuuacagguauuauaaagaauaugcuuuaaaaaaguuaauuuauaaaggauuauauccaauaggacuguuccuuuuuucuugaaauauaacucacuaaaaguuguaagaagaaugacuccuugcauagaauuguaauucguaguacaacaaauuaaauucaaguuaacaaauagaaaucuaagagcauagauguuagcaaauaacaaguuuauggcuuuaauauacaugaagguuauaauaauaaauuuuagagugcuugguuuuauuuuaaaaaaacccuuaugagagaaaacaaaguagaaaaauuauucuuucacauuuaaaaaaaucuaguguuucauaugaauagcucuguaaugucaaaaucuguuugaauuaugccugccuucaggcaguacucacuuaagguuaagaauguggaguuuagagccagaaagaccuggauuaggaccaggaucuggcucuuguaacuuugggcaaguuauuuaaccucucugguccucgauuuuuucaucuguauaauggaaguaaugaaauuaauaaggugauggugaagaguaaaugagauaauggguaaaaauaaaaacacagugcuuggcacauagucauaggaagugcucuuuauaugauugcuaauauuauuacuacuguaauuaucauaaagcauaaaaauuauuuuuauaguguuuugagguuuucagaauugauguugaagauaucaccugagcaggugauaaugguuaucuucauaucuuuugguacuuuggguugcuuuauaacuguuuuuuuuuuuccuagccugccaguauaaauuggcaguggaacgguacgaauggaacaaauugcaaagugugaagucaauaguacccaugguucaucuuuccuggaauauggcacgaaauaucaaggucucagauccaaagcuuuuugaaaugauuaaguaagucuuuucuaaaacugcuguagucccucucuuuuuggggaguguuaacuauuaaguuuuuuuucucccuuagaauuacguugacaucaaagcaaaauggugcaaaagucuagcagaauguauuaugagaauccacauguuaaaaauauuuuucccuuucaaauagcccacuaugguacagaaaggaaaaaaagaccuaugauuauaaaccaguagagucacagaccugugcuucuuucccauuucccucugaaccaccugauaucccaggauaacuuuaguuuuaauaugaaaaucuaccauuaauaacuugaggggaaaauggcaucacagaauauuuguugucacagacaaauuagcaguuaauauagggauuugacuaaaaugcugauuuuuuaauuuuuaauuaaaucaucuauuuuuuaaguaucucuuuucugagcuacuuaaaaaaauuuaguauaaguuauauaaauucuuaccuagggaccuaguuugaauacauauauaccaguaagcuucacauuuguuuucacaguuucuaucuuagccauuuuguaaaucuauuuagagguacuauuuucaaauagugcuauauagcaguguuucccuaaacuguguuuuccacuacuagcucuguccccaaaagauggggaauucuggcuauggaaauaugggaaaugauagauuaaaguucagcaaguggacaaguccuuuauuuuuuguaaaauauuucagauacuguauauguuaauguaauuugugaaugagggagaagaguuauaguguaugguauuucccaaacuuauuugaccaguaucuuuugaagaauuaguuuucucaaaagcucauuuugggauacacugcuuuauauuaauugauaaaaauaaguuugucuuagucuuuguuaaaauagaguuuacauuaaguauuucuccugcagauauauuaauuuggucagcauguguuguuuucaaaauacuguauuuugaaaguaauccugguuuguuaaaaugauuucaaaucuagaucgaaacuuuuauuuaaacaaaaguuguguggccaagguaacaugccuauaaauuauuuuaugacagucuuuucucaguugcaccauuuuaccuaguuauagguagaaggguaggggagacaaaaaggaccaaaagccaaauuauagcgaguaauguacuacaaauucuuuagaacauuggaucuuagguaccauacucucgauaaauauaauuuauagugggguggggaauugucuguccauuuauccuguuauaugucagaaugguacuuuacccugaauagcaaguucaguguuauuuuuugaaacaaaaaugaccuaaagucacugaagguguuuaguagaucacuuaaagguaguucaagguacaagccauuuaucuaacagcuauauagacugaaaguaacucauuacauuaugaguagauuaggauuuuauaauuggaaaggauuuuaaggucacuuaaucagcuccuacuuaauauaguaaucucaucuguauucauaauuuguggucauccagugacuucuuaaacauucuuuucaccucacuauaauucuugcaaguucuuuacaaaauggccuaaagucuaccugucauuuggucccaauuuccuaaauauauuuaggauuucugcagaauaaaucccauucaacaaauguuugaaaacucacucuaugccagacacuguucuaggcacugaugauggacauaccaauguuuaagaugaaauuccuguccucuggagacuucaauucuaguagaacaagacagaaacccccaguauaauuuauuuauaugaauaagauaaaauacaauaauauuugggaggagggaaggucggagugcuccuuuugcuuaacuggucugagagugugaguuuucugcuuagcccugaauaaugagaugaaaucaacuacacaaagaucuauggguagaaccuuucauauacagagaacagaugaaggcuaaauugggaauaacuuuggcauguuuaugggacaaaaaggccagggugacuauagcugaaugagagaaaggaagagugauggugauaaacuuaagcaagcaggaaugagaucauacaugggcuuucuggacaugguaagaaguuuauauauuaauucuagguguuacagcuugccauagaggauuuuaagcaggaaaggaauagguuucacuuuaaauuuagaaaauggaucuagugggugcaguggcucaucccuauaauccuugcacuuugggaggccgaggcgagccggaucacuugaggucaggaguuugagaccaggcuggccaacauggcgaaaccccaucucuacuaaaaauacaaaaauuagccgggcauggugaugggcaccuguaaucccagcuacucuggaggcugaggcggcaggggugguggggcgggggguugcagugagccaagauggugccacuucacuccagccugggugaaagagugagacucucucucaaaaaaaaaacaaacaaacaaacaaacaaaaaaaaaacggaucuaauugcuguguguggaaugaguuccaagggguaagcuuagaaguagggaggacaaauuaggaggcaauuguaacaguacagaccaaccuggacagagauuucccuguaaaaauagagagagggggucaaacuagggagucuuauggaacuaaagcuuguagaacuugcucauagauuaggugguugagugagagggaaaaaggaaccaaggaaaacuuauagucuuuucuucuuguugccugauugucauuaauguaaacauuaaucaccucuaucaucuuuuccauucccuaccccacccucaauauucuugauacccuuugagacuccuuccaguuuaucauuaaaauguugagguaucgacauuuauguuguuauaaaguugucuuguguugagguuggacacacaaaauuuguguguuuuucuacuuauaauuuauagugauacuguuguuucuuauacauuucuuuuuuuuaaccuagaugcacuuacauucuuaucuauacuccauuuugcccuacgcuacaaaaugucucaucauuuaaaucuugauugcauuccugugauauuaacaauucuucucccagcuugaguaccuauugacacaccaauugaaaauguuaaccacaagucuagaccccuaggccuugcuuuauaagccucccuuuuugaaauaauugucauugagccauugcuaaaaauguacuuuucagcagccaacauggcucccuuucuuugauuuaaugagucuuugcuuauuguaugcaaggcucuaggcuaggcccugaggguuuauaaauacaugguauagguccuuucuucaaguaacaguuagugcauauaaauaaaauagauugaaagaaauucggugauagauccacugauguuuccagcccaaggagucaggucuuuuuaaaaaacugugcauucuggggaagaauguauuuugugugaugggugaaaaugaggaggcagggagaagagaaaggaauagcacuuaagccagcuuaaaaccaaacucuugcaccaugagaaagaugccccaguucauccauaaaauagcauacauaccauaucuccuuaaguccagcacaguuacguuuucauccagugaaagaauaaaucccuuuucuucacuugagcaccaggcaaaauaguuggcuuguguagagaggccauguuguaugaauaacuucagucuucaaccgcuaaagucauacucaacaugguaauuuugaaaggcucggaggaacucuguagaggaauagcaaauguauacuccaaguaauguucucuuccuccugcugucauucucuccacuauaccucucuuuuuugcccucccuccugauuacccucccugcugugcauuugcgugagcuuaaauguauauacgauacaacugcuauauguuuauuguccauaauuggugguauguuuuggcuugagugcaaugugugaugaguaguaaaauaagauacaguuguaaaaguugguuagaagccaauuaugcuuuguguaccaaacuuaagacuuucuucugucagagagcucuugguggguuuuuaauuaauaugaucuaauuuagguuucguaaagguguuucuagcuauuaaauagagcaaacuuuuggauaguaagaggaaggagugaaugaaagauucuuuggcuuuuaagucuggauacuuagaugguuuaauaauaaugcuaguuaauaaaucgggcucaguacuuagccaagcacugagcaaagugcuucccagacuguauuauuucucacagcaucccaaggucauucaauugacuagagguagagccaagauuuaaacccauaucugucugugaaagugcuugagugaaucuauggcacaugacuucauuugggggcaaguuuggggagccauuaaaagaguuagauagagcuauuuagaagaagcugacuagggagucuucuaccuaggaguugcugacugucuugagaggaaaagggaagaaaaaguuggggauagcacuuugugggggauaugccuguuuaagaaaaagaaauacgugagcuauauaacaggagagcauggagacuguauuguugcagaaauagagaaggaggucuuuuuccacaagcacaguuuugccguauaauuguuauauccauaucauugcucuggucuucaagucuaguaguuccugccaaaaaaugaagugcuguugguuuuuucugguuugugagcugugccaguucuuaauaaaugguuuucccuugccauuccuucccucugcuuugaguuauuuucuucaucuccuguucacucugccacccacagcaguuuggcuuucuacccuugguaagcccaacacuucucuuguugaggucaccagugaccaacuguuguacaucugcaaaggcacuaauguacacuuucuucagaaaucuaccuuuuuuaagccuagcaugugaaugccucaaaucugauucccacuugccuugucagccauuucucccacugcugcuuuuaaaugugugcuugaauuguuuucuauuuauuaauauuuuuaccacuccauuugcuauuuuaaaccaucuuuaauaugaacugcaguuuuuacaucucccccuuuuuuuccuuugaaucaucuuuuaauaaagcauuaauucuguauauguugagcauacgaauuauaggcuauauuaaaagaaaaaauaacagcuaaaugaaaugaaauagagaagauauacaaacauagucuucuuccuuaauucuccccugaauuguuauuuuuaauucuuaaauacugugaaucuacaguguguaauuuuuaggcuuucauaguuaagugguaagcccgcucaaccaaaaagaauguaagcaaaauuuaccuugugccuucucauccgcucccucccucccucagcucuacccaguucuuuuuauucagugaauguuuauuguguacugcauugguacccagguuugugcuaggugaaaaggauuugaucacuucucagacugcucaaagugaauugagaaaccgucaaaccauuaaaacaugugaucuuuaaugauagagauauugguaagaaaccaugguggggcagcauagaggaagguucuuccgaaagaguggaagguucaguaaaggcuucaccagaaguacuacagcuucgcagucucuuauuguaaacccuuuagacuaaauguguuuuggagcuaagaauuuuuagauuuagcaaaaaccacagugagauaccaucucacaccagucagaauuacuauuauuaaaaaguuaaaaaauaacaggugcuggcaaggauguggagaaaaaggaacaguuacacacuguuggcgggacuguaaauuaguccaaccauuguggaaagcagugcagugauuccucaaagagccaaaagcagaacuaccauucaacucagcaaucccauuacugaguauauaaccaaaggaauauaaauuauucuaucauaaagacacaugcacacauauauuaauugcagcacuauucacaauagcaaagacauggaaucaaccuaaaugcucaucagugguagacugcauaaagaaaauguauauauacaccauggauuacuauacagcuauaaaauaagaaugagaucaucuuuuuuccaggaacauggauggagcuggaggccauauccucagcaaaugaaugcagaaacagaaaaccaagugccacauguucucacuuauaagugggagcuaaauuaugagaccacauggacgcauagaggggaacaacagacacugggaccgauuggaguauggagggugggaggagagagaggaaaaauaacuaauggauacuagacuuaauaccugggugacaaaauaaucuguacaacaaacccccaugacacaagcuuaccuauaacagaccacauguaccccugaacuuaaaaguuaaaaaaaagauaauguuuuuuagauuuagaaagguaauugaguacauuuauaauauaucguaccuucccagcagggucuguugcaguauccugggaacgaacauauuaguauuucagcacuaaaacauagaaauagucacucuaaugagcuaagugaauaccguaaguagccccaggucaaauuucagcaccacaugaguuuaugcaagauuuaugaaaaauuugugggauuauaauaagggauuaugaaccuguauuugcacuggguuauuuaauaaugggaaaugguguuuucuucuguugucaccuccugauuccucauuaucauuuugagaauaaaucgccuguacuuccuuaagcaaaucaguaucacucuugcuuuuucucugcacuuucaaguucaagucuggucuuuaaggacccugugauuccauaaaguucuguuuaucugaguaagucauuuaguaaaucucuucaaauuucuacaaccuagccauuuugcuaaaauacauuaaucauauucugcuucacauucuuccagauauuuccuauguuggcauaagucaaaagaauauauauuaucuugauuacuucuuucauuugauaaugcagugaacuugacuuaaaaguucacaaccuaacuacuuaggaaaauuuaaguggcagcucaguggauaacuuucucuuuugacuucauuuaacuauuuaaaugaaauaacuuuucucugcaaaugaacuuaauuucuccuuuagaccaaacuuuaagugucuuucccugguuuaugccauacuuguguguucauauuagcugaagauagauuuaaacuuuuguugcuaaaaauuucagguagacuucacauuggcaaugacugccaaugagaagucuuuaucauuuuuaauauuuuaaauaauggucaaauuugcauguuggaucacuugguagcaagaugaagcauuaaauggaaggcagaagauuuagagacauaaauuagaagguaauugcuccaguucagacaaaaggagagacaaagauuagaggguaaaauagacuacacuugguaauugauuggugguagaguugagcgagaaaucuguaucgcuggacuuuggcuugggccagacaguggaacauuugugcuuguuguugaaacuggagauaaagaagaaaugaguuggguguagagaaugaugguuaucaacuugacuagcuuuagacaugcagaacuugaauugcuccuacaagauuuaaguugaaauuucuauuaaauaacagcuagauggauguaugguucuauugcuuagaaaaggagucugagauaauacauuuguagcccucagcuggcugauaggcaaucacugcuaagguauuagcuguugaguuuuccgaaccauuaguuauuuuuaagguagagcagugcccauacaaagaaaugaauaaaggaaaacuuuaagaucaaggguacugaucuccuuuaauucauucaacuaugaugguuuuucuagguuaauauaucuagucuccuuuaaaauauauaaaauuuacauguauaacacaucacugcccuccuccccaacuuguuuauacuuuuuccuccaacuuuuacuuugaaauuucuuaaaccuacaaaaaaaguugaaagaguaguacagcgaauaccuguguaaccucaucuggauucaucaguuaaguuuuugccacauuuauuuagcggucucuguauacacauacaugcuugcacgugcuuuuucauaugagcucuaugaaaaaguaauuugcagacaucaugacauaucacuucagauacuucauccugcaucuuaagaauaagguuauucuccuacauaccuguaauacgauuuaccauaucuaggaaauaagaaauuccauaguaugaguuaauacacaguccacauuuagauuuccccaacuauccaaaaaugucuuuuuuuuuuuuuaagcacuugccucucccuauugaauuaagguucacauuuaauugaauauguagucauugugucuucuuuagucucuuaaaccuacgaaagucuuuuuuuaaugacauuuucuucuugaagacagcagaccuuuguguugugcagaguucuacauucuggauuuguuuucucauaauuguauuuaggguaaauuuuugacaaaaacuacuaaugauguuuacuuuuguuaaacuccugccucacuccaguauaaacuaugucagagauaucuuccuuaguggguccugaguaaauuaaguuuuacuuuaaaaaggcaauuuuaaaacuuaaaauuaggggugaggagauuauuguuacuuucuaguccaucuuuuucauaguauaugguuuuuauccuguggcuuuaauuuuacgacugguagauuaagauuuaaaagaaacccucacugggugcgguggcucacgccuauaaucccaacacuuugggaggccaagucgggcagaucacaaggucaggagaucgagaccauccuggcugacauggugaaaccccgucucuacuaaaacuacaaaaaauuagcugggugugguggcacacgccuguagucccagcuacuugggaggcuuaggcaggagaaucacuugaacucgggaaguggagguugcagugagccgagauugugccacugcacucuagucugggcgacggagcaagacucugucucaaaaaaaaaaaaaaccccucugcaaauucaugauucccauuuuaagguauuugagauacaguacuuuggguuauauuuuauuuuucucuuuguacaauacuaagacgcuuuacgucauuuucauaagacucauacauuccuuguuuugccucugaaguauuuuuuuuaacaggacauuugaaaggaaucaaguguuagugcaggagaugagcucugcagacuguugguacugaugagaguucccuguagauaacaggcuuucagaauaaauagacuuacaggugcaguugauaaagccgacccccagcaaauaugccauaaguuguuacagucauguuggacuguugucaaguuagugcaaugguaguauguuuucaauacauuggaaacuuugguuuauucaccagcaacuuugugaguucacuuaaaucaccacgauaaguaauuuaguaaauuuuaaaauaugucaaaaacagaaugccaaggagugcauuuuccucugaaaaguuuaauguuaggaagucucagauuuaggaggagcauaucaaauaguaugcugaggaguagaaaguuaauuuugaggauacacauucauuugucuuacgccccuguaaucugccagacacuaacacauucuaaaaaugcuaauaacauauaagccaauguuugaaaauaaauucucuucaauuucaacagugccaagcucauugaaaaccacucuugcacaaacuuaauuucuugucauauuauuuuguuauucuuuugaccaucuuauaaagcacuguuuuauauuuuuucuuuuucuuucuucuuuuuuuuuuuaauuaaaaaaauaaagacaggaucuccccauguugcccaggcuggucucaaacuccugggcucaagggaucccccugccucggccucccaaagugcuaggauuaacaggcaugagccaccaugccuggccaauauuucaguuuuuaaaugugccaucuuauaugcacaauguuaauguuuuaugugcuuucucugugccuuuuguguauaugugaucacuauguguucgauguuugcccauccauuuuuauuuuccuaagucuuagagucuaugcuauuuaauaucccaguaagauauuacaggaagggcagcauuguguaguuucuggaauccaaucugccuucauaucuuagcuucuucauuuauuggcuggggaacugcggacagauugcuaaaccuauuagucuuuauuuccucuucugaaaaauggggauaauacugucuuucuaaaauaacuuuuaugacuguuaugugagucuuagcauacgauaagcauucaguaaaugguaguuguuguaauuauuauuauuuuauagaaaccccaauuaccuucuauuuuuuuaauuaauauucuuggaccuaguguagugcuucucaaauguggacaauuuuuccuccccccacuuuccuuucccaggggacauaugccaauaucaugacuugagugggagagaugcuacuagcuuuuuugaguagagauuaggaaugcugcuauuaaauauccugcagggcacaagacagcuccccauaacaaagaauuaccauaccaauagugcugagauugaaaaacccuuaucuaaucuaauggaauccagacuaaacaccuuuugaauaacuuuauuucauuuucuuuuugguguguuaacuauuauacuuugaguuggcauucaucauacaauuuuuucaaauuaaauaacuuuaauuuaguaauuauaugauuauuuuaauacaguuuaggaauuugacaugucaaguucaaauaauuaacauuuauugagcauuaacugccaggcacaagucuaagcauuuuauauaacauauguaauccucauaacagcacuguaaguuaaauauccccuuuuuucagcugaggaaacugaggcacagaggugugcagcuggaauuugaacccagacagucuagguauagaaucugcucuugcccacucuacagcucuuucuauggucucuuaaaggcucuaauccuaaaaacacagugauucgugaaguugauauuuuaccagucuauugaaaaauacacuacaaaucugagacauugguuuuaauuuugacacuuacgaaguaagagguuugcacugguucucucacuugcugaucacaagaaucaccuggaacucuuauuaaaauagguuuucagagcucuaugcaaagaacucugggaaccuuuuucaugguggccuagugaaucuuaucagacaaauuaggucuuuuuuagaacuaagaauuucuuugcucccuuuucuuucacauacauuauagguuauuaccuuaccuaccuacauaaaauauacuuuaucacaaacacagaauuucaaaauguaaauuaaagcgaacucauaaguauuaacucccuuuucucuuugauucccuuauuuaaauggauaaauaugguguuauacaacucuuuaguccacacccauuugaccuaauaauggaccaagauuuuuccaacacuaugcguagauaaugguauagccauaaagaccaguccauaguuagcauugauccuagugauguagugcuguaguccugguggucuucuaauacucuguuggguuugauauauaaugcuuuuugauaacaaugaccaaacaaaaucuaaaaauucuaaaacugcauucucaugguuaauauauauguauuugcuuucaugcuuuuuuccccccaucuaggagcuuaaaguucuuaagauaugcguuuuuucauugacugagaccuugauuuucagccaugugguugguguaaauaaaacuguuagaugccuuauugacauucauauacccacuauuguccuaggagaacacaacccuggagugacagguggcaagagaguuuucagagcucauauguuggcuugcuuuuccugcauggcucuuucaguaagggagacuaggcagagcaaggcaccucuugguguucguuaaguuaucuacuucucaguggcugagacuguuaccauaaagcauuuaaaagugcaguaccaaguuaacccauauuucaucuaucuucacauugauauuugguaacuuacuuuggaaacugagucacauugccauuagaaugucagaguaacccccaguguugucuuaacuuugauguaauauaauauuauuauggcuucauuccuguuacuuccugccccagaaacgucaugcgaagauuaaaaucuuguaagaacaguuguuuguuccccaaagaagcccccauacuaccuucuuguggcauucuuucuguaccgagugugccuucccccaacucuuuuuccuguucauaaucaauuaaguaaauugauucagaaauuucaacuucuguuugaaaacuuaugugauucucuaccuccccucaccugaagaugaucucucgcucuccuuuuaguauccauagcauacuauguuuauuuuuugccuaauguccucauguauugauuuaugaauauauugugcauuaauugcccauaaauauaaggcuuuugauaauuugucuacauauuauuuuauucaguucucuuguucuaauauugcaaguguauuuucauucuauucccugugugaaguuguucucuaaaauucuaucgcucuuuaagcuucaucuuugcagaucacuuuuugguuggauuagauucuaguauauaaccucaaauaugccaagcucucaaucagcuucuuccucaugguuuucuuccauucuggaacuuccuuuguccccugccuuuuuguguagucuuucaucgaaacaacuaaaaacagggauuggguccugaaaccaauacugauccuuaaacgucaaagaauuuccugcuuuucuagcuguugaaaucauuuuugaccuuguuucuaaaguacacguaugcaaaauagcauuuuccaucuucuauguguuuacaccuuuugcaaaugauuuauucuucuguuuuuagcaaauugaauucuuuuuuuuuuuuuuuuugagacggaguuucgcucuuguugcccaggcuggagugcaauggugcgaucucgucucaccacaaccuccaccucccggauucaagcaauucuucugccucagccuccccaguagcugggauuacaggcauaugccaccacaccuggcuaauuuuguauguuuaguagagacgggguuucuccauguuggucaggcuggucucaaacucccaaccucaggugaucacccgucucggccugccaaagugcugggauuacaggcgcgagccaccgcgcccagcccucaaauugaauucuuaauuaccauaagguaaacuuacagaaauucagcaaaacuaaaauuaagaggaaaugagaauccugauuuuguuuagcuuuuauuuuuuagcucuuuaauguacuuaaauguugucuuuguauaaaaucagucuggggcuaaucaaagcagaacagguuaucauuuaagucuuaaauauuauauguuucuuuacuacgauccuuucccuaaaucacuuugcuuucuauuuuucccuauccuucaauugaaucacauucuuucuuuuuuaggacuugcucauuacuguggacuccauaagagccucucucucucuaaauucuucuguuccaagugcugccuuuugaaaaggcgaaggaacaaaaauuuccaauguuaaaaaaguaaaggcaagcagaaaucacaguuuuguuauucaucaucagauaagauuaauagaacugucaguuuucuaagauuuugguaucacacaaaauauaaaauauaaauucuggagcagaauuuauuccagaagcagacugacuacuuauggcuuaauauuuauucuuagcaaccuuaucucagaccccuuguuauuugcaggaaaucaguauacugccuuuuuuaagaugaaacuaccaaacuaacaauacauuguaaauuuacagucuaagugccaguguagucaguggcauugaagaugaaaauuuaucugcugaguaacaaguagccugauacuccauagaaccaaggcucuguguuuggaaaaacugugcuuccugagcccaagaaucucaucuucgagggggagugggugauaauaagaugugaggagaccaaaaagaaggguuacagugugagauaguaagggggaagcuugagauuuucuuuuaaaaacucauagcucaaccacuuaaauagcuuuaugacauuagacaaacuuaacuucucugcgcuccuuuuuccccauuugcaagauagagauaaccuuucucccaggguuguuaggaggcuuacuuggcauaauguauaugaaauagcaaauacauggccccugucugguucuuauuuuuuauuugcuuuuauuauauuauuuuuguuuggccauguggaaggacaguugaguuugaagucuuccaaugguaucuacagaguuuuaggcauuauuuuccuguaagagaccuuauuuugaagcccuacuuggaaaacuuguucaguaagaucuguaucuuuagaagugaauuguaugggacaugaggagggacaaagaggagcaggugcuauucaagagcuagagacagagucugaauuauauucucucuuugcuaugaucuaaauuuuuacuugcuaccuucccuggugcccuauacaggcacgcaugcacacaucaauagcuguccuaaccuugacacacagccacaggcuaaagcagggguccccaaccccugggcugcagaccaguaucaguccuucgccuguuaggaaccgagcugcacagcaggaggugagcagcaggcaagcuggcauuacugcuugagcuccagcuccuuucagaucaguaguguuauuagauucucauaggagcaggaacacuacugugaacugcacaugcaaggcaucuggguuccuugcuccuuaugcgaagcuaaugccugaugaucugagguggaacaauuucaucccaaaaccauucccccccgccccuuccccuaggucuguggaaaaacucaucuuccacgaaacugaucucuggugcuaaaaagguuggggaccgcuggucuaaagcaauguuuuuguuucuaaauaaguuaaauaugcaagaauuguugaagccaagcugagagugcaaucuuugaauauugcacuuaaggaauugaccuacaacuauaaaauugauauuguuuuauauuuguuaaguaagcuaacagguuuuacaaauguuuuuagucauuccccaccuccccacccaccaccagguuaauauacacggguucugauacauaacaauacuuuaacauaguaacguauaaaauagcaaagaaauauaaaauaagguauauuaaauauuuuaguacuuauuugaauuuuaguuguguauugauuaagcuacuauaugcuaggcacugcccuagguggugaguagauaaguagauagcaggaauaaaauagauaagaccuuugcuuucaagacaacacucaguugcuaaacccauuuccuuuucuuuaggauauuuucauugucuccgaauuuuagagcugaaaagugccuuagagaucaucuaguucaaccucuccguucaaauggagaaccugagccacuaagauucacaggagaguaagauaauugagcaaacaacuccaaguaaugacagaaaauuauaggagaaucaguacaaauugugagaauuuacuauguuguuagcauccuaaguaugaguuuagaaaagguagaaguuauaagaaaaguuaaauuguuuuaauaugaauggauuccacuguuaccuucaagauaaaaugaagacauacuuuuuucuuuaguauuauaguuaaacgaauauuguauccuguagugacuaaauucauaaauauuuuuucugcuuauagacuugaguuucaaaagcagcuguacagaugaugcuguuaaugaguguuuagguaguguugauuaaaaaaaaaauaaugugccuuccugccuuacuagaaucauagaaguucauaucuggaauucauaccccuuauuucacggaugaggaaauugacucccagagagguuaacugacuugcccaaauuaagagccaaaauuagcaacucacauuuaagcagggagucaguuuuuauguacuaagaccauuauauuuugauauccagauauuacuuuucucaacuuuaaauguuuuaauauugucuucaucaggccugcugagcauugucauuuuaaaaucugagaauauuugauaaauugaugaaagaaaaauuaugaagucauagacauuagaaucaagucucuuggcauuauuucuaguugguauaucuuuuaugcuaaaaauauucaauauucaguugcuggucacaaauaauuucucccccacaauagguauugucuucuaagaacucugaagcaaugucagacauugagggaagcucucauugcugcaggaaaagagauuauauggcaugggcggacaaaagaagaaccagcucauuacuguagcauuugugaaguaaguaauuguuuuuauccacaguuguuuuauaaagccucuucccucuccacuguugguuucucuuuauuuuuaaaaaacuuuuuuauacuuuuauguaauccaguuuauaguaauuaacauuggauucaauuuuguugcuuagccauuauauuaaaauucagugugauaauaaugauauuucacugugaauuaaccuuaaaaguaucuacugcagagucauuuuugugguagaucuucaacagacaauaaucagcaaauuuagucugagauuuuaaacuaagaacaaucuagauguacacagaugccaauaaacuggauguuugguguaacucuaggcagaucgauuaucaguccucucuggugcaauuaacaauacauuugucaaucuuguguggccaaggcuugcaagaggugcaggaacaaagauguggugccuccuaugaaggagcuuaaauucuacuuggagcagacagauuauaaacaacuaauuguaauguacaugagacuaugaugaaugugaaguuggacuuccuguuaaugauaacacugagggggaaaaugaccuaauuuuuucuucuaguauuggcauaagaacucacaaacguauuagcauuugaguccauccuuggaaaaaagaguaugauaucaaguagacuaaaaaagugaugagaaucggagguagacugucaugggcuauaggcacaagaagagaacagggaaaugaaaugguuuuagaaaagguugaauguguuccgauuuggcuggaacacagacugugcaaauuccgcucauaagucuagguggcauuuaauuuauagcacaucuugaaugguuuuaaggaauuugauauuccaagguuauugaagccauuaaaagguuuugagcaggcaacuaaggguaaguaagauauguguuucagggagaaaagugguuggaaaggacagcgauauauaagcuauugcaguggucuuaagaguuaugggacuguaaacuaguucaaccauuguggaagucaguguggcgauuccucagggaucuagaacuagaaauaccauuugacccagccaucccauuacuggguauauacccaaaugacuauaaaucaugcugcuauaaagacacaugcacacguauguuuauugcagcauuauucacaauagcaaagacuuggaaccaacccaaauguccaacaaugauagacuggauuaagaaaauguggcacauauacaccauggaauacuaugcagccauaaaaaaugaugaguucauguccuuuguagggacauggaugaaauuggaaaccaucauucucaguaaacuaucgcaagaacaaaaaaccaaacaccgcacauucucacucauaggugggaauugaacagugagaucacauggacacaggaaggggaacaucacacucuggggacuguugugggauggggggaggggggagggauagcacugggagauauaccuaaugcuagaugaugaguuagugggugcagcgcaccaccauggcacauguauacauauguaacuaaccugcacaaugugcacauguacccuaaaacuuaaaguauaauuuaaaaaaauaauaauaauaauaaauaaauaaauaaauaaauaaauaaauaaaguaccuguaaaaaaaaaaaaguuauuuuaaggccuagacuagaaccuggcaaugggaauauuaaagaagggaaagaauucaaaaauauuuagaggguaaaaucagcgagacaccucauuaaauggcagaaguggaaggacaaguugaagaaugcucaccaauuuucuagcucaggucacuagguuuguauugcugcuuguugacaguaauggauaacauggugaacucuaggauuguaguuaacuguuaaaagaagacaugggaucauaagaguuuucugucauugaagaaauuuaaggauaagccaaagacaggauguugaugguccauuucaaaccuugaaauucuguaauucuagcaucaaccuuuauuugaaaugauagaauccauugauuuuuuuuuuaaaugucauauggccugaccaaagugagucauuaggagaucagauagauuccaguuagguguguuguuccuuauccuaccugaacccuagcaacucaucaaucuuucuguauaagauagagguauuauuucuaaaaucaugcuguacucaugaauacauaaaaaugaucacuuaugucugauuguauacuaauguuuuagauuuaaaaauagguugaccuuuaucaaacuuuugaacugggcuuugccagugguugucaugaguaugucauucccuuugauuauuccccuaaauaugcauuacuacccaugucuuuggauuuggugcaaaauaaaccuggucuguuaaagauucucaaacacagccauguuuuucuuaccaccuacucuuaaccagagaucacuguccacaauuucauucaaguagaauuccaugauuauacuaaagcaguacaguaaauaccacuaucucuauugaauacguuuuucucuuguauaaaacagguggagguuuuugaucugcuuuuugucacuaaugagaguaauucacgaaagaccuacauaguacauugccaagauugugcacgaaaaacaagcggaaacuuggaaaacuuuguggugcuagaacaguacaaaauggaggaccugaugcaagucuaugaccaauuuacauuaguaagucaaaucaacaugugaguacauaguuagcuggguuaugaagcagcaguguuugcucugccaccugauaaguaggagguaaugaaauauuuuaaauuuuccuuuggcucauuauauauugcaugaggguauauucauaucauuccccccuccauuuccaaguauuuauuccuauaaaauuggcauauaucauuuucaguuuuccugggugagaccagccuaaauaauuuuacaacaauuacauuuaaaaaucuuugcgugcuuuagauagaacacuaucauauccuuuaugucauuuuaucucaguugauaaaauguuuguguacguagguuauuagagcccacaaaaugaaucaguaagugugcuuuuaaauauacuucugcuuuuagagcuaauuguauuuguuuaaaauuuuguccuugccagaaguauuaaccucaugggaguauuuaauggagcuuaacuuccugguauauuauguaaccuuaugaaauucaaguauacuuauaaauugcacaguuuuuaauuucagacagcagaugcuugggggaagcauuuuacuuucgcagaucaauagcuuuaugaauagaaacacagagauaauuuaugaauuguugauuuucuccaguacuugucucccacacauaugugaucagaaacuaacuuuuugaaauuuacuuucugauauuuucacuugaauggucuucaagauugcuugaagaagaaaauuaucugaaauauguugaagaaaauauauuaccuagcugagauagauucugaaggcagucacuagugaaauuguaauuuguuaaauuauuuugcaagaagcccccuuuuuuuaagcaaucuuaaaaaaugguaaacguaauaacauuccaagaguuuuugacuaauuggugaagaaguauagaaaauugcaaguacacugaguaggauaauggucuuagauucuuaggaagauuggcugaaugggagauaguaagguaggcuguacuuuuauguugcauagcaggcuguugaacuuuuugagaguuauuuccccuaacuucacaagcagacuauauguuuguagccaugagcuauuaacaauuuguauaucaaaauaaccuaccuuacuuuuauuuucaggcuccuccauuaccauccgccucaucuugauauuguuccauggacauuaaaugagaccuuuucugcuauucaggaaauaacccaguucugcaccacugguuuuuguagcuaucucguaaggcugcuggcugaaaacugugucuaugcaaccuuccaagugcggagugucaaccaacuggacgggagagaguacugcuccuacuccaggacucucacaaagcugaugagcuguacuucagaaaaaaauaauaauuuccauguuuuguauauaucugacaaaacuggcaacaucuuacagacuacugacuugaagacaaccucuuuuauauuucucuauuucugggcugaugaauuuguuuucaucugucuuuucccccuucagaauuuuccuuggaaaaaaaauacuagccuagcuggucauuucuuuguaagguaguuagcaauuuuaagucuuucuuuggucaacuuuuuuuuaaugugaaaaguuagguaagacacuuuuuuacugcuuuuauguuuuucugucuuguuuugagaccaugaugguuacacuuuugguuccuaaauaaaauuuaaaaaauuaacagccaagucacaaagguaauggauugcacauagacuaaggaauaaacuucagauuugugauuuuuguuucuaaucuugauguaaauuuacacuauuuauaaauacauauuuauugcuugaaaauauuugugaauggaaugcuguuauuuuuuccagauuuaccugccauugaaauuuuaaggaguucuguaauuucaaacacuacuccuauuacauuuucuauguguaaauaaaacugcuuagcauuguacagaaacuuuuauuaaaauuguuuaauguuuaaagaguuuucuauuguuugaguuuuaaaaaagacuuuauguacagugcccaguuuuuguucauuuuugaaaucugauuauauauauuuuauauauacuuauguauguauauauaauauauauagaaaucuggauauauauguauaaaucuuuagaacuuaaauuuuucucguuuuaaguuucacaucuaugguagauuuuugaggugucuacuguaaaguauugcuuacaaaaaguaugauuauuuuuaaagaaauauauaugguauguauccucaagaccuaaaaugucagacugguuuauuguuaaguugcaauuacugcaaugacagaccaauaaacaauugcugccaaaauguaguauaauaguagaaaacaaauagugauugaacuuaagauuuuaaagggacuguuauaugggcuugacaaauccugu

SEQ ID NO: 18932 - RNA, 418 nt, Homo sapiens
agcgcggcaccagcccuuccgccacggccgccucuggagagcagcaaccauggcucuaggcuacccuauggccaugggccucuucaagggccacaaggugaccaagaacgugagcaaacccaggcacagcagccgccgcaggcgucugaccaaacacaccaaguucgugugggacaugauucgggagguguguggcuuugccccguacaagcggcgugccauggagcuacugaaggucuccaaggacaaacaggcccucaaauuuaucaagaaaaggguggggaugcacauccgcgccaagaggaagcaggaggagcugagcaacguacuggccgccaugaggaaagcugcugccaagaaagacugagcccccuuccccugcccucucccugaaauaaagaauagcuugacagaaaga

SEQ ID NO: 18933 - RNA, 982 nt, Homo sapiens
ccuacagagggguccauacagcgucguucuggauucccgucguaacuuaaagggaaacuuucacaaugucuggagcgcuugauguccugcaaaugaaggaggaggauguccuuaaguuccuuguagcaggaacccacuuagguggcaccaaucuugacuuccagauggaacaguacaucuauaaaaggaaaagugauggcaucuauaucauaaaucugaagaggaccugggagaagcuucugcuggcagcucgugcuauuauugcuauugaaaacccugcugaugucaguguuauauccuccaggaauacuggccagagggcugugcugaaguuugcugcugccacugaagccacuccaauugcuggucacuucacuccuggaaccuucacuaaccagauccaggcagacuucugggagccaaggcuucuugugguuacugaccccagggcugaccaccagccucucacggaggcaucuuauguuaaccuaccuaccauugcucuguguaacacagauucuccucugcgcuauguggacauugccauuccaugcaacaaccagggagcucgcucaguggguuugaugugguggacgcuggcucgggaaguucugcgcaugcguggcaccauuucucgugaacaccuaugggaggucaugccugaucucuacuucuacagagauccugaagagauugaaaaagaagagcaggcugcuacugaaaaggcagugaccaaggaggaauuucagggugaauggacugcuccagcuccugaguucacugcuacuaagccugagguugcagacuggucugaagguguacaggugcccucugugccuauucaguaguucccuacugaagacaggagugcucagccugccauggaagacuggucugcagcucccacugcucaggccacugaauggguaggagcaaccacugacuggucuuaagcuguucuugcauaggcucuuaagcaaca

SEQ ID NO: 18934 - RNA, 982 nt, Homo sapiens
uguugcuuaagagccuaugcaagaacagcuuaagaccagucagugguugcuccuacccauucaguggccugagcagugggagcugcagaccagucuuccauggcaggcugagcacuccugucuucaguagggaacuacugaauaggcacagagggcaccuguacaccuucagaccagucugcaaccucaggcuuaguagcagugaacucaggagcuggagcaguccauucacccugaaauuccuccuuggucacugccuuuucaguagcagccugcucuucuuuuucaaucucuucaggaucucuguagaaguagagaucaggcaugaccucccauagguguucacgagaaauggugccacgcaugcgcagaacuucccgagccagcguccaccacaucaaacccacugagcgagcucccugguuguugcauggaauggcaauguccacauagcgcagaggagaaucuguguuacacagagcaaugguagguagguuaacauaagaugccuccgugagaggcugguggucagcccuggggucaguaaccacaagaagccuuggcucccagaagucugccuggaucugguuagugaagguuccaggagugaagugaccagcaauuggaguggcuucaguggcagcagcaaacuucagcacagcccucuggccaguauuccuggaggauauaacacugacaucagcaggguuuucaauagcaauaauagcacgagcugccagcagaagcuucucccagguccucuucagauuuaugauauagaugccaucacuuuuccuuuuauagauguacuguuccaucuggaagucaagauuggugccaccuaaguggguuccugcuacaaggaacuuaaggacauccuccuccuucauuugcaggacaucaagcgcuccagacauugugaaaguuucccuuuaaguuacgacgggaauccagaacgacgcuguauggaccccucuguagg

SEQ ID NO: 18935 - RNA, 2845 nt, Homo sapiens
gcuuuuuagaagcuugauuuccuuugaagaugaaagacuagcggaagcucugccucuuuccccagugggcgagggaacucggggcgauuggcugggaacuguauccacccaaaugucaccgauuucuuccuaugcaggaaaugagcagacccaucaauaagaaauuucucagccuggccgaaaaugguuggccccacgaagccacgacaacuggaggcaaagaggguugcucaacgccccgccucauuggaaaaccaaaucagaucugggaccuauauagcguggcggaggcggggcgaugauugucgcgcucgcacccacugcagcugcgcacagucgcauuucuuuccccgccccugagacccugcagcaccaucugucauggcggcugggcuguuugguuugagcgcucgccgucuuuuggcggcagcggcgacgcgagggcucccggccgcccgcguccgcugggaaucuagcuucuccaggacuguggucgccccguccgcuguggcgggaaagcggcccccagaaccgaccacaccguggcaagaggacccagaacccgaggacgaaaacuuguaugagaaggugagaggcggggggggggggggggguaguggggacggaaccccgaaggggucaguccgggaucggcagauggggcgcuguagaggacguucuuaggcaguagaggacugcgcggccggcgaaagccuagaagacuugggaauuuugccuaccuuguguuccuccuuugucucucgguaucuucguuccagggccagaggcaggauugguuuuauuuugcagacagaaaucacaccucaaguggacagcgcucaaaacacguuagaagcaguauaguacaacgauaauacuaaacaccgauauggcacuugcucguugccgucugcauucuuuuuuuuuuuuuuauagggacgagaucucgcuauguugcccaggcuggucucgaacuccuggcucaagcgauccucucgccucggccucccaaggugcugggauuacaggcaugagccaccgcuccgggccccgucuguguucuaaacacuugacaugcauuagcucaucuuauacucgaaacaaaccccauuucgaggugggcucuauuauuauacucauccuacagaugaggaaacugaggcacagagauguuaaguggauugcccuagcucacauaacugaauacaugguggagguggaacugguauuugaauuuagggcuaccaggucugcugugcuguauuaauagcagacgcugugaaaucaggcagcacugacgguuacccacccgugugaucuugguagcauaaacccuuggugccucaguuucuuugucuguaagaugggaacaguaauaggacaccuucuaaaaaauaggacaccccaccugccucauguaauuaaaugaguaaaaauggucagaacagcagcuggcacuucguaaguauguacucagcacuagaauguguuuauuauugccauguuucaccucacugagauauugugagguguuucuaugugaaaagacuggcacauaauaaguacuucaucaauacuaaccucugguuaaggggcuuggauauauaggaugcuuguucauucuguaaauauguauugagggccugcuguaugccaggcucaguucagggcccuggggauacagcaguguggaaaucagacaaagcccaugcucucauagagcuuacaugauaguggggaagacagaaaauaaacaguaaaauauuagaaaacaauaauacaaaguaguauaauagauaauauaacaugagaauguaugauauacagagaauggggaaaguaugcuacuuagguaaacauagacuagaaagagacagaaggaagagaggaugugaagacaaaguuaagcaagauaaguggauagagaaugacuuggguguagggggcuauuucauuagcuugagcuauaagaaauugccaguauucaaccauuugugaccuauaaaaauagcaguuuccuaugcuucaacuuugaaagacaagguaacuagggagugccuccugaaggaaguggugaugaaucuaaaaccuugaaugaggagacagauccagccaugacuagagcuggaagaaaggcuuuccaggcagagagagcagcaagugcaguggcccugcagugggaaggagcuugacauaucccaagaauggaaacagaggaauuuagugagaggggcacauggagaccaaguuaugcagggccagaauaaggcuuuguggagcagcaggaagcccucauugaccucuauuucuccacagaacccagacucccaugguuaugacaaggaccccguuuuggacgucuggaacaugcgacuugucuucuucuuuggcgucuccaucauccugguccuuggcagcaccuuuguggccuaucugccugacuacaggugcacaggguguccaagagcgugggauggguaagaggcagaggcagggauggagguugaaggggauucugccaggaguuuuguuccugcaccauugggaauggggagcugagaugagggauugguaucaguugaggcucccucacgucuaccccugcuauuugcacuaccaggaugaaagaguggucccgccgcgaagcugagaggcuugugaaauaccgagaggccaauggccuucccaucauggaauccaacugcuucgaccccagcaagauccagcugccagaggaugagugaccaguugcuaaguggggcucaagaagcaccgccuuccccacccccugccugccauucugaccucuucucagagcaccuaauuaaaggggcugaaagucuga

SEQ ID NO: 18936 - RNA, 24700 nt, Homo sapiens
ucaucugggucugaaacgggcaccagcgacgcgggagcagggacugacgccccucuagcaaagcaucugugguacaucccagacccggggcucuccaaggccccgcgcuuccgagcuccgcgcaaacucuggcuucucuuguacgacagaggugguuugcucuuccguugccccguggcuucagcucaucuuuggcaggaaggcgaggcuuccgcccggcacagggggugagcuggagcaccgugcccccaagccucuggacagcauuuggaggagggugcuucccuaaucccaacuucggggaaaccccucaugggcguauuuggagccuccgggcccggggugauauuuagggggcgucugcuuuugagacccuuaaggggugccguuuggggacuucggggugggauuugggagucuguuucggggagcaccccucggaggcaggguuuggggggcuuuggggagauucuuaggguccguguaugggcacccuuguccguggagcaggauuuggguuauucuucaaggggagaagcaaagcuugagguuacuaaagucaaggcgggacugggggagggcuuguuucaggacgggguccuggugacagaacaaucgggaccgacguggcauuguggaggugucaggccuuugugaccucugguuuugugaugagguccuccccgcgccuggaggcucaggacugcgagacuggacacgucgggggcccagauguuucuagggagaggagccucccagcucaggcuagggaagggacaccggagcccagcucuuccugagcugacgaggcgccacccggccuuuauucauuauucauaauaagguggggcugugguaggcggcaguuuuuuugccucuuucgcaccugguccgcugaagguucucggcuugugaauuauucacgaggggcggaucagcgugccgaagggacgugcugaaggggcguucugaagucugccgcgcaaacgaguucauugaugauucgcaaaaguuaaguagcacccugaguuuucaguggcuuuucuagggguuccgugcuuaauucaugaggagcguggcuuuugcagcuuugucugcgugauccgcgguuagcuuucccuugcagguaccagaguuaaaaccuggcgucuagcaaagggaugaggccuccuacauuguucauuucuuauggccugguaaucccagauaaucagccggcucuggauucaaaucccaucgauccuuuccaguugugugaucuuuggcaaaucguuuuguaagccugaauaauggguaugaggauaacgauaagauuagcuuacacucguuuagcuacuuagcgcauuuaaucuucacgacaauccuaggagguaggucauuauuacccccacuuuauagauaaggaaacugggacacaggaaggcuaaguaauuugccuaaggucacacaaucagugaguggcugggccgggauucaaauuggggucuaguuccgcaaucuguagucuuaaccagaugccauaaugucuccccuccccauuccccugcgccgccauuugauaguacuacuacuacuaauauaacacuuagcaugugccaggcacuggucuaagcccuuucuacuuauuucuucauuuaaacuccaucgcaagguaaguugcuguuauuccuauuuuauggauggggaagcaguggcccaaguuggggguuucucuaguggcugaguauucauaacuaauuuuauauuaauguaaauauauauuuacauaucuuaacauauuacuuuuauauuaauauauaauauuuuaaaaauuuaacagugccuugugccagcaauguucuaaggcucaucccauaauuuauauucucugauuuucuuuuguuugagacggaguuucucucuugucgcccaagcuggagugcaauggcgcgaucucggcugacugcaaccucugcuucccgaguucaagcgauucuccugccucagccuccccaguagcugggauuacaggcgcccgccaacaugcccagcuaauuuuuguauuuuuaguagagacaggguuucaccaucuuggccaggcuggucuccaauuccugaccucaggugauccacccgccucggccuccuaaagugcugggauuacaggcgucaucugauuuucauaauaacacauuacuauccucauuuuacaguuguggaaacugaggcaccugccaaagacauguagugaguuuggguuugauuggaccaaggcagcccuuguuccugaggcggggagaauggagggaggcguggagaggggaggugggggcagggaguacacguccccuggguuuucugguggcacugcagugacaucuuucauuauucaugaacaggaaggcgugcucacuuugccuuggcuauagcaucguaaucccuauuugcugggcagggcagucuuggguguuucuucgccuuaugcauaauucauaaauuggguggaaccuuucuugaccucucugaguuuccagguugagcuacugcagcagcauaauucauuauucaggaccugggagaguguguuuucccugcagcagccccauuucccugcuuacaguguauuagaugcagcaauaggcgggcgugccccuuuuauuccaacccacugggccucaugcauuauucaugaguaaguuguggccugggucuccuuggcuuccgggccccugcaagaucaucauuauucaugaauggggguguguggcuuccauguuuuaacaucugcuuucugguugcugguuguuagucuaccaaccacucaacuucaugcauaacuuauaaucaggaagcauggccuuaacgguuuuucuucgcuuccuugacagccuggcugcaacaauucauucauuagucgcauuccaugaggcguggccucuguuuuaccuguuuucguuguuacugccacaauguccaccagguggugcuguuccacuucuaaccgaaugaaucgcaaccgaguagggaacuuuaugcaugauucauaaguaggcgcggcccgcuugcauccggguuucuggggguggggcccaagguuuuguuccggccccaggcucagcguccgccaucuugugucggcggcucggcuguaaggagguggcagggacaaccacaaccacaacggccgggggaggagaaggcggcagcggcgauucuaggcggcccaggcggcggggaggaggagaaggaggaggguggcggccgggcuuggcuucggcuccuugaggaguuggcggcggcgcgacccggggaaccggcauugguaaaaaaacguccuuucacugcgccucgcccugggcagggguuucggggaggcacuggagggcccugagccacgcugcugucggggcgggccgcggugacucgggagccaggaaucagcggaguagggagggggagcggauccuggggcggggccgacuuuccccggccaggaccacuccggcucccucugguugcaaaaucugaccuuggagucggacccccaggaugugcuuuuagagacucacgcccaacaucucuagucugggaccugacuccgucccgaaccuuguaucucagaucagaacucuuccccagucuccaauagagauuuacguggaucagcauugcugaucagagcuccucaccauugaaugccguuaaagaccugccccagaaucuccuuugagacacuuccuagcuucucaguauuuguccucaaggcuuccaggacgggcuagaucucgaagggguccauaggcccuuuaucucuguaagagaguccucuuuagcauuuuccuucagacccccaucccacacacaugcuagccgcgcucagagcuuccagggguacuagacccugugaaaggccauuugggccuggccuuugugucgggggccccucuucgccacacgucaggucuccuaaccccacccuggcccuagcaucuuccaucagagacucugcccaguauuucuacucagagaccccucuuaccaucugccuugagagacucuucaauuccuagacucuguccuuugacacuuucucuacuuuuauggaauuucucgcuuuuuauacuuccaguauucagagacuacugagaggccucagcaucuuccccaucaggcaccuugaacccccagagccuuccagugcaccagauaccagggaggaacuguuuggauacauaauccuccaucaaagagccccugcgagcaucugcucuugcagaucccguuggcuucuagccccuuccaucagagacucgccuccccaaccccacccuagacccagccucugccuucaaaaaccaaccuggguucuagcugcuuuuuucacagaucccuuauccucacaucaggccucagaaucugcccucagaucguuucaaggucccuaacgucugcagucagggguuuucagcuucugcuuucagccuccuuggaccccaggaucauugucagaugucccuuccccccacaggccuucuuguuuucuuuuucuuuuucuuuuuuccgagacagaauuguuucacuaugucguccaggcuggagugcaguggcgccaucucagcucacugcaaccuccaccuccuggguucaagcgauucuccugccucagccucccgaguagcugggauuacaggcaugcaccaccacgccuggcuaauuuuuuguauuuuuaguagagaugggguuucaccauauugcccaggcuggucucgaacuccugaccucaggugauccaccugccucggccucccaaagugcugggauugcaggcgugagccaccgcgccuggccauggcccucuuguuuucuacugcaguagaaaacccucuucucagcaucuaccuucagcgccuccaugggguccuacauaauuggucagagaaacccaaccccauuuggggaccuagccaguguuugcuuauuaaccuuuuuaaggccugcacuaucugggcccagcuucccguuuccacacccucagagcagcugugauaccuagcauguccugucagagauugacacagggccuuuguguuccauuagaaaccucucccagccccucaccauccacccucacagccuccugggacucuguaguaggaaugucagauacaccucuccucuugcaugucccuaucuauuauuuuugguuaaagauuucucucugcuaccagcaucugucuccagaguccuccagagccucaacauccuccugauggaggcugccucuccccccagaccccaacaucuuccugcugccuccucagacucuagaaucccccacccauucccuuugcagcuuccauggggcccagcaacuguccuccuaccuccuugcagccuugggggccuccacugcaauuuuucagccuuucuccaaaagauccuuuuccagagauccgaauuugagucuuuuccuaauacccuagccuaguccuuucccucccaggacuucuaacaucuccuuucccauuugucucagagccuccuugcucuuagacacccacuuccugauucuccucucacguucccauggacuucucaguuaaccccucccagaaagcuugacaugcuccagccccccuucucuaugcccuagcuucuccauccugcuaaccugccuccucucacaccuccaagacuccucccucaaacccucugguuugggaauagagaaugcuuacgcuugaaaaucuucaguuuggagacucagguauguuuagaaacuaagccacagcucagcuuugccaaacaguucacaguguguauguuauggugggggccugagcaaauguugagguaggaaggguguagauuguuuuucugcugggggugggggaucuuuagcuccucugcagaguuucugucccagacuccugcuugccuugagacagggcuguuccaaaccuuugcagucaaaauccacuugaacaaucaucugaaacuucuuagacucuugcugccugcacuggggauccagaggugaaauguccagauauuaaagugcucucuggcccuggaucaucucuaauuuauggagugaggaaauggcaugucccaaacaaacugaccaaugacaaggcaaggagauaacuaaguaauagaggccacuacacgugcccagggaggaacucacauccucaggucagugaguucugaccacagaccuuggcuucuuuaacccugccagcagccccuugaagacaguuucauuugucccagcuuuuggagaaaaugaggcucagaggaaaugagaucucuaccccaggucagucagagagucaguaaauggaaaauaugguucaccuuugucucuacuaacucaccaagccucuugcuacccagguuggcucuuagcauucuaagcaauucaccuggcuaucucaggggcuccagccagccugcugccuccccucaucucccauuccuuagcccuguggacugggcccugagcccaggggcauuuggcaaacagucccccaccagcugcaugccucugggcgagugaaugggguucucuaagccuuucuuuucccauuugugauuugggcauaggguuaucugggucauggggauuguuaagauuagacaaagcccuuuccucuuugauugacacacaguaugcucuugguagauaguagggagcucuugucauugugguuggugcuagugacaagugccaagauggaaucuuagguacauugggauacuuagugucauaaaagucucagugugggaggacuugugugaacagaagacucagugccuagaggagcacuuggggugaggggaagugacgcuggguccucccaucuccagcauguggacccagucacccccaccaccagauuucacuuccacagcaggcuuuauuguucugucucugggaccuagcaggugacccugggcaaguuacuucucauuuguccggcaaggacacuaaacucugccuugcugggucagggucauggaggggaugaaacgugauaacacgaggaagcagccugggcuucagagucagcagauccuggucuggucccagcucagugugugggaaccuuggucaccgaacgucccugagugaauuuuuuuccaucacuuuaaaguuggggguauuauugauagcaguccaaaccccacaggaguacccugaggacagagugagacgagguuuagagaagugcuuacuauggcaucuggcacaaggaggacuccugaucaaucuaauacucauuuaucauugugguuaaccuguuuaagggacuccgcaugcagaugaggcuugggauguguuuguuuucuaucuuuuugcaaccucuuuuauuggucugugucgguuuuccccucccaaagcugggggcaggguugggcuuuauaaaacuugagccccucuggggacuggguucucagcaaguuaccgcuccugccaucaugccacccugauggauguccaagccucacuucccuccugcacuccccgcucccgccgccaucccugggauuaagggagaggagaauggcugcuuguuacugccuaccuacucugugccagguucuaugcucuguguuauuuaucaucucgauaaccccguggggaagguaagugguauuaucaccccuguuucacaggugagaaaacugaggccuguggcgguuaauuauuacuguuagugcguggcaggcucaagauuugaaaccaggucuguccugaauccacauccuuccccugaccucgacacaaguacauucuugucauuccuuucacuccaggauuggagucucucccucauuaugcugggcugggaagaagcaaauggcuuaguggucagcaguguggauuugcaaaucagaccaccuggguucagaucuuaggucugacagcuguguuacccugggcaaguccucaccuuucugugccuguccccucuuugcuguaaaauggggguacuaauacuuaagucuucccuucccccacaguugcuacuaacaaacagaaaaacgguacccaugugcuccagggucaccucugaccuuuuuuuccuccagauguccagcucgccgcuguccaagaaacgucgcguguccgggccugauccaaagccggguucuaacugcuccccugcccaguccguguuguccgaagugcccucggugccaaccaacgugaguguccucuccguggagacuggcagacgagguggugggugggaaagucuuuuguaucacugucugucuauccaugcuccacuccugugugucucccuaaacuuguucuuuuccucuauuccuagggaauggccaagaacggcagugaagcagacauagacgagggccuuuacucccggcagcuguaaguggggccaaggccgggcugagggguguggaaugggacauugagaggauaagguuggguggggcaggcccugaccuagaguacccccuaaccuggcagguauguguugggccaugaggcaaugaagcggcuccagacauccaguguccugguaucaggccugcggggccugggcguggagaucgcuaagaacaucauccuugguggggucaaggcuguuacccuacaugaccagggcacugcccagugggcugaucuuuccucccagguaccucuuccuagcacccuucccccuuucccccuucccgaggcaccacuguucccggugccacagccauuucaucuuuuucccuacugcacacccuuacaguucuaccugcgggaggaggacaucgguaaaaaccgggccgagguaucacagccccgccucgcugagcucaacagcuaugugccugucacugccuacacuggaccccucguugaggacuuccuuagugguuuccagguaucuuggggguacuacccagccuucugcccaguuuucucagagcccaucucugguuuauucaguaguguucaauauugauuuaaugggucggccugaaugucagguuuugugcugggggacuagaguaugcaggcagcaguuagccccuggcccugccuuuucuuuucuucuuuuuuuuuuuuugagacggagucuugcucugucgcccaagcuagagugcaguggcgcgaucucggcucacugcaagcuacaccuccuggguucacgccauucuccugccucagccucccgaguagcugggacuacaggcgccugccaccacgcccggcuaauuuuuuuuuguauuuuuaguagagacgggguuucacuguguuagccaggguggucucgaucuccugaccuugugauccgcccgccuccgccucccaaagugcugggauuacaggugugagccaccgcacccggccuggccccgccuuuucaaguggggaagauguguacagacaguacagcauagugguugugggcacagacuguagagccauacugccuugcugcaggccuccagccuugguagugugacuucaagcagguuguuucaucuccuguaccuuuguuuuccuguuuguagucagugcgugguagcagcacugacuucauggacuuuuugugaggguuaaacacguggaauugcagcuggcauauaaggacuggauggguguuuguuaauuaaaaaguccaggccggaaagaggugcucuggaagcugagaguugucccuggaguaucccagguugccagggcacugcagcuaaauccugauggaggaguaggagcucacccugguggggaaggauggacauucaggcagagagcaaaaucccaaagaucauggcggagcaggcgucgucuugagaauuggaagcaggugggugugguaggagugagcucagacuuuggcuggagacagaguuuuacuccagugucucacagggcauggcagacagacagcagcggguguuugucaaauaaaugagucagcucuucuccaaacucccuccucccagcuaccucuucaccuuuccugguauaguccagggguucauuuucgacccccacagagucugauacacaguaggugcuauguguuugugaaagaggcugacccagcaaagccuggauguguuugccuugaggacugccugaguccuccacaccagcccuccauuuuuuccccuucaccccaaugcugggccugagccuccaucucuccacaggugguggugcucaccaacaccccccuggaggaccagcugcgagugggugaguucugucacaaccguggcaucaagcuggugguggcagacacgcggggccuguuugggugaguggcagcccaccucccucccuguccccuuuucccccaacuccuaccaagcccaggccaagacucuaggcucucccugcccucaucccuucucagcuacccagguuuuggguucuguguuuucaucucuccccauguggcacaaguaccaucuuacaucccagcagugauaggcugaguuugcucagcaaguuuucacuacaucuugagggacccgugggaccuguaugugcaugggacacaggcaccagcccuauugcuucccucuacaggcagcucuucugugacuuuggagaggaaaugauccucacagauuccaauggggagcagccacucagugcuaugguuucuaugguuaccaagguaaggagaccagcccuaggguuccuggcaggcaggugggcugcaguaguccuuccugucugcucuugguacccugggccuguuucugagacucacucuuccuuuaaccaggacaaccccggugugguuaccugccuggaugaggcccgacacggguuugagagcggggacuuugucuccuuuucagaaguacagggcaugguugaacucaacggaaaucagcccauggagaucaaaguccugggugagcugcgaccaugggggaagcagaggggaacuagaagauauguuccuggguucuggccggggaguugaagggagaagacauggcccuugguucagaguugggaagacacauccugguguuugagaugaacuacagacaauccugugggguccaauaagagcuggugggcaugggggagagguacuguguuugagcuauuccugggagaaugugucccugguaucugagcugaguggggaaaaagucucugguguuugaacagggcagaucagcggaucuacuugugugugagcugauuuggaugggaagcagagaaggucuucccguguagacuuggagccagggacacagggucucacggggucugagcugagucuggggcacaggagagaugguuucugauguccaaguggagccuggagcugagggaagacagcuucugaugucugagcugagucggggcaggagguuccuuaucuugcagggguuguggauuuuagggagaauggguagacugacagcucucuuccugcccucuguagguccuuauaccuuuagcaucugugacaccuccaacuucuccgacuacauccguggaggcaucgucagucaggucaaaguaccuaagaagauuagcuuugugagugugucgaugggaucagugggcuguggggggugguucuaggcauucccuaguucuccauuccucucuucugguucugaugaccucuccccccgccacagaaauccuugguggccucacuggcagaaccugacuuuguggugacggacuucgccaaguuuucucgcccugcccagcugcacauuggcuuccaggcccugcaccaguucugugcucagcauggccggccaccucggccccgcaaugaggugggugagugggcgagccagccagcgcagacaugccuggcacugcaggcucaccaugccucucugcguguccacacucccugcccucacuguggccugacauauccucucuugguucuuucuggcccaccaggaggaugcagcagaacugguagccuuagcacaggcugugaaugcucgagcccugccagcagugcagcaaaauaaccuggacgaggaccucauccggaagcuggcauauguggcugcuggggaucuggcacccauaaacgccuucauugggggccuggcugcccaggaagucaugaaggucagcacggguggggagaggcaggauuggggugggccagguuccuccaugacucugucacuugcucucugucugugucaggccccuguuaaccacugaccacccccucucucccuuccccucuccaggccugcuccgggaaguucaugcccaucaugcaguggcuauacuuugaugcccuugagugucucccugaggacaaagagguccucacagaggacaagugccuccagguaugugggugggaccuguggggagggcaucauuggggacauuucuggggaggccucucuaacccuccucccuuugcauuccuuagcgccagaaccguuaugacgggcaaguggcuguguuuggcucagaccugcaagagaagcugggcaagcagaaguauuuccugguaagugguccccuuggaugucugcuccccucaucuuggccucuggccaucaccccuggggcuuccuucggcaucucaaugcaaccgguggcgcauucucuuugccauucuccuuaucuugaagggaagcccagugcaucccucguuuccccuucuggugccuccuuccucacaugacugcgugucauuucuuagaguccugcaaccugaagaugugguguuagccccucuccccgucucucaggggagugaggggugauggguagcuucacacuaaccugcaucacccugaccagccucugccugucuucuugguugcuucuuaggugggugcgggggccauuggcugugagcugcucaagaacuuugccaugauugggcugggcugcggggaggguggagaaaucaucguuacagacauggacaccauugagaagucaaaucugaaucgacaguuucuuuuccggcccugggaugucacggugaguaggguaggagguuggggcuuugucgucucacuuuccuccuuuuucuuuuuuuuuuuuuuuuugagacggaguuucgcucuuguugcccaggcuguagugcaguggcgugaucucuggcccaccacaaccucugccuccuggguucaagcgauucuccugccucagccuccugaguagcugggacuacaggcaugcgccaccacgcccggcugauuuugcauuuuaaguagagacaggguuucuccauguuggucaggcuggucucgaauucccgaccucaggugaucugccugcuucagccucccaaaguguugguauuacaggcgugagccaccacaccucaccccuccuuuuucuuguucccauucuuucugucagagaucuuucugccucugccagaagcccuucuuuuuggccuuucuuucccucagcuucuguuuuuuuuuuuuuuuuuuuuuuuuuuuugccuuaaccucuuuuuagugcugguugggacagugugucugggguccucaaaacuacucucaagcucaauucaccuagaguacuuacaggacucagcauauagucgugcuuguggcuacaauuuauuacagcaaaaggauacagaccaaaaucagcaaagggaaaaggcuggugcaaguuucuaggagucuucucccagcgggaguuaaacaaggcggccuuuauuuccccaguagcaacaguaacuacagaaauaacagcaacaagguguaacaagacaugaaauguugccaaccagggaagcuuguuagacucagcaccaccucuuuuacuuggggcuggucauguaggcgcccccuuccuggcacauaacaaaauuuccagacucccagaaggaaagguguucagcguaaacuguauuguuugcaugaacgguuuaggcacagugaaccacugauaccagguagggagcggugggaaccuuccugaauuccaaguucccagacaccagccaaggagccgaccuuggaagcaggccuuuccaaggguuguaguuucagucuccuaggcuuacacuucucugcacauauggaaacuggguugguuaugcaggguucucugagaagcuuucuguaaggagcagugucguuuuugcuuacccaggauuuauucccccuuucauuuauuucauuuauucaccagauaguuuuaguacuguuuuagguauuggggauauaccaaggaauaaaacaagauuccuggagggagaggggaacggacagcaaacaauagacacaauacgaucgugagguauauaguuaauguuggugaugagugcuccucaaaggaaacaacuaaaaccagacaagggaagucggggugucagggagaaugguuuguaguauugaugacaaugguuaaggaaggccugaguucugcaaagaccucaaggauaugagggacuagagugcccucugcuguggaagagccugcgcaaagauccugaggugggaggggucagggagccaacucauuuuacgguaaguggaggugggauccaggggaggauucugagcagaggagggacguggcccaauuugggcuuugaaaggauccugcuugucugugugccagcauccugguggugguugggggagucugcaucaauccugggugcuguuaccugaaaaaauagcagguguuagacgaaagaacagaugucuggcccauugucuccagucuguuccuguccacagcuucccuuuaugcugagccccugccacaugcaucaucauccuggccauguggcauugucacagaccgucucuccugcuagccuccuaacucagggccugggucuuccccagcauuaaguaaaucagucucaggcagacagcccuuuauagguguuugggccaggugcgguggcucacgccuguaaucccagcucuuuguggggccgaggucuuugagcucaggaguucaagaccagccugggcagcaugacaaaacccugucucuaccaaaaauacaaaaauuagccacgcaugguggcacacaccuguggucccagcuacucgggaggcugaggugggaggaucgcuggagccugggaaguugaggcugcagugagccgugaucaugccacugcauuccagccugugugauggagagagacccugucucaaaaaaaauaaagauguuuguugggugaaugcacaaauaagugagcuuuguucccccauccccacccuggaacugcacuuucuuaacccuuuagaaguuaaagucugacacggcugcugcagcugugcgccaaaugaauccacauauccgggugacaagccaccagaaccguguggguccugacacggagcgcaucuaugaugacgauuuuuuccaaaaccuagauggcguggccaaugcccuggacaacguggaugcccgugaguuuggaggcgggugagguggucacgggcaaaguuguguguguuucgguguguauauaccaagagggguguccgucuuucuguccucuccugauguuucuuuccuagcucucgcuuugugcuccccacaggcauguacauggaccgccgcugugucuacuaccggaagccacugcuggagucaggcacacugggcaccaaaggcaaugugcagguggugauccccuuccugacagagucguacaguuccagccaggacccaccugagaaguccauccccaucuguacccugaagaacuucccuaaugccaucgagcacacccugcaggugauaagcugugggagaagggaaagaggccaggcaucuggccaggcugcugccucuccgcccccaggcccuugccuugccuucagauguugcaugccuaaguguaagaugugccuuuucuccaaaccucccucccucacuucccaccaggcagccuagguuucuagaaugacucauucuuuuuucacuuuuauuuugauuuuuuuuucaacacauagacaaauauuaagaauauuaugaugaauacucaaauaccauuccucaccuaaauuuaacaauucuuaauguuuugccacauuuucuucuuagauuuauguagauuuuucuucuuugugcuuaaaugugucacagacaucacagcccuuuacucccuacuauuucagugccucugccaagugaggauauguugcuguagaacaggguuucuuagcuucagcacuacugacauuuggggcugguuauuuauuugucaugggagaggggaugcccugugcacuguaggauguuucucagcauuccugacuucugcccacuagaugccaauagcacucucccuccaucaugacaucucaaaaugucuccagacauugccagauguccccaggggugccacaucacucccaguugagaacuacuucugucuaacagaaacaucauuuucaugcucagcaaaauuaacaaucauucuuaccaucucuucuaguuauuuauuugucucuaaugguccauauucagguuuuccccagcuguuacucaaaaugaguuuaacagcugguuugucaggaugauucuguguguauggugcauuuaucuacagaacagugcauauauuaucuagcucgggguguccaaucauuuggcuucccugggccacauuggaagaagaauugucucgggccacacauaaaauauacuaauacuaacgauagcugaugagcugaaaaaauaaaagaaaaaaagauccgugcauaaaucucauaaugucuuaagaaaauuuacaaauuuguguugggcagcauucaaagucauccugggcugcauaugggccacagguuagacaagcuugaucuagcugaaguuuuacaaagugaacacacaggugaccaccaccugggccaagaaacagaaccuagggauuaccauugugcugucagaauaauucuuagugcaguguuugaggccaaaccauuuagaauaguaggaguaugagggugggaacaaaauagggaagggaaaaaaaaaacaguuccaucugucacuuucucccuucugacacugcaguuccagaguggguauguuuguauuugugcaccaaccacagucuugcuaggucauguguaaccuugaacuuaaccucucugugccgcagauuccuguucuguaaaaugggaaugacagcaucuaccucacaggacuauugugaaccacuuggcauuuacugugugccuggcacuguuuuaaccaagcuuuaaauauauauguauuugcucauuucuuccuagcaaccccaugaagguagguaucacuguuguaacaccuguuuuagagacaaggcacagagguaaagauguuauccugugugccugaagucacaaaacuagguaauacguggcauagcuggaaucugaaccugaauuucuaacaucuguacacuccaaaccaccucgcuaaugacugcgaacuguccuaggaauucucagaggccagaaguucugucuuguuugcuauuuuauuuuuugagacaggucucauucugccauucaggcugaaguguauuggcacaaucauagcucacugcaaccuuccaacuccugggaagugucuguacguguguguguguguguguguaagugucuguguguacguguaaguguguguacgugugugugugugugugugcgcacgcacgcgugcccguuacguugaccaggcugguuguaaacuccugggcucaagugauccaccugccucagccuccaaaagugcugggauuacauguguaagccucuguguccggccucugucuuguuuucugccaaguccucagggccuggauagggaucauuguugguuuggucugaguuuuuuguguuuuaaaaaacugugguaagauauaccuaauugaaguuuuuauuuuuuauggaggcauaacauaucuagaauaagguacacagauuuuuuuuuuuuuuuuuuugagguggaguuuugcucauguugcccagguuggagugcaguggcgcagucucggcucacugcagccuccgccucccagguucaagcgauucuccugccucagccuuccaaagugcugggaauacaggcgugagccaccucgccuggcacucagaucuuaauacauuuuuaggcugggcauggcggcugacaccuauaaucucagcacucaggaggccaaggagugagguuuguuugagcccaggaguucaagaccagccuaggcaacauagcaagacccugucucuacaacaaaucuuaaaaauuagccgggugugguggcaugugccugcugucccagcuauucgggaggcugaggugggaggaucguuucaaccugggaggucaaggcugcugugagccgugauugcaucgcugcacuccagcucgggugacagugugagacuuugucucaaacaacaaaacaaaacaguuuuccacauacacagcacuauuguaaccacugcccaaaucaacuucauugauuuuucuuuuuuugagacagucuuccucugucacccaggcuggagugcaauggcaugaucucggcucacugcaaccuccgccucccggguucaagagauuuccugccucagccuccugaguagcugggauuacaggcaucugccaccacgcccagcuacuuuuuguauuuuuaguagagaugggguuucaccauguuggucaggcuggucucgaacccuugaccucaggugauccaucugccuuagccucccaaagugcugggauuacaggugugagcuacugugccuggccugguuuuucaauugaggugggggaauggggaaggcuagagggcuuccccacuuccagaguagcugugcgccuuguacuugcuuuauucacugaugguccuucuaauaaugccugcggaaacccauuuugucaacuguggccacauguaaucuguuugcucugucugcagugggcucgggaugaguuugaaggccucuucaagcagccagcagaaaaugucaaccaguaccucacgugaguaacucgagugcccucucgcccugucccuguccaccagccaaggcaucccggcugcuuuccucaugacaguaacacuuggcaccaggcacacuuuucacaugaaugaguggcuguuggggccucauguuguuuggggucgggacuaguuuuccauggagaaaguaagauugcucuggagcccacucuugaggcugacauguaauccuauccucuguccucuucgauuccugauagagaccccaaguuuguggagcgaacacugcggcuggcaggcacucagcccuuggaggugcuggaggcugugcagcgcagccuggugcugcagcgaccacagaccugggcugacugcgugaccugggccugccaccacuggcacacccaguacucgaacaacauccggcagcugcugcacaacuucccuccugaccagguaaugcccaguuguuggguccauuuggcagaauguguuucccugaaaugggagccugcaguguggguccucccacuguggaguccagcuguggcaggugcccugaggcauggggaucugagaagagugauugauccugaccugcuuuuuccucacccuaguuccuuugagcaaagaggcuugguugcuauugcccuugacuguggugugggcugcgucauaccugauucccagucagggcuguagggauuaugggggagaaauucuggaguuaagagcacaggaaucaauauggguucaaauccaaacucuacuugaacuuaggcaaaucacguaacuucucucuguaccucaguuuccucgucugugaaguagaaauaauagugaucuaucucaugggggguuuggggaggauuaacugguauuuauuaaaaugaaguuaguacaaugccugguaauccaugagaguuuguuaaaugaugggcuguuuagcacaaaauggcuacccagugauugguaauuguucucucagccagaucucugguucaaccugugggacccuacaguugagguauuuugugauuggcuccaguccgcaucgagugcccaacccaagauagugaauugggggcacaucuggggccuaggugaagcgugaagauugucagagaggccuucacucucagguccuguucucaaaaaucucuccaucccuuagcucacaagcucaggagcgccguucuggucugggcccaaacgcuguccacacccgcucaccuuugaugucaacaauguaagucuccuuucuagggucuucuggggucagguggagggugaauaggugggaaggagguggcggcuccccacucgagggcugaugugcucacccuucccugcccugccuucuccuagccccugcaucuggacuaugugauggcugcugccaaccuguuugcccagaccuacgggcugacaggcucucaggaccgagcugcuguggccacauuccugcagucugugcagguccccgaauucacccccaagucuggcgucaagauccauguuucugaccaggagcugcagagcgccaaugccucuguuggugaggguguuuggccaguuggccaggagucaccccacauguccccggccuaguccagccuccccaccaguccucuaccccugguucugcucugcucugugaccccaggccugagguuuacccacaccuuccuuugagccucccuuugacaugaagaggguagguuggggcaaauuaucucccucccuccuccuccuucccacuaucuggcccucaggagaacuugcuguuuuacucuugcucuguguauuucccuuaguuuuguucuuucuucuguuucuucuugaucuguucaucuaggagguaugaucucuaccagcagucucucucccuugauacuuuccugccuugucuccuuccagauccgcccccaucuguacaucuaccugcauguuucucugugcaucuucacccuccauaguuuggggcugcgguuuacugacacccccaccccaccccaucugcauauuuuuucaccaccccucccuucuguauaugaugcuucuguagcucuguaacgcccccuacauuuaccuuccuuauaucucccccgucuuccucuccauagaucuccucccauuuccccuuccaugguccccaucuuccuucugaaaugucuacuccuucauguuccuuuauguaugucuuccaaucuuuccuuccauagcucucaucaccuucauauauuucuuccaucuuucuccucccaccugccucgcccucuguauauacccccacucucccccuuuuauaucuucuccaucuccccccauaucuuuccucuauguccacaucuguguauuccccccaacuuccccuccauauaucuuuuuuacuccccuuuuccucccuguauccucuguguuccccccaucuugcucuacaucauucuucccaagaucuuuacgucucccaucuugaucucuccaucuccacuuucuccuaacauuuucauuuccguuccuuagugucucuagagagaucauucuugauagccucagcucuuucucuguguuuuucagguuuguauucugcucugcucuaccucuccuccuugccccuuuucucucccaggaugucucuccuuuccaaauccuuuuuguaccugaauaccuuuugccccacccugggcucucauuuccaucucagaccuuagccugggaucuaaagggcugacagugucccuuucuucaugcagaugacagucgucuagaggagcucaaagccacucugcccagcccagacaagcucccuggauucaagauguaccccauugacuuugagaagguaugggguggggcucaggacagggaaggaggaugggcaaagcauagacaggcuggagaaaacaggaguaucuggagccagccccgggccuuuguggggaucagauugugggccugccauauggcucugaaugaguagguguucccagccaucccuuugugaucugggagaguccagcaggcaauugcaguggaggauacacaucuucuuuaucugauccucuccccacugccuucacacccuccccacucauaacaggaugaugacagcaacuuucauauggauuucaucguggcugcauccaaccuccgggcagaaaacuaugacauuccuucugcagaccggcacaaggugaggggaaucuaaaucugauguuccacccuccuccagguuugaguuacccacacuuagccccucuguagacccugaggcucuuguacuuaacuaccaccuucuuuugucccuucugucucucagagcaagcugauugcagggaagaucaucccagccauugccacgaccacagcagccgugguuggccuugugugucuggagcuguacaagguugugcaggggcaccgacagcuugacuccuacaagaaugguuuccucaacuuggcccugccuuucuuugguuucucugaaccccuugccgcaccacgucaccaggugggggccugcauccgaagcaggguuugggugggguguaucuguguagaucugguucugauucacgucauacccugucaccaggugaggguuucugucuguguaccuacccuuuuuguguauccuuuuucacuuauucauuaaucacauuauuugaguacgugcgaaaagaugggauauuugaauugugcccugggagauuauuaguaacuacacaauaauggcagccaaaauuuauuggacgcuuccuacacuuaagugcuuugcuugcuucauuaaugaauucacucaaauauuuauugagcaccuuuugugugcagggacucuucuaaguuauguuccucaaguagauuauauaaauaaccuauuaaaugauuuuggaaucaaaaaaggauaaaaagaggccgggcgugguggcuuacgccuguaaucccagcacuuugggaggccgaggcacgugguucaccugaagucaggaguuugagaccagccuggccaacaugaugaaacccugucucuacuaaaaauacaaaaaauuagccaggcguagugguaggcaccuguaaucccagcuacucgggaggcugaggcaagagaaucacuugaacccgggaggcggagguugcagugagccaagauggcgccauugcacucccgccugggugacagagcgagacugcaucucaaaaaaaaaaaaagauaaagaggacuugagaauaccagggggcgaggggauguauuugagauuuuguguaggauggucagaaaaggccuugcugaaaagaugacauuugagaucagacuuggaggauguaaggggacaaacugugcaggcuugguggcgaguggggacacauuccaggcagagggaccaguucuugaaaggguaccaagauaggggugugccuggcaaguuggaggaauucaaaguccccagagugagugugagauugaggaggguaggagaugagaagaaaacagaauuucauugcuuagggugagauaggaaccacaagaggauuucgaacaaaagaggguugugaucugacuaaacacgucugcauggggguaggggggauggagacagaugggggcuggacccucugggauggucuccaucuuacacuccccucuuugucuugcaguacuauaaccaagaguggacauugugggaucgcuuugagguacaagggcugcagccuaauggugaggagaugacccucaaacaguuccucgacuauuuuaagguaaggccccucccuuacucugucaccccaccucagggggcgagguguacacggugacuugcuggccuguccaccuccaugacccugcuguucccccucccucuccagacagagcacaaauuagagaucaccaugcugucccagggcguguccaugcucuauuccuucuucaugccagcugccaagcucaaggaacgguuggaucagccgugaguuggacacuggccaggcuaggggaggcccuguauggguuggggagccucaucauccagcugucccacuccaguucacugccccuaccuaccugcccauccucucuugcuuucugcccuccugacccuauacucccaucccccuauccccaggaugacagagauugugagccgugugucgaagcgaaagcugggccgccacgugcgggcgcuggugcuugagcugugcuguaacgacgagagcggcgaggaugucgagguucccuauguccgauacaccauccgcugaccccgucugcuccucuaggcuggccccuuguccaccccucuccacaccccuuccagcccaggguucccauuuggcuucuggcaguggcccaacuagccaagucugguguucccucaucaucccccuaccugaaccccucuugccacugccuucuaccuuguuugaaaccugaauccuaauaaagaauuaauaacucccacaucgccugcccugcugguuccagggaaggaagggacuuccuggagcugucugguucagaugauaacucagagggcucaaccccaccacaccugccaguuuucuggacaaagaaaauguaauugccaccucuuccugcccucucugccuaggaagagauggaggcaccagugaggccauagugagcagguacuuggguccaugugacuguuaauuugagcuggguucaauucucaccuucuccauguccuaacuccuugcucugugaagaggaaaguuacggugaccaggcugcu

SEQ ID NO: 18937 - RNA, 24700 nt, Homo sapiens
agcagccuggucaccguaacuuuccucuucacagagcaaggaguuaggacauggagaaggugagaauugaacccagcucaaauuaacagucacauggacccaaguaccugcucacuauggccucacuggugccuccaucucuuccuaggcagagagggcaggaagagguggcaauuacauuuucuuuguccagaaaacuggcagguguggugggguugagcccucugaguuaucaucugaaccagacagcuccaggaagucccuuccuucccuggaaccagcagggcaggcgaugugggaguuauuaauucuuuauuaggauucagguuucaaacaagguagaaggcaguggcaagagggguucagguagggggaugaugagggaacaccagacuuggcuaguugggccacugccagaagccaaaugggaacccugggcuggaagggguguggagagggguggacaaggggccagccuagaggagcagacggggucagcggaugguguaucggacauagggaaccucgacauccucgccgcucucgucguuacagcacagcucaagcaccagcgcccgcacguggcggcccagcuuucgcuucgacacacggcucacaaucucugucauccuggggauagggggaugggaguauagggucaggagggcagaaagcaagagaggaugggcagguagguaggggcagugaacuggagugggacagcuggaugaugaggcuccccaacccauacagggccuccccuagccuggccaguguccaacucacggcugauccaaccguuccuugagcuuggcagcuggcaugaagaaggaauagagcauggacacgcccugggacagcauggugaucucuaauuugugcucugucuggagagggagggggaacagcagggucauggagguggacaggccagcaagucaccguguacaccucgcccccugagguggggugacagaguaagggaggggccuuaccuuaaaauagucgaggaacuguuugagggucaucuccucaccauuaggcugcagcccuuguaccucaaagcgaucccacaauguccacucuugguuauaguacugcaagacaaagaggggaguguaagauggagaccaucccagaggguccagcccccaucugucuccauccccccuacccccaugcagacguguuuagucagaucacaacccucuuuuguucgaaauccucuugugguuccuaucucacccuaagcaaugaaauucuguuuucuucucaucuccuacccuccucaaucucacacucacucuggggacuuugaauuccuccaacuugccaggcacaccccuaucuugguacccuuucaagaacuggucccucugccuggaauguguccccacucgccaccaagccugcacaguuuguccccuuacauccuccaagucugaucucaaaugucaucuuuucagcaaggccuuuucugaccauccuacacaaaaucucaaauacauccccucgcccccugguauucucaaguccucuuuaucuuuuuuuuuuuuugagaugcagucucgcucugucacccaggcgggagugcaauggcgccaucuuggcucacugcaaccuccgccucccggguucaagugauucucuugccucagccucccgaguagcugggauuacaggugccuaccacuacgccuggcuaauuuuuuguauuuuuaguagagacaggguuucaucauguuggccaggcuggucucaaacuccugacuucaggugaaccacgugccucggccucccaaagugcugggauuacaggcguaagccaccacgcccggccucuuuuuauccuuuuuugauuccaaaaucauuuaauagguuauuuauauaaucuacuugaggaacauaacuuagaagagucccugcacacaaaaggugcucaauaaauauuugagugaauucauuaaugaagcaagcaaagcacuuaaguguaggaagcguccaauaaauuuuggcugccauuauuguguaguuacuaauaaucucccagggcacaauucaaauaucccaucuuuucgcacguacucaaauaaugugauuaaugaauaagugaaaaaggauacacaaaaaggguagguacacagacagaaacccucaccuggugacaggguaugacgugaaucagaaccagaucuacacagauacaccccacccaaacccugcuucggaugcaggcccccaccuggugacguggugcggcaagggguucagagaaaccaaagaaaggcagggccaaguugaggaaaccauucuuguaggagucaagcugucggugccccugcacaaccuuguacagcuccagacacacaaggccaaccacggcugcuguggucguggcaauggcugggaugaucuucccugcaaucagcuugcucugagagacagaagggacaaaagaaggugguaguuaaguacaagagccucagggucuacagaggggcuaaguguggguaacucaaaccuggaggaggguggaacaucagauuuagauuccccucaccuugugccggucugcagaaggaaugucauaguuuucugcccggagguuggaugcagccacgaugaaauccauaugaaaguugcugucaucauccuguuaugaguggggagggugugaaggcaguggggagaggaucagauaaagaagauguguauccuccacugcaauugccugcuggacucucccagaucacaaagggauggcugggaacaccuacucauucagagccauauggcaggcccacaaucugauccccacaaaggcccggggcuggcuccagauacuccuguuuucuccagccugucuaugcuuugcccauccuccuucccuguccugagccccaccccauaccuucucaaagucaaugggguacaucuugaauccagggagcuugucugggcugggcagaguggcuuugagcuccucuagacgacugucaucugcaugaagaaagggacacugucagcccuuuagaucccaggcuaaggucugagauggaaaugagagcccaggguggggcaaaagguauucagguacaaaaaggauuuggaaaggagagacauccugggagagaaaaggggcaaggaggagagguagagcagagcagaauacaaaccugaaaaacacagagaaagagcugaggcuaucaagaaugaucucucuagagacacuaaggaacggaaaugaaaauguuaggagaaaguggagauggagagaucaagaugggagacguaaagaucuugggaagaaugauguagagcaagauggggggaacacagaggauacagggaggaaaaggggaguaaaaaagauauauggaggggaaguuggggggaauacacagauguggacauagaggaaagauauggggggagauggagaagauauaaaagggggagaguggggguauauacagagggcgaggcaggugggaggagaaagauggaagaaauauaugaaggugaugagagcuauggaaggaaagauuggaagacauacauaaaggaacaugaaggaguagacauuucagaaggaagauggggaccauggaaggggaaaugggaggagaucuauggagaggaagacgggggagauauaaggaagguaaauguagggggcguuacagagcuacagaagcaucauauacagaagggagggguggugaaaaaauaugcagaugggguggggugggggugucaguaaaccgcagccccaaacuauggagggugaagaugcacagagaaacaugcagguagauguacagaugggggcggaucuggaaggagacaaggcaggaaaguaucaagggagagagacugcugguagagaucauaccuccuagaugaacagaucaagaagaaacagaagaaagaacaaaacuaagggaaauacacagagcaagaguaaaacagcaaguucuccugagggccagauagugggaaggaggaggagggagggagauaauuugccccaaccuacccucuucaugucaaagggaggcucaaaggaagguguggguaaaccucaggccuggggucacagagcagagcagaaccagggguagaggacugguggggaggcuggacuaggccggggacauguggggugacuccuggccaacuggccaaacacccucaccaacagaggcauuggcgcucugcagcuccuggucagaaacauggaucuugacgccagacuugggggugaauucggggaccugcacagacugcaggaauguggccacagcagcucgguccugagagccugucagcccguaggucugggcaaacagguuggcagcagccaucacauaguccagaugcaggggcuaggagaaggcagggcagggaagggugagcacaucagcccucgaguggggagccgccaccuccuucccaccuauucacccuccaccugaccccagaagacccuagaaaggagacuuacauuguugacaucaaaggugagcggguguggacagcguuugggcccagaccagaacggcgcuccugagcuugugagcuaagggauggagagauuuuugagaacaggaccugagagugaaggccucucugacaaucuucacgcuucaccuaggccccagaugugcccccaauucacuaucuuggguugggcacucgaugcggacuggagccaaucacaaaauaccucaacuguagggucccacagguugaaccagagaucuggcugagagaacaauuaccaaucacuggguagccauuuugugcuaaacagcccaucauuuaacaaacucucauggauuaccaggcauuguacuaacuucauuuuaauaaauaccaguuaauccuccccaaaccccccaugagauagaucacuauuauuucuacuucacagacgaggaaacugagguacagagagaaguuacgugauuugccuaaguucaaguagaguuuggauuugaacccauauugauuccugugcucuuaacuccagaauuucucccccauaaucccuacagcccugacugggaaucagguaugacgcagcccacaccacagucaagggcaauagcaaccaagccucuuugcucaaaggaacuagggugaggaaaaagcaggucaggaucaaucacucuucucagauccccaugccucagggcaccugccacagcuggacuccacagugggaggacccacacugcaggcucccauuucagggaaacacauucugccaaauggacccaacaacugggcauuaccuggucaggagggaaguugugcagcagcugccggauguuguucgaguacugggugugccagugguggcaggcccaggucacgcagucagcccaggucuguggucgcugcagcaccaggcugcgcugcacagccuccagcaccuccaagggcugagugccugccagccgcaguguucgcuccacaaacuuggggucucuaucaggaaucgaagaggacagaggauaggauuacaugucagccucaagagugggcuccagagcaaucuuacuuucuccauggaaaacuagucccgaccccaaacaacaugaggccccaacagccacucauucaugugaaaagugugccuggugccaaguguuacugucaugaggaaagcagccgggaugccuuggcugguggacagggacagggcgagagggcacucgaguuacucacgugagguacugguugacauuuucugcuggcugcuugaagaggccuucaaacucaucccgagcccacugcagacagagcaaacagauuacauguggccacaguugacaaaauggguuuccgcaggcauuauuagaaggaccaucagugaauaaagcaaguacaaggcgcacagcuacucuggaaguggggaagcccucuagccuuccccauucccccaccucaauugaaaaaccaggccaggcacaguagcucacaccuguaaucccagcacuuugggaggcuaaggcagauggaucaccugaggucaaggguucgagaccagccugaccaacauggugaaaccccaucucuacuaaaaauacaaaaaguagcugggcgugguggcagaugccuguaaucccagcuacucaggaggcugaggcaggaaaucucuugaacccgggaggcggagguugcagugagccgagaucaugccauugcacuccagccugggugacagaggaagacugucucaaaaaaagaaaaaucaaugaaguugauuugggcagugguuacaauagugcuguguauguggaaaacuguuuuguuuuguuguuugagacaaagucucacacugucacccgagcuggagugcagcgaugcaaucacggcucacagcagccuugaccucccagguugaaacgauccucccaccucagccucccgaauagcugggacagcaggcacaugccaccacacccggcuaauuuuuaagauuuguuguagagacagggucuugcuauguugccuaggcuggucuugaacuccugggcucaaacaaaccucacuccuuggccuccugagugcugagauuauaggugucagccgccaugcccagccuaaaaauguauuaagaucugagugccaggcgagguggcucacgccuguauucccagcacuuuggaaggcugaggcaggagaaucgcuugaaccugggaggcggaggcugcagugagccgagacugcgccacugcacuccaaccugggcaacaugagcaaaacuccaccucaaaaaaaaaaaaaaaaaaaucuguguaccuuauucuagauauguuaugccuccauaaaaaauaaaaacuucaauuagguauaucuuaccacaguuuuuuaaaacacaaaaaacucagaccaaaccaacaaugaucccuauccaggcccugaggacuuggcagaaaacaagacagaggccggacacagaggcuuacacauguaaucccagcacuuuuggaggcugaggcagguggaucacuugagcccaggaguuuacaaccagccuggucaacguaacgggcacgcgugcgugcgcacacacacacacacacacguacacacacuuacacguacacacagacacuuacacacacacacacacacacguacagacacuucccaggaguuggaagguugcagugagcuaugauugugccaauacacuucagccugaauggcagaaugagaccugucucaaaaaauaaaauagcaaacaagacagaacuucuggccucugagaauuccuaggacaguucgcagucauuagcgaggugguuuggaguguacagauguuagaaauucagguucagauuccagcuaugccacguauuaccuaguuuugugacuucaggcacacaggauaacaucuuuaccucugugccuugucucuaaaacagguguuacaacagugauaccuaccuucaugggguugcuaggaagaaaugagcaaauacauauauauuuaaagcuugguuaaaacagugccaggcacacaguaaaugccaagugguucacaauaguccugugagguagaugcugucauucccauuuuacagaacaggaaucugcggcacagagagguuaaguucaagguuacacaugaccuagcaagacugugguuggugcacaaauacaaacauacccacucuggaacugcagugucagaagggagaaagugacagauggaacuguuuuuuuuuucccuucccuauuuuguucccacccucauacuccuacuauucuaaaugguuuggccucaaacacugcacuaagaauuauucugacagcacaaugguaaucccuagguucuguuucuuggcccaggugguggucaccuguguguucacuuuguaaaacuucagcuagaucaagcuugucuaaccuguggcccauaugcagcccaggaugacuuugaaugcugcccaacacaaauuuguaaauuuucuuaagacauuaugagauuuaugcacggaucuuuuuuucuuuuauuuuuucagcucaucagcuaucguuaguauuaguauauuuuauguguggcccgagacaauucuucuuccaauguggcccagggaagccaaaugauuggacaccccgagcuagauaauauaugcacuguucuguagauaaaugcaccauacacacagaaucauccugacaaaccagcuguuaaacucauuuugaguaacagcuggggaaaaccugaauauggaccauuagagacaaauaaauaacuagaagagaugguaagaaugauuguuaauuuugcugagcaugaaaaugauguuucuguuagacagaaguaguucucaacugggagugauguggcaccccuggggacaucuggcaaugucuggagacauuuugagaugucaugauggagggagagugcuauuggcaucuagugggcagaagucaggaaugcugagaaacauccuacagugcacagggcauccccucucccaugacaaauaaauaaccagccccaaaugucaguagugcugaagcuaagaaacccuguucuacagcaacauauccucacuuggcagaggcacugaaauaguagggaguaaagggcugugaugucugugacacauuuaagcacaaagaagaaaaaucuacauaaaucuaagaagaaaauguggcaaaacauuaagaauuguuaaauuuaggugaggaaugguauuugaguauucaucauaauauucuuaauauuugucuauguguugaaaaaaaaaucaaaauaaaagugaaaaaagaaugagucauucuagaaaccuaggcugccuggugggaagugagggagggagguuuggagaaaaggcacaucuuacacuuaggcaugcaacaucugaaggcaaggcaagggccugggggcggagaggcagcagccuggccagaugccuggccucuuucccuucucccacagcuuaucaccugcagggugugcucgauggcauuagggaaguucuucaggguacagauggggauggacuucucagguggguccuggcuggaacuguacgacucugucaggaaggggaucaccaccugcacauugccuuuggugcccagugugccugacuccagcaguggcuuccgguaguagacacagcggcgguccauguacaugccuguggggagcacaaagcgagagcuaggaaagaaacaucaggagaggacagaaagacggacaccccucuugguauauacacaccgaaacacacacaacuuugcccgugaccaccucacccgccuccaaacucacgggcauccacguuguccagggcauuggccacgccaucuagguuuuggaaaaaaucgucaucauagaugcgcuccgugucaggacccacacgguucugguggcuugucacccggauauguggauucauuuggcgcacagcugcagcagccgugucagacuuuaacuucuaaaggguuaagaaagugcaguuccaggguggggaugggggaacaaagcucacuuauuugugcauucacccaacaaacaucuuuauuuuuuuugagacagggucucucuccaucacacaggcuggaaugcaguggcaugaucacggcucacugcagccucaacuucccaggcuccagcgauccucccaccucagccucccgaguagcugggaccacaggugugugccaccaugcguggcuaauuuuuguauuuuugguagagacaggguuuugucaugcugcccaggcuggucuugaacuccugagcucaaagaccucggccccacaaagagcugggauuacaggcgugagccaccgcaccuggcccaaacaccuauaaagggcugucugccugagacugauuuacuuaaugcuggggaagacccaggcccugaguuaggaggcuagcaggagagacggucugugacaaugccacauggccaggaugaugaugcauguggcaggggcucagcauaaagggaagcuguggacaggaacagacuggagacaaugggccagacaucuguucuuucgucuaacaccugcuauuuuuucagguaacagcacccaggauugaugcagacucccccaaccaccaccaggaugcuggcacacagacaagcaggauccuuucaaagcccaaauugggccacgucccuccucugcucagaauccuccccuggaucccaccuccacuuaccguaaaaugaguuggcucccugaccccucccaccucaggaucuuugcgcaggcucuuccacagcagagggcacucuagucccucauauccuugaggucuuugcagaacucaggccuuccuuaaccauugucaucaauacuacaaaccauucucccugacaccccgacuucccuugucugguuuuaguuguuuccuuugaggagcacucaucaccaacauuaacuauauaccucacgaucguauugugucuauuguuugcuguccguuccccucucccuccaggaaucuuguuuuauuccuugguauauccccaauaccuaaaacaguacuaaaacuaucuggugaauaaaugaaauaaaugaaagggggaauaaauccuggguaagcaaaaacgacacugcuccuuacagaaagcuucucagagaacccugcauaaccaacccaguuuccauaugugcagagaaguguaagccuaggagacugaaacuacaacccuuggaaaggccugcuuccaaggucggcuccuuggcuggugucugggaacuuggaauucaggaagguucccaccgcucccuaccugguaucagugguucacugugccuaaaccguucaugcaaacaauacaguuuacgcugaacaccuuuccuucugggagucuggaaauuuuguuaugugccaggaagggggcgccuacaugaccagccccaaguaaaagagguggugcugagucuaacaagcuucccugguuggcaacauuucaugucuuguuacaccuuguugcuguuauuucuguaguuacuguugcuacuggggaaauaaaggccgccuuguuuaacucccgcugggagaagacuccuagaaacuugcaccagccuuuucccuuugcugauuuuggucuguauccuuuugcuguaauaaauuguagccacaagcacgacuauaugcugaguccuguaaguacucuaggugaauugagcuugagaguaguuuugaggaccccagacacacugucccaaccagcacuaaaaagagguuaaggcaaaaaaaaaaaaaaaaaaaaaaaaaaaacagaagcugagggaaagaaaggccaaaaagaagggcuucuggcagaggcagaaagaucucugacagaaagaaugggaacaagaaaaaggaggggugaggugugguggcucacgccuguaauaccaacacuuugggaggcugaagcaggcagaucaccugaggucgggaauucgagaccagccugaccaacauggagaaacccugucucuacuuaaaaugcaaaaucagccgggcgugguggcgcaugccuguagucccagcuacucaggaggcugaggcaggagaaucgcuugaacccaggaggcagagguuguggugggccagagaucacgccacugcacuacagccugggcaacaagagcgaaacuccgucucaaaaaaaaaaaaaaaaagaaaaaggaggaaagugagacgacaaagccccaaccuccuacccuacucaccgugacaucccagggccggaaaagaaacugucgauucagauuugacuucucaaugguguccaugucuguaacgaugauuucuccacccuccccgcagcccagcccaaucauggcaaaguucuugagcagcucacagccaauggcccccgcacccaccuaagaagcaaccaagaagacaggcagaggcuggucagggugaugcagguuagugugaagcuacccaucaccccucacuccccugagagacggggagaggggcuaacaccacaucuucagguugcaggacucuaagaaaugacacgcagucaugugaggaaggaggcaccagaaggggaaacgagggaugcacugggcuucccuucaagauaaggagaauggcaaagagaaugcgccaccgguugcauugagaugccgaaggaagccccaggggugauggccagaggccaagaugaggggagcagacauccaaggggaccacuuaccaggaaauacuucugcuugcccagcuucucuugcaggucugagccaaacacagccacuugcccgucauaacgguucuggcgcuaaggaaugcaaagggaggaggguuagagaggccuccccagaaauguccccaaugaugcccuccccacaggucccacccacauaccuggaggcacuuguccucugugaggaccucuuuguccucagggagacacucaagggcaucaaaguauagccacugcaugaugggcaugaacuucccggagcaggccuggagaggggaagggagagaggggguggucagugguuaacaggggccugacacagacagagagcaagugacagagucauggaggaaccuggcccaccccaauccugccucuccccacccgugcugaccuucaugacuuccugggcagccaggcccccaaugaaggcguuuaugggugccagauccccagcagccacauaugccagcuuccggaugagguccucguccagguuauuuugcugcacugcuggcagggcucgagcauucacagccugugcuaaggcuaccaguucugcugcauccuccuggugggccagaaagaaccaagagaggauaugucaggccacagugagggcagggaguguggacacgcagagaggcauggugagccugcagugccaggcaugucugcgcuggcuggcucgcccacucacccaccucauugcggggccgagguggccggccaugcugagcacagaacuggugcagggccuggaagccaaugugcagcugggcagggcgagaaaacuuggcgaaguccgucaccacaaagucagguucugccagugaggccaccaaggauuucuguggcggggggagaggucaucagaaccagaagagaggaauggagaacuagggaaugccuagaaccaccccccacagcccacugaucccaucgacacacucacaaagcuaaucuucuuagguacuuugaccugacugacgaugccuccacggauguagucggagaaguuggaggugucacagaugcuaaagguauaaggaccuacagagggcaggaagagagcugucagucuacccauucucccuaaaauccacaaccccugcaagauaaggaaccuccugccccgacucagcucagacaucagaagcugucuucccucagcuccaggcuccacuuggacaucagaaaccaucucuccugugccccagacucagcucagaccccgugagacccugugucccuggcuccaagucuacacgggaagaccuucucugcuucccauccaaaucagcucacacacaaguagauccgcugaucugcccuguucaaacaccagagacuuuuuccccacucagcucagauaccagggacacauucucccaggaauagcucaaacacaguaccucucccccaugcccaccagcucuuauuggaccccacaggauugucuguaguucaucucaaacaccaggaugugucuucccaacucugaaccaagggccaugucuucucccuucaacuccccggccagaacccaggaacauaucuucuaguuccccucugcuucccccauggucgcagcucacccaggacuuugaucuccaugggcugauuuccguugaguucaaccaugcccuguacuucugaaaaggagacaaaguccccgcucucaaacccgugucgggccucauccaggcagguaaccacaccgggguuguccugguuaaaggaagagugagucucagaaacaggcccaggguaccaagagcagacaggaaggacuacugcagcccaccugccugccaggaacccuagggcuggucuccuuaccuugguaaccauagaaaccauagcacugaguggcugcuccccauuggaaucugugaggaucauuuccucuccaaagucacagaagagcugccuguagagggaagcaauagggcuggugccugugucccaugcacauacaggucccacgggucccucaagauguagugaaaacuugcugagcaaacucagccuaucacugcugggauguaagaugguacuugugccacauggggagagaugaaaacacagaacccaaaaccuggguagcugagaagggaugagggcagggagagccuagagucuuggccugggcuugguaggaguugggggaaaaggggacagggagggaggugggcugccacucacccaaacaggccccgcgugucugccaccaccagcuugaugccacgguugugacagaacucacccacucgcagcugguccuccagggggguguuggugagcaccaccaccuguggagagauggaggcucaggcccagcauuggggugaaggggaaaaaauggagggcugguguggaggacucaggcaguccucaaggcaaacacauccaggcuuugcugggucagccucuuucacaaacacauagcaccuacuguguaucagacucugugggggucgaaaaugaaccccuggacuauaccaggaaaggugaagagguagcugggaggagggaguuuggagaagagcugacucauuuauuugacaaacacccgcugcugucugucugccaugcccugugagacacuggaguaaaacucugucuccagccaaagucugagcucacuccuaccacacccaccugcuuccaauucucaagacgacgccugcuccgccaugaucuuugggauuuugcucucugccugaauguccauccuuccccaccagggugagcuccuacuccuccaucaggauuuagcugcagugcccuggcaaccugggauacuccagggacaacucucagcuuccagagcaccucuuuccggccuggacuuuuuaauuaacaaacacccauccaguccuuauaugccagcugcaauuccacguguuuaacccucacaaaaaguccaugaagucagugcugcuaccacgcacugacuacaaacaggaaaacaaagguacaggagaugaaacaaccugcuugaagucacacuaccaaggcuggaggccugcagcaaggcaguauggcucuacagucugugcccacaaccacuaugcuguacugucuguacacaucuuccccacuugaaaaggcggggccaggccgggugcgguggcucacaccuguaaucccagcacuuugggaggcggaggcgggcggaucacaaggucaggagaucgagaccacccuggcuaacacagugaaaccccgucucuacuaaaaauacaaaaaaaaauuagccgggcgugguggcaggcgccuguagucccagcuacucgggaggcugaggcaggagaauggcgugaacccaggagguguagcuugcagugagccgagaucgcgccacugcacucuagcuugggcgacagagcaagacuccgucucaaaaaaaaaaaaagaagaaaagaaaaggcagggccaggggcuaacugcugccugcauacucuagucccccagcacaaaaccugacauucaggccgacccauuaaaucaauauugaacacuacugaauaaaccagagaugggcucugagaaaacugggcagaaggcuggguaguacccccaagauaccuggaaaccacuaaggaaguccucaacgagggguccaguguaggcagugacaggcacauagcuguugagcucagcgaggcggggcugugauaccucggcccgguuuuuaccgauguccuccucccgcagguagaacuguaagggugugcaguagggaaaaagaugaaauggcuguggcaccgggaacaguggugccucgggaagggggaaagggggaagggugcuaggaagagguaccugggaggaaagaucagcccacugggcagugcccuggucauguaggguaacagccuugaccccaccaaggaugauguucuuagcgaucuccacgcccaggccccgcaggccugauaccaggacacuggaugucuggagccgcuucauugccucauggcccaacacauaccugccagguuaggggguacucuaggucagggccugccccacccaaccuuauccucucaaugucccauuccacaccccucagcccggccuuggccccacuuacagcugccgggaguaaaggcccucgucuaugucugcuucacugccguucuuggccauucccuaggaauagaggaaaagaacaaguuuagggagacacacaggaguggagcauggauagacagacagugauacaaaagacuuucccacccaccaccucgucugccagucuccacggagaggacacucacguugguuggcaccgagggcacuucggacaacacggacugggcaggggagcaguuagaacccggcuuuggaucaggcccggacacgcgacguuucuuggacagcggcgagcuggacaucuggaggaaaaaaaggucagaggugacccuggagcacauggguaccguuuuucuguuuguuaguagcaacugugggggaagggaagacuuaaguauuaguacccccauuuuacagcaaagaggggacaggcacagaaaggugaggacuugcccaggguaacacagcugucagaccuaagaucugaacccagguggucugauuugcaaauccacacugcugaccacuaagccauuugcuucuucccagcccagcauaaugagggagagacuccaauccuggagugaaaggaaugacaagaauguacuugugucgaggucaggggaaggauguggauucaggacagaccugguuucaaaucuugagccugccacgcacuaacaguaauaauuaaccgccacaggccucaguuuucucaccugugaaacaggggugauaauaccacuuaccuuccccacgggguuaucgagaugauaaauaacacagagcauagaaccuggcacagaguagguaggcaguaacaagcagccauucuccucucccuuaaucccagggauggcggcgggagcggggagugcaggagggaagugaggcuuggacauccaucaggguggcaugauggcaggagcgguaacuugcugagaacccaguccccagaggggcucaaguuuuauaaagcccaacccugcccccagcuuugggaggggaaaaccgacacagaccaauaaaagagguugcaaaaagauagaaaacaaacacaucccaagccucaucugcaugcggagucccuuaaacagguuaaccacaaugauaaaugaguauuagauugaucaggaguccuccuugugccagaugccauaguaagcacuucucuaaaccucgucucacucuguccucaggguacuccugugggguuuggacugcuaucaauaauacccccaacuuuaaagugauggaaaaaaauucacucagggacguucggugaccaagguucccacacacugagcugggaccagaccaggaucugcugacucugaagcccaggcugcuuccucguguuaucacguuucauccccuccaugacccugacccagcaaggcagaguuuaguguccuugccggacaaaugagaaguaacuugcccagggucaccugcuaggucccagagacagaacaauaaagccugcuguggaagugaaaucugguggugggggugacuggguccacaugcuggagaugggaggacccagcgucacuuccccucaccccaagugcuccucuaggcacugagucuucuguucacacaaguccucccacacugagacuuuuaugacacuaaguaucccaauguaccuaagauuccaucuuggcacuugucacuagcaccaaccacaaugacaagagcucccuacuaucuaccaagagcauacugugugucaaucaaagaggaaagggcuuugucuaaucuuaacaauccccaugacccagauaacccuaugcccaaaucacaaaugggaaaagaaaggcuuagagaaccccauucacucgcccagaggcaugcagcuggugggggacuguuugccaaaugccccugggcucagggcccaguccacagggcuaaggaaugggagaugaggggaggcagcaggcuggcuggagccccugagauagccaggugaauugcuuagaaugcuaagagccaaccuggguagcaagaggcuuggugaguuaguagagacaaaggugaaccauauuuuccauuuacugacucucugacugaccugggguagagaucucauuuccucugagccucauuuucuccaaaagcugggacaaaugaaacugucuucaaggggcugcuggcaggguuaaagaagccaaggucuguggucagaacucacugaccugaggaugugaguuccucccugggcacguguaguggccucuauuacuuaguuaucuccuugccuugucauuggucaguuuguuugggacaugccauuuccucacuccauaaauuagagaugauccagggccagagagcacuuuaauaucuggacauuucaccucuggauccccagugcaggcagcaagagucuaagaaguuucagaugauuguucaaguggauuuugacugcaaagguuuggaacagcccugucucaaggcaagcaggagucugggacagaaacucugcagaggagcuaaagaucccccacccccagcagaaaaacaaucuacacccuuccuaccucaacauuugcucaggcccccaccauaacauacacacugugaacuguuuggcaaagcugagcuguggcuuaguuucuaaacauaccugagucuccaaacugaagauuuucaagcguaagcauucucuauucccaaaccagaggguuugagggaggagucuuggaggugugagaggaggcagguuagcaggauggagaagcuagggcauagagaaggggggcuggagcaugucaagcuuucugggagggguuaacugagaaguccaugggaacgugagaggagaaucaggaagugggugucuaagagcaaggaggcucugagacaaaugggaaaggagauguuagaaguccugggagggaaaggacuaggcuaggguauuaggaaaagacucaaauucggaucucuggaaaaggaucuuuuggagaaaggcugaaaaauugcaguggaggcccccaaggcugcaaggagguaggaggacaguugcugggccccauggaagcugcaaagggaaugggugggggauucuagagucugaggaggcagcaggaagauguuggggucuggggggagaggcagccuccaucaggaggauguugaggcucuggaggacucuggagacagaugcugguagcagagagaaaucuuuaaccaaaaauaauagauagggacaugcaagaggagagguguaucugacauuccuacuacagagucccaggaggcugugaggguggauggugaggggcugggagagguuucuaauggaacacaaaggcccugugucaaucucugacaggacaugcuagguaucacagcugcucugaggguguggaaacgggaagcugggcccagauagugcaggccuuaaaaagguuaauaagcaaacacuggcuagguccccaaaugggguuggguuucucugaccaauuauguaggaccccauggaggcgcugaagguagaugcugagaagaggguuuucuacugcaguagaaaacaagagggccauggccaggcgcgguggcucacgccugcaaucccagcacuuugggaggccgaggcagguggaucaccugaggucaggaguucgagaccagccugggcaauauggugaaaccccaucucuacuaaaaauacaaaaaauuagccaggcgugguggugcaugccuguaaucccagcuacucgggaggcugaggcaggagaaucgcuugaacccaggagguggagguugcagugagcugagauggcgccacugcacuccagccuggacgacauagugaaacaauucugucucggaaaaaagaaaaagaaaaagaaaacaagaaggccuguggggggaagggacaucugacaaugauccugggguccaaggaggcugaaagcagaagcugaaaaccccugacugcagacguuagggaccuugaaacgaucugagggcagauucugaggccugaugugaggauaagggaucugugaaaaaagcagcuagaacccagguugguuuuugaaggcagaggcugggucuagggugggguuggggaggcgagucucugauggaaggggcuagaagccaacgggaucugcaagagcagaugcucgcaggggcucuuugauggaggauuauguauccaaacaguuccucccugguaucuggugcacuggaaggcucuggggguucaaggugccugauggggaagaugcugaggccucucaguagucucugaauacuggaaguauaaaaagcgagaaauuccauaaaaguagagaaagugucaaaggacagagucuaggaauugaagagucucucaaggcagaugguaagaggggucucugaguagaaauacugggcagagucucugauggaagaugcuagggccagggugggguuaggagaccugacguguggcgaagaggggcccccgacacaaaggccaggcccaaauggccuuucacagggucuaguaccccuggaagcucugagcgcggcuagcaugugugugggaugggggucugaaggaaaaugcuaaagaggacucucuuacagagauaaagggccuauggaccccuucgagaucuagcccguccuggaagccuugaggacaaauacugagaagcuaggaagugucucaaaggagauucuggggcaggucuuuaacggcauucaauggugaggagcucugaucagcaaugcugauccacguaaaucucuauuggagacuggggaagaguucugaucugagauacaagguucgggacggagucaggucccagacuagagauguugggcgugagucucuaaaagcacauccuggggguccgacuccaaggucagauuuugcaaccagagggagccggagugguccuggccggggaaagucggccccgccccaggauccgcucccccucccuacuccgcugauuccuggcucccgagucaccgcggcccgccccgacagcagcguggcucagggcccuccagugccuccccgaaaccccugcccagggcgaggcgcagugaaaggacguuuuuuuaccaaugccgguuccccgggucgcgccgccgccaacuccucaaggagccgaagccaagcccggccgccacccuccuccuucuccuccuccccgccgccugggccgccuagaaucgccgcugccgccuucuccucccccggccguugugguugugguugucccugccaccuccuuacagccgagccgccgacacaagauggcggacgcugagccuggggccggaacaaaaccuugggccccacccccagaaacccggaugcaagcgggccgcgccuacuuaugaaucaugcauaaaguucccuacucgguugcgauucauucgguuagaaguggaacagcaccaccugguggacauuguggcaguaacaacgaaaacagguaaaacagaggccacgccucauggaaugcgacuaaugaaugaauuguugcagccaggcugucaaggaagcgaagaaaaaccguuaaggccaugcuuccugauuauaaguuaugcaugaaguugagugguugguagacuaacaaccagcaaccagaaagcagauguuaaaacauggaagccacacacccccauucaugaauaaugaugaucuugcaggggcccggaagccaaggagacccaggccacaacuuacucaugaauaaugcaugaggcccaguggguuggaauaaaaggggcacgcccgccuauugcugcaucuaauacacuguaagcagggaaauggggcugcugcagggaaaacacacucucccagguccugaauaaugaauuaugcugcugcaguagcucaaccuggaaacucagagaggucaagaaagguuccacccaauuuaugaauuaugcauaaggcgaagaaacacccaagacugcccugcccagcaaauagggauuacgaugcuauagccaaggcaaagugagcacgccuuccuguucaugaauaaugaaagaugucacugcagugccaccagaaaacccaggggacguguacucccugcccccaccuccccucuccacgccucccuccauucuccccgccucaggaacaagggcugccuugguccaaucaaacccaaacucacuacaugucuuuggcaggugccucaguuuccacaacuguaaaaugaggauaguaauguguuauuaugaaaaucagaugacgccuguaaucccagcacuuuaggaggccgaggcggguggaucaccugaggucaggaauuggagaccagccuggccaagauggugaaacccugucucuacuaaaaauacaaaaauuagcugggcauguuggcgggcgccuguaaucccagcuacuggggaggcugaggcaggagaaucgcuugaacucgggaagcagagguugcagucagccgagaucgcgccauugcacuccagcuugggcgacaagagagaaacuccgucucaaacaaaagaaaaucagagaauauaaauuaugggaugagccuuagaacauugcuggcacaaggcacuguuaaauuuuuaaaauauuauauauuaauauaaaaguaauauguuaagauauguaaauauauauuuacauuaauauaaaauuaguuaugaauacucagccacuagagaaacccccaacuugggccacugcuuccccauccauaaaauaggaauaacagcaacuuaccuugcgauggaguuuaaaugaagaaauaaguagaaagggcuuagaccagugccuggcacaugcuaaguguuauauuaguaguaguaguacuaucaaauggcggcgcaggggaauggggaggggagacauuauggcaucugguuaagacuacagauugcggaacuagaccccaauuugaaucccggcccagccacucacugauugugugaccuuaggcaaauuacuuagccuuccugugucccaguuuccuuaucuauaaaguggggguaauaaugaccuaccuccuaggauugucgugaagauuaaaugcgcuaaguagcuaaacgaguguaagcuaaucuuaucguuauccucauacccauuauucaggcuuacaaaacgauuugccaaagaucacacaacuggaaaggaucgaugggauuugaauccagagccggcugauuaucugggauuaccaggccauaagaaaugaacaauguaggaggccucaucccuuugcuagacgccagguuuuaacucugguaccugcaagggaaagcuaaccgcggaucacgcagacaaagcugcaaaagccacgcuccucaugaauuaagcacggaaccccuagaaaagccacugaaaacucagggugcuacuuaacuuuugcgaaucaucaaugaacucguuugcgcggcagacuucagaacgccccuucagcacgucccuucggcacgcugauccgccccucgugaauaauucacaagccgagaaccuucagcggaccaggugcgaaagaggcaaaaaaacugccgccuaccacagccccaccuuauuaugaauaaugaauaaaggccggguggcgccucgucagcucaggaagagcugggcuccggugucccuucccuagccugagcugggaggcuccucucccuagaaacaucugggcccccgacguguccagucucgcaguccugagccuccaggcgcggggaggaccucaucacaaaaccagaggucacaaaggccugacaccuccacaaugccacgucggucccgauuguucugucaccaggaccccguccugaaacaagcccucccccagucccgccuugacuuuaguaaccucaagcuuugcuucuccccuugaagaauaacccaaauccugcuccacggacaagggugcccauacacggacccuaagaaucuccccaaagccccccaaacccugccuccgaggggugcuccccgaaacagacucccaaaucccaccccgaaguccccaaacggcaccccuuaagggucucaaaagcagacgcccccuaaauaucaccccgggcccggaggcuccaaauacgcccaugagggguuuccccgaaguugggauuagggaagcacccuccuccaaaugcuguccagaggcuugggggcacggugcuccagcucacccccugugccgggcggaagccucgccuuccugccaaagaugagcugaagccacggggcaacggaagagcaaaccaccucugucguacaagagaagccagaguuugcgcggagcucggaagcgcggggccuuggagagccccgggucugggauguaccacagaugcuuugcuagaggggcgucagucccugcucccgcgucgcuggugcccguuucagacccagauga

SEQ ID NO: 18938 - RNA, 11770 nt, Homo sapiens
cuuuucacuuuagacuuuuuaauauuucauacagcgauuauggugcauucaggaacccaaccccccaaacccacuaggagggcucccaccccugcccucccaccccauuucagggccccagggcuuaggguggaggaaggggagguaaccacccauccagggacugacccuggagacugucccugcccugccucacccuccccaggagauagggggcaacaccugggcacaaccccucacaccccccucccccaacccugcuugugcacauaugcacauuauggcuccucgcugagcuggucaguuccuggcagggccccuacccaacagcaccgagugggaugggagcaaggggacugggcuggggagacccugagaaggaaggaggccccagcuacgggacugcaggagagaaagaguggggccccccaccuuguccauuucccagagucucugguaguccccagaucccccugcaacuggggauggcgggcggggguaggaaggcgaguggcuguggcaugcuuucccauagccaaucccagggucuggugaugaucaggguuccaaauaggggcugugucccugucucugaaaggcugggagcagggcuucauugcacaaaauacugugggagggccacacgcaggggguggggcccagccagucuguauacagagauauugcauuuaaaaaaaacaaaaaucucauuuaaaauaauuaaaaaaaaaaaaacaaugaaugaaacaaacaaaaaaaggcccacacaauaugaggcagguggggcaggcaggaaagcaggcagaggaugccucagacucaaggcauugucaccaucuugucugagucgagauccccagccugggcuagcucuggaccccuggcuggccgugggguagugguccugggggcugguaugaugggggguagaccuggccucagugugggaggcuggcacggccaugcuguccaccggcaacuaccaagacagagacagacagaccaagugaaggagugaugagagcuuuguuagcacccagcagacaggccaauggguggguugacaggccaauggugggguguuugggcaggcagcaggggacaagugggcaggugaacauggcucaggcagguaggcagagaguaagcagggaagauguaguugggggcugcccugugagggguguggcaucccuccagccgcugccugcuggggccucggucuguggcuuagaacucgguguccaccacgcggaaagcuggccugccugugggggaaagcagagcagauggcuguugguggguaagcagguagguggguggggcagggaggaagacaaggggcuauaccuaccugagucaggcaucgacgaagaccgaaggcuggccuccuuuuguagcugaaucuccuuuagugcaaauauggaaguagcuacagaugggggagacauagaagugggggaugacccaugaggucaucuaggaccagccccauaugaccccaugggaagaauuagaaaaagcugccccuucucugagaggcuugaccuuuaucugucaaacaauuccauacacaaaccagcuacaaccagggaagaugaaauauagacuauuacaugacacaaagaaaucauuauuaacuuugucaagugaauuaugguauugcaauuaccaccuguuaagucuaggugaugggugguguuugggguuugcuuuauauauuaauccagugggaagauagggaaagugagcaaauguuuuuuguagguuugauaauaauauuguuguuuuaaaaaaaucuuuuauagguauaugcugaaauuauuuaaggauaaaugcuaugaugucugggauuggaugugauucaaaauaaucagagagaauauagauaaaaccagauugaccaugaauugaugacucacuggaguacuuagggacucaucauauuacuuugacuaauauauaaauacauauauuugaaaauauccauauuaaaaaguuuuuaaaagccagauauaaaaagaacaucacaugugauucuauuucuauaaaguacaaggacagaaaaaacuuauccuugcuguuagaggucaaaacaguggccacccuuugggaaggggcugggaauaacugaaggagaugcaagggagcuggggguggggagcuuuuaacauucuguuucuugacuuuugugcuaguuacaaggauguguuucauuuaugaaaauucauuguauaguauacuuaugauuugugcauuuuuuagcacauguaaggaaaugucuacuuuaaaaaaaguaaagugcuauugcauauauuuuuauguauguuuuaaauuuuucaugaaagguaaaaggaacugaaaacuaaaaaauguuuucauaacaaauacaacccaucacacacgugaacaagauguccccccacguagagguggcacagccagaauccuacacaacccgccagcuggccccagcaguccuguuucccaguccccacgcuggccgguccauuccccagcuccacucacugucaggaaguuuguggauccgcucccccagacugaggaagaauggauguuucauggcauccucugcggagauccgauuucgacccucaaacugagugggggugcggggagggggauaguauugauaucuucaacaaguaggucucucugcccaccucagacccugccccugguuugagggggggggucccuguuuccccacacuuggaaucccauacccccaaggcugacccaagguggucucaccugcaacagcuuggugaggaggucggccccgucgcuaucaagucugccacaaggacaaagagaccugauuuaaaaugaguuuggacacucuggccccuaacgcccacccacccaccagccucaccggggugcguggcucaaaagggccucggcucgguacuugggguaguuguaugucuugaacuccucguuggacaggaugccuggccacgucuccucaguugggguuccuaguagggaagaggaguuaucccaaacauuucacagguccuccccgugugucuccacagcgccuagggcccaugccuccucaccuaagauacggaagaugaaguguagcuguuccuccaccguggagcccggaaagaggggacggccuguggccaucucauagaagaugcagcccacaccccugggcagggagggcacagugaauagaaaggcagcuggcuggguggcuguugugaccaagccacccccuuuaccacauggccccugccacacuuccaccuguccuuaccacaugucaaucugaguggaguaguccguggacccaagcaggaugucagggggccgguaccacagugucaccaccucauuggaguaugucuuuguugggauugacuuggcucgggccaggccuggaaaucagagaaaggacagcuagaaugagggagucaugggcaaagucucggggagagugcaguugagacugaggguguccuaggcaaaaucuggcaaggcugaagggaagugagacuaaguggucaugggaaaguaggaggcuggggagccaauaagaaaggggaggccagugguaccaaagucagccagcuugagcucuccccucucguugaugagcagguucuggggcuugaggucucgguguagcaccuucugccgguggcaguaggccaggccacggagcagcuggaacaggaacagcuggggacccaggaauggcaggcagaggucaaagacuauccacuagcccgacccccagcaggcacugcuccccucccaaacacagacacuaggcccagagccuugucacacaaaagaggacagggucccagugcccuccaagggcuccuagcaaaaaaagccaaagggaaaaguccguuucugggagauuuguggguuggagugggugagugggggcccccuugugccccugcuuccugccccacacccacuuucacguugugcauguugaugauguucccacagucauccagguacugcuucagguccuuguccugaggaaagaagaggugguacaggaaugaggguuacuuccuauggcuccuggccuucuccucaccucccccugggaccuacugccacucaaccuuaccagguacucaaagacaagggugagggacuucuccguguggauaaugucauguagcguaacgauguuggcguguuugagguccuugagcagggacacugcaggaagcaugggagugggacaggggaagagucaggguccuacccucaggacagaggugaggacaaggacuagaaagggacaagcccagguuuucuuucuuucucuagacaguucaggguaaugccucggagccaccagcucuaacccgccucaugccagaagaaaguugugucuccauguugcagauguggaaaauaagacucagaggagaguauggagcaagaaccugggauugcagccccaggcucaugugacacuagauuuucacaaccuguuuuugguuucugggaaggggccuggcuccaacccucaguacauaggccugcagcaucgcgugaaaucgaauuugcacacuaaauuucagugcaauucaaauucauuccaugugauauucugacuagaaauuguuacaguaaauaaacuggugagcacuuucagggguguucucagaaccaaacccugguuugcaauucaucuaccuuuuauccaaaugggaacagauuccugguuacccugauuauuaccuggauaugugggugacaggcauucccaugaaagccagaguguuuuggggggucuuagaaccagucuuuguucucauuauggagugugugcgccagggguggguuggggaagccuggggcagaugggauggggguguguaccuucccggauggcggugcagggugcccccucuucauguuccagucugaucuccuugagugccacaagguugucugugagcuugcuuuugccuuuguagacgguggcauagguacccuggaaugugaggaagugugacaggagaggugcuaugagauuccaggaguucccacugaccuucauccccaccaugggccuccuauuugccucucaccucgcccaguuuguccagcuuaauguaggucuccaguuucccaaagccaaucucagacugugggacaaaugaggcagguuaaagcuggcucaggagaagggucugggagagaagaaaaaggagaggacgggaacagaaggugcuuacuaggcugacacgacggaggcggcggcugaggggcuugucaaagauggggcuauugagggucagcuucuccagguagcccucaggcagccggaugucagcugguagugauaggcgcuuguugauguccuagcagguaaggcaagagagaaacaggaucaugagcuccaccuccccagguccaacccccuuuuccaguuccuccaccauccagacggggucaagcaccucaguggagaucuugcgugggggaugguugcgcauacgcacucucacuggagacugcaccucauccgaggacguggcugaagccuggucacucuccccaucagaccccaucuucaaguccucgugcacaaucucugguggcagggagagggguagggcaggccagguggggucaggaaccacaggacaccccaucccccacgaaacauauuccaucaucacacaugugugcacguggcccccacaggaaaccuggagucccucggggagagggugauguaccugagcccagggaagcucagguacaucuagggcagguugaacugggggguggggaagcaaaagucaccuaguggaacccuuccuuccaagggcaagcugagcucagagccggcagcuaggugguggcaggggaagccaaggguccugggaaggcaggcccagggcaggcagguaccagaggacugaggaggccaucauagagggcagaagggcagagggagccuuggggcagcugugacaggcaaggcaccuucugucccccaccacggggccugggcagaaaggcaagaagaggagcgcagauggacagauagacagacgguguugagagaagaugggagggaagggggagaagagagcacauggggggcagagaaagggcagaaaauuuagaggaaaaugaggaaugugaccaggaggcaacaccugggaagcagccuggggccauaugggagaggggauagccaguggacccaccuggugcagagcugagugggccccgugcagaacgaaguuccccaggagcagcacgugugggggccucuccagggucacugccgccaccaccaccacucucauccaggccuaucugcucaggggcaccauuggucuugucuaugccucggccaccucggagugucauugacagcugccguuugaucuucuucauccgauccauggcgaucugagcaagggacaaggauggaaaugggucucuuauuagcauuugcuugaucaccauggguucccuaaagcccacagccuagcagggggcacugacaugaacuugucagugcucacucaaccacuauggaccccagagccacucaggaguucuggaaacccagcauggauggggaucuuugucaguaccugcccacccacacagccagccccacugggacccugcuccuacguagcccaccugaguucucagauuuagguggcugauugagggcaagggcccuaacgauggauuguugggaucuaggggaaaagccccacugcaggagcagaaggcuccauugcagaucuucucagguacagcugcagugaugggcccagccaugggucggccagggcgugugcccagaauugaaggaugggugacauggucucgagcacggccauagaguggcauaguuccccuagcaccacccucaaaggccaaggcagacuauucccuguggccacagggacccucuuccugacuucucuagcacucaucgucaugacaaccacugcaucaucccauucaucuacccagguggggggggggaggggagcgugugucaggguguccugcccagacccaaccacugggugggauuguguggagggcgggggggucucaguguacaccagcucuucucagggcugccagaacgguuugaucagguuaggaccccuaggguccaaucuagacuuuuacaagccaagucacauuucuccucuacucaagaauguacauuuuucaucaccccaaauacacgccccaguccucaauguggcccacagguguuucuuuaccucauuugccccuauugccucuugcccacggcccccccccacccccacacccccccgccaucauuccuaguugcuguucugcaaccacacccaguagagucccaccucggggccuuuacacuggcuguuccugguaccuggaacacccuuccccuaaauuucgaaauggcucacuccccucucccuuugggccauugcucaaaggucaccuuuuucaugaggccucugugaauaacccuauuuaaaaucucaaccaucccgaacucccucaccuugccaguuauccccccagcacucauuaccuccucagaaaugacaccaccuacuuauugguuucuuuagucuuuacugucuaucuccucaccgccacaacuagaagaucagcuccgccaggguagauuucuguguuuaggucacggcuauauccugaggaccuggaauagugacugacacagaguagaugcucaaaaagugcuuauggcagaaauaagugaaucagggggcugagggccuaggaccaaccucugcugaggugaugagucccugcuauucauugaacaacccuaaacaagguagcccagggaugcuggcaucgacaggaagaugaccuagauggauugcugaagggaauggggccaccaaaaggcuuaggccagccgucuucugcuuccucuugggcucugggccagcaaggagggggaaagaccugacccaggaaccaucuggacucacagcagggccuaagauggcccugggcccaagggaaguagagcuagauaggaggucgaggaugagacuggggcuggauuugaggagagaaaugggucaucugcuaccuugaaaucaggugcuucccccagcaguucucgcccccaccuggcugaacucacuauccccaggagggguaggggccacccuagcagaaagaccucagauacaggaugagguccauccauggagaacccaggauaaccacaaaacauccugaccugggaggcugaauacugggccuaaggcaaggaagguaaagcauggccagcucccaaagacaaccuuguguccccauauggcacagauacccaguugcuuugcauguugugacagggaguaguggaggggcugggggagacuggaaguagggcugaauggaggauggggaggaagccaggaggagccauggguccacgaccucuaacuggaaaccccaagggcuggacaugcucuggaguucaguuuuuugggauuuuaggaagaugggguguaaaaucuguauaucacauaacacucccagaaagggggaugggggucucagacaugccccugugaacagagauaauugaacauuuauacgcaaggaaacuuuuaaauaucauuucaguugaaugagcuuuuuagauuucaaaaaaggagggagcaagaaacuggacauaaaaccuuaccccaaaaaaggcacauguccugccugacccuuccugauccccaaagacauacacccauccucagacuacucucauacucaaggauacucaacacaccaaccacuaaggacuuggucaucgcacccuauguccugauccccauuaauacacgcuagacccucaaggaggccucacuacaucuuaccugcuauuaucucauauacccaucagcauucaaagcccuaacacauaacauaccgcccugaacucugucagcacacacuuagccuccucuaaguaacucuugccaccacauucuugggccccucccuggccuagcugcuuguuaccuucuccauaguacugacuccccucauuaacguacuguucccccuacaugauucugaccucuauuaacaugcacuugggguacucuauagcugacccacauuagcacucacuggaccuucuucaugcugcucugaaugcuauuaacauaaagugaaccuuacagauagaucucuaaccaguguuacccacacucaggccccuucacagcuacgaccauccuuaacacacauuccaguccuuccacuguccuguccccucugucagcacaaacugagucuucacucaggccugauuucuauuagcacacgccgggccucacacaguccugccuccccauuagugcacccugaacccuuacucagcccuauuccgcagggacacacaaacacacuguucuaccauggccugacccucauuagugcacacaggucucauucagcccugacucccauuagcacacacuucagcccucccuagcuguaauccacuuuagcacaccgagaucaucacacauuccuguccucuauugcucucugcucagagauaucuccacagauauaauccuuguugguucacacuuagaucccuucaugaaagcccugaucccccuuauuacacacuagauccccuccgcagcccuacccccgaguagcacccccuggaaccucaacauacucugguccuccgcggacacaagggcacaaucuucacaagguucugaugcuuauuagcauauuccagacuucacacagcugacucucgaaauggcacacauugaagugccucuaugucucuaaacccacauuagcaaccaccaguacuucuauuacccugcuccuuccuagugugcccucgagacucacauucccuguguccauggacacacucacaccucacaucaccuuuacccuucguccacuaagccucugacagugcuaagacacuuccccaccacuccuuccugggcccagacagacacgcaauucucaucuccuuuaggccaggcucagguauuccacaguccuuccuccguuagauacccucagguccuuccuccacucugcccucauuagcauauacugggucccaaacuaccuagaccuucgaggccacaggcauacacccucuacagccaugacccccacuggcgcacacaccacacucgaguccuucagcuaccugcccuccacaagcacacacugcauucucacacacugcaggccccacggacagacacgcaguauuaacaccauccagggccucaucgccacgcaccaggccucagagcccugaccccaccaacacacguucugguaccugugccacccugucccccaugaacacacaccgggccucucugcggacauaaucccuaugagcaugucuuagaacuuccucgacacccuaccccccguuauacacccucgggucccucacccgcuccgcaccccgcccuccuuccacaagcacacacggggccuugaaccuuacacgacuuauuggcgugaggcuuacugccacaugcuccgacccccaucagcaacccccccaagucuuucaccccauugucacccauuuccacacccuuugguccuuugacucccccagguccccauuagcacccacagcacuacccaaccccagcucccaggacaggcccagggcggggccaaggucagggaggccccaaaugaccccccgccccggugcauucugggaaauucgccgggggugggggcaccugccagccccgcagcccagaccccugggcaccgcccgagguggguucugaaggaggaggggcagccuccacgccucggggacgcgcucaccggcgggggcgcgcgagcaaccucagagccgcggggccggcgcggcggcgccuggggcggcggcccgggaugaggccgcgcgaccuccuucuccuccuguucgccgcaggcgcccgucccaguagucuucagccaugguugcugggcccgggccgccgccggcugaggaggaggaggcggcggcggcggcgguggcugaggcggaggcggcgucccgcucagccggccaugagcuuggccgcugcgggcgaugcccccggacucguuggcgccggcuugaauccgagugcucacggcggcucgcggcacagagcggucugaucgcggaguggcggcggaucccagggccgaacagccaacggcccaaccgccgcgcgcgccgcgcuccgcgcaugcgcacgcaggcgcucggaagggugaaguggaaaggaggggacucaccucggacugcauguaccaaaggacccguccgcagcgggaggggacgcggccaucgcgagcccagaggaggaugcggcgccaagccggagacggcaccagggagaacuguggaggcuguuuaguacucaguuccgaucuuggcagaaguuugcuagcgccuaggugagcaguggccaguaaccuggcgcgucaaucaccacucguucccccuacucggucucacuugguacauccccaugguggcaaacgggacuuuugcaaggaggaaaaaagacaaaugaagcacucaguucuagucccuugaggugcuuggggaggaaggcauuuuaaagguucgcgagaagaugacuuuucgaggagaggcagccugaagaguuauuggccuuuaccaccuuagcuaggacggccuauccccgcccaacugcccccuccaccg

SEQ ID NO: 18939 - RNA, 4488 nt, Homo sapiens
uuggcuucugcacugaugguggguggaugaguaaugcauccaggaagccuggaggccugugguuuccgcacccgcugccacccccgccccuagcguggacauuuauccucuagcgcucaggcccugccgccaucgccgcagauccagcgcccagagagacaccagagguaagcagggcccgggguggcccagcagggaccggagcugggcugcagcuugggugcuggccaccaggcccgugcacucccgugccagaugccugucuacucagcuuggccugcggguaccaggacccugggcuagucuagggggaagagggucggaggcuggaacugcuuucccaaccccgaggcuccaaacucccuagaaccccugacauccgcccccaauucccccaaacccaugacccccuaauaucacaaaugcuuuccaaauccccccgcaaauuccuucaucccgaaauuucccucaucgcccccuaaauacccaccgcuaaccccugcagcucccuaaacucccccagcuccccaauccccaguuccccagcucccaaacuucuuuugcccucaaauuccucaaguauccccauugccuuaagcccccaaauucccccaaccccuucaaccuccaaacucccccagcucccuaaacccccaaccuccuccaaauuccucaaccucccuaaauucccccagccucuuauaucucuuaauauacacaaccccuaaacucugccgucuccaaacuccuccagcccccaaucccaaauuccucacccccaaacuccucaaccuccagaauuccccaauccccucauuccucaaacuuccucagcccccuucucccccaagugccacaaccccauaaccccgcaacucacucagucccucaauaauuuaaacucucccaacucucuaaacccuaaauuccucugcgcuccccaauccccuuaaaaucccuaagcuuaccaaccccucaagcccaaauccagcccccuaaucccccccauaggcugccccggggcaagaugggguggaugaccugcccaggucagcagaucagcugggccggggccugccugacaucccccuuccccacagaacccaccauggcccccuuugagccccuggcuucuggcauccuguuguugcuguggcugauagcccccagcagggccugcaccugugucccaccccacccacagacggccuucugcaauuccgaccucggugaguccucaccccacucagcccacacacucugccuugguuucccuuucaguccaguggggcucaccauggcacuuaccucuagaaugauuccacucgccccugcacuuccucugcuuuagccacacuggcauccucacacuuccuugaguacucugugcccaagcccaccacaggaucugcaugcuggcugcucccucugccugguacacuuuccccccagguauccacauggguggcugccucaaacgucaccuucucaggauggccuucccuggccauccuguuuaaaauuuuaaccccugccccuuaguacuccugaucuccuguuaaacagaaaaauauucagugauacuuguuauaacacaguaaggaagaccauauucaggaccauggugauggguauaggaaccacugcaaugggaucuugcagucggugggagagauugggcucaacacugaauauagcaugggccagugggaauguguagcuaaggagcagugugagggucuguggguggaaauuacuaagaagaaacaucagggguaagggggauucuggcuaaaccgacguaacaggauucuugcugaaggcaggccaaggggaaucagacaucaccugggggaugguggaagaugaagaacccagucagauagcaaggaugaucagguauugaggaugaucagagauugaggaugaucagagauugaggaugaucagguauugaggaugaucagagauugaggaugaucagguauugaggaugaucagagauugaggaugaucagguauugaggaugaucagagauugaggaugaucagauauagaauauagggguucuugcuaaacugacuuagcaaggcucucggcuaaaacuggauuuuacaaggaagugcacagaugggccuaggaggagguucaggagccugaguaaaguuuggucaagcaaagaaucuuugucagccccuuacccaggucuguaauuccccauuauacuuaaugucuaacauuccauauccuuauuuuguuuguucuuagccugucuccuccuggcuagaaugugaacuccacaaggaaagggauuucuguguuuuguucacuguugugucccuaacacccagaacaaugucuggcacacagugggcacucccaaauauuugaggaguaaaugaacaaaucaauguaugaaaauggcuuaagcagugcccggcaaagagagacacucaacauacagaugaaucaaugaacaaauguguaaaucacuuugugugcugucuggcauccaauaaccccuauuuauguaugcgcuuugcugguaugaugaugaugaugaugaugaucuuauuuuuauuggcucaugcaguccauuugacucauauuucccuccucuccugcagucaucagggccaaguucguggggacaccagaagucaaccagaccaccuuauaccagcguuaugagaucaagaugaccaagguauccccugcccccgccucuuucccagcauuuucuaacaucuuccuccuggucaaaacagaaacuucuggccacugguuggugcgagaaaguuggcugugaucuugggaugcuauaugacuucagggaagaaccuggagugggaggauuaugucaguaaaagagacacuuccccucauccaucaacagauguauaaaggguuccaagccuuaggggaugccgcugacauccgguucgucuacacccccgccauggagagugucugcggauacuuccacaggucccacaaccgcagcgaggaguuucucauugcuggugaggcaccguccccgcgcccugugccacaccaaccagucccuggggcgcggccuagcaaccacgagggggcgaggcucugaugggaauggucccacuggaaauggggaccaccccaauuucagucuaucagaaggccgggccuuuggcagcuuggcagcucagccaaucacaagcugcuugucgguccccgccccgccuuucuccuuaggaaaacugcaggauggacucuugcacaucacuaccugcaguuuuguggcucccuggaacagccugagcuuagcucagcgccggggcuucaccaagaccuacacuguuggcugugaggaaugcacagugagugccuggacccugaccuccaacgggagauccuucccggggccauucccuaaaucgugggcuuguuucuugcucccucuggcuauucugugucccuguggcugcuccccaacccuaagggcugucccugaucucucuugcuauuuccccaagcccgagacugcucccuuacaaauucuggcugcucccuuucccuguguccaauaccgugugaucaccugucccucccuggucccucuaauucucccuugugacuauucuguaaucccacuccccguuccugagcccccgggauuguuucuugguuccccagaauguucuccaagaacccaaagugcuguucccuaaucccacugacccuuccucagcacaucugcuuguugcucugcagcucugacuauuccagacaccagaggguguuacacugaccuccuggcuaguccaagccuguucccugauggcuccugauggccucugagcccagugacuaucuugaagccccacuggcuauuccugugcuuaaacuccuuagccgccaaccggguggggccccuuacuacugccaguuuuucccuguccuuugggacaauuccacaggcgaccugccugacugacccccagggccuauuccccagccaccauuccaggacacugauuuacuggcuuacuguuaccuuucaggacccagugacauuucccucaaugggaggggcuguccugggguauguacuuagguggggugagagcaagucuccccagcggcucaguguugaaagcugaggagaggaaguucugcuccacgggggaggcagggagaagcccucagagauguuucccuccucccuuccagguguuucccuguuuauccauccccugcaaacugcagaguggcacucauugcuuguggacggaccagcuccuccaaggcucugaaaagggcuuccagucccgucaccuugccugccugccucgggagccagggcugugcaccuggcagucccugcggucccagauagccugaauccugcccggaguggaagcugaagccugcacaguguccacccuguucccacucccaucuuucuuccggacaaugaaauaaagaguuaccacccagcagacacu

SEQ ID NO: 18940 - RNA, 4488 nt, Homo sapiens
agugucugcugggugguaacucuuuauuucauuguccggaagaaagaugggagugggaacaggguggacacugugcaggcuucagcuuccacuccgggcaggauucaggcuaucugggaccgcagggacugccaggugcacagcccuggcucccgaggcaggcaggcaaggugacgggacuggaagcccuuuucagagccuuggaggagcugguccguccacaagcaaugagugccacucugcaguuugcaggggauggauaaacagggaaacaccuggaagggaggagggaaacaucucugagggcuucucccugccucccccguggagcagaacuuccucuccucagcuuucaacacugagccgcuggggagacuugcucucaccccaccuaaguacauaccccaggacagccccucccauugagggaaaugucacuggguccugaaagguaacaguaagccaguaaaucaguguccuggaaugguggcuggggaauaggcccugggggucagucaggcaggucgccuguggaauugucccaaaggacagggaaaaacuggcaguaguaaggggccccacccgguuggcggcuaaggaguuuaagcacaggaauagccaguggggcuucaagauagucacugggcucagaggccaucaggagccaucagggaacaggcuuggacuagccaggaggucaguguaacacccucuggugucuggaauagucagagcugcagagcaacaagcagaugugcugaggaagggucagugggauuagggaacagcacuuuggguucuuggagaacauucuggggaaccaagaaacaaucccgggggcucaggaacggggagugggauuacagaauagucacaagggagaauuagagggaccagggagggacaggugaucacacgguauuggacacagggaaagggagcagccagaauuuguaagggagcagucucgggcuuggggaaauagcaagagagaucagggacagcccuuaggguuggggagcagccacagggacacagaauagccagagggagcaagaaacaagcccacgauuuagggaauggccccgggaaggaucucccguuggaggucaggguccaggcacucacugugcauuccucacagccaacaguguaggucuuggugaagccccggcgcugagcuaagcucaggcuguuccagggagccacaaaacugcagguagugaugugcaagaguccauccugcaguuuuccuaaggagaaaggcggggcggggaccgacaagcagcuugugauuggcugagcugccaagcugccaaaggcccggccuucugauagacugaaauuggggugguccccauuuccagugggaccauucccaucagagccucgcccccucgugguugcuaggccgcgccccagggacugguugguguggcacagggcgcggggacggugccucaccagcaaugagaaacuccucgcugcgguugugggaccuguggaaguauccgcagacacucuccauggcggggguguagacgaaccggaugucagcggcauccccuaaggcuuggaacccuuuauacaucuguugauggaugaggggaagugucucuuuuacugacauaauccucccacuccagguucuucccugaagucauauagcaucccaagaucacagccaacuuucucgcaccaaccaguggccagaaguuucuguuuugaccaggaggaagauguuagaaaaugcugggaaagaggcgggggcaggggauaccuuggucaucuugaucucauaacgcugguauaagguggucugguugacuucugguguccccacgaacuuggcccugaugacugcaggagaggagggaaauaugagucaaauggacugcaugagccaauaaaaauaagaucaucaucaucaucaucaucauaccagcaaagcgcauacauaaauagggguuauuggaugccagacagcacacaaagugauuuacacauuuguucauugauucaucuguauguugagugucucucuuugccgggcacugcuuaagccauuuucauacauugauuuguucauuuacuccucaaauauuugggagugcccacugugugccagacauuguucuggguguuagggacacaacagugaacaaaacacagaaaucccuuuccuuguggaguucacauucuagccaggaggagacaggcuaagaacaaacaaaauaaggauauggaauguuagacauuaaguauaauggggaauuacagaccuggguaaggggcugacaaagauucuuugcuugaccaaacuuuacucaggcuccugaaccuccuccuaggcccaucugugcacuuccuuguaaaauccaguuuuagccgagagccuugcuaagucaguuuagcaagaaccccuauauucuauaucugaucauccucaaucucugaucauccucaauaccugaucauccucaaucucugaucauccucaauaccugaucauccucaaucucugaucauccucaauaccugaucauccucaaucucugaucauccucaaucucugaucauccucaauaccugaucauccuugcuaucugacuggguucuucaucuuccaccaucccccaggugaugucugauuccccuuggccugccuucagcaagaauccuguuacgucgguuuagccagaaucccccuuaccccugauguuucuucuuaguaauuuccacccacagacccucacacugcuccuuagcuacacauucccacuggcccaugcuauauucaguguugagcccaaucucucccaccgacugcaagaucccauugcagugguuccuauacccaucaccaugguccugaauauggucuuccuuacuguguuauaacaaguaucacugaauauuuuucuguuuaacaggagaucaggaguacuaaggggcagggguuaaaauuuuaaacaggauggccagggaaggccauccugagaaggugacguuugaggcagccacccauguggauaccuggggggaaaguguaccaggcagagggagcagccagcaugcagauccuguggugggcuugggcacagaguacucaaggaagugugaggaugccaguguggcuaaagcagaggaagugcaggggcgaguggaaucauucuagagguaagugccauggugagccccacuggacugaaagggaaaccaaggcagagugugugggcugaguggggugaggacucaccgaggucggaauugcagaaggccgucuguggguggggugggacacaggugcaggcccugcugggggcuaucagccacagcaacaacaggaugccagaagccaggggcucaaagggggccaugguggguucuguggggaagggggaugucaggcaggccccggcccagcugaucugcugaccugggcaggucauccaccccaucuugccccggggcagccuaugggggggauuagggggcuggauuugggcuugagggguugguaagcuuagggauuuuaaggggauuggggagcgcagaggaauuuaggguuuagagaguugggagaguuuaaauuauugagggacugagugaguugcgggguuaugggguuguggcacuugggggagaagggggcugaggaaguuugaggaaugaggggauuggggaauucuggagguugaggaguuugggggugaggaauuugggauugggggcuggaggaguuuggagacggcagaguuuagggguuguguauauuaagagauauaagaggcugggggaauuuagggagguugaggaauuuggaggagguuggggguuuagggagcugggggaguuuggagguugaagggguugggggaauuugggggcuuaaggcaauggggauacuugaggaauuugagggcaaaagaaguuugggagcuggggaacuggggauuggggagcugggggaguuuagggagcugcagggguuagcgguggguauuuagggggcgaugagggaaauuucgggaugaaggaauuugcggggggauuuggaaagcauuugugauauuagggggucauggguuugggggaauugggggcggaugucagggguucuagggaguuuggagccucgggguugggaaagcaguuccagccuccgacccucuucccccuagacuagcccaggguccugguacccgcaggccaagcugaguagacaggcaucuggcacgggagugcacgggccugguggccagcacccaagcugcagcccagcuccggucccugcugggccaccccgggcccugcuuaccucuggugucucucugggcgcuggaucugcggcgauggcggcagggccugagcgcuagaggauaaauguccacgcuaggggcggggguggcagcgggugcggaaaccacaggccuccaggcuuccuggaugcauuacucauccacccaccaucagugcagaagccaa

SEQ ID NO: 18941 - RNA, 23191 nt, Homo sapiens
cagucggugugcggcucgucgaugaccagcagcacccuggaggcggcucccccgcggccugcgcccccagagccgccgcccaccugcucgcugaagguggcagcugccgccgccguggucugcuugaccgcguuggacagcgacgagaagaagccaccgccccccgaggacccggggcuaggggcggccggagaggccgcuggggcgaccccggaggaccucucggcaguggcggucccgggaccgggcguggcuccggggcugugggcaccgggcggcggugggggcggcugcggacgcugcaggucugucauguacccauuuggcagauuggccauaaaguugcuguccgacaggcggcgccgcagguaguucauggcugcgacuuggggcaggggguccuagggguggucuggccaggagccgcgggggcggacugcgcggugcccaggagcacagcugcgcucucaggcacgacacgacuccuccgcugcccaccgcagacugaggcagcgcugagucgccggcgccgcagcgcagauggucgcgcccgugccccccuaucucgcgccucgcguggugcgguccggcugggccggcggcggcgcggacgcgaccaagguggccgggaaggggaguuugcgggggaccggcgagugacgucagcgcgccuucagugcugaggcggcgguggcgcgcgccgccaggcgggggcgaaggcacuguccgcggugcugaagcuggcagugcgcacgcgccucgccgcauccuguuuccccucccccucucugauaggggaugcgcaauuuggggaauggggguugggugcuuguccagugggucggggucggucgucagguaggcacccccaccccgccucauccugguccuaaaacccacuugcacucauacgcagggcccucugcagauacucgguuuguaguguugauauucaacucagaaggcauuuuuuggggggaggggggcacuggaagcacacucagagacacgaaaguagagaaauaacccccucacagaggggggugaggucacacgcagugcccgcggggagauuagucucccacauccacacaggcucagcuaggcagagagcgggggcgucacagacagcaucagacaagcggagguggacacuugggugguguacacacccuugcccaagguggcaaggggggccuggaggcacacaagaaaugacacacauauaaacacacacaaaagugaggaaacauacgagggcauguacagacagaacacacgccaaucuagguauacauacagacauacaaguccagaguaacacacaugggcauguuacauacaugcaugcauacacccauacccccacacacacagguaacacacugacacacagagacccagggaaacucauaugagcauacacuugcagacaaaacacauucccaccgaugaucauggagaaaccuagaucugcaacacagacauucucugcagcccuagcccuggugcguguccacccccacaccagaacacacuugguauauacgccaccaucccuuugcucuggacaccgccaaaacucacgauaacuaccugaugucaucagugcccauggcugucucccccugcacccaagaacuuuccacagaggcaggcccaucccauggugcacacacaguagguaccaaauaauguuugcauaugagcaaaugagguaguccaagcagaggugggauaugggaaccugucaaaucuuuaugauucugacuacaauaaaagcacuaauucauaaucauuuguucacugauuguacccaacucuuaacuaagcuguuuacaugcaucauuucauccaacccucacaacaauccagugggguggauaauauaaugucuauuuuacagaugagggaauacaagaacuccaguuaauucccaaagggucauguucacuuuaugaucaacacauuuuuuuaagaaugugccaggaagaggaaacauccagugccaauguggcuggaacaagcugaaggggguugugguagcaggggccagauuggguaggaccuugaccauagugagcagugaugguggacuaggagagguggcagaagauaggcaagaaguaaguagauauggagucucuuuugccugcagaauuuucaggugacucauccacuuauucauuuguucauccuuuauucauuaaaucauuggcugguuuaaacaaggcaguaauaguguggggucuggagacacagugccuggguucaaguggggccuccaccauacacuugggaaagugacuuaaucuuucugagauuugguuuccucaucuguaaaaaggauacaucucuaacccaccucuaaggagagggguaggaagggggcaaccucuguaccuuugcauguguuguaacuucugccaggaauguccucuccuucucucucgagggcugccuuuggccacugucugcaggaaccccucacccccaggucucagauucuauccccuccuccccuaggcuuccacaguacccaagucaaacacuucccaaaccauccucuacucccuccuccaacccagccagcuucagucccaccuccaggccuuugauuuggccacucuuuucuccucccuucaggauuccuucucuggcauuccaaauccuaguguuacccagauggggaucuccccgcaaaucagauauuuuccaaugucuugaaguaugugcucccugguuuuuugcccaguaacggaagcaaacaagcugugcagggcgcggugcccucuuuggggacaggaacagcugcaggucuacagaucuuucugacuccuuuaggucugaauucagguuccucgggaaucuaucuccaggcugcgccucuuccugggguccccauuccuagguuccuaguacuuguggccccagcaccauuucauuuuuccacguggcucaauuuccagaaauuaauuuuuuguagauuguuuuguagaggaaugaggauucaccucaggagugccucaauucacuaaggcaaagguuaggcucccccaaacugucuccaucuuguucagcaggaauaggcguacaaaaggggccccaauaaugauuuugcuguacauuggugagcaacgacucucaaacacacaccccugacauauguucacauucaguauuguacccauguuugugacucacacauacauguccauggcaccuuaauguguaugugcacacacgggacuccugcauuguuauggcauacauacauuuguaaccucacacacaugccacauaucaauacauccuuaauucuugcacaggcccaaaggucugcaucucucucucacacacacacagcugaauucccacuuucuuguaaacguauaccucucucauacccuguaguagcaaccagaaccccucacuuuggcucagucuucccaagaugaccaaguaaguacucaucaacuucaucuucacuucaacucauugacugguccacuugaauaaggggaaaacgaaccagagaagucaaguaaguguaccaauauacucugggugugcaugucacaaaccuccuacccgaaccuucccacacagacggguccccuccacccacagcacucuugacauuuaagaccucaucacaauccaugaugcuucaaaaauguccagccuacuaccuuucugugcguguuuccuuuguaaaauggggauaauaauacuuacccacauggguuugcuguggacgaaaugaguucaugcuauggaaagccuuaagacacuacuaagcacacaguaaguacuuucuaaguaguagcuauuaccaugauuauuaugauucuuaugaugcgucucuucacaaggggcccggcauucaguaagugguaaaugaaugagcaaaugcuaaaagcacuggugucuggcuuuguucccuuuacugcggagacacguaacgcucugauuccucuucuucucuauucuccgugauguccagcacuauuguuaguauacaguaggcguuaaguguugaauagauguucacacgaaaggaauaccuucugagucuguucccucacucagauguccucuuucuaccagcccuccuccacccuagaugcucagacucagcuuuagcauacagcaggcgcuaauaaguguugaaugaaugaacaaauuaccagaggaaagugucuggauuugucuugggggcuccuccgggcggauacugacucuagcuucuuugccccuccucagcucagagcgcaacacaggcacuuccucggcccgccccccgccucgccgagcuauuugucgcugguaauuguggcauuggagcugggcugucgggagugggugggugcaggugcucgggcggcagggugccagccucggccacgccucugccguucauccucgacugacgcggagucggagucggccggcagaggcuccuccaggguuccggcuggugggaaucuagggagguccaggagacggggagacaacgaacaagcacgccggccaaucaagaagugccugccaggacaaguagccaaucaggaaacccguaacgcggagcucugcagaggaacgugccgggcggcccugaggcucuaagggggcugcgcagggcccagacauugggguuauggcagcggcggggagaggcugggacugcacacucgcuuucacuccugccaaccugcgaccacaguggaaaauacuguuuuccgcaacaggcugcugugucuuggcccgugcugugcuguuugcccuaugagaugcuaucacccuacuuuuggggaaggggauagguuguuuuuccuccuuuaaggaaucguagacgaacucgaagaggcuaguuuauugagguuuggaaggucagggggcucagaguggaggagagaaguguuagaguuccucuuccucagggucuuugcaagcaggcacguguagacauggucguuucuccuccaccaccagcuucugcccuuguagcuccucacaccguggcagcggucucccccagaaggucacguucuucucgcccugaccuucgaccauggaaacggugggccugaggcauuagggguggggaggaacggaagggagaaucucagggaaggcaagaaugcauucaauucuuauugagugccugcuauaugccgagggcuacuuuuuuuuuuuuuuuuuuuccuuuuuuuuuuuugaggcagggucucacucuguugcccaggcugcagugcaguggcacaaucauagcucacugcagccucaaucuccugggcucaagugaugcuccugccucagccucccaaaguguugcugggauuacaggcgugagccacugugccuggccucccaacacuacuuuuuagcuauaggauauugggcaauuucuuuagcuucucugugccucgguuucccucaucugcaaaaugagaaugguaggaauaguaauauuaauacucaccucacgggguugaaugaggauaaaugaguuaauucagguaaagugcucagagcagugccuggcacacagcaagugcucaauaaaugcuggugaauguuacuuguuggcaugagcuacuuucuuuuaccuccgaaauauauacccuuuauaucucuuuccacugccuccaggaaaaaacccaaugccuuguccugacauucaaggccuuauuguugggcccaaaucccugccccaagccaaucucucucucugucuccuccacuuuauucaagcucagucccuguccagaaaggucuuuaccuggguuauuugucccacuaggaaagcccuccauucacucccaucccaguucucucaauugcuucuuccuccacucagucucucgcucacucaaguccuuugugccuccauucaacaccucuaaucuucaggccccacucuaacccccucagccgggagaucccuucccagauggcagcccuuccacgagcugggaauaguucacuuaaucuaguagcuugauguauguggaaggaagaaaagggaugaacauuuuaacccucucuaacaccugggccccucuggcaccuggaaacacuuauagcggcuaaucaccuagcuccaaggcuccguucacagucuugaugccaggaaugccuuucccaaccccuaccugcccugggaggcccagucagcuuccuggaccuagguugagguggcagcaccuguugcaugcaccagcuguuccucauaugccuccugucaggggcuugcucagcugggucccuuggaggauccacaggaucugggcuguguguaucugcaacuguugcugaaaaagccuuggagugccuuggcucagugagaugcugacaaaguggauggaggcaugagugacugugggaggcaggcagugaauggaggccugagugauggcagcuaaaagcauggguaacugaaggucggagucaaugacacaugaaggacuaaguggaugagugacugaacaggugacugaggggcacagaggcuacgaauuauccuccaagaacuucuuucucaucuucuuaguuucuccccacuuccugcagcugggagguggcacucggcaaggcagauaccuuagauucagcaguggaaacccugguuuccugggguagccgacucucccgccuguaauauaaugacccccucccaggcauacuuugcccucucacucacggguacuuggggagcaagggugugcagaggcgcuggcgggcacggguaggauuagguccacaggggggcaugcacagcccccagguacuccacucugaccaugauccuuucacugcaaugagggguaggggucacagagucagaacuggaggucuuggugggaaagugagagggaggcugcagagacgugagguccacagcagagaguuggaaaccccuuauccugcaugggccaccccacccucagagcacagucugugggacacucacaggggcagugcuggaugcuguagcagugccggauauccugcuguugcccggcacaucgauguccgucaaacuugcggccccugcagguccucccgcgugacugcuggcccgggauuucuugacagcugauggacuucauguuccgucggauacaggggcuccacuccccccacgagucccacuccccauccacugcagagacagggcaacaggggauuggaccaaagcagggaaucagcaaggggguucagaggaaggaaugagggcgguaggagggaguagaggugaucagaugugugaaugggggaccagggguggaaacaagguaucagggccaggaaaggaggaaucagagacaggaacaaggccucagcagcaggagcugggcagcagagaagggcaagggggacuuaggcaugcaaaucgugaacccugagaugcugaccagggcagggcacagcuguguugcagauguggguccggguggcaucgccagcacagaaggggcccccaugcuggggcacagggugauugcacguccguuguuccauggucuggcccaggccacaggucacagggcaggggcucacagggccccaaggcccccagcccccagccacuguuggaggaggaaagggagugaggagaaaggccuccucaauccuuccucucagccccuagacccuugaagcagacuguccccaaaugaagggcugcauggucacauggccuaggaacucuagaaauggcagagcaucucugcccucaaucaagagccccaccagcaacaucagcagccucauccugguguaccugggcaggguggcaggccggugcaccuccgcugcucguaggcuagccccgggcagggcuucccaggagguuucugggagggcucaggugcagaacacuugcggcuucgugucuccuuagguucgugggguccaccguggcaggaggcugagcaggggguccaggggccccagguggcccaggccccgugugcugugguggggugggagguggagggaugcagguguggucaugcaugcuaaaguccucucagccuggcaguucccugcuguaaccccgcagacccacgcugggugcacccaucagcauccuguggcuucccucacucacuggggcagaccugcugggugucacaggccucugauuccugugccuguccugggcaguggcccccacacuugggagcagggugauuacaggcucgccugcggguccgggucccuuuggagcaggugacagagcaaggcucccagggcccccagccagaccagccgcccaucucugugggagagaagagaggguaaugggauggagguggggugucauucagggcucuuugcuuccuugagugccccacaugagcuaauccuguccuuauauccucugccaccauucugggcccaccauccccgcucaccgggccugccgcagcaaccuucacaugggugccuccgcuuccccucucacccucaccgugcacagucuguucuccucccaaccccagucagaucacguuccuccucugcccacaguccaaauuacucagaugaaaagccaacguccucucuguggcccccaggcaauggacccuccucaccucucugaccucaccucccaccacucuccuccuuagguccuuacaaacacuggggacgggcccacucugaggaccucuguaccgaucguucccaccagugcugggugacagggagugcuugcccgccuugcucauccuccucaccaggacagcacugcugguccucacaggccuggagcugccacuccagggucccaggugccaccuuuccagagcacugcccauuccagcccacacagcgccgguaccgcagcugggagcccucagagcacgucaccgaacagggggcccauguggaccacagggaccaucguggggaccuguggagaagagcacacacaucccauccuggcaugagcuaacaagaauggcaugugggacuccagagugugggcagacacgaaggguugcuaggcaagugcgugugcgauggauugauaaguccuuaccuuuuagggauauugggauacugaugggaagcaguggauauacaauaagugcuugauaaugucauuuaccuucacaaucaggcaucuggaguuaccauuggaaggcugcauggccaacaccagguccgcaguaagcaaagguaaggacuagaaaccaagggcugcugucagaaacccaccagaucaccacacuacacgguaguagguaaauagaaagugcuuaauaaaccugagccaucaucccuaugaccucagaggccuccucagaaauaaccccagaucuauccccaacccacugcauagcccuagguaugcuguucaugccaaauagaugugaugaacuguugacaugacuuggggcccagagcugcccucaaaaauccccaagcuccccaugcccacgguguaucugggauauauaguaaacaaguagaaaacaggucuggcauacgguaagggcucaauccaugcaagcuggaaaucaugaucaggagacuagagcuacccucagaaauccucaagcucaucucccaacccugccaugcagcugguauacagggagugcucaaugaaugugaagugucaucauaauuaggggccuagagcugcccuuugaauuccccaaacuuucccgcccccacaguguguccauauacaguaagcacucaauaaacaugagcugucaucaaaauuagggaaauaccaagcugcaccccaccugcaaugcuuccagugugcaggaggugcucaauaugugugagcuaugucagugguucucaaucaggggugauuuugacccccaggggacauuuggcaaugucugcugacauguuugguugucacagcugguggggagaauugcuacuggcaucuaguggaaggcuagggguguuacaaaacaucccacaauacacagguaagcaauccccucccccagccaagaauuuccagccccaaaugucaauaguaacaagguugagaaacccugagguauggucacgaucagggccucagggccacccuuggaagucccagagaaagaaagugcccaguuuugggugacccccacagacaguccuucccucccccccaucccccaccccaggcucccccuaaccugcaaggcugacagagcccaccacuacguuucugguaggcaaaggcaguguugagacagcagucuuccacgcugacaccaccccccaggaggcccuugcacuugccggaggauucuucauacugggugaagcagagcacggggucugagccuguaacagggccaggggauggguggguggggcucggucagggauguggugggccuggacaccccuggggccagcugggcccucacccccucaccuguggcuggcagggugagcagcaggagcagcggcggcagcaacaaucgaggggccugcgcucccucugugaucauguugaguacugcccccugcaccucuaccagagaggaggucccgcuuuaucuggguugauaggcuccuggaaucagcagggaaagaggaaccuagaggcaggaggaacugggagggcauccugcuuugaccccacccuguccccucugccuccuucucuacucuccccuccccauuuccugucuuacucuuggucuuguucuguuuguuacuauauccccagcaccucgcgcuccucccagcaaccucacaguguucaauagaagcuccuaggacaaauucucacccagaggaaauggagcauaggagcgugcagcaacuuccuagccgugugaccuugggugagucacuuaacaccccugagccucaguuucccuauguggaaaaugcauaaucucuaacauaaugacggggucaaccucguggggguguugaaccagggugaagugagugugcggugcucaguauguuccugcucguggggguggagggagcaucgagucaguugcuccaccuuccacccucccuuaaccucggcccuccuuuccugagagguucccuguggucagcuuguggucggggaggucagcacaagggaagugagaaagggaaguggcaggagccuggggagggauucaggaggggaauggggucuauccauuguuccaugggcccagcuggggacaacaccagggucuggggugauuaggagggaauaagcugggccauauuccaucagagaacccucaggcagauaacaccccccuucuggagccuguuuccccucuguaaaaugugcucacagacagcaccuacaacauagguaggguguguugcaaagauugcgaguuaagcuuuuguuuguuuugucgagauggagucucacuccgucgcccaggcuggcgugcagugucacgaucucggcucacugcaaccucugccucccgauuucaaccaauucuccugccucagccuccugaguagcugggauuacagccguguaccaccauguccagcuaauuuuuguauuuuuaguggagacaggguuucaccauguuggccaggcuggucucgaacuccugaccucagguuauccaccugccuuggccucccaaagugcuaggauuacaggcgugagucaccgugcccggccaggaguuaagcuuuuggaaagucuuuagaacagugccuggcauauaguaggugcucuguguuugauaaauuuauucaacauuuauugagcaccuacuggaugccagaugcgguucuuagcauuagagcagagaauaggacagacaaaaauccuggcccucgagaagauggauaacaaauguugccccuccucacagaggccuuccccauacccuugucuggcaucccugucacucucuagcccaguagcuuccaaaccuguuuuuuuguuuguuuuguuuuaaagagacagagucuugcugucaccugggcuggagugcaguggucugaucauagcucauugcagccucaaacuccugggcucaagugauuuucccaccuuagcguccccaaguagcugggacuacaggcacacaccaccacacaacuaauguuuuuauuuucuguauagauggggucucguuguguugcccaggcuggucucaaacuccuggcuucaauauuuucucccaaccucagccucccaaagugcugggauuacaggcaugagccaucacaccagcccuucuuuuuuuuuuauuuuuuuauuuuuuuuuuauaaacccuaaugaaacuccagggcccacuuuaaaauuuuuauuuugcuuuuaauuaacaaaaagaagcacaagaaagauaggaaggcaaugccuaauuuccucugcucucagggaggcagaggaauucugcaaauucaaauguaauaauuuggucagcuguuaaaacagaaguucuucaggaacacuuguuuuaugggcaguaaaguauguguuaauaucuguauccauuacagacauacucuguucucugauaacauaaggcuauccuugaaaaugugcuuugaacaaaggagucuuauuaagauucuacgacuucaagacaaucauugcuguguuauccugugaaaacacucuccaagagaccugaaacuggccaggcaugguggcucacgccuguaaucccaacacuuugggagauugaggcagguggaucaccugacgucaggaguucgagaccagccuggucaacauggugaaacgccgucucuacuaaaaauacaaaaauuagccaggcgugguggcggaugccuguaaucccagcuacuugggaggcugaggcaggagaaucgcuugaacucgggaggcagaggcucuagugagcugagaucgugccacugcacuccagccugggcgacagagugagacucugucccaaaaaaaaaaaaaaaaaaaaagaaagaaaccugaaauucuggcuggcuucuuuauuuaaccaccuguugcccugguaauaauauuaacaauauuuccuuuguuucuaaacuguauaaauacucauaggauucccuguggaagaggacugucagcacucuaucuuuucccacacguuuaggcaauaaaaugacugcagauuccuuaaacaaagagugagagucuugucuuauuuaauuauuacaucccuaccugcuacuauguauuugccugcuucuuguuauucucacucccuaaauaucaguuccacaagggcagggauuuuugucuggcuuguuaacugcugggucugcagggcauuagauaggcaccaggaaacaguggaugcucaauaaacaucugcuaaaugaaucaaucaaugaaauaaacaaaacuuuagagauuacgauaaaaugccagaaggacagucugaguuagagguaaaaaugugggcaucccauggaggauaaguaguauuucaagugugaagaccuggauaagaugaccuagagaggaugcgugagaagagagaagggaaucccagggcuuugcccuggggaaccccagcauuucaaguuuuagagaaguaggagaagccagcccagcggacugagcaggaggggccuguggaggaacaggaaaaacagaagaggguuuuucuccagggccuggaacauucgagggucugcagggcauuagaccucucacacagucucauuuggucuguuauuuucucucucucucuuuuuuuuuuuaaaccuaucuacacaguuauguuuuucuuuucuuucuuuucuuuucgagacagggucugguucuguuacccaggcuggagugcaguggcgugaucgcagacuacagccucaaccuccugggcucaaaccauccucccaccucagccucccgaguaacugggacuacaggcacacgccacaccuggcuaauuuuuuaaacuauuuggagagacaggguuuugccacauugcccaggcuggucucaaacucaaacuccugggcugaagcgauccucccaacucaguguccucaguagcugggacuacaggcaugcaccacuauaccuggguaauuuuguuuuuuguuuugguagcggcaggguccuucuauguugcccagguuggucucaaacucaaaauccuggccucaaguaguccucccacaucagccucccauguagcugggauuacaggugcacaacacuacguuaugcuaauuuuuuaaauuuuuaguagugacggggucucaccauguggcccaggcuggucucaagcuccuggccucaagugauccucccaccuuggccucccaaagugcugggauuacaagcaugagccaccgcacccaguccggauuuacagccucuacuauauucucuuaaucacacagccucucagacauucugucacucauagucauuuucugugucauggauuccagccuuacuacagucuccuaacaguuucacacacacaaucauguuuaacagccugucucauucagucaauauugccaauaguuucucucaccagucaguuccuuacauacacgugcagucacacaaucucaugaaacguuuaggcacucauuuggccuguuacuuucucacauacacaaauagucacugauuuauagucaccacuaacuagucucucaugaaguuucccacacaugcacaaaaaucaccucuccuaccccuuucucacucaagccacuuuuucacacacccacgaucccugauuacagccucucccacaaagacauucacacgcauacacaaucacacaguaucucagacacugucgucaccuagucucacguuucuucucaaucagcuuccaguacccucaguccuugauuuacagccuuucauaaagucucuugcaaaggguuuacccauggacacacaauccguuucucagccacugucucagucaucacugucccucagucagcuucugauauacucggucaguauuucacaaucaccacuaggcccucgauaagucacccacagucacccaugcccucucagucgugcacaccgucauuuucuucauauggucagcucaucacggacacacgugcacagcuuuacaaguuucucacacacugucacguggucacuuggcaugucucauuugcucagcucuuuuguauggccccugauuuaugguuucuuaugaacuguuucacagacccccuggugcucugacaucacucaguugucaaguuccucucccacaguuucugacuuccaguuacugcuacugccaagucucucauaaacaguuccuugucccucucccuugcaugcccagugauguggucucucacaccaugucaguggcuccguccggcucaccgucauuuucucuccuacuuucucacagucccugaaccugugggauagacugugguaguaaugguaaaucgauuugcaacuaguuucagguguacacacacacacacacagccugucacacucucccagucacagccauucguuuuucucagucuuugcugcagucucucacgccugcuuucguacacacaauugcaccuucuuguaucuuuggucucggucacugguuuggucucccagccauucucucccguacaaucaaguucgcacccauacagucuuacagcuuuagcugacacuacagccucaaguaaacaguuuugcacaucaucuauuucucaaacguugagucgccuacagugagguuugucaccuacacaaucuuugccacaaucccugacaaccucuacuguaguuucaugcccacguagucucucacaugugguuuuggucacccagucugucuugcucgccaucaaacagugacagggcugcaguccccguucccuucucguagacauuauuuugugcauaccaucacagguucuuguacaguaccuugacuauucauccaggcucaguuauuuucugaaacacagccacaauuucccacauagacacaccaucaaaagucuguggucacaacuucugcacacucucacacacaaucacagcuuuccacgucucugacacacacaugguuaccgauaugcagucccuacuauuguuucucacacacgccaucacaccguuucucucacaaucgaccucugccucacacccuccacacacagucaugcgugucacgcucagcuaguccugacaacaucagagaaaaagugccagcagccuccagcaucacuuugaaaaauauauauuuacaggaacaauuccccauucucugggacucuuuagaaaaaaaaaagguccauuuuggggaaguaaaacaaacaguggagacgaguguagcacugucccccaaaucaccaacccccaggucccaaggccugggcugggccagcgcuaacaggugagcccaggagucuuuugaacccacucucucuugccuagaauagagacaggacaggcuuuaugucccccauuccucccucccaacuccagggacauugaaaggguccuuuguacccgcccgcaggaaauuggggggcugggagggagggaacugaaaauucauguuugguaucaaaaauaaacacuuggagugggggaggcggcaggaagauucccccccaaaucccuuccuucccacccaccccaccaaauauaggaagagaugacucccucuccccuauugaaaagccccauuuaaaaauagauuauacuaucaaaauggcagcgggggagagacagggagaccuggaguacuggcuggaggggccccccagacggggaccaccccccaaaaaaacccuccauugggaggaaacaggcaggaccccagggagguuggcagacaaaggaauggcuucucagggggaagaacaaaagggacauuccucccuggccaaaaaguugguugaaaaggauaagcugucugagagaaagguuggggagguggaaauuucuauuccaagggugugauucuuccuuggccaagacucccaacccauuaaaugguacaaauucuuccuggaccccugaguauggccaggaauaauaaaacaaaacaaacuaacucuucuacucacauccaaaaacgcagacagggcucccucaucuccccaagggcaggcugagaaauaaagaaagaaaggucguucucaagccagaccucgauugucuugucuuggggaaaaaaguggggaggugggggagauguccuaaccacccuaaaagguuaggucaggcuccucccaguggccuucaaaaaauaaauaaauaaaccgccccuaccauugaaguaggagacguguaagggcggccacugggggacugacagaaaacagagaaguuguggaagcuguguguuuucuguggaggagauaaugagaguuacucuugggaguaauucuucccaaggauccccaccccaccacaaucagagcaugagucuuucaguugaacuauguuucuccuugagauggcuggcuggagagagcauggauggagugaccccagaaggggugguggugguggugguaguagucauggcuucuggggcccuggggagagcaccacgggggucgagaggccauccacgcugauagaagggaugugcaccugggcgcugccacuggauggaaacugggggcaaaaagagggagaggucacagaugggggccauucuugggucucucacccuguccaaaacggggaaagaggauccuaccuggaaggagagcuuggccgggcuacggggcgcaaugggacucagggugcuccagaagugaaugcuaggaggcagcgagcugggugucagcagcaccggggucuguggggagaggguggucggagcucaagugaguagaaaguagaugugggaugcuggaagggacuuggucccggccccaccacagauuucccacucacacucccagggucacuccccaaagugcacacaccuagaugguaaccauggaggccaugccuaugaucucucaaacucugcagacaccccccacuccccacucccgagagcccacccucaguugcugagaccucauuggucaagaccacccacaagacccuauccaaaugcugcucucaaaccucucaagucaccaucccaacagcucagggucaacuuccaacucaugucccacccaugaaaccccauaugcacaucccagaccaaaaagcccugcucagguuccuuaagccacaccccaaccuagaaacagucccacagaaagacccucggucccacccacaaaaguccccagcccugcccuucacuaaucaaaccccaucccuccagccagcaucagcccagucaaucacacucaaaggcuccacccucuucaggaacaaccacacucacccuccucugauuccugucagucacccgccacaugccaaucccauuggugcuggcgcccacacaccccaccccuccgcaggcacucaccaauguaugcguaggaagcagggauggggucagcgccggccccggagccuggaggccggagccacuucccgauccugggguccguucgggucccggcccaccuagcaggcucgggcugaguggaagcucuaggucccggggcuuccggcccuucugcggcugggagaucucagggcuggaagccgcauggccgcccgccugcccugcgguguccauaacaaccgcgggcagccgggcuggcacgcccuccuguggagggacuucuggcucggccuuggugguuucuggcacaaacccucucucccccgcaacuuccaacucuuccuugggcccuucuacuuucacuucugggggcaaagcccggcccaaacccggcuccacauuaagcucuuccgauuucagguuuggggccucgggcggggucaggaugaccugguagaggagcaggcacaaagaggguguguaaggauuguugggaccacaggauucuccugugggccacccagugauuuccccgggaagguggcacuugguacucagggcaugacugcacaucagagcaaguccuccaacaggacauaggacuucgucaaggaaguagggcuuccucuggggcagguccuccuaugggacaggggacuuggggugagacaaccugaagcggguaggaaucugagggauaccauccucauucauuaaaacagugguucucaaaaauuuaccuuccucuggaccagcaauaucugccucauuugguaacaaguuaaaaaugcaaauuauugggccccuccccagccccacaaauucagaaacucugggggugugccuggcaaucugugguuuaacaagaccuacaggugauucugaugagcacuagagugcgagaaccagugcauuaaacauauuccaggcaccuacauguucggcagcuacuaacuguagcacaguauucuccccuuucugucucaggauuuguguagcucucugccccaccccuccuucuaagaggaugucuuccuuccaccauuaucuccuuuaacgggacagcuaugucucuucuaccagccucccucgucauccggggauuacacaucccuccucuuuacugccuccucuuacugaauuucuauauuccaguccuuaccugcagaggcaagccggccucuucagccuccagacaggccuccaaggggcuuggacuggugcuccugcuccccgaggggggcgcugcugccccugcaggagcugcacuggggagcaccacagcaggccgaggaugaggggguggcugcggcugcagagacuggauggugaagguggaauagaggcccgagcgcauguacucguuccggcugcugcgugccaaaccgccugggccugccauuccugcacccuugggugugccuggcuuuccagagacaguguccccuggggcggcauguauagcagcaggggccacauuuggcaugguggagguaacagacaccucuggcuggggcgggcaguccucaguggagcacccugcgaccucaggguaggacacaaacuuguagacgaacuucuggccgcucaccuugcggaugauguucuaggaagggaggagaggaacagagggccuuagaggaaaggggcaggcuggaggcagggugucaggggggaggagggggguggaguggcauuucucuucuccuaguggcuuucuucccacuugcuccucuccggcuuucccgucccuccucuguaaguuucucucucagcccauuuccucucccauugguuucuaccucuuuccucucccgccagauuccccuuaucuauaucccuccccaguuccuccccuuucucucuucucuccacaauaauuuuuucuuuaagccccuucccauccaccccuuuccaagccucccuuugucacucuccagguccgucuaucugauuuucccacucccuccacacuguagcuccucuucacaauggggcccaugaagggcaguaggugugggagcaggucuucuuccuggcuccaagaaccagagguucacagggccaggccuugugggugacugucaggacacaguuuuggagacuagcaaaugcaauaagacaagaaaaugaaguaacugauauaaauguuggaagaaaguaaauuaauguagauggauggggugaugaauuauuaauacagaggauuauuugaagcuaaugauacagaaguggaacagggcaaggucacugcagaggagagggugaggaggccucauuauuaauaccacuguggagguugaagcuaaaaugguaagaaaaugaaguaacuaacagcaauuagacaagaauauuaaaaauacugguauaaauauugggagggggccuauaucaaggcuggcuuugcugggucacagagcauguuugggguuuuucaggucuggugggucucagagaugaccuaguguucccagagggcagagugagauagccucauuacuaauauuguucuggaggguugagcucaaggaauaaaauaugaaaauggaauaaaugccauaaacuaugaagggugugcagcauaugaccagggcaguucugggaguguggaggcacuagggcauucuguggaagucuuagugcuggucagauaugucacagggugggccuguguuucucggaagaggaauaaaaagggauauucaugaauauuguuugggaaauuucaguagaaggauuaagaaaaugaaauaacugguauaaauauuggggggaggagaaacccagcaguggccugggggucugagagggcaggaugggggaaauuuuaaauuuuagcuguaggaauaagauaaugaaaacaauugauauaaauauugggguagaccagugcuccucugggaauuuaagaagacaguguguggaaguuggcauuaaacauguuguuucagagguuuuagcuuaaggaauaagagaagaaaauaauuaguuaaaaauguugggagucccagaggacgaaguaagcaaaaguugguauaauacugucagggagguuuugauucuaggaauaugaaauauucuggaauaagagaagacuaugaaauaacuagggaagcccagcacugguccagggguuucagaggacagaaugaggaccagccauuauuaaccguguuuucaagauguuggcuauaggaauacggcaggaaaaugaaacguugugcauggcagggcagcaucacuuuggggaucucagagugggaguagaaagagucaguauuaauaaugcaguggugguuuucgccaaagcaguaagacaagaaaguaggugagauaguguuuaggggcccaauacuggucuuaggguaccaauggauggguuaaaaacugauaaauuuuaacauugcuuucaaagucauagcuauggcaauuaaaacaaaauaaaaucucugauauaaaugucagggggggguuccagcccuggucugagagacuguaccuugucauaguaguaccgcaaggcccggcugagcuugucguaauucauguuggucuuguucuugcguagcccccacagccgggccaccuccucugcauccaccagcuugaauucaccaccaucccgugaaguccaggagaugauguggccauugccuugcucucucagcagcugcagcagaaacugccacagcgucacagauggguccaucgcugggggagugcucacgccaucccagggguaccuggagagcaaacagcugaguugagaggcuguggacauaggaggggcagaggucagcgggaggaggauuccuuuuuuugucaucuuuucuccaucucugucuucaaacccuaccaucauucccuaaaccuucccagacuaacuucuagcuccccagucuugcuugggaugcucccugugaugggauacaacucauggguaucuuaggauggugugaauguauuuugaaugugaaacaaaugugaaucugugggggucagagggcagacugugguaggccaaaugaugccaacccugcuccgcauccuaauccucggaaccuguauguuauuuacacuacauagcagaaaggaacuuugcagaugaaauuaagguuacaaacccuaagacagggagauuauuucuggauuauuugaugaaauucaaucuaaucauaugagcucugaaaagcagaugauggagaaagaaagguagcucagagaugugaugacagaagaggcaggggagauucaaaaugugagagggacucaaccugccauuguuggcuuugaagauggaggaaggaggcucagaaucaaggacugugggcagccucuuaaagcugggaauggcugucagcugacagacaguaaggaaacagggacuucaguccuacaaucucaaggaauuggauucugccaacaacuugaaugagcaggaaauggauuuuccccuagagccuccagaaggaacgcaacccugccaauaccuugauuucagcugagaccagugugggacuucugaccuacagaacuguaagauaacaaauguguuguuuuaagcagcuaaauuugugauuauuuguuacagcaagaauagaaaacuaguuccauccuccucauuugaauauuaucuguaucuucuaccauaucaaugucaaguuuuucaggagguuuuuuuuuugccagacccuugcaaaggcugcucacuccacguggggcuuccuucuuucgccuagcagucuuucuuaucuuucaagucccagcccaaagguccuuuccuuuaugaagccguccuaaaacugaauga

SEQ ID NO: 18942 - RNA, 35048 nt, Homo sapiens
ugcccuaugagaugcuaucacccuacuuuuggggaaggggauagguuguuuuuccuccuuuaaggaaucguagacgaacucgaagaggcuaguuuauugagguuuggaaggucagggggcucagaguggaggagagaaguguuagaguuccucuuccucagggucuuugcaagcaggcacguguagacauggucguuucuccuccaccaccagcuucugcccuuguagcuccucacaccguggcagcggucucccccagaaggucacguucuucucgcccugaccuucgaccauggaaacggugggccugaggcauuagggguggggaggaacggaagggagaaucucagggaaggcaagaaugcauucaauucuuauugagugccugcuauaugccgagggcuacuuuuuuuuuuuuuuuuuuuccuuuuuuuuuuuugaggcagggucucacucuguugcccaggcugcagugcaguggcacaaucauagcucacugcagccucaaucuccugggcucaagugaugcuccugccucagccucccaaaguguugcugggauuacaggcgugagccacugugccuggccucccaacacuacuuuuuagcuauaggauauugggcaauuucuuuagcuucucugugccucgguuucccucaucugcaaaaugagaaugguaggaauaguaauauuaauacucaccucacgggguugaaugaggauaaaugaguuaauucagguaaagugcucagagcagugccuggcacacagcaagugcucaauaaaugcuggugaauguuacuuguuggcaugagcuacuuucuuuuaccuccgaaauauauacccuuuauaucucuuuccacugccuccaggaaaaaacccaaugccuuguccugacauucaaggccuuauuguugggcccaaaucccugccccaagccaaucucucucucugucuccuccacuuuauucaagcucagucccuguccagaaaggucuuuaccuggguuauuugucccacuaggaaagcccuccauucacucccaucccaguucucucaauugcuucuuccuccacucagucucucgcucacucaaguccuuugugccuccauucaacaccucuaaucuucaggccccacucuaacccccucagccgggagaucccuucccagauggcagcccuuccacgagcugggaauaguucacuuaaucuaguagcuugauguauguggaaggaagaaaagggaugaacauuuuaacccucucuaacaccugggccccucuggcaccuggaaacacuuauagcggcuaaucaccuagcuccaaggcuccguucacagucuugaugccaggaaugccuuucccaaccccuaccugcccugggaggcccagucagcuuccuggaccuagguugagguggcagcaccuguugcaugcaccagcuguuccucauaugccuccugucaggggcuugcucagcugggucccuuggaggauccacaggaucugggcuguguguaucugcaacuguugcugaaaaagccuuggagugccuuggcucagugagaugcugacaaaguggauggaggcaugagugacugugggaggcaggcagugaauggaggccugagugauggcagcuaaaagcauggguaacugaaggucggagucaaugacacaugaaggacuaaguggaugagugacugaacaggugacugaggggcacagaggcuacgaauuauccuccaagaacuucuuucucaucuucuuaguuucuccccacuuccugcagcugggagguggcacucggcaaggcagauaccuuagauucagcaguggaaacccugguuuccugggguagccgacucucccgccuguaauauaaugacccccucccaggcauacuuugcccucucacucacggguacuuggggagcaagggugugcagaggcgcuggcgggcacggguaggauuagguccacaggggggcaugcacagcccccagguacuccacucugaccaugauccuuucacugcaaugagggguaggggucacagagucagaacuggaggucuuggugggaaagugagagggaggcugcagagacgugagguccacagcagagaguuggaaaccccuuauccugcaugggccaccccacccucagagcacagucugugggacacucacaggggcagugcuggaugcuguagcagugccggauauccugcuguugcccggcacaucgauguccgucaaacuugcggccccugcagguccucccgcgugacugcuggcccgggauuucuugacagcugauggacuucauguuccgucggauacaggggcuccacuccccccacgagucccacuccccauccacugcagagacagggcaacaggggauuggaccaaagcagggaaucagcaaggggguucagaggaaggaaugagggcgguaggagggaguagaggugaucagaugugugaaugggggaccagggguggaaacaagguaucagggccaggaaaggaggaaucagagacaggaacaaggccucagcagcaggagcugggcagcagagaagggcaagggggacuuaggcaugcaaaucgugaacccugagaugcugaccagggcagggcacagcuguguugcagauguggguccggguggcaucgccagcacagaaggggcccccaugcuggggcacagggugauugcacguccguuguuccauggucuggcccaggccacaggucacagggcaggggcucacagggccccaaggcccccagcccccagccacuguuggaggaggaaagggagugaggagaaaggccuccucaauccuuccucucagccccuagacccuugaagcagacuguccccaaaugaagggcugcauggucacauggccuaggaacucuagaaauggcagagcaucucugcccucaaucaagagccccaccagcaacaucagcagccucauccugguguaccugggcaggguggcaggccggugcaccuccgcugcucguaggcuagccccgggcagggcuucccaggagguuucugggagggcucaggugcagaacacuugcggcuucgugucuccuuagguucgugggguccaccguggcaggaggcugagcaggggguccaggggccccagguggcccaggccccgugugcugugguggggugggagguggagggaugcagguguggucaugcaugcuaaaguccucucagccuggcaguucccugcuguaaccccgcagacccacgcugggugcacccaucagcauccuguggcuucccucacucacuggggcagaccugcugggugucacaggccucugauuccugugccuguccugggcaguggcccccacacuugggagcagggugauuacaggcucgccugcggguccgggucccuuuggagcaggugacagagcaaggcucccagggcccccagccagaccagccgcccaucucugugggagagaagagaggguaaugggauggagguggggugucauucagggcucuuugcuuccuugagugccccacaugagcuaauccuguccuuauauccucugccaccauucugggcccaccauccccgcucaccgggccugccgcagcaaccuucacaugggugccuccgcuuccccucucacccucaccgugcacagucuguucuccucccaaccccagucagaucacguuccuccucugcccacaguccaaauuacucagaugaaaagccaacguccucucuguggcccccaggcaauggacccuccucaccucucugaccucaccucccaccacucuccuccuuagguccuuacaaacacuggggacgggcccacucugaggaccucuguaccgaucguucccaccagugcugggugacagggagugcuugcccgccuugcucauccuccucaccaggacagcacugcugguccucacaggccuggagcugccacuccagggucccaggugccaccuuuccagagcacugcccauuccagcccacacagcgccgguaccgcagcugggagcccucagagcacgucaccgaacagggggcccauguggaccacagggaccaucguggggaccuguggagaagagcacacacaucccauccuggcaugagcuaacaagaauggcaugugggacuccagagugugggcagacacgaaggguugcuaggcaagugcgugugcgauggauugauaaguccuuaccuuuuagggauauugggauacugaugggaagcaguggauauacaauaagugcuugauaaugucauuuaccuucacaaucaggcaucuggaguuaccauuggaaggcugcauggccaacaccagguccgcaguaagcaaagguaaggacuagaaaccaagggcugcugucagaaacccaccagaucaccacacuacacgguaguagguaaauagaaagugcuuaauaaaccugagccaucaucccuaugaccucagaggccuccucagaaauaaccccagaucuauccccaacccacugcauagcccuagguaugcuguucaugccaaauagaugugaugaacuguugacaugacuuggggcccagagcugcccucaaaaauccccaagcuccccaugcccacgguguaucugggauauauaguaaacaaguagaaaacaggucuggcauacgguaagggcucaauccaugcaagcuggaaaucaugaucaggagacuagagcuacccucagaaauccucaagcucaucucccaacccugccaugcagcugguauacagggagugcucaaugaaugugaagugucaucauaauuaggggccuagagcugcccuuugaauuccccaaacuuucccgcccccacaguguguccauauacaguaagcacucaauaaacaugagcugucaucaaaauuagggaaauaccaagcugcaccccaccugcaaugcuuccagugugcaggaggugcucaauaugugugagcuaugucagugguucucaaucaggggugauuuugacccccaggggacauuuggcaaugucugcugacauguuugguugucacagcugguggggagaauugcuacuggcaucuaguggaaggcuagggguguuacaaaacaucccacaauacacagguaagcaauccccucccccagccaagaauuuccagccccaaaugucaauaguaacaagguugagaaacccugagguauggucacgaucagggccucagggccacccuuggaagucccagagaaagaaagugcccaguuuugggugacccccacagacaguccuucccucccccccaucccccaccccaggcucccccuaaccugcaaggcugacagagcccaccacuacguuucugguaggcaaaggcaguguugagacagcagucuuccacgcugacaccaccccccaggaggcccuugcacuugccggaggauucuucauacugggugaagcagagcacggggucugagccuguaacagggccaggggauggguggguggggcucggucagggauguggugggccuggacaccccuggggccagcugggcccucacccccucaccuguggcuggcagggugagcagcaggagcagcggcggcagcaacaaucgaggggccugcgcucccucugugaucauguugaguacugcccccugcaccucuaccagagaggaggucccgcuuuaucuggguugauaggcuccuggaaucagcagggaaagaggaaccuagaggcaggaggaacugggagggcauccugcuuugaccccacccuguccccucugccuccuucucuacucuccccuccccauuuccugucuuacucuuggucuuguucuguuuguuacuauauccccagcaccucgcgcuccucccagcaaccucacaguguucaauagaagcuccuaggacaaauucucacccagaggaaauggagcauaggagcgugcagcaacuuccuagccgugugaccuugggugagucacuuaacaccccugagccucaguuucccuauguggaaaaugcauaaucucuaacauaaugacggggucaaccucguggggguguugaaccagggugaagugagugugcggugcucaguauguuccugcucguggggguggagggagcaucgagucaguugcuccaccuuccacccucccuuaaccucggcccuccuuuccugagagguucccuguggucagcuuguggucggggaggucagcacaagggaagugagaaagggaaguggcaggagccuggggagggauucaggaggggaauggggucuauccauuguuccaugggcccagcuggggacaacaccagggucuggggugauuaggagggaauaagcugggccauauuccaucagagaacccucaggcagauaacaccccccuucuggagccuguuuccccucuguaaaaugugcucacagacagcaccuacaacauagguaggguguguugcaaagauugcgaguuaagcuuuuguuuguuuugucgagauggagucucacuccgucgcccaggcuggcgugcagugucacgaucucggcucacugcaaccucugccucccgauuucaaccaauucuccugccucagccuccugaguagcugggauuacagccguguaccaccauguccagcuaauuuuuguauuuuuaguggagacaggguuucaccauguuggccaggcuggucucgaacuccugaccucagguuauccaccugccuuggccucccaaagugcuaggauuacaggcgugagucaccgugcccggccaggaguuaagcuuuuggaaagucuuuagaacagugccuggcauauaguaggugcucuguguuugauaaauuuauucaacauuuauugagcaccuacuggaugccagaugcgguucuuagcauuagagcagagaauaggacagacaaaaauccuggcccucgagaagauggauaacaaauguugccccuccucacagaggccuuccccauacccuugucuggcaucccugucacucucuagcccaguagcuuccaaaccuguuuuuuuguuuguuuuguuuuaaagagacagagucuugcugucaccugggcuggagugcaguggucugaucauagcucauugcagccucaaacuccugggcucaagugauuuucccaccuuagcguccccaaguagcugggacuacaggcacacaccaccacacaacuaauguuuuuauuuucuguauagauggggucucguuguguugcccaggcuggucucaaacuccuggcuucaauauuuucucccaaccucagccucccaaagugcugggauuacaggcaugagccaucacaccagcccuucuuuuuuuuuuauuuuuuuauuuuuuuuuuauaaacccuaaugaaacuccagggcccacuuuaaaauuuuuauuuugcuuuuaauuaacaaaaagaagcacaagaaagauaggaaggcaaugccuaauuuccucugcucucagggaggcagaggaauucugcaaauucaaauguaauaauuuggucagcuguuaaaacagaaguucuucaggaacacuuguuuuaugggcaguaaaguauguguuaauaucuguauccauuacagacauacucuguucucugauaacauaaggcuauccuugaaaaugugcuuugaacaaaggagucuuauuaagauucuacgacuucaagacaaucauugcuguguuauccugugaaaacacucuccaagagaccugaaacuggccaggcaugguggcucacgccuguaaucccaacacuuugggagauugaggcagguggaucaccugacgucaggaguucgagaccagccuggucaacauggugaaacgccgucucuacuaaaaauacaaaaauuagccaggcgugguggcggaugccuguaaucccagcuacuugggaggcugaggcaggagaaucgcuugaacucgggaggcagaggcucuagugagcugagaucgugccacugcacuccagccugggcgacagagugagacucugucccaaaaaaaaaaaaaaaaaaaaagaaagaaaccugaaauucuggcuggcuucuuuauuuaaccaccuguugcccugguaauaauauuaacaauauuuccuuuguuucuaaacuguauaaauacucauaggauucccuguggaagaggacugucagcacucuaucuuuucccacacguuuaggcaauaaaaugacugcagauuccuuaaacaaagagugagagucuugucuuauuuaauuauuacaucccuaccugcuacuauguauuugccugcuucuuguuauucucacucccuaaauaucaguuccacaagggcagggauuuuugucuggcuuguuaacugcugggucugcagggcauuagauaggcaccaggaaacaguggaugcucaauaaacaucugcuaaaugaaucaaucaaugaaauaaacaaaacuuuagagauuacgauaaaaugccagaaggacagucugaguuagagguaaaaaugugggcaucccauggaggauaaguaguauuucaagugugaagaccuggauaagaugaccuagagaggaugcgugagaagagagaagggaaucccagggcuuugcccuggggaaccccagcauuucaaguuuuagagaaguaggagaagccagcccagcggacugagcaggaggggccuguggaggaacaggaaaaacagaagaggguuuuucuccagggccuggaacauucgagggucugcagggcauuagaccucucacacagucucauuuggucuguuauuuucucucucucucuuuuuuuuuuuaaaccuaucuacacaguuauguuuuucuuuucuuucuuuucuuuucgagacagggucugguucuguuacccaggcuggagugcaguggcgugaucgcagacuacagccucaaccuccugggcucaaaccauccucccaccucagccucccgaguaacugggacuacaggcacacgccacaccuggcuaauuuuuuaaacuauuuggagagacaggguuuugccacauugcccaggcuggucucaaacucaaacuccugggcugaagcgauccucccaacucaguguccucaguagcugggacuacaggcaugcaccacuauaccuggguaauuuuguuuuuuguuuugguagcggcaggguccuucuauguugcccagguuggucucaaacucaaaauccuggccucaaguaguccucccacaucagccucccauguagcugggauuacaggugcacaacacuacguuaugcuaauuuuuuaaauuuuuaguagugacggggucucaccauguggcccaggcuggucucaagcuccuggccucaagugauccucccaccuuggccucccaaagugcugggauuacaagcaugagccaccgcacccaguccggauuuacagccucuacuauauucucuuaaucacacagccucucagacauucugucacucauagucauuuucugugucauggauuccagccuuacuacagucuccuaacaguuucacacacacaaucauguuuaacagccugucucauucagucaauauugccaauaguuucucucaccagucaguuccuuacauacacgugcagucacacaaucucaugaaacguuuaggcacucauuuggccuguuacuuucucacauacacaaauagucacugauuuauagucaccacuaacuagucucucaugaaguuucccacacaugcacaaaaaucaccucuccuaccccuuucucacucaagccacuuuuucacacacccacgaucccugauuacagccucucccacaaagacauucacacgcauacacaaucacacaguaucucagacacugucgucaccuagucucacguuucuucucaaucagcuuccaguacccucaguccuugauuuacagccuuucauaaagucucuugcaaaggguuuacccauggacacacaauccguuucucagccacugucucagucaucacugucccucagucagcuucugauauacucggucaguauuucacaaucaccacuaggcccucgauaagucacccacagucacccaugcccucucagucgugcacaccgucauuuucuucauauggucagcucaucacggacacacgugcacagcuuuacaaguuucucacacacugucacguggucacuuggcaugucucauuugcucagcucuuuuguauggccccugauuuaugguuucuuaugaacuguuucacagacccccuggugcucugacaucacucaguugucaaguuccucucccacaguuucugacuuccaguuacugcuacugccaagucucucauaaacaguuccuugucccucucccuugcaugcccagugauguggucucucacaccaugucaguggcuccguccggcucaccgucauuuucucuccuacuuucucacagucccugaaccugugggauagacugugguaguaaugguaaaucgauuugcaacuaguuucagguguacacacacacacacacagccugucacacucucccagucacagccauucguuuuucucagucuuugcugcagucucucacgccugcuuucguacacacaauugcaccuucuuguaucuuuggucucggucacugguuuggucucccagccauucucucccguacaaucaaguucgcacccauacagucuuacagcuuuagcugacacuacagccucaaguaaacaguuuugcacaucaucuauuucucaaacguugagucgccuacagugagguuugucaccuacacaaucuuugccacaaucccugacaaccucuacuguaguuucaugcccacguagucucucacaugugguuuuggucacccagucugucuugcucgccaucaaacagugacagggcugcaguccccguucccuucucguagacauuauuuugugcauaccaucacagguucuuguacaguaccuugacuauucauccaggcucaguuauuuucugaaacacagccacaauuucccacauagacacaccaucaaaagucuguggucacaacuucugcacacucucacacacaaucacagcuuuccacgucucugacacacacaugguuaccgauaugcagucccuacuauuguuucucacacacgccaucacaccguuucucucacaaucgaccucugccucacacccuccacacacagucaugcgugucacgcucagcuaguccugacaacaucagagaaaaagugccagcagccuccagcaucacuuugaaaaauauauauuuacaggaacaauuccccauucucugggacucuuuagaaaaaaaaaagguccauuuuggggaaguaaaacaaacaguggagacgaguguagcacugucccccaaaucaccaacccccaggucccaaggccugggcugggccagcgcuaacaggugagcccaggagucuuuugaacccacucucucuugccuagaauagagacaggacaggcuuuaugucccccauuccucccucccaacuccagggacauugaaaggguccuuuguacccgcccgcaggaaauuggggggcugggagggagggaacugaaaauucauguuugguaucaaaaauaaacacuuggagugggggaggcggcaggaagauucccccccaaaucccuuccuucccacccaccccaccaaauauaggaagagaugacucccucuccccuauugaaaagccccauuuaaaaauagauuauacuaucaaaauggcagcgggggagagacagggagaccuggaguacuggcuggaggggccccccagacggggaccaccccccaaaaaaacccuccauugggaggaaacaggcaggaccccagggagguuggcagacaaaggaauggcuucucagggggaagaacaaaagggacauuccucccuggccaaaaaguugguugaaaaggauaagcugucugagagaaagguuggggagguggaaauuucuauuccaagggugugauucuuccuuggccaagacucccaacccauuaaaugguacaaauucuuccuggaccccugaguauggccaggaauaauaaaacaaaacaaacuaacucuucuacucacauccaaaaacgcagacagggcucccucaucuccccaagggcaggcugagaaauaaagaaagaaaggucguucucaagccagaccucgauugucuugucuuggggaaaaaaguggggaggugggggagauguccuaaccacccuaaaagguuaggucaggcuccucccaguggccuucaaaaaauaaauaaauaaaccgccccuaccauugaaguaggagacguguaagggcggccacugggggacugacagaaaacagagaaguuguggaagcuguguguuuucuguggaggagauaaugagaguuacucuugggaguaauucuucccaaggauccccaccccaccacaaucagagcaugagucuuucaguugaacuauguuucuccuugagauggcuggcuggagagagcauggauggagugaccccagaaggggugguggugguggugguaguagucauggcuucuggggcccuggggagagcaccacgggggucgagaggccauccacgcugauagaagggaugugcaccugggcgcugccacuggauggaaacugggggcaaaaagagggagaggucacagaugggggccauucuugggucucucacccuguccaaaacggggaaagaggauccuaccuggaaggagagcuuggccgggcuacggggcgcaaugggacucagggugcuccagaagugaaugcuaggaggcagcgagcugggugucagcagcaccggggucuguggggagaggguggucggagcucaagugaguagaaaguagaugugggaugcuggaagggacuuggucccggccccaccacagauuucccacucacacucccagggucacuccccaaagugcacacaccuagaugguaaccauggaggccaugccuaugaucucucaaacucugcagacaccccccacuccccacucccgagagcccacccucaguugcugagaccucauuggucaagaccacccacaagacccuauccaaaugcugcucucaaaccucucaagucaccaucccaacagcucagggucaacuuccaacucaugucccacccaugaaaccccauaugcacaucccagaccaaaaagcccugcucagguuccuuaagccacaccccaaccuagaaacagucccacagaaagacccucggucccacccacaaaaguccccagcccugcccuucacuaaucaaaccccaucccuccagccagcaucagcccagucaaucacacucaaaggcuccacccucuucaggaacaaccacacucacccuccucugauuccugucagucacccgccacaugccaaucccauuggugcuggcgcccacacaccccaccccuccgcaggcacucaccaauguaugcguaggaagcagggauggggucagcgccggccccggagccuggaggccggagccacuucccgauccugggguccguucgggucccggcccaccuagcaggcucgggcugaguggaagcucuaggucccggggcuuccggcccuucugcggcugggagaucucagggcuggaagccgcauggccgcccgccugcccugcgguguccauaacaaccgcgggcagccgggcuggcacgcccuccuguggagggacuucuggcucggccuuggugguuucuggcacaaacccucucucccccgcaacuuccaacucuuccuugggcccuucuacuuucacuucugggggcaaagcccggcccaaacccggcuccacauuaagcucuuccgauuucagguuuggggccucgggcggggucaggaugaccugguagaggagcaggcacaaagaggguguguaaggauuguugggaccacaggauucuccugugggccacccagugauuuccccgggaagguggcacuugguacucagggcaugacugcacaucagagcaaguccuccaacaggacauaggacuucgucaaggaaguagggcuuccucuggggcagguccuccuaugggacaggggacuuggggugagacaaccugaagcggguaggaaucugagggauaccauccucauucauuaaaacagugguucucaaaaauuuaccuuccucuggaccagcaauaucugccucauuugguaacaaguuaaaaaugcaaauuauugggccccuccccagccccacaaauucagaaacucugggggugugccuggcaaucugugguuuaacaagaccuacaggugauucugaugagcacuagagugcgagaaccagugcauuaaacauauuccaggcaccuacauguucggcagcuacuaacuguagcacaguauucuccccuuucugucucaggauuuguguagcucucugccccaccccuccuucuaagaggaugucuuccuuccaccauuaucuccuuuaacgggacagcuaugucucuucuaccagccucccucgucauccggggauuacacaucccuccucuuuacugccuccucuuacugaauuucuauauuccaguccuuaccugcagaggcaagccggccucuucagccuccagacaggccuccaaggggcuuggacuggugcuccugcuccccgaggggggcgcugcugccccugcaggagcugcacuggggagcaccacagcaggccgaggaugaggggguggcugcggcugcagagacuggauggugaagguggaauagaggcccgagcgcauguacucguuccggcugcugcgugccaaaccgccugggccugccauuccugcacccuugggugugccuggcuuuccagagacaguguccccuggggcggcauguauagcagcaggggccacauuuggcaugguggagguaacagacaccucuggcuggggcgggcaguccucaguggagcacccugcgaccucaggguaggacacaaacuuguagacgaacuucuggccgcucaccuugcggaugauguucuaggaagggaggagaggaacagagggccuuagaggaaaggggcaggcuggaggcagggugucaggggggaggagggggguggaguggcauuucucuucuccuaguggcuuucuucccacuugcuccucuccggcuuucccgucccuccucuguaaguuucucucucagcccauuuccucucccauugguuucuaccucuuuccucucccgccagauuccccuuaucuauaucccuccccaguuccuccccuuucucucuucucuccacaauaauuuuuucuuuaagccccuucccauccaccccuuuccaagccucccuuugucacucuccagguccgucuaucugauuuucccacucccuccacacuguagcuccucuucacaauggggcccaugaagggcaguaggugugggagcaggucuucuuccuggcuccaagaaccagagguucacagggccaggccuugugggugacugucaggacacaguuuuggagacuagcaaaugcaauaagacaagaaaaugaaguaacugauauaaauguuggaagaaaguaaauuaauguagauggauggggugaugaauuauuaauacagaggauuauuugaagcuaaugauacagaaguggaacagggcaaggucacugcagaggagagggugaggaggccucauuauuaauaccacuguggagguugaagcuaaaaugguaagaaaaugaaguaacuaacagcaauuagacaagaauauuaaaaauacugguauaaauauugggagggggccuauaucaaggcuggcuuugcugggucacagagcauguuugggguuuuucaggucuggugggucucagagaugaccuaguguucccagagggcagagugagauagccucauuacuaauauuguucuggaggguugagcucaaggaauaaaauaugaaaauggaauaaaugccauaaacuaugaagggugugcagcauaugaccagggcaguucugggaguguggaggcacuagggcauucuguggaagucuuagugcuggucagauaugucacagggugggccuguguuucucggaagaggaauaaaaagggauauucaugaauauuguuugggaaauuucaguagaaggauuaagaaaaugaaauaacugguauaaauauuggggggaggagaaacccagcaguggccugggggucugagagggcaggaugggggaaauuuuaaauuuuagcuguaggaauaagauaaugaaaacaauugauauaaauauugggguagaccagugcuccucugggaauuuaagaagacaguguguggaaguuggcauuaaacauguuguuucagagguuuuagcuuaaggaauaagagaagaaaauaauuaguuaaaaauguugggagucccagaggacgaaguaagcaaaaguugguauaauacugucagggagguuuugauucuaggaauaugaaauauucuggaauaagagaagacuaugaaauaacuagggaagcccagcacugguccagggguuucagaggacagaaugaggaccagccauuauuaaccguguuuucaagauguuggcuauaggaauacggcaggaaaaugaaacguugugcauggcagggcagcaucacuuuggggaucucagagugggaguagaaagagucaguauuaauaaugcaguggugguuuucgccaaagcaguaagacaagaaaguaggugagauaguguuuaggggcccaauacuggucuuaggguaccaauggauggguuaaaaacugauaaauuuuaacauugcuuucaaagucauagcuauggcaauuaaaacaaaauaaaaucucugauauaaaugucagggggggguuccagcccuggucugagagacuguaccuugucauaguaguaccgcaaggcccggcugagcuugucguaauucauguuggucuuguucuugcguagcccccacagccgggccaccuccucugcauccaccagcuugaauucaccaccaucccgugaaguccaggagaugauguggccauugccuugcucucucagcagcugcagcagaaacugccacagcgucacagauggguccaucgcugggggagugcucacgccaucccagggguaccuggagagcaaacagcugaguugagaggcuguggacauaggaggggcagaggucagcgggaggaggauuccuuuuuuugucaucuuuucuccaucucugucuucaaacccuaccaucauucccuaaaccuucccagacuaacuucuagcuccccagucuugcuugggaugcucccugugaugggauacaacucauggguaucuuaggauggugugaauguauuuugaaugugaaacaaaugugaaucugugggggucagagggcagacugugguaggccaaaugaugccaacccugcuccgcauccuaauccucggaaccuguauguuauuuacacuacauagcagaaaggaacuuugcagaugaaauuaagguuacaaacccuaagacagggagauuauuucuggauuauuugaugaaauucaaucuaaucauaugagcucugaaaagcagaugauggagaaagaaagguagcucagagaugugaugacagaagaggcaggggagauucaaaaugugagagggacucaaccugccauuguuggcuuugaagauggaggaaggaggcucagaaucaaggacugugggcagccucuuaaagcugggaauggcugucagcugacagacaguaaggaaacagggacuucaguccuacaaucucaaggaauuggauucugccaacaacuugaaugagcaggaaauggauuuuccccuagagccuccagaaggaacgcaacccugccaauaccuugauuucagcugagaccagugugggacuucugaccuacagaacuguaagauaacaaauguguuguuuuaagcagcuaaauuugugauuauuuguuacagcaagaauagaaaacuaguuccauccuccucauuugaauauuaucuguaucuucuaccauaucaaugucaaguuuuucaggagguuuuuuuuuugccagacccuugcaaaggcugcucacuccacguggggcuuccuucuuucgccuagcagucuuucuuaucuuucaagucccagcccaaagguccuuuccuuuaugaagccguccuaaaacugaaugaaugccugaucucucuguccuguuacugucccugaauguucucguucuuuuuuuuuuuuucuuuuuuuuugagauggagucucucucuguugcccaggcuggagcgcaguauaguggcacaaucuugacucacugcaaccucugccucccagguucaagcgauucucaugccucagccucccgcauagcugggauuacagguacccacgaccacgcccggcuaauuuuuguauuuuuaguagagacaugguuucaccauguuggccagacuggucuugaacuccugaccucaagugauccacccaccucccaccuuggcuucccaaagugcuaggauuacaggugugagauaccgugcucggcccugaauauucucuuucuugaugacagcaauaauuaacaucuauugagagcuuaauacacaucaggcacucuucuaagcagagaggcaauauggccugcuggacaacugcccaggcacuagggccagauugccaguguuugaauccugguucugccacuuauuagcugugugacccugggcauauucuuuuucuuuuuuuaagaaauggggucucacuauguugcccaggcuguucuugaacuccugggcucaagcaauccucucucccuggccuccuaaagugcuaggauuacaggcaugaggcaccacgcuuggcugauauucuuuaaccucuuuguaccucaauuuucucauguguaaaacagggauaaugauaugcccauuaguaaaauggggauaacaauaccuaguucacagagauauuguacagauuaaauauuauaugccugagguguaugauaagcucuaaauauuaguuucugauuuguucauagucccuuaucugccauuccaacauccaaaaugcucuaagggcagaaagcuucuuuuaacucuuuugguggcaaaaccugauuugaaaugaaacaaggcccuuucuggucuuuauugaaucucacuuauugcgaguguucauacauuuugcugcagaaauaugaacacagccgauuacagagcuuacuaagggguguuauguaacaucguauaugcaucauguuaccuuucugaaaugugaagaaauggaaauucugaaacacaucuggccccagggguuuuggguaagggcauguacaccuguacuguuauuuuuuuuuuuaaugggcauugacuuauuuaucccugaucaugccucugagaaguagguagucuuccugucauuaacuuauaaaugaggcagcggaggcacaaaugucuacguaccuuccacaggccacauguggcaaagccagcauuuggagccaggcagucagguuccaguugacuaagcauuucaccauuaggcuaaacggccccucacaccgacuauucccucucagcauguccuucaaagaacaggauccucccugucaccccauuacugcuuucuuuccugagagcaaacuggaaauaaacaugagcuuccuguucaauuauacaagucacaaagccaugaaguguccgauuagagaguccugucaccagagaccucacugaauuuguuuugcaggcaggcuuguuucagaaguccaaagaguucagagugacuccugguggcaaagacaggcaauuuuaccaguucuucuuucagcugcaacagaaccuaucagcugagugaaaggugacggugggcuuccagcuucaacagcacacagggcuuuguauuuuguuauuucucccacuugaccccucauaagaguucuaguaaucugccuugcuuagauauguuuacuucuuuccaucuccuucacuuagcaagcauuuggugagugcauacugugggccaggugcugcggauacagucgagaacgcaacagacaacaaucccugcuccagaggagcucacaucuuagcaggaaaggcagaugagaaaaaaggcaaacauguacaagagugcgucagauggugguaaggguuaugggaaaaaaaucaagcaggggagagcuguuacuuuuacauggagagucaggggagaguagucgccaaggaggggacaacugggcagagaccaaaaggaggugaaggaacugagcucgugaguaucugagagcagcaagccagguggaagcggcagccggugugaagggcccaaggcuggagagugccuggcaggugacauggggagaggaggcugacauggguucgggggagaggagggaggcagcgggagaggagaacagagugacgggggccagacugagccaggcuuuuucgggugcugucaggauguugagugagacaggagccacaagaggguugugaacagagggaugacaggcugugacugagauuucaacaggaucccccuggcgguugugagaagaacagacuguuggggcugaagaagccacugcgguagaugauggugguagcaguggggcuggcgagaaguagcuggggucuggagaaagccugaacacagaauaggacuugcugacagauagcaugcccgggggaggugagagaaggguccagggugagucuagguuuguggccuaaucacccacaaagacagcauuguggucagcugaggugggagccuugcaggagaguaaguuuugaggggggucacaccaguuuuggagauggucaguuucagaggccugucagacaucuacggguaugcuaugaauacauuuuaauaauuuaaaaaugcaagccaggcauacgauccuuaccgugggcugcacacucuuugaaucauuuaacucauugaauccucaaaccaccguuaaaggguggggauuaucauuucccccauuuuccacaugaggcaauggagguacagagaaguaaccugccccaagucacacagcuggaaguuggcagagccggaauucaaaaccuaagugguuuggcucuagugagcaaucgccuuacaccaccaguucuccaugaagagaaacagagaaggguaagauccuagagagugacaggaaugcuguuuuuacacaggguguacaaggaguucuuccccaaggaagugacaccuggccugaaggaggggagguagcaagccaggcugcccucugugggggagggccuucaggcggagcgaacggcguguacaaaggcucugaggcagccacccugaacuaucuaccguucccgagacaguuccaaccucugaggguaagcacgggcugcucuccccgcagggagagcucuucccucacuucauggacucaauuacacaaucaucgcauuccaggaagaauucauucuuccucugcgugaucaaaggugccaaauaaccugccugcccuugcaaaucuguucuucuuucugagucuucagccuuauguuccucugccccuguucuggcuauucuggcucaagguuacccugagcaaguuacucagccucucuuugcuuguuuccucaucuguaaaauggggauauuuuacucucaaagucaaauauucucaaaaguacaccuacccuccaaggcuucugugaggauuaacugugucaauucuguaaaauacuucuguaaaagacuugagggguugacuuuuuuuuuuguuuuuacaaguagcauuguuaggaacuucuuuuuuauacaugugccuuuguauaguauauuccaagcaccauaguguuuaacaaugaauauuuacugaaauaacacuacccaggugccagaaaaucaaaucacucuuagaaacaucuuuuaugccugugccuuuaggagaguguauuaugcacaccacagugguuauuuuuuggguuuuuuuucggagacggggaucucacuauguugcacaggcuggccuggaacuccugggcucaagugauccucccaccucagccucugugcccagcuauacaccacaguuuugugaacacauucuuucaaugcaacaacacaguccuuauucacauauacaacuagcacucuuagaaacagcuuuuauaccugugccuccauagagcauauuacauaccucaguuuugugaacauauccuuuugaaaaggaggaaaauccuuauucauauauaaacuggcauucuuagaaauaucuuugacacauguaucuuuuuguagugcauuccaggcaccaccgugugguaaacauccuuuggggguugguauuugaacagaaaagugccucugauguguggcagauacuccacagauauuagcuauuagcuagugugucauccuucucccccugccccugcaauccuauccuauguaucaccugcacuaucuggcucccaucaccugugugaccucaccuucuacccuuccccgcacucugcuccagccacacuggccgccuugauguuccuugaacauggcaggcaccaucccaccucagggccucugaacuggcacuuccuucugccugguaugcucuucccguagacauuaaggcucucuccgucucuaccgugaggcccuaauucaagagucaccuucccuaugccuaagauuucaaccacccccaauacucgauuccuaccugcccuauuucauuauuucuucucagcauuugucuauuaugcuaauuuuacuuauuuauuuuguucacauagucugucuccccagcuuggguuuuuuuuuuuuuuuuuuugagacagagucucgcucugucacccaugcuggagugcauggugcaaucuuggcucacugcaaccuccgccuccuggguucaagcaauucuccugccucagccucccaaguaacugggauuacaggcgcacgccgccacacccagcuaauuuuuuuguauuuuaguagagaugggguuucaccgugaugcccaggcuggucuugaacuccugagcucaggcaauccacccaccucagccucccaaagugcuaggauuacugguguuagccaccgugcccagccuccccaacuuuuaauaaaugucagcuccacaagcacaaauauuucgcccuguuucguuccuugccauauuccagcaccuagaagagugccugguacucacaaggggcucaguaaagguugguugcaggaacagucccaacuaauuagcucucauaucccuucuucuuccucaugugaccccuacacuggugucucaaauuaucuuuuucccauuuauucaugggauaaauucuuauugagcaucugcuguuuaccugguacauuuucaguugcuggagacauagcggugaaugagcagacaaaaacugaguccucaugggacucacauucuaaugaggagagacagacaacaaacaaguaacccacacagugugucagacagugauaaagggcaacgggacaaaucagggaccuggcuugagcccugcugggugugcagcuucagauggucagggagggguugacuuuuuuuguuuuuacaaguagcauuguuaggaacuucuuuuuuauacaugugccuuuguauaguauauucuaaguaccauggugugacaaucaaccuuuaaugaaauaacacuacccagguacaacaaaaucaaaucacucuuagaaacaucuuuuacgccugugccuuuaagagaguguauuacacacaccacagugguuguuuuuuggguuuuuuuuuuucagaaaaagggaucucgcuauauugcccaggcuggccuggaacuccugggcucaagcuauccucccaccucagccucccgaguagcugggacuauaagugcacaccccugugcccagcuacacaccacaguuuugugaacacauucuuucaaugcaacaacacaguccuuauucacauauacaacuagcacucuuagaaacagcuuuuauaccuaugccuuuacagagcauauuacguaccucagucuugugaacacauccuuuugaaaaggaggaaaacccuuacucauauauaaacuggcauucuuagaaacaucuuucauacauguaucuuuuuauacugcauuccacacaccacagugugguaaacauccuuuggggguugguauuugaacagagugcugaaaggaaccaugcagagaucugggggugguguucaaggcacaaagaacagccaaugcaaaggcccugaggcuggcccaugccugcuauguuugaggagcugugugguggaaccagugugguuggagcacaguaagggggugggaagguauaggcgguaaugcuagaaagguuacuuguuuuaccauuaauucacaguuaauauuuauuuacacuggaagggauucuaguucugaucccccauuucacaaaugaagaaaaaggcacagagaggaagugguuaaaucacucaucuaaggucacacagcugcugggauuggggggugggugggugcugagagaaggugaggaaugaagacugcucugcaggcagagggaacagcaagaacaaaagcuuggaggugagaacuaauuugguuuuuaaggacugaggccucacguggggugggaugagaucuaagaggggagccucaaaaauuauccuguguccugaguacuuccugggccaccuuugaguaaggaauuuaaccucccuauggcccaauucccucacuaccuaucucaugggguuguggugaggauuaaaggaacucauucauaugaaacacucugccugauauacggcaggugcucaauaaacgcuagcuccuauuggcauuacuaucaucacuggcgcuaauguauucacuuauuguagugaggcagaacgucuuugugguuacgagugugaccaggcugacccacuauuaagagguggaggacagggaaggccguacagugcuccaucacaaggaaaagaggaucagcacguucucuucugggaagggaaaaaaaaagagaaggaaauugaaaguacacggccgaucuucccccaauuacaaagcacuggacucacgggaggguaugcgggggacugugcaagcauacaggggugugggggaggaaggccaaugaacagauccacugcaaagggaggggugaugaggcucaucgucugaggggaaggggagcagaaaaccuuacagacuccugcaccacagugagaggagagaaaagccaucacacagacugauucaaagcagagagggaaaaggcuauggacugagcuacugaaaauagggagauguaaagcacuaaacuaacccacuauuaaaaaggagagaaccccaagcgcuagagcgacagucuacgaaaaagaggagacagggcaauggacugauagcuaaagggacgugaauccaaacaugaagacugauccacuauaaaaugguggugguggugguggggggggggggugguuuugaaaaaagccauggacugaugcauugggggacuggaggaggcaggaauacaaacucagguagacucacuguuaaagagggaugcggaggagugcggcgccacggauugauucgcuacgauguacaggaaggguggaauaaauaaggccacggacgggucuccugaaaguugaggcuaggagaaauccaaacacucagauacaccuacuauuaagggggcugaacacugucacaggcuagcucccuauaaguggggguggguggggggcggguggggguagggguagggggaaagccuauggacgaguccacccuaaguuggcguggggaaaaacauaagcacgcagaccgauccauuauacaacgggagggggagguuaggccacggucagauccacuauaagggacgaagggcuugagcaaugccacacgcagguccaccagccguggugguggcggcggggagucgaacaccagcaggccaccggccaagccacauccucugcgcgggggcgggaaggauacguggggucacggacugggcccuccacccuccaggcccagagcucaccuguguguagcguggcgguggcguuggcaauguuggcagcuccggggggcgggggcuccauacgcggccccaccgccccccaggccuggguuccgaggcggcgguggagguggugguggcgguggcggcggcagcaccuagaagccgccccugcguuucccuacagcucacgugggcccgaggaggaggagcccaaugucccgccgcucgcugauuggccaaagcgcuauuaaucggccgcaaggccucgagggguugggggacgggcccuucccuacagagcugugccgugauuggcguaaggggaaaugauggaacgcucacggccccuggagucccgaggaggcgcguucggccuucacggugcuccacgccgauuggcucaaggacugacggacugugagcaacugaaaaggcucggggccugugucgggggggcgggggucugccucacacugauuggcuuacaugggauugauggaagacagcccccaaggacggggguggguggcccuguuuuucucugauuggcggacgagggacuucuagaccccugccaaaacaccaagggggcggugucgcacgccaugcugcucagcggaagcagggcuuguauagaaaugggcguagcagccggcgggagugggucggacugggcuccgcguaggcgggcagggcagcucuacgguuagacaagaccauagagcuggguaaagacgaauuuagaacacagcggagguaggagggcaggauggcugucaggcacacgaaagagcauugaguggcagaaacgaaaugcuuucagagggcaggguugaacugcggccagaguuaaaaaggggaggaaccuggcucugcauugauuggcgguggcuggacucaaccuagaauaggggcccgacuagggagagcgggauccaggucugugcccauuggaagcuggaacacuuacaagcaggggcuaagacaagguagggcugaguuaggguuuggguguaauuugggguaccuggggaaugauugggugugugaaagcguaaaccuuagggcccuuugauuguugugggaaugaacaaaccuccaccaugaauuggcccauucucuauggcaauucaaaggguggcgucuaggaaaaggaauggaagaaagggugagguggggggcccagguugccaagaugacagaagagagggcagugcauaaggucaacuggcaaauacugccaggcaacaggcuggaggcaggacugcuggggcauuuuggagguuccacagagagacuggaucucugggucucucaguaacuuugugcccuaggaacaggcccccguggcaacuagcaggguuuauggggaaaaagaagggccaugugacucaaaggcauucaggcucuuuaaugucugaggauggggggaagaagucaauggugaggcuucucugggaaauucugcaggccuuguaguucucuaagccccugaaaaagaggacagaagagauugaacaaagacugggucuggguuacgcccccaggcuugcucugaccucccucccuugacuccaguuuagagggaaagaugguccuucccuucuuucgcucucuuccuucuucaggucaccacccuaaacacagagucugguaguggggugagcugcucucaccucuagcaacauguggauaugggcuuugauauucauggaguccuuggugaggcuguugcugagccuagagaaaagaaacaagaaagggcaaaaugggccccacaugauuaugaugacccuuccuuaucacuucaagaucuacuuauauccuggaugauuuccaccuggcucauuccuauguggaaaugccaagccaccaucugguuuucacugauucaaagauuauuaaaugccuacuguaugccaggcaauuuuaggcacugggagauagcagcaaacacaacaaacaaaacucccggccugauggacuucaaauucuuguaaagaaagacauaacaaaaaaccaauggaauaaaagcuaugugucagaugguucuaacuacaauaacaaaaauuaaaaaugagagacaauaaggaguacaggaguggggggcugcaauuuuaaagagggcucagggauggcuucacggagaagcauuugaguaaagacuuaaagacagugaauuuugaguaguguggcuauauggaggauguguuccacacacaaggggcagcaaacacaaaggcacugaggugggagugugccuggcauguuugaggugcagcaaagaggccacucuggcuggagaagaauaagugaagggggaauguaagaggugaggucagagagguaaugagggagacaaacugugugaagccuacaaggccaugguaaggacccuggcuuugaccuuaagugagaugggagccaagggaagguugcagcagaggaaggagguugaauuacaugaaccagucaguugacuccuuuucucuaagccaguuuggaucagaucucgcccaaaagaauccuaauugauauaaagggucaaggaaggccuuucucaagaaugaagaaugagaaggaaucgaagaaugccuaaugguuaagcaguaggaaggccuuuuccacaaaaaggacaagaggcaacaaagagcuguuugagaagcagugaggucagaguguuagaaauugaguggggagggaaaguggccuaagacaagguccaagagauaggaagagguuagaucacacagggucuuaauauaauaaggaauguggauuuuauugugcugucaauguaggagucaguuugagggguaaaugaaacuaaauacuguuggaaaagcagagagcaauaagauaggauguuaaauuggaaaaaaaaguaguaugaacccauguauauaccaauaucucccacauuuuuauuucuagcccagaacucucuccugaacuugacuaguuuuaaugacaucuucuaaaaauccacuucaguguuuaauaagugccucauacuuaacagguuccagacuaaauuccugaccuuccccuccaaaucuacuccuccccuaacuucuccaucucagauaauggcaacuccaucccuccaguugcucagccaaaaaccugggcuccucucucucacacuucacauccagucagccauucuucuuaaaaucaugacuguuccauugcagguaaugcuucugaucuccaugauaugcuuucuccauagcacugucaacaucugacauacuacaucauucauuuguuuauuguuugucuccccugacuagaaugucagcuguaugagggcagauuuuguuuuuuuuuguuuccugcucuauccccagggaccagaacaguguguggcacagaggaggcacccaacguauguugaaugaauaagugacuacuccauuaaaaggaaccugagguuggcugaguguauguuuagggacaggaaauaaaugaaguauggguguuguugccagagagcaagaauacuuucaagaauauucuggggguaaugcuuaaagaacagaagaaugaaccugaucagcuccuaagggacaauuuuaacaucaaaaaagagaacaaaauuaguuaaugguguaagcuuaccuuaugaaaaccuaugaguucaacacuuuaaaagggagaaaaauacagaguucaccaaaugcuagcuguaacacaaaagggauauguuuauuacugcugauuuauuuuuauuugcuaugugagaagcaaauuacuacugauuuaguauguaaggcagugugaauagucauaugguuaugcuuuuuuuuuuuuuuuugagauggagucucacugugucgcccaggcuggagugcaguggcgugaucucggcucacugcaaccuccacccuccgaguucaagcgauucuccugccucagccuccuaaguagcugggauuacaggcgccugccaccguucccggcuaauuuuuuguauuuuuaguagagacgggguuucacuaucuuggacaggcuggucuugaacuccugaccucgugauccacccaccucggccucccaaagugcugggauuacaggugugagccaccgcgcccggccguuaggcuguuucuucuauaauuacaugucuauucaugagauguggauguguacuccuuucugugucaucaggaaagaauauagagauuucaucccuuccacuucccaaacaaagaaauauacuaagaacaggaagaacugacacuuuugaucacauaaaaugaccagaaaguuaguucaaaguauaucccaaguaaccaaauauuuuuaaaggacagccagcuacauagacucaaaucuucaucucuuagaaaaauuaaacuucuagacaguccuacuaauuacaauaaagcaguaagacucaaccauauuuuucaucacacuaacagaccaggucaguacaucaaaaagaccaggcaagggggcaggcacugacaauuuaaauacuucauuuuggggaaguacguggagucucaaaacauuaaaaucuauuugauaggcucaggaauccugugacauaacaaggaaagccuucuuauacaaacuagacuuuagcugggcgcgguagcucacaccugcaaucccagcacuuagggaggcugaggugggcagaucaucugaggucggaguuugagaccagccuggccaacauggcaaaacccugucucuacuaaaaauacaaaaauuagucgggagugguggugggugccuguagucccagcuacuugggaggcugaggcaggagaaucccuuaagcccaggaggcagagguugcagugagccaagaucgcaccacugcacuccagccugggcgacaagagcaaaauuccgucucaaaaacaaaguggacuuggucuaaaugaccaccaguucagaauuguguugaccaugaaagcaggccguuuaauuaaacuauuugcuaauuggucugaacaccaagaaucagaaaucucagcaggucugagguucuuuuggguccacuagcaccugcuaguccuucccauggcuggaaagguuugaaaagauaaaaauuacugaaacucuaagggaggcaacucuggaaaaaaugaauguagaacagacauaaacacaaaacacaaccaacaaagaaguuuaaaucaaugguacucacacuugugagauguuguuaaucuaaguguauugcucagugcccccaugcucauuccauugaaaccaagcucaccucucuugguaguuucacuagcauaccaggcacacuauuccucuugccaggaaugcucuucgccagauagccccauggcuuugucacucagucaaaugauucaaaugucccuuccucugggaggccuucccuagcuacauuucaaaucccucaucuaugcucccaacugcccuucccugcacaaaaccguaaaucaagcuuguccaaccugcaaccagugggccacaugcgguccaggacggcuuugaaugcagcccaacacaaauucauaaacuuucuuaaaacauuaugugauuuuuuuuugcaacuuuuuuauuuuagcucaucagcuaucauuagcauuaguguauuuuauguauggcccaagacaaaucucccaauguggcccacggaaaccaaaagauuggacacuccugccuuaaacucaacuggagcccacauuuucucuccccaucacccccaacacagaucugcuucaauaaccacuuuaauaugcuuccagcauacccuuucaaauuauuucaacaaacacaaagccggguacagcagugcgccuguagucccaguuacuuggcaggcugaagcaaggggauugcuugagcccaggaguuugaggauguaguaugcuaugaucgcagcuguaaacagucacugcauuccagccugggcaacacagcgagacaccaucucuuaaaaacaaaaacacagagugucuacuauaugcuuguacuacucuagucaccuggguauaagggaauaaaccaaaucucccccuuuguaaaacuuacauucuaauuggaggagacaacaugagaaagaaauuacauaguaaauauuagggggugauaaguguuaguagaaaaaaaguagaaggaggggaaucaagcaugccaggggcuguaauuugaaaguuagguuacagagggccuuguugaggaagugacauuuaagcaagacgagugagugaggagaaaggaagccauguggguacugggggaaagagcagugcaggcagagagaacagcuacagcaauaucccuggggugggaucauucuugggguguugaaagaagcaugugaaggugaguguggcaggaacacagugaaugaauaguaaaauuagcaggaagugaaaucauagguaacuaguuuucuuguuaccaauucuaacaggcugagaccucauggaucuggucauaauuguauuuauguauaacaguauaguccuucuagauuguaagccuucaaggaacucuucugucuuguucacugcugcauucccacugcuaagcacagugccuggcauacagaagaugcccaauaaauguuugcgugaaugaacaauacaaagaucauuuuuugagugcuuauuaugugcuacacaugggcuuugcaaccccauuucuucagccccagcucugaagaggaggggagaugaguccuuaaguaucauuccaggcagccauggguaaagggagaagaguguuggaaauggugguguuuuuacacacuauccucauggaauggacuuacucugugaggagagagcucuuacgaucaaugaacuugagagcuucugccagugucaacuccaggaaaaaaccauaucccagggccacauagaugcgugaaguaucugggcugaggaaagagagguuagaggaaguggggagaaguccuuaucacuguuuagcauaguuuauguuuugcuccccacccuuccccaaauugaggcucugggaaggcagggauuuuguccuauuuuauucacugucacauccccagcaccuagcuuauauccuacugggauauaaaaccucgcauagugccugguacauagaagauacucaaaaaaauauaaguugcaugagggaagggguaagcugaacccugugggcucagaggggcggguagacacucacaccacugugucaacgaagaaguuacagcccaaauccaccugcauauauaacuccgagugcuuagcuuccuguggggccagggaaaaagagguaggggucaguggugaacucuuaggucaggugacaggguugggucuggagucucucuucccauuucccucccuugcccacacauaccaaaaaaaugguacccaaucccauagucuuuaccuggagucgcucaaugacauuucucaguugaagguauuuggccagcugcucauauaccuugucucgaugguccagcaccuuucugaugggacgaaaguacaauggugaccaauaggcagccccauuccuccuaguauaccucauaucaugacccucugagacucucaugucaccauacacugaaaaggcuuuuuagugcauaaguuaauuuucggcucugggucagacugccuggguuuggaucugggcucuauccuuuauagaugugugacuuuggcaaguaaauaaccuguuugggacucaguuuccccauuuauaaaauacagaugacaguauuaccuuguagagucauuaggauuaaaugagcguuuacuacaaagcaucuagaauaaugcuuaucaaaugguaaacucucuauauacauguuaguuauaauuacuauuauuauacucccaauacugaacuccaaucauaaugucccauccucacccuagaaaaauccuccaucccuuuuaggaugcucauaggccuaguucugaacaccuuauuuccugcuuagauuaacaaagauugcaauaauauuucuucauacucauugaaccucuacuauguuucaggcauccaugcuaaauucuugacaaagaugggacacaucaaaaacucaaaaccacugcauggggaagguuccagaaaacuccccauuucacagaagaguaaaguuuauagggcacagaaaggcgagguaggacguauucacaaggaugaagaauggccgagccaggauucgaacccgagaacuguggcuccagaaaacaagccuuaaucuguuaaacaucggaggccgcgcaugcgcugacacgccccugcuaugaacgccacgucccagccaaacugcaccccggaugucguccccacuucucgcuccaaggagcgcggggccggacucugaacgccucgcccgccaauucaaaggguuggcccuaacuuugaacgccccacccaccacguggaauguuccaaacgccccgccccccgcacugucacucaccgcaagucccgcugcagcacgucacugaugaaggucucguagcgcagcacuuucucccccguggccuccaccgcccgccgcuuagggggcgucgccaugaugggcuccuggggaguggggagggggaagaccauguugaccgauccaguuuggccucacacacaguucaucucuacccucucaacgcugggaaucggcuuguccggcucaagcuggagguucagccuuccgccccucccaacucggggacccgaccacccagggacacccaagcgcggccuuuaccucaggccgccagcaauaagaacgguugguaggaaccgcggcuuccggguggcgcgggugaaugacg

SEQ ID NO: 18943 - RNA, 35048 nt, Homo sapiens
cgucauucacccgcgccacccggaagccgcgguuccuaccaaccguucuuauugcuggcggccugagguaaaggccgcgcuugggugucccuggguggucggguccccgaguugggaggggcggaaggcugaaccuccagcuugagccggacaagccgauucccagcguugagaggguagagaugaacugugugugaggccaaacuggaucggucaacauggucuucccccuccccacuccccaggagcccaucauggcgacgcccccuaagcggcgggcgguggaggccacgggggagaaagugcugcgcuacgagaccuucaucagugacgugcugcagcgggacuugcggugagugacagugcggggggcggggcguuuggaacauuccacgugguggguggggcguucaaaguuagggccaacccuuugaauuggcgggcgaggcguucagaguccggccccgcgcuccuuggagcgagaaguggggacgacauccggggugcaguuuggcugggacguggcguucauagcaggggcgugucagcgcaugcgcggccuccgauguuuaacagauuaaggcuuguuuucuggagccacaguucucggguucgaauccuggcucggccauucuucauccuugugaauacguccuaccucgccuuucugugcccuauaaacuuuacucuucugugaaauggggaguuuucuggaaccuuccccaugcagugguuuugaguuuuugaugugucccaucuuugucaagaauuuagcauggaugccugaaacauaguagagguucaaugaguaugaagaaauauuauugcaaucuuuguuaaucuaagcaggaaauaagguguucagaacuaggccuaugagcauccuaaaagggauggaggauuuuucuagggugaggaugggacauuaugauuggaguucaguauugggaguauaauaauaguaauuauaacuaacauguauauagagaguuuaccauuugauaagcauuauucuagaugcuuuguaguaaacgcucauuuaauccuaaugacucuacaagguaauacugucaucuguauuuuauaaauggggaaacugagucccaaacagguuauuuacuugccaaagucacacaucuauaaaggauagagcccagauccaaacccaggcagucugacccagagccgaaaauuaacuuaugcacuaaaaagccuuuucaguguauggugacaugagagucucagagggucaugauaugagguauacuaggaggaauggggcugccuauuggucaccauuguacuuucgucccaucagaaaggugcuggaccaucgagacaagguauaugagcagcuggccaaauaccuucaacugagaaaugucauugagcgacuccagguaaagacuaugggauuggguaccauuuuuuugguaugugugggcaagggagggaaaugggaagagagacuccagacccaacccugucaccugaccuaagaguucaccacugaccccuaccucuuuuucccuggccccacaggaagcuaagcacucggaguuauauaugcagguggauuugggcuguaacuucuucguugacacaguggugugagugucuacccgccccucugagcccacaggguucagcuuaccccuucccucaugcaacuuauauuuuuuugaguaucuucuauguaccaggcacuaugcgagguuuuauaucccaguaggauauaagcuaggugcuggggaugugacagugaauaaaauaggacaaaaucccugccuucccagagccucaauuuggggaaggguggggagcaaaacauaaacuaugcuaaacagugauaaggacuucuccccacuuccucuaaccucucuuuccucagcccagauacuucacgcaucuauguggcccugggauaugguuuuuuccuggaguugacacuggcagaagcucucaaguucauugaucguaagagcucucuccucacagaguaaguccauuccaugaggauaguguguaaaaacaccaccauuuccaacacucuucucccuuuacccauggcugccuggaaugauacuuaaggacucaucuccccuccucuucagagcuggggcugaagaaaugggguugcaaagcccauguguagcacauaauaagcacucaaaaaaugaucuuuguauuguucauucacgcaaacauuuauugggcaucuucuguaugccaggcacugugcuuagcagugggaaugcagcagugaacaagacagaagaguuccuugaaggcuuacaaucuagaaggacuauacuguuauacauaaauacaauuaugaccagauccaugaggucucagccuguuagaauugguaacaagaaaacuaguuaccuaugauuucacuuccugcuaauuuuacuauucauucacuguguuccugccacacucaccuucacaugcuucuuucaacaccccaagaaugaucccaccccagggauauugcuguagcuguucucucugccugcacugcucuuucccccaguacccacauggcuuccuuucuccucacucacucgucuugcuuaaaugucacuuccucaacaaggcccucuguaaccuaacuuucaaauuacagccccuggcaugcuugauuccccuccuucuacuuuuuuucuacuaacacuuaucacccccuaauauuuacuauguaauuucuuucucauguugucuccuccaauuagaauguaaguuuuacaaagggggagauuugguuuauucccuuauacccaggugacuagaguaguacaagcauauaguagacacucuguguuuuuguuuuuaagagauggugucucgcuguguugcccaggcuggaaugcagugacuguuuacagcugcgaucauagcauacuacauccucaaacuccugggcucaagcaauccccuugcuucagccugccaaguaacugggacuacaggcgcacugcuguacccggcuuuguguuuguugaaauaauuugaaaggguaugcuggaagcauauuaaagugguuauugaagcagaucuguguugggggugauggggagagaaaaugugggcuccaguugaguuuaaggcaggaguguccaaucuuuugguuuccgugggccacauugggagauuugucuugggccauacauaaaauacacuaaugcuaaugauagcugaugagcuaaaauaaaaaaguugcaaaaaaaaaucacauaauguuuuaagaaaguuuaugaauuuguguugggcugcauucaaagccguccuggaccgcauguggcccacugguugcagguuggacaagcuugauuuacgguuuugugcagggaagggcaguugggagcauagaugagggauuugaaauguagcuagggaaggccucccagaggaagggacauuugaaucauuugacugagugacaaagccauggggcuaucuggcgaagagcauuccuggcaagaggaauagugugccugguaugcuagugaaacuaccaagagaggugagcuugguuucaauggaaugagcaugggggcacugagcaauacacuuagauuaacaacaucucacaagugugaguaccauugauuuaaacuucuuuguugguuguguuuuguguuuaugucuguucuacauucauuuuuuccagaguugccucccuuagaguuucaguaauuuuuaucuuuucaaaccuuuccagccaugggaaggacuagcaggugcuaguggacccaaaagaaccucagaccugcugagauuucugauucuugguguucagaccaauuagcaaauaguuuaauuaaacggccugcuuucauggucaacacaauucugaacugguggucauuuagaccaaguccacuuuguuuuugagacggaauuuugcucuugucgcccaggcuggagugcaguggugcgaucuuggcucacugcaaccucugccuccugggcuuaagggauucuccugccucagccucccaaguagcugggacuacaggcacccaccaccacucccgacuaauuuuuguauuuuuaguagagacaggguuuugccauguuggccaggcuggucucaaacuccgaccucagaugaucugcccaccucagccucccuaagugcugggauugcaggugugagcuaccgcgcccagcuaaagucuaguuuguauaagaaggcuuuccuuguuaugucacaggauuccugagccuaucaaauagauuuuaauguuuugagacuccacguacuuccccaaaaugaaguauuuaaauugucagugccugcccccuugccuggucuuuuugauguacugaccuggucuguuagugugaugaaaaauaugguugagucuuacugcuuuauuguaauuaguaggacugucuagaaguuuaauuuuucuaagagaugaagauuugagucuauguagcuggcuguccuuuaaaaauauuugguuacuugggauauacuuugaacuaacuuucuggucauuuuaugugaucaaaagugucaguucuuccuguucuuaguauauuucuuuguuugggaaguggaagggaugaaaucucuauauucuuuccugaugacacagaaaggaguacacauccacaucucaugaauagacauguaauuauagaagaaacagccuaacggccgggcgcgguggcucacaccuguaaucccagcacuuugggaggccgagguggguggaucacgaggucaggaguucaagaccagccuguccaagauagugaaaccccgucucuacuaaaaauacaaaaaauuagccgggaacgguggcaggcgccuguaaucccagcuacuuaggaggcugaggcaggagaaucgcuugaacucggaggguggagguugcagugagccgagaucacgccacugcacuccagccugggcgacacagugagacuccaucucaaaaaaaaaaaaaaaagcauaaccauaugacuauucacacugccuuacauacuaaaucaguaguaauuugcuucucacauagcaaauaaaaauaaaucagcaguaauaaacauaucccuuuuguguuacagcuagcauuuggugaacucuguauuuuucucccuuuuaaaguguugaacucauagguuuucauaagguaagcuuacaccauuaacuaauuuuguucucuuuuuugauguuaaaauugucccuuaggagcugaucagguucauucuucuguucuuuaagcauuacccccagaauauucuugaaaguauucuugcucucuggcaacaacacccauacuucauuuauuuccugucccuaaacauacacucagccaaccucagguuccuuuuaauggaguagucacuuauucauucaacauacguugggugccuccucugugccacacacuguucuggucccuggggauagagcaggaaacaaaaaaaaacaaaaucugcccucauacagcugacauucuagucaggggagacaaacaauaaacaaaugaaugauguaguaugucagauguugacagugcuauggagaaagcauaucauggagaucagaagcauuaccugcaauggaacagucaugauuuuaagaagaauggcugacuggaugugaagugugagagagaggagcccagguuuuuggcugagcaacuggagggauggaguugccauuaucugagauggagaaguuaggggaggaguagauuuggaggggaaggucaggaauuuagucuggaaccuguuaaguaugaggcacuuauuaaacacugaaguggauuuuuagaagaugucauuaaaacuagucaaguucaggagagaguucugggcuagaaauaaaaaugugggagauauugguauauacauggguucauacuacuuuuuuuuccaauuuaacauccuaucuuauugcucucugcuuuuccaacaguauuuaguuucauuuaccccucaaacugacuccuacauugacagcacaauaaaauccacauuccuuauuauauuaagacccugugugaucuaaccucuuccuaucucuuggaccuugucuuaggccacuuucccuccccacucaauuucuaacacucugaccucacugcuucucaaacagcucuuuguugccucuuguccuuuuuguggaaaaggccuuccuacugcuuaaccauuaggcauucuucgauuccuucucauucuucauucuugagaaaggccuuccuugacccuuuauaucaauuaggauucuuuugggcgagaucugauccaaacuggcuuagagaaaaggagucaacugacugguucauguaauucaaccuccuuccucugcugcaaccuucccuuggcucccaucucacuuaaggucaaagccaggguccuuaccauggccuuguaggcuucacacaguuugucucccucauuaccucucugaccucaccucuuacauucccccuucacuuauucuucuccagccagaguggccucuuugcugcaccucaaacaugccaggcacacucccaccucagugccuuuguguuugcugccccuuguguguggaacacauccuccauauagccacacuacucaaaauucacugucuuuaagucuuuacucaaaugcuucuccgugaagccaucccugagcccucuuuaaaauugcagccccccacuccuguacuccuuauugucucucauuuuuaauuuuuguuauuguaguuagaaccaucugacacauagcuuuuauuccauugguuuuuuguuaugucuuucuuuacaagaauuugaaguccaucaggccgggaguuuuguuuguuguguuugcugcuaucucccagugccuaaaauugccuggcauacaguaggcauuuaauaaucuuugaaucagugaaaaccagaugguggcuuggcauuuccacauaggaaugagccagguggaaaucauccaggauauaaguagaucuugaagugauaaggaagggucaucauaaucauguggggcccauuuugcccuuucuuguuucuuuucucuaggcucagcaacagccucaccaaggacuccaugaauaucaaagcccauauccacauguugcuagaggugagagcagcucaccccacuaccagacucuguguuuaggguggugaccugaagaaggaagagagcgaaagaagggaaggaccaucuuucccucuaaacuggagucaagggagggaggucagagcaagccugggggcguaacccagacccagucuuuguucaaucucuucuguccucuuuuucaggggcuuagagaacuacaaggccugcagaauuucccagagaagccucaccauugacuucuuccccccauccucagacauuaaagagccugaaugccuuugagucacauggcccuucuuuuuccccauaaacccugcuaguugccacgggggccuguuccuagggcacaaaguuacugagagacccagagauccagucucucuguggaaccuccaaaaugccccagcaguccugccuccagccuguugccuggcaguauuugccaguugaccuuaugcacugcccucucuucugucaucuuggcaaccugggccccccaccucacccuuucuuccauuccuuuuccuagacgccacccuuugaauugccauagagaaugggccaauucaugguggagguuuguucauucccacaacaaucaaagggcccuaagguuuacgcuuucacacacccaaucauuccccagguaccccaaauuacacccaaacccuaacucagcccuaccuugucuuagccccugcuuguaaguguuccagcuuccaaugggcacagaccuggaucccgcucucccuagucgggccccuauucuagguugaguccagccaccgccaaucaaugcagagccagguuccuccccuuuuuaacucuggccgcaguucaacccugcccucugaaagcauuucguuucugccacucaaugcucuuucgugugccugacagccauccugcccuccuaccuccgcuguguucuaaauucgucuuuacccagcucuauggucuugucuaaccguagagcugcccugcccgccuacgcggagcccaguccgacccacucccgccggcugcuacgcccauuucuauacaagcccugcuuccgcugagcagcauggcgugcgacaccgcccccuugguguuuuggcaggggucuagaagucccucguccgccaaucagagaaaaacagggccacccacccccguccuugggggcugucuuccaucaaucccauguaagccaaucagugugaggcagacccccgcccccccgacacaggccccgagccuuuucaguugcucacaguccgucaguccuugagccaaucggcguggagcaccgugaaggccgaacgcgccuccucgggacuccaggggccgugagcguuccaucauuuccccuuacgccaaucacggcacagcucuguagggaagggcccgucccccaaccccucgaggccuugcggccgauuaauagcgcuuuggccaaucagcgagcggcgggacauugggcuccuccuccucgggcccacgugagcuguagggaaacgcaggggcggcuucuaggugcugccgccgccaccgccaccaccaccuccaccgccgccucggaacccaggccuggggggcgguggggccgcguauggagcccccgccccccggagcugccaacauugccaacgccaccgccacgcuacacacaggugagcucugggccuggaggguggagggcccaguccgugaccccacguauccuucccgcccccgcgcagaggauguggcuuggccgguggccugcugguguucgacuccccgccgccaccaccacggcugguggaccugcguguggcauugcucaagcccuucgucccuuauaguggaucugaccguggccuaaccucccccucccguuguauaauggaucggucugcgugcuuauguuuuuccccacgccaacuuaggguggacucguccauaggcuuucccccuaccccuacccccacccgccccccacccacccccacuuauagggagcuagccugugacaguguucagcccccuuaauaguagguguaucugaguguuuggauuucuccuagccucaacuuucaggagacccguccguggccuuauuuauuccacccuuccuguacaucguagcgaaucaauccguggcgccgcacuccuccgcaucccucuuuaacagugagucuaccugaguuuguauuccugccuccuccagucccccaaugcaucaguccauggcuuuuuucaaaaccaccccccccccccaccaccaccaccaccauuuuauaguggaucagucuucauguuuggauucacgucccuuuagcuaucaguccauugcccugucuccucuuuuucguagacugucgcucuagcgcuugggguucucuccuuuuuaauaguggguuaguuuagugcuuuacaucucccuauuuucaguagcucaguccauagccuuuucccucucugcuuugaaucagucugugugauggcuuuucucuccucucacuguggugcaggagucuguaagguuuucugcuccccuuccccucagacgaugagccucaucaccccucccuuugcaguggaucuguucauuggccuuccucccccacaccccuguaugcuugcacagucccccgcauacccucccgugaguccagugcuuuguaauugggggaagaucggccguguacuuucaauuuccuucucuuuuuuuuucccuucccagaagagaacgugcugauccucuuuuccuugugauggagcacuguacggccuucccuguccuccaccucuuaauagugggucagccuggucacacucguaaccacaaagacguucugccucacuacaauaagugaauacauuagcgccagugaugauaguaaugccaauaggagcuagcguuuauugagcaccugccguauaucaggcagaguguuucauaugaaugaguuccuuuaauccucaccacaaccccaugagauagguagugagggaauugggccauagggagguuaaauuccuuacucaaagguggcccaggaaguacucaggacacaggauaauuuuugaggcuccccucuuagaucucaucccaccccacgugaggccucaguccuuaaaaaccaaauuaguucucaccuccaagcuuuuguucuugcuguucccucugccugcagagcagucuucauuccucaccuucucucagcacccacccaccccccaaucccagcagcugugugaccuuagaugagugauuuaaccacuuccucucugugccuuuuucuucauuugugaaaugggggaucagaacuagaaucccuuccaguguaaauaaauauuaacugugaauuaaugguaaaacaaguaaccuuucuagcauuaccgccuauaccuucccacccccuuacugugcuccaaccacacugguuccaccacacagcuccucaaacauagcaggcaugggccagccucagggccuuugcauuggcuguucuuugugccuugaacaccacccccagaucucugcaugguuccuuucagcacucuguucaaauaccaacccccaaaggauguuuaccacacugugguguguggaaugcaguauaaaaagauacauguaugaaagauguuucuaagaaugccaguuuauauaugaguaaggguuuuccuccuuuucaaaaggauguguucacaagacugagguacguaauaugcucuguaaaggcauagguauaaaagcuguuucuaagagugcuaguuguauaugugaauaaggacuguguuguugcauugaaagaauguguucacaaaacugugguguguagcugggcacaggggugugcacuuauagucccagcuacucgggaggcugaggugggaggauagcuugagcccaggaguuccaggccagccugggcaauauagcgagaucccuuuuucugaaaaaaaaaaacccaaaaaacaaccacugugguguguguaauacacucucuuaaaggcacaggcguaaaagauguuucuaagagugauuugauuuuguuguaccuggguaguguuauuucauuaaagguugauugucacaccaugguacuuagaauauacuauacaaaggcacauguauaaaaaagaaguuccuaacaaugcuacuuguaaaaacaaaaaaagucaaccccucccugaccaucugaagcugcacacccagcagggcucaagccaggucccugauuugucccguugcccuuuaucacugucugacacacuguguggguuacuuguuuguugucugucucuccucauuagaaugugagucccaugaggacucaguuuuugucugcucauucaccgcuaugucuccagcaacugaaaauguaccagguaaacagcagaugcucaauaagaauuuaucccaugaauaaaugggaaaaagauaauuugagacaccaguguaggggucacaugaggaagaagaagggauaugagagcuaauuaguugggacuguuccugcaaccaaccuuuacugagccccuugugaguaccaggcacucuucuaggugcuggaauauggcaaggaacgaaacagggcgaaauauuugugcuuguggagcugacauuuauuaaaaguuggggaggcugggcacgguggcuaacaccaguaauccuagcacuuugggaggcugagguggguggauugccugagcucaggaguucaagaccagccugggcaucacggugaaaccccaucucuacuaaaauacaaaaaaauuagcuggguguggcggcgugcgccuguaaucccaguuacuugggaggcugaggcaggagaauugcuugaacccaggaggcggagguugcagugagccaagauugcaccaugcacuccagcaugggugacagagcgagacucugucucaaaaaaaaaaaaaaaaaaacccaagcuggggagacagacuaugugaacaaaauaaauaaguaaaauuagcauaauagacaaaugcugagaagaaauaaugaaauagggcagguaggaaucgaguauugggggugguugaaaucuuaggcauagggaaggugacucuugaauuagggccucacgguagagacggagagagccuuaaugucuacgggaagagcauaccaggcagaaggaagugccaguucagaggcccugaggugggauggugccugccauguucaaggaacaucaaggcggccaguguggcuggagcagagugcggggaaggguagaaggugaggucacacaggugaugggagccagauagugcaggugauacauaggauaggauugcaggggcagggggagaaggaugacacacuagcuaauagcuaauaucuguggaguaucugccacacaucagaggcacuuuucuguucaaauaccaacccccaaaggauguuuaccacacgguggugccuggaaugcacuacaaaaagauacaugugucaaagauauuucuaagaaugccaguuuauauaugaauaaggauuuuccuccuuuucaaaaggauauguucacaaaacugagguauguaauaugcucuauggaggcacagguauaaaagcuguuucuaagagugcuaguuguauaugugaauaaggacuguguuguugcauugaaagaauguguucacaaaacugugguguauagcugggcacagaggcugaggugggaggaucacuugagcccaggaguuccaggccagccugugcaacauagugagauccccgucuccgaaaaaaaacccaaaaaauaaccacuguggugugcauaauacacucuccuaaaggcacaggcauaaaagauguuucuaagagugauuugauuuucuggcaccuggguaguguuauuucaguaaauauucauuguuaaacacuauggugcuuggaauauacuauacaaaggcacauguauaaaaaagaaguuccuaacaaugcuacuuguaaaaacaaaaaaaaaagucaaccccucaagucuuuuacagaaguauuuuacagaauugacacaguuaauccucacagaagccuuggaggguagguguacuuuugagaauauuugacuuugagaguaaaauauccccauuuuacagaugaggaaacaagcaaagagaggcugaguaacuugcucaggguaaccuugagccagaauagccagaacaggggcagaggaacauaaggcugaagacucagaaagaagaacagauuugcaagggcaggcagguuauuuggcaccuuugaucacgcagaggaagaaugaauucuuccuggaaugcgaugauuguguaauugaguccaugaagugagggaagagcucucccugcggggagagcagcccgugcuuacccucagagguuggaacugucucgggaacgguagauaguucaggguggcugccucagagccuuuguacacgccguucgcuccgccugaaggcccucccccacagagggcagccuggcuugcuaccuccccuccuucaggccaggugucacuuccuuggggaagaacuccuuguacacccuguguaaaaacagcauuccugucacucucuaggaucuuacccuucucuguuucucuucauggagaacuggugguguaaggcgauugcucacuagagccaaaccacuuagguuuugaauuccggcucugccaacuuccagcugugugacuuggggcagguuacuucucuguaccuccauugccucauguggaaaaugggggaaaugauaauccccacccuuuaacggugguuugaggauucaaugaguuaaaugauucaaagagugugcagcccacgguaaggaucguaugccuggcuugcauuuuuaaauuauuaaaauguauucauagcauacccguagaugucugacaggccucugaaacugaccaucuccaaaacuggugugaccccccucaaaacuuacucuccugcaaggcucccaccucagcugaccacaaugcugucuuugugggugauuaggccacaaaccuagacucacccuggacccuucucucaccucccccgggcaugcuaucugucagcaaguccuauucuguguucaggcuuucuccagaccccagcuacuucucgccagccccacugcuaccaccaucaucuaccgcaguggcuucuucagccccaacagucuguucuucucacaaccgccagggggauccuguugaaaucucagucacagccugucaucccucuguucacaacccucuuguggcuccugucucacucaacauccugacagcacccgaaaaagccuggcucagucuggcccccgucacucuguucuccucucccgcugccucccuccucucccccgaacccaugucagccuccucuccccaugucaccugccaggcacucuccagccuugggcccuucacaccggcugccgcuuccaccuggcuugcugcucucagauacucacgagcucaguuccuucaccuccuuuuggucucugcccaguuguccccuccuuggcgacuacucuccccugacucuccauguaaaaguaacagcucuccccugcuugauuuuuuucccauaacccuuaccaccaucugacgcacucuuguacauguuugccuuuuuucucaucugccuuuccugcuaagaugugagcuccucuggagcagggauuguugucuguugcguucucgacuguauccgcagcaccuggcccacaguaugcacucaccaaaugcuugcuaagugaaggagauggaaagaaguaaacauaucuaagcaaggcagauuacuagaacucuuaugaggggucaagugggagaaauaacaaaauacaaagcccugugugcuguugaagcuggaagcccaccgucaccuuucacucagcugauagguucuguugcagcugaaagaagaacugguaaaauugccugucuuugccaccaggagucacucugaacucuuuggacuucugaaacaagccugccugcaaaacaaauucagugaggucucuggugacaggacucucuaaucggacacuucauggcuuugugacuuguauaauugaacaggaagcucauguuuauuuccaguuugcucucaggaaagaaagcaguaauggggugacagggaggauccuguucuuugaaggacaugcugagagggaauagucggugugaggggccguuuagccuaauggugaaaugcuuagucaacuggaaccugacugccuggcuccaaaugcuggcuuugccacauguggccuguggaagguacguagacauuugugccuccgcugccucauuuauaaguuaaugacaggaagacuaccuacuucucagaggcaugaucagggauaaauaagucaaugcccauuaaaaaaaaaaauaacaguacagguguacaugcccuuacccaaaaccccuggggccagauguguuucagaauuuccauuucuucacauuucagaaagguaacaugaugcauauacgauguuacauaacaccccuuaguaagcucuguaaucggcuguguucauauuucugcagcaaaauguaugaacacucgcaauaagugagauucaauaaagaccagaaagggccuuguuucauuucaaaucagguuuugccaccaaaagaguuaaaagaagcuuucugcccuuagagcauuuuggauguuggaauggcagauaagggacuaugaacaaaucagaaacuaauauuuagagcuuaucauacaccucaggcauauaauauuuaaucuguacaauaucucugugaacuagguauuguuauccccauuuuacuaaugggcauaucauuaucccuguuuuacacaugagaaaauugagguacaaagagguuaaagaauaucagccaagcguggugccucaugccuguaauccuagcacuuuaggaggccagggagagaggauugcuugagcccaggaguucaagaacagccugggcaacauagugagaccccauuucuuaaaaaaagaaaaagaauaugcccagggucacacagcuaauaaguggcagaaccaggauucaaacacuggcaaucuggcccuagugccugggcaguuguccagcaggccauauugccucucugcuuagaagagugccugauguguauuaagcucucaauagauguuaauuauugcugucaucaagaaagagaauauucagggccgagcacgguaucucacaccuguaauccuagcacuuugggaagccaaggugggagguggguggaucacuugaggucaggaguucaagaccagucuggccaacauggugaaaccaugucucuacuaaaaauacaaaaauuagccgggcguggucguggguaccuguaaucccagcuaugcgggaggcugaggcaugagaaucgcuugaaccugggaggcagagguugcagugagucaagauugugccacuauacugcgcuccagccugggcaacagagagagacuccaucucaaaaaaaaagaaaaaaaaaaaaagaacgagaacauucagggacaguaacaggacagagagaucaggcauucauucaguuuuaggacggcuucauaaaggaaaggaccuuugggcugggacuugaaagauaagaaagacugcuaggcgaaagaaggaagccccacguggagugagcagccuuugcaagggucuggcaaaaaaaaaaccuccugaaaaacuugacauugauaugguagaagauacagauaauauucaaaugaggaggauggaacuaguuuucuauucuugcuguaacaaauaaucacaaauuuagcugcuuaaaacaacacauuuguuaucuuacaguucuguaggucagaagucccacacuggucucagcugaaaucaagguauuggcaggguugcguuccuucuggaggcucuaggggaaaauccauuuccugcucauucaaguuguuggcagaauccaauuccuugagauuguaggacugaagucccuguuuccuuacugucugucagcugacagccauucccagcuuuaagaggcugcccacaguccuugauucugagccuccuuccuccaucuucaaagccaacaauggcagguugagucccucucacauuuugaaucuccccugccucuucugucaucacaucucugagcuaccuuucuuucuccaucaucugcuuuucagagcucauaugauuagauugaauuucaucaaauaauccagaaauaaucucccugucuuaggguuuguaaccuuaauuucaucugcaaaguuccuuucugcuauguaguguaaauaacauacagguuccgaggauuaggaugcggagcaggguuggcaucauuuggccuaccacagucugcccucugacccccacagauucacauuuguuucacauucaaaauacauucacaccauccuaagauacccaugaguuguaucccaucacagggagcaucccaagcaagacuggggagcuagaaguuagucugggaagguuuagggaaugaugguaggguuugaagacagagauggagaaaagaugacaaaaaaaggaauccuccucccgcugaccucugccccuccuauguccacagccucucaacucagcuguuugcucuccagguaccccugggauggcgugagcacucccccagcgauggacccaucugugacgcuguggcaguuucugcugcagcugcugagagagcaaggcaauggccacaucaucuccuggacuucacgggaugguggugaauucaagcugguggaugcagaggagguggcccggcugugggggcuacgcaagaacaagaccaacaugaauuacgacaagcucagccgggccuugcgguacuacuaugacaagguacagucucucagaccagggcuggaaccccccccugacauuuauaucagagauuuuauuuuguuuuaauugccauagcuaugacuuugaaagcaauguuaaaauuuaucaguuuuuaacccauccauugguacccuaagaccaguauugggccccuaaacacuaucucaccuacuuucuugucuuacugcuuuggcgaaaaccaccacugcauuauuaauacugacucuuucuacucccacucugagauccccaaagugaugcugcccugccaugcacaacguuucauuuuccugccguauuccuauagccaacaucuugaaaacacgguuaauaauggcugguccucauucuguccucugaaaccccuggaccagugcugggcuucccuaguuauuucauagucuucucuuauuccagaauauuucauauuccuagaaucaaaaccucccugacaguauuauaccaacuuuugcuuacuucguccucugggacucccaacauuuuuaacuaauuauuuucuucucuuauuccuuaagcuaaaaccucugaaacaacauguuuaaugccaacuuccacacacugucuucuuaaauucccagaggagcacuggucuaccccaauauuuauaucaauuguuuucauuaucuuauuccuacagcuaaaauuuaaaauuucccccauccugcccucucagacccccaggccacugcuggguuucuccuccccccaauauuuauaccaguuauuucauuuucuuaauccuucuacugaaauuucccaaacaauauucaugaauaucccuuuuuauuccucuuccgagaaacacaggcccacccugugacauaucugaccagcacuaagacuuccacagaaugcccuagugccuccacacucccagaacugcccuggucauaugcugcacacccuucauaguuuauggcauuuauuccauuuucauauuuuauuccuugagcucaacccuccagaacaauauuaguaaugaggcuaucucacucugcccucugggaacacuaggucaucucugagacccaccagaccugaaaaaccccaaacaugcucugugacccagcaaagccagccuugauauaggcccccucccaauauuuauaccaguauuuuuaauauucuugucuaauugcuguuaguuacuucauuuucuuaccauuuuagcuucaaccuccacagugguauuaauaaugaggccuccucacccucuccucugcagugaccuugcccuguuccacuucuguaucauuagcuucaaauaauccucuguauuaauaauucaucaccccauccaucuacauuaauuuacuuucuuccaacauuuauaucaguuacuucauuuucuugucuuauugcauuugcuagucuccaaaacuguguccugacagucacccacaaggccuggcccugugaaccucugguucuuggagccaggaagaagaccugcucccacaccuacugcccuucaugggccccauugugaagaggagcuacaguguggagggagugggaaaaucagauagacggaccuggagagugacaaagggaggcuuggaaagggguggaugggaaggggcuuaaagaaaaaauuauuguggagagaagagagaaaggggaggaacuggggagggauauagauaaggggaaucuggcgggagaggaaagagguagaaaccaaugggagaggaaaugggcugagagagaaacuuacagaggagggacgggaaagccggagaggagcaagugggaagaaagccacuaggagaagagaaaugccacuccaccccccuccuccccccugacacccugccuccagccugccccuuuccucuaaggcccucuguuccucuccucccuuccuagaacaucauccgcaaggugagcggccagaaguucgucuacaaguuuguguccuacccugaggucgcagggugcuccacugaggacugcccgccccagccagaggugucuguuaccuccaccaugccaaauguggccccugcugcuauacaugccgccccaggggacacugucucuggaaagccaggcacacccaagggugcaggaauggcaggcccaggcgguuuggcacgcagcagccggaacgaguacaugcgcucgggccucuauuccaccuucaccauccagucucugcagccgcagccacccccucauccucggccugcuguggugcuccccagugcagcuccugcaggggcagcagcgccccccucggggagcaggagcaccaguccaagccccuuggaggccugucuggaggcugaagaggccggcuugccucugcagguaaggacuggaauauagaaauucaguaagaggaggcaguaaagaggagggauguguaauccccggaugacgagggaggcugguagaagagacauagcugucccguuaaaggagauaaugguggaaggaagacauccucuuagaaggagggguggggcagagagcuacacaaauccugagacagaaaggggagaauacugugcuacaguuaguagcugccgaacauguaggugccuggaauauguuuaaugcacugguucucgcacucuagugcucaucagaaucaccuguaggucuuguuaaaccacagauugccaggcacacccccagaguuucugaauuuguggggcuggggaggggcccaauaauuugcauuuuuaacuuguuaccaaaugaggcagauauugcugguccagaggaagguaaauuuuugagaaccacuguuuuaaugaaugaggaugguaucccucagauuccuacccgcuucagguugucucaccccaaguccccugucccauaggaggaccugccccagaggaagcccuacuuccuugacgaaguccuauguccuguuggaggacuugcucugaugugcagucaugcccugaguaccaagugccaccuucccggggaaaucacuggguggcccacaggagaauccuguggucccaacaauccuuacacacccucuuugugccugcuccucuaccaggucauccugaccccgcccgaggccccaaaccugaaaucggaagagcuuaauguggagccggguuugggccgggcuuugcccccagaagugaaaguagaagggcccaaggaagaguuggaaguugcgggggagagaggguuugugccagaaaccaccaaggccgagccagaagucccuccacaggagggcgugccagcccggcugcccgcgguuguuauggacaccgcagggcaggcgggcggccaugcggcuuccagcccugagaucucccagccgcagaagggccggaagccccgggaccuagagcuuccacucagcccgagccugcuaggugggccgggacccgaacggaccccaggaucgggaaguggcuccggccuccaggcuccggggccggcgcugaccccaucccugcuuccuacgcauacauuggugagugccugcggagggguggggugugugggcgccagcaccaaugggauuggcauguggcgggugacugacaggaaucagaggagggugagugugguuguuccugaagaggguggagccuuugagugugauugacugggcugaugcuggcuggagggaugggguuugauuagugaagggcagggcuggggacuuuugugggugggaccgagggucuuucugugggacuguuucuagguugggguguggcuuaaggaaccugagcagggcuuuuuggucugggaugugcauaugggguuucaugggugggacaugaguuggaaguugacccugagcuguugggauggugacuugagagguuugagagcagcauuuggauagggucuuguggguggucuugaccaaugaggucucagcaacugagggugggcucucgggaguggggaguggggggugucugcagaguuugagagaucauaggcauggccuccaugguuaccaucuaggugugugcacuuuggggagugacccugggagugugagugggaaaucugugguggggccgggaccaagucccuuccagcaucccacaucuacuuucuacucacuugagcuccgaccacccucuccccacagaccccggugcugcugacacccagcucgcugccuccuagcauucacuucuggagcacccugagucccauugcgccccguagcccggccaagcucuccuuccagguaggauccucuuuccccguuuuggacagggugagagacccaagaauggcccccaucugugaccucucccucuuuuugcccccaguuuccauccaguggcagcgcccaggugcacaucccuucuaucagcguggauggccucucgacccccguggugcucuccccagggccccagaagccaugacuacuaccaccaccaccaccaccccuucuggggucacuccauccaugcucucuccagccagccaucucaaggagaaacauaguucaacugaaagacucaugcucugauuguggugggguggggauccuugggaagaauuacucccaagaguaacucucauuaucuccuccacagaaaacacacagcuuccacaacuucucuguuuucugucagucccccaguggccgcccuuacacgucuccuacuucaaugguaggggcgguuuauuuauuuauuuuuugaaggccacugggaggagccugaccuaaccuuuuagggugguuaggacaucucccccaccuccccacuuuuuuccccaagacaagacaaucgaggucuggcuugagaacgaccuuucuuucuuuauuucucagccugcccuuggggagaugagggagcccugucugcguuuuuggaugugaguagaagaguuaguuuguuuuguuuuauuauuccuggccauacucagggguccaggaagaauuuguaccauuuaauggguugggagucuuggccaaggaagaaucacacccuuggaauagaaauuuccaccuccccaaccuuucucucagacagcuuauccuuuucaaccaacuuuuuggccagggaggaaugucccuuuuguucuucccccugagaagccauuccuuugucugccaaccucccugggguccugccuguuuccucccaauggaggguuuuuuuggggggugguccccgucuggggggccccuccagccaguacuccaggucucccugucucucccccgcugccauuuugauaguauaaucuauuuuuaaauggggcuuuucaauaggggagagggagucaucucuuccuauauuugguggggugggugggaaggaagggauuugggggggaaucuuccugccgccucccccacuccaaguguuuauuuuugauaccaaacaugaauuuucaguucccucccucccagccccccaauuuccugcgggcggguacaaaggacccuuucaaugucccuggaguugggagggaggaaugggggacauaaagccuguccugucucuauucuaggcaagagagaguggguucaaaagacuccugggcucaccuguuagcgcuggcccagcccaggccuugggaccuggggguuggugauuugggggacagugcuacacucgucuccacuguuuguuuuacuuccccaaaauggaccuuuuuuuuuucuaaagagucccagagaauggggaauuguuccuguaaauauauauuuuucaaagugaugcuggaggcugcuggcacuuuuucucugauguugucaggacuagcugagcgugacacgcaugacuguguguggagggugugaggcagaggucgauugugagagaaacggugugauggcgugugugagaaacaauaguagggacugcauaucgguaaccaugugugugucagagacguggaaagcugugauugugugugagagugugcagaaguugugaccacagacuuuugauggugugucuaugugggaaauuguggcuguguuucagaaaauaacugagccuggaugaauagucaagguacuguacaagaaccugugaugguaugcacaaaauaaugucuacgagaagggaacggggacugcagcccugucacuguuugauggcgagcaagacagacugggugaccaaaaccacaugugagagacuacgugggcaugaaacuacaguagagguugucagggauuguggcaaagauuguguaggugacaaaccucacuguaggcgacucaacguuugagaaauagaugaugugcaaaacuguuuacuugaggcuguagugucagcuaaagcuguaagacuguaugggugcgaacuugauuguacgggagagaauggcugggagaccaaaccagugaccgagaccaaagauacaagaaggugcaauuguguguacgaaagcaggcgugagagacugcagcaaagacugagaaaaacgaauggcugugacugggagagugugacaggcuguguguguguguguguacaccugaaacuaguugcaaaucgauuuaccauuacuaccacagucuaucccacagguucagggacugugagaaaguaggagagaaaaugacggugagccggacggagccacugacauggugugagagaccacaucacugggcaugcaagggagagggacaaggaacuguuuaugagagacuuggcaguagcaguaacuggaagucagaaacugugggagaggaacuugacaacugagugaugucagagcaccagggggucugugaaacaguucauaagaaaccauaaaucaggggccauacaaaagagcugagcaaaugagacaugccaagugaccacgugacagugugugagaaacuuguaaagcugugcacguguguccgugaugagcugaccauaugaagaaaaugacggugugcacgacugagagggcaugggugacugugggugacuuaucgagggccuaguggugauugugaaauacugaccgaguauaucagaagcugacugagggacagugaugacugagacaguggcugagaaacggauuguguguccauggguaaacccuuugcaagagacuuuaugaaaggcuguaaaucaaggacugaggguacuggaagcugauugagaagaaacgugagacuaggugacgacagugucugagauacugugugauuguguaugcgugugaaugucuuugugggagaggcuguaaucagggaucgugggugugugaaaaaguggcuugagugagaaagggguaggagaggugauuuuugugcaugugugggaaacuucaugagagacuaguuaguggugacuauaaaucagugacuauuuguguaugugagaaaguaacaggccaaaugagugccuaaacguuucaugagauugugugacugcacguguauguaaggaacugacuggugagagaaacuauuggcaauauugacugaaugagacaggcuguuaaacaugauugugugugugaaacuguuaggagacuguaguaaggcuggaauccaugacacagaaaaugacuaugagugacagaaugucugagaggcugugugauuaagagaauauaguagaggcuguaaauccggacugggugcgguggcucaugcuuguaaucccagcacuuugggaggccaaggugggaggaucacuugaggccaggagcuugagaccagccugggccacauggugagaccccgucacuacuaaaaauuuaaaaaauuagcauaacguaguguugugcaccuguaaucccagcuacaugggaggcugaugugggaggacuacuugaggccaggauuuugaguuugagaccaaccugggcaacauagaaggacccugccgcuaccaaaacaaaaaacaaaauuacccagguauaguggugcaugccuguagucccagcuacugaggacacugaguugggaggaucgcuucagcccaggaguuugaguuugagaccagccugggcaauguggcaaaacccugucucuccaaauaguuuaaaaaauuagccagguguggcgugugccuguagucccaguuacucgggaggcugaggugggaggaugguuugagcccaggagguugaggcuguagucugcgaucacgccacugcacuccagccuggguaacagaaccagacccugucucgaaaagaaaagaaagaaaagaaaaacauaacuguguagauagguuuaaaaaaaaaaagagagagagagaaaauaacagaccaaaugagacugugugagaggucuaaugcccugcagacccucgaauguuccaggcccuggagaaaaacccucuucuguuuuuccuguuccuccacaggccccuccugcucaguccgcugggcuggcuucuccuacuucucuaaaacuugaaaugcugggguuccccagggcaaagcccugggauucccuucucucuucucacgcauccucucuaggucaucuuauccaggucuucacacuugaaauacuacuuauccuccaugggaugcccacauuuuuaccucuaacucagacuguccuucuggcauuuuaucguaaucucuaaaguuuuguuuauuucauugauugauucauuuagcagauguuuauugagcauccacuguuuccuggugccuaucuaaugcccugcagacccagcaguuaacaagccagacaaaaaucccugcccuuguggaacugauauuuagggagugagaauaacaagaagcaggcaaauacauaguagcagguagggauguaauaauuaaauaagacaagacucucacucuuuguuuaaggaaucugcagucauuuuauugccuaaacgugugggaaaagauagagugcugacaguccucuuccacagggaauccuaugaguauuuauacaguuuagaaacaaaggaaauauuguuaauauuauuaccagggcaacaggugguuaaauaaagaagccagccagaauuucagguuucuuucuuuuuuuuuuuuuuuuuuuuugggacagagucucacucugucgcccaggcuggagugcaguggcacgaucucagcucacuagagccucugccucccgaguucaagcgauucuccugccucagccucccaaguagcugggauuacaggcauccgccaccacgccuggcuaauuuuuguauuuuuaguagagacggcguuucaccauguugaccaggcuggucucgaacuccugacgucaggugauccaccugccucaaucucccaaaguguugggauuacaggcgugagccaccaugccuggccaguuucaggucucuuggagaguguuuucacaggauaacacagcaaugauugucuugaagucguagaaucuuaauaagacuccuuuguucaaagcacauuuucaaggauagccuuauguuaucagagaacagaguaugucuguaauggauacagauauuaacacauacuuuacugcccauaaaacaaguguuccugaagaacuucuguuuuaacagcugaccaaauuauuacauuugaauuugcagaauuccucugccucccugagagcagaggaaauuaggcauugccuuccuaucuuucuugugcuucuuuuuguuaauuaaaagcaaaauaaaaauuuuaaagugggcccuggaguuucauuaggguuuauaaaaaaaaaauaaaaaaauaaaaaaaaaagaagggcuggugugauggcucaugccuguaaucccagcacuuugggaggcugagguugggagaaaauauugaagccaggaguuugagaccagccugggcaacacaacgagaccccaucuauacagaaaauaaaaacauuaguugugugguggugugugccuguagucccagcuacuuggggacgcuaaggugggaaaaucacuugagcccaggaguuugaggcugcaaugagcuaugaucagaccacugcacuccagcccaggugacagcaagacucugucucuuuaaaacaaaacaaacaaaaaaacagguuuggaagcuacugggcuagagagugacagggaugccagacaaggguauggggaaggccucugugaggaggggcaacauuuguuauccaucuucucgagggccaggauuuuugucuguccuauucucugcucuaaugcuaagaaccgcaucuggcauccaguaggugcucaauaaauguugaauaaauuuaucaaacacagagcaccuacuauaugccaggcacuguucuaaagacuuuccaaaagcuuaacuccuggccgggcacggugacucacgccuguaauccuagcacuuugggaggccaaggcagguggauaaccugaggucaggaguucgagaccagccuggccaacauggugaaacccugucuccacuaaaaauacaaaaauuagcuggacauggugguacacggcuguaaucccagcuacucaggaggcugaggcaggagaauugguugaaaucgggaggcagagguugcagugagccgagaucgugacacugcacgccagccugggcgacggagugagacuccaucucgacaaaacaaacaaaagcuuaacucgcaaucuuugcaacacacccuaccuauguuguaggugcugucugugagcacauuuuacagaggggaaacaggcuccagaagggggguguuaucugccugaggguucucugauggaauauggcccagcuuauucccuccuaaucaccccagacccugguguuguccccagcugggcccauggaacaauggauagaccccauuccccuccugaaucccuccccaggcuccugccacuucccuuucucacuucccuugugcugaccuccccgaccacaagcugaccacagggaaccucucaggaaaggagggccgagguuaagggaggguggaagguggagcaacugacucgaugcucccuccacccccacgagcaggaacauacugagcaccgcacacucacuucacccugguucaacacccccacgagguugaccccgucauuauguuagagauuaugcauuuuccacauagggaaacugaggcucagggguguuaagugacucacccaaggucacacggcuaggaaguugcugcacgcuccuaugcuccauuuccucugggugagaauuuguccuaggagcuucuauugaacacugugagguugcugggaggagcgcgaggugcuggggauauaguaacaaacagaacaagaccaagaguaagacaggaaauggggaggggagaguagagaaggaggcagaggggacaggguggggucaaagcaggaugcccucccaguuccuccugccucuagguuccucuuucccugcugauuccaggagccuaucaacccagauaaagcgggaccuccucucugguagaggugcagggggcaguacucaacaugaucacagagggagcgcaggccccucgauuguugcugccgccgcugcuccugcugcucacccugccagccacaggugagggggugagggcccagcuggccccagggguguccaggcccaccacaucccugaccgagccccacccacccauccccuggcccuguuacaggcucagaccccgugcucugcuucacccaguaugaagaauccuccggcaagugcaagggccuccugggggguggugucagcguggaagacugcugucucaacacugccuuugccuaccagaaacguaguggugggcucugucagccuugcagguuagggggagccuggggugggggaugggggggagggaaggacugucugugggggucacccaaaacugggcacuuucuuucucugggacuuccaaggguggcccugaggcccugaucgugaccauaccucaggguuucucaaccuuguuacuauugacauuuggggcuggaaauucuuggcugggggaggggauugcuuaccuguguauugugggauguuuuguaacaccccuagccuuccacuagaugccaguagcaauucuccccaccagcugugacaaccaaacaugucagcagacauugccaaauguccccugggggucaaaaucaccccugauugagaaccacugacauagcucacacauauugagcaccuccugcacacuggaagcauugcagguggggugcagcuugguauuucccuaauuuugaugacagcucauguuuauugagugcuuacuguauauggacacacugugggggcgggaaaguuuggggaauucaaagggcagcucuaggccccuaauuaugaugacacuucacauucauugagcacucccuguauaccagcugcauggcaggguugggagaugagcuugaggauuucugaggguagcucuagucuccugaucaugauuuccagcuugcauggauugagcccuuaccguaugccagaccuguuuucuacuuguuuacuauauaucccagauacaccgugggcauggggagcuuggggauuuuugagggcagcucugggccccaagucaugucaacaguucaucacaucuauuuggcaugaacagcauaccuagggcuaugcaguggguuggggauagaucugggguuauuucugaggaggccucugaggucauagggaugauggcucagguuuauuaagcacuuucuauuuaccuacuaccguguaguguggugaucugguggguuucugacagcagcccuugguuucuaguccuuaccuuugcuuacugcggaccugguguuggccaugcagccuuccaaugguaacuccagaugccugauugugaagguaaaugacauuaucaagcacuuauuguauauccacugcuucccaucaguaucccaauaucccuaaaagguaaggacuuaucaauccaucgcacacgcacuugccuagcaacccuucgugucugcccacacucuggagucccacaugccauucuuguuagcucaugccaggaugggaugugugugcucuucuccacagguccccacgauggucccugugguccacaugggcccccuguucggugacgugcucugagggcucccagcugcgguaccggcgcugugugggcuggaaugggcagugcucuggaaagguggcaccugggacccuggaguggcagcuccaggccugugaggaccagcagugcuguccuggugaggaggaugagcaaggcgggcaagcacucccugucacccagcacuggugggaacgaucgguacagagguccucagagugggcccguccccaguguuuguaaggaccuaaggaggagaguggugggaggugaggucagagaggugaggaggguccauugccugggggccacagagaggacguuggcuuuucaucugaguaauuuggacugugggcagaggaggaacgugaucugacugggguugggaggagaacagacugugcacggugagggugagaggggaagcggaggcacccaugugaagguugcugcggcaggcccggugagcggggauggugggcccagaaugguggcagaggauauaaggacaggauuagcucauguggggcacucaaggaagcaaagagcccugaaugacaccccaccuccaucccauuacccucucuucucucccacagagaugggcggcuggucuggcugggggcccugggagccuugcucugucaccugcuccaaagggacccggacccgcaggcgagccuguaaucacccugcucccaagugugggggccacugcccaggacaggcacaggaaucagaggccugugacacccagcaggucugccccagugagugagggaagccacaggaugcugaugggugcacccagcgugggucugcgggguuacagcagggaacugccaggcugagaggacuuuagcaugcaugaccacaccugcaucccuccaccucccaccccaccacagcacacggggccugggccaccuggggccccuggacccccugcucagccuccugccacgguggaccccacgaaccuaaggagacacgaagccgcaaguguucugcaccugagcccucccagaaaccuccugggaagcccugcccggggcuagccuacgagcagcggaggugcaccggccugccacccugcccagguacaccaggaugaggcugcugauguugcugguggggcucuugauugagggcagagaugcucugccauuucuagaguuccuaggccaugugaccaugcagcccuucauuuggggacagucugcuucaagggucuaggggcugagaggaaggauugaggaggccuuucuccucacucccuuuccuccuccaacaguggcugggggcugggggccuuggggcccugugagccccugcccugugaccuguggccugggccagaccauggaacaacggacgugcaaucacccugugccccagcaugggggccccuucugugcuggcgaugccacccggacccacaucugcaacacagcugugcccugcccuggucagcaucucaggguucacgauuugcaugccuaagucccccuugcccuucucugcugcccagcuccugcugcugaggccuuguuccugucucugauuccuccuuuccuggcccugauaccuuguuuccaccccuggucccccauucacacaucugaucaccucuacucccuccuaccgcccucauuccuuccucugaacccccuugcugauucccugcuuugguccaauccccuguugcccugucucugcaguggauggggagugggacucguggggggaguggagccccuguauccgacggaacaugaaguccaucagcugucaagaaaucccgggccagcagucacgcgggaggaccugcaggggccgcaaguuugacggacaucgaugugccgggcaacagcaggauauccggcacugcuacagcauccagcacugccccugugagugucccacagacugugcucugagggugggguggcccaugcaggauaagggguuuccaacucucugcuguggaccucacgucucugcagccucccucucacuuucccaccaagaccuccaguucugacucugugaccccuaccccucauugcagugaaaggaucauggucagaguggaguaccugggggcugugcaugccccccuguggaccuaauccuacccgugcccgccagcgccucugcacacccuugcuccccaaguacccgugagugagagggcaaaguaugccugggagggggucauuauauuacaggcgggagagucggcuaccccaggaaaccaggguuuccacugcugaaucuaagguaucugccuugccgagugccaccucccagcugcaggaaguggggagaaacuaagaagaugagaaagaaguucuuggaggauaauucguagccucugugccccucagucaccuguucagucacucauccacuuaguccuucaugugucauugacuccgaccuucaguuacccaugcuuuuagcugccaucacucaggccuccauucacugccugccucccacagucacucaugccuccauccacuuugucagcaucucacugagccaaggcacuccaaggcuuuuucagcaacaguugcagauacacacagcccagauccuguggauccuccaagggacccagcugagcaagccccugacaggaggcauaugaggaacagcuggugcaugcaacaggugcugccaccucaaccuagguccaggaagcugacugggccucccagggcagguagggguugggaaaggcauuccuggcaucaagacugugaacggagccuuggagcuaggugauuagccgcuauaaguguuuccaggugccagaggggcccagguguuagagaggguuaaaauguucaucccuuuucuuccuuccacauacaucaagcuacuagauuaagugaacuauucccagcucguggaagggcugccaucugggaagggaucucccggcugaggggguuagaguggggccugaagauuagagguguugaauggaggcacaaaggacuugagugagcgagagacugaguggaggaagaagcaauugagagaacugggaugggagugaauggagggcuuuccuagugggacaaauaacccagguaaagaccuuucuggacagggacugagcuugaauaaaguggaggagacagagagagagauuggcuuggggcagggauuugggcccaacaauaaggccuugaaugucaggacaaggcauuggguuuuuuccuggaggcaguggaaagagauauaaaggguauauauuucggagguaaaagaaaguagcucaugccaacaaguaacauucaccagcauuuauugagcacuugcugugugccaggcacugcucugagcacuuuaccugaauuaacucauuuauccucauucaaccccgugaggugaguauuaauauuacuauuccuaccauucucauuuugcagaugagggaaaccgaggcacagagaagcuaaagaaauugcccaauauccuauagcuaaaaaguaguguugggaggccaggcacaguggcucacgccuguaaucccagcaacacuuugggaggcugaggcaggagcaucacuugagcccaggagauugaggcugcagugagcuaugauugugccacugcacugcagccugggcaacagagugagacccugccucaaaaaaaaaaaaggaaaaaaaaaaaaaaaaaaaguagcccucggcauauagcaggcacucaauaagaauugaaugcauucuugccuucccugagauucucccuuccguuccuccccaccccuaaugccucaggcccaccguuuccauggucgaaggucagggcgagaagaacgugaccuucugggggagaccgcugccacggugugaggagcuacaagggcagaagcuggugguggaggagaaacgaccaugucuacacgugccugcuugcaaagacccugaggaagaggaacucuaacacuucucuccuccacucugagcccccugaccuuccaaaccucaauaaacuagccucuucgaguucgucuacgauuccuuaaaggaggaaaaacaaccuauccccuuccccaaaaguagggugauagcaucucauagggca

SEQ ID NO: 18944 - RNA, 1001 nt, Homo sapiens
gcagucggcucgaguacucccaguaacgaggagguguucucggucgucccacccuccccugccgucgccgggcugcgccgccggagccgggacgcgccuccgcugcccucgccuccuccguccccgcugcccucgccgcccccguccccgcugcccucgccgccuccguccccgcggccgccgcuccccucgucguccgcgcgcacacgaugaagaaggagucccucaaccagagccucgccgaguggaagcucuucaucuacaacccgaccaccggagaguuccuguggcgcaccgccaagagcugggguuugaucuugcucuucuaccuaauuuuuuauggguuccuggcugcacucuucucauucacgauguggguuaugcuucagacucaacgaugagguuccaaaauaccgugaccagauucuuaacccaggacugaugguuuuuccaaaaccagucacugcauuggaauaugcauucaguaggucugaucuaacuucguaugcaggguacacugaagaccuuaagaaguuucuaaaaccauauacuuuagaagaacagaaaaaccucacagucuguccugauggagcacuuuuugaacagaaggguccaguuuauguugcuugucaaucucccauuucguuacuucaagcaugccgugguaugaaugaucuugauuucggcuauucucaaagaaacccuuguauucuugugaaaaugaacagaauaauuggauuaaagucugaaggagugccaaggauagauuguguuucgaagaaugaagauauaccaaauguagcaguuuauccucauaauggaauuauagacuuaaaauauuucccauauuauggggaaaaacugcaugugggguaucuacagccauugguugcuguucaggucagcuuugcuccuaacgauacugggaaagaaguaacaguugaaugcaagauugauggaucagccaaccuuaaaagucaggaugaucgugacaaguuuuu

SEQ ID NO: 18945 - RNA, 11500 nt, Homo sapiens
cuguuggguuccugagucgugcugcgucgacaacgguagugacgcguauugccuggaggauggcggacgccggcauucgccgcgugguucccagcgaccuguauccccucgugcucggcuuccugcgcgauaaccaacucucagagguggccaauaaguucgccaaagcgacaggagcugugaguuccgggcuuggggcggggaccgggcugagaugaccacaaggcuucaggcccugacgugcuuagguuuccagguggggaagucuggggguccgccaguccagugucugcaaggccuuuacgccgaccccucggcagugaccagagaaagccugcggccucggucgcuuaccuuccuccaugucugaguagauaucgcugagucuuguugcuuuuuucuugugaccugugcagcggcggcagcgugggagccucguggccccaagccacauggcuggcagagugcagcggggagguagagucuuguuccacugaggacguugguucuucggcaucuucuggggggcuuuucguugggugaggcaaaccgugauuugaccuuagccucagucacauuuacugggauucaaaagcaagugaaauuucuuuagaaugaagucugggauuuucguuuguaaagaagaaaaugaaugaaaguagaagcagaguuuuguuuugaguuacacugagaauugagagucaucaacagcccuaccaaguaggcauaguagugggcuuggagcuuuggcuaauugaaucaaacaaaccuagguuugggaccaggcucugccacuuuuuagauacgugacccgggcaguuuauuuaaccuuucugagucuuucuacagggaugucaucauccacuuuauaggauuuuugugaguuucaguaagaugauguguaagaguagcaaucucagugcugguacagaggaaucuuguaaaagugaaagcuguaccauaguuauggcaauuuaggaugcuccaaacacauguaagaguaagagaaccaggaaugugaaagguuuguaaucuacaucaacggacauuccugcaugggaagacacuuugagagaggagagagggggggucuucagcagggaugauagcaugacuaggaaggauggcuugcacuuuuagcagaaucaggcugcgaaagcaaagaaucagaucagccucaaaacuuccuuaagcugggacaggcugccaugugaucuaacugcuuucuuaaugaaacuguuuagaguugacuguuaaggagacugcggagagugcuuucacaguggacuggauggaauuggacauuucagaauuaggauucuuuuuuuuuuuuuuuuuuuuuugagacggagucucuguugcccaggcuggagugcaauggugcgaucucggcucauuguaaccuccgccucccaaguucaagugauuauccugccucagccuccccaguagcugggauuacaggcgcguaccaccacgcccggcuaauuuuuguauuuuuaguagagaugagguuucaccauguuggccaggcuggucuugaacuccugaccucaagaaauccacuugccucagccucucaaagugcugggauuacaggcgcgagccaccgugcccggccucaggauuaggauucugaaaugguuuuaugugagaaaagcuaaucuuugugaagagcuaacuaagggucagaugcuacgcccuucacaugcauuuaauuuuuuuuuuuuuuuuuuuugaggcggagucuggcucugucgcccaggcuggagugcaguggcacgaucucagcucacugcaaccucugccucucaggcuaaagugauucuccugccucagcuucccaaguagcugggacuacaggugugccccaccaugccuggcuaauuuuuuuuuuuuuuuuuuguauuuuuaguagagacgggguuucaccauguuggccaggcugcucuugaacuccugaccucaagaaucuacugccucggcuucccaaagugcugggauuacaggugugagccaccgcacccggccaacaugcauuaugucuuauccucucaauaacuuaaugagauguguaguauuaucuccauuuuauagaaaagaaaauaaucucagggagauaagguaauuuguccaaaggugaguucccaucuguacugacucugaucauuuacucuuuuuuggaccacagagucucacuguugcccaggcgggagugcaguggugcaaucucagcucacugcaaccuuugccucccagguugaagcgauucuugugccucagccucaugccucagccucccaaauagcugggauuacaggcgcccgccuccacgcccagcuuauguuuguaucuuuaguagagaugggguuucaccauaccagccaggcuggucucaaauuccugaucaggugauccacccaccucagccucccaaaguguugggauuacaggcccgugagccacugcaccuggccugauccuguacucuucuguguauuguuuuguguuuguuuguuucuuuuagagggucucacucugucgcccaggcuggaguaaagugaugcaaucauacuucgcuguagcaucgaacuccugggcucaggcaauccuccugccucagucacugggguagcuaggacuacagacauguaccaccacaccuggcuaauuuuuuuuuuuuuuuuuuugugacaguuucgcucuuguugcccaggcuggagugcaauggugcaaucucggcucaccacaaccuccaccuccuggguucaagcgauucuccugccuuagccuccugaguagcugggauuauuacaggcaugcgccaccacgcccagcuaauuuuguauuuuuaguagagacgggguuucuccauguuggucaggcuggucucgaacucccgaucucagaugauccacccgccucagccucacaaaguguugggauuacaggcguuuagccaccacaggccaagcaaccgcagugccauugcaauccaaccugggcgaccaagagcgaaauuccauuucaaaaaaaaaaaaagagagagagagagagauggaggucucacugucuugcccaggcuggucuugaacuccuguccuuaagugauccuccugccuuggccugccaaaguguuagcguaccugcgcccggccugaaugcauuuuuuuuuuuuuuugagacuuacucugucgcccaggcuggaguacaauggugugauacuggcucacugcaaccucagccuccuggguuaaagcgauucuccugccucagccuccugaguagcugggauuacaggugugcaccaccaugcccaguuaauuuuuuguguuucugguagaaaugggguuucaccauguuggccaggcuggucucaaacuccugacaucaugaucugccuaccucgaccucccauagugcugggauuacagcagaccugagccaccgugccuggcccuuaaaugcaguucuuuacauucaauacaguacuuacuagucuuguuucuuucuuuuuuuuuuugagacagagucuuggucugucgcacaggcuggagugcaguggcgcgaucucagcuuacugcacccuccgccucugggguucaaacgauucuucugccucagccucccgaguaccugggauuacaggcgccugccaccacacccggcuaagagacaggguuucuccauguuggccaggcuggucuugaacuccuggccucaggcgaucugcccgccuuggccucccagaguguugggauuauaggcgugagccacugcaucccgccuggaggcuuauuucuaaugauuugguauuauaauccacauugcaggaaaaaccuucuuguauuaguguuuguacccucaaguaauggauaagauuacauucuuagauaguacauugcuagaguaaagagagagccuuuuuuuuggcagagggguagagaugggggucuugcuauguugcuuaggcuggucuugaacuccuggcauccagugauccuccugucucagcuucccaaagugcugagauaacaugagauaacaggcauaagccacugugcccagucaaaagugauuuuuuuuuuuuuuugaaauggagucuugcucuuguugcucaggcuggagugcaguggcgcgaucuccuagguucaagugauucuccugcuucagccuucuagguucaagcaauucuccugcuucagccucccaaguagcugggacuacagacaucugccaucaugcugggcuaauuuuuguuuuaguagagaugggguuucaccauguuggccaggcuggucuugaacuccugaccucuugaucugccugccucggccucccaaagugcugggauuacaagcaugagccaccgugacuggcugauuuuuuguuuuguuuuguuuuaggacuuugaucaauauagauuggcaggcaggggguuagaugguuagauggugccgcaaacauaggaguagcccguuuuuuacaucagaaauugggaaauccacaaauagaauauuuuucuccugauuuaugcacguagcaaaaguuuuaugaagauguaacauuuauaccaaauuuaguaauuauguauguaacaggccacauuuaaugaaagcauaaccaggauaaaauaauuuccuuacccagcucuuuuucuucuacagacacagcaggaugccaaugccucuucccucuuagacaucuauagcuucuggcucaaguaagccuuuccuguuccauuuuggcuauuuucucccccaagauaggcugggcuguguuucuugguuugggaagauuccaguccccuagaaauugguccaaucuaccucagcaggucugccaaggucccagagcgaaaguuacaggcaaauggaccaguggcuaagaaagcuaagaagaaggccucauccagugacagugaggacagcagcgaggaggaggaggaaguucaagggccuccagcaaagaaggcugguaaggcagaguagcaggugggcuugguggugccaggaaaagaauuuacagccugcuuguuucacauggcugauucuuacugggaccuguguguuuguucagcuguaccugccaagcgagucggucugccuccugggaaggcugcagccaaagcaucagagaguagcagcagugaagaguccagugaugaugaugaugaggaggaccaaaagaaacagccuguccagguuugcagcuuugggaagaaaaagggguuuaaggauuagaaaggaagaaaccuaaaaucuuggccucuagcuuguaaccaaggggugauggcggcaauacaauaggugauuaugaggaagaaaaucuggggauuuucagggagcugauaaaaguaugaggucuggaagggaugugugagguugaggucaggcuccgaaucuagaggaaauuaaacccauucugcuugaggaguuuggguucuucugggacacuauucagggcuccaagaauaagagagaguguuuuccugggagcuuuggcaggauaaggcaggaacagggccaguguaucaaguggcugaacuuuguuguuuuuugcccuuuccguauccuguccuuagcuuucuuuugcucuuacugcuccauuaggccccuaaaaauaaaaggaaccuaggaugcccuuuggguacccggaagcuuuugcugauuucucuccuugugucuuuucuaacagaagggaguuaagccccaagccaaggcagccaaagcuccuccuaagaaggccaagagcucugauucugauucugacucaagcuccgaggaugagccaccaaagaaccagaagccaaagauaacaccugugacaguuaaagcucagacuaaagccccucccaaaccagguacuguuucuguucccaagaggcugggcuggggaccagauugcucuggggacuggaguuaaaauugccgauuuggcacaggggugaaaugguacuguuuguugaacuggagguguugauuacuggucuuuuaauuuuaaagguuuuacuaauaaauaacaagauuucauaggagcuaguaaauagagaaaguuauugcagcaagaaaaaauguguauuuuuuuuaaugguauccauuugguauuuugugacauuucauagacauuuuauguuuucacacaucccauuccacuguaaucacuuaaauaucuauuuguugugcuuuucacugccauuuuuacucuuguauguucauucuaugagacaaaugagaauuuuucuuuuuuucuguaacuugugaugaggguuagguuauuucucugaauggagguugaagugaaagauuuuagagggcguauugagauuauuuaugucaucuuuucuaagaagacaguuuuauuccugccaugggauaggaaagguauccuuugaugugguaaaccauggcuggcauucuccucgauggcugcucuaaaguugaaagaauugguggacuccuggccaggcacaguggcucacaccuauaaucccagcacuuugggaggcugaggcgggcggauugcuugaggucaggaguucaagaccagccuggccaacauggcgaaacccugugucuacuaaaaauauaaaaauuagcugggcaugguggugggcaccuguaaucccagcuacuccagaggcugaggcgggagaguugccugaaccacugcacacuagccugugcaacagagccagagccagacuccgucuccaaaaaaaaaaaaaaaaaaaaaaaaaaaaaugguggacuccuaaguucucugcucauaggaaggagguuuuucaugguccugacuugcccuaauacuccuuacucuuucuuuuucuuggguauuccagcucgagcagcaccuaaaauagccaaugguaaagcagccaguagcagcaguagcagcagcagcagcaguagcagugaugacucagaggaggagaaggcagcagccacccccaagaaggucuggaccauaacuucugucagggcagaggugaccagggugugaugugugugugucuuccuucccuggcaggauugguugggucagcauuuuccugugguaaucaauuuucuuucuaaugcagacuguaccuaaaaagcaaguuguggccaaggccccagugaaagcagcuaccaccccuacccggaagaguucuagcagugaggauuccuccagugacgaggaagaggagcaaaaaaaacccaugaaaaauaaaccaggugacuggacauggggagcgaagcugugugacuguggucagggcccagcugcaguaaccacauggaccucuccauagaggugcaugagcguccucaugacaugacagcuagcuucuccgagcacuagugauccaggaaagcaaggagaaaucuccagugccuuguguaaccuagacucagaggugacaccauguucuguuagaacugagucauugauucuggcccauacucaagugaaggggaauuaagcuucauuucuacaagaaaguaguaucaaaaaaaguuguagacauauccuaaaaccaucacacuauccuuuuuaaacaggucccuacaguucaguccccccgccuucugcucccccaccaaagaagucucugggaacccagccucccaagaaggcuguggagaagcagcagccuguggaaagcagugaagacagcagugaugagucuggugagucagagggaugcagccuccccucagcgugggucuggaggaggggaugaggaauaagggagagagaaagccuuccauccuucgguugcuuuuugcuuaaagcaagacagagcuaaggcucugugcgugucuuugcauucuuuuuauugcuguccugguuggguugggacucuggacccagcauaaugcuacagguucuccucagauucaaguucugaagaagagaagaaacccccaacuaaggcaguagucucuaaagcaaccacuaaaccaccuccagcaaagaaagcagcagagagcucuucagacagcucagguaaggcauauggaggcccucaguucagugagaugcucucaggcagcugcuaagggcuccccugaauccaauuuggggagcuguugauuccaucccuucugugucuagacucugacagcucugaggaugaugaagcuccuucuaagccagcugguaccaccaagaauucuucaaauaagccagcugucaccaccaagucaccugcagugaagccagcugcagcccccaagcaaccugugggcgguggccagaagcuucugacgagaaaggcugacagcagcuccagugaggaagagagcagcuccagugaggaggagaagacaaagaagaugguggccaccacuaagcccaaggcgacugccaaagcagcucuaucucugccugccaagcaggcuccucaggguaguagggacagcagcucugauucagacagcuccagcagugaggaggaggaagagaagacaucuaagucugcaguuaagaagaagccacagaagguagcaggaggugcagccccuuccaagccagccucugcaaagaaaggaaaggcugagagcagcaacaguucuucuucugaugacuccagugaggaagaggaagagaagcucaagggcaagggcucuccaagaccacaagcccccaaggccaauggcaccucugcacugacugcccagaauggaaaagcagcuaagaacagugaggaggaggaagaagaaaagaaaaaggcggcagugguaguuuccaaaucaggucuguacccaaugaacaugcccucuggguuuuguccccccaaaucaggaugggauauacucuuugagaguaggguagugagaggaggcccaccacugggcuuccaguuguggaaacugggaggaagaacaggaaacugguuaccuuuuuuuuuuuuuauuagagucucacugugucacccagaccagggugcaauggcaugaucacggcuugugcagccuuaaccucauggacucaggugaucuuuccaccccagccuccugaguagccgggacuacaagcaugcaccaccaugucuggcucauuuuuuuaacuuuuuauagagacagaaucucacuauauugcccaggcugaucugaauuuccugggcucaagcgauccuccuaccuuggacucccaaaaugcugggguuacaguugugagccacuguacucggccugagucuggcuuuuuguuuuguagguucauuaaagaagcggaagcagaaugaggcugccaaggaggcagagacuccucaggccaagaagauaaagcuucagaccccuaacacauuuccaaaaaggaagaaaguaaguugucucacuuucuucucaggagccagcucuuuaaaaguagaaaaaucuaggaucaucuugacagcucugccuggcgugaccugguacaugugcccauguguaucacucaggagaacuguuacaugaccacucugucuuuaauuuccuacuucauucuucuguagggagaaaaaagggcaucauccccauuccgaagggucagggaggaggaaauugagguggauucacgaguugcggacaacuccuuugaugccaaggugagagagagaucugugccauucuugggagggaggauggguagugucagagaggacaauucuugguucagguuggugggaaucuucucuggguucagguuuccuugagcagggaguagaaagaauaaagugacagggcuccagcaugguccuccucuguguuaaucucccucucuacuuaccagcgaggugcagccggagacuggggagagcgagccaaucagguuuugaaguucaccaaaggcaaguccuuucggcaugagaaaaccaagaagaagcggggcagcuaccggggaggcucaaucucuguccaggucaauucuauuaaguuugacagcgagugaccugaggccaucuucggugaagcaagggugaugaucggagacuacuuacuuucuccaguggaccugggaacccucaggucucuaggugagggucuugaugaggacagaaguuuagaguagguccuaagacuuuacaguguaacauccucucugguccuuuucuguguuccuaguuuuguacagacuuguuuuugaguguugaguagcagggacaaaauaagggaauguuauuuuuuaagaaaauucauuuucauuguugucuccuuccuuuucugugaaaguccucauacugagaaauuuguauauuuuauauuaaaucacuuacuauugauuuuuguugugauuuucaaagguggauucccacagauaaaaucuuggcuauugcccaaaacauaguaaagggucacgugugacuuuuuauaauaggaagaaaauucugccuuugugagugcacauguccacauuucaucccuccuucccucaaaacccuagagaggggcauuaaagaauuguugauguauaugcaaugucuguuaagcaugcacuauguauuucauccucauuuauugggucugggacugaaguuuuuagccagcauggaccuaaccuacuuuuugggauaaaauucucuguuuuguuacaggcaaaauucugguauggcgugaaugccaugggucauucugaauauauuuuuuucuguaauuuuaucauuacacgauguuugcaauacgugcuuuguuuuuuaauuugaaagcaaacuuuucuacuguugaaagacauuuuuugacaacuugacccuuccuaguauugaguucuaaguugaggacugcaucuucucguuuuuuacaguauagagaacaaaaugacaugaguuugaaaaauacauaucacuugguauugcugucuugguugcaguggugauacagaauugguuucauuaauuccuacaugguugagaaucacugaucaagaaaguggggggaaaaaaaacaaacguuaaaaccucaauccucaguaggaagguagauuacauuaggugaaauuauagguaaucuauguaugugcuaaugggguuggaaagaaccuuacagagcauauuaccugauaaacuggaguggguuugggagaacaaacuaauaggauuauugugucuccuaguugguaccugggagcaauugacaugcccccuucagaaccuuaacuguuaguagcaguggcuguaacaacacaaaccagugaccagagauaacagcuuuuaggccaagcuggccugacgguauggcugcaggaagugacugagcaguagcgguacucagccagaccaagacggagagggaagaguccacagcuuucuggaagcuaaggcauucuggugguagaaaagugugccccaagccuucauggacgaguuauaggucuuaagauuagucuccucuuguuuggauuccauacuugcuaaauaaccugauaauaaccugguuuuccauguaacugccucuaggaagaaaauguacuguucaugcugacacagauauuucagucugcaugguaaaaguucuaaaucuuacuacaaaauaauaaa

SEQ ID NO: 18946 - RNA, 11500 nt, Homo sapiens
uuuauuauuuuguaguaagauuuagaacuuuuaccaugcagacugaaauaucugugucagcaugaacaguacauuuucuuccuagaggcaguuacauggaaaaccagguuauuaucagguuauuuagcaaguauggaauccaaacaagaggagacuaaucuuaagaccuauaacucguccaugaaggcuuggggcacacuuuucuaccaccagaaugccuuagcuuccagaaagcuguggacucuucccucuccgucuuggucuggcugaguaccgcuacugcucagucacuuccugcagccauaccgucaggccagcuuggccuaaaagcuguuaucucuggucacugguuuguguuguuacagccacugcuacuaacaguuaagguucugaagggggcaugucaauugcucccagguaccaacuaggagacacaauaauccuauuaguuuguucucccaaacccacuccaguuuaucagguaauaugcucuguaagguucuuuccaaccccauuagcacauacauagauuaccuauaauuucaccuaauguaaucuaccuuccuacugaggauugagguuuuaacguuuguuuuuuuuccccccacuuucuugaucagugauucucaaccauguaggaauuaaugaaaccaauucuguaucaccacugcaaccaagacagcaauaccaagugauauguauuuuucaaacucaugucauuuuguucucuauacuguaaaaaacgagaagaugcaguccucaacuuagaacucaauacuaggaagggucaaguugucaaaaaaugucuuucaacaguagaaaaguuugcuuucaaauuaaaaaacaaagcacguauugcaaacaucguguaaugauaaaauuacagaaaaaaauauauucagaaugacccauggcauucacgccauaccagaauuuugccuguaacaaaacagagaauuuuaucccaaaaaguagguuagguccaugcuggcuaaaaacuucagucccagacccaauaaaugaggaugaaauacauagugcaugcuuaacagacauugcauauacaucaacaauucuuuaaugccccucucuaggguuuugagggaaggagggaugaaauguggacaugugcacucacaaaggcagaauuuucuuccuauuauaaaaagucacacgugacccuuuacuauguuuugggcaauagccaagauuuuaucugugggaauccaccuuugaaaaucacaacaaaaaucaauaguaagugauuuaauauaaaauauacaaauuucucaguaugaggacuuucacagaaaaggaaggagacaacaaugaaaaugaauuuucuuaaaaaauaacauucccuuauuuugucccugcuacucaacacucaaaaacaagucuguacaaaacuaggaacacagaaaaggaccagagaggauguuacacuguaaagucuuaggaccuacucuaaacuucuguccucaucaagacccucaccuagagaccugaggguucccagguccacuggagaaaguaaguagucuccgaucaucacccuugcuucaccgaagauggccucaggucacucgcugucaaacuuaauagaauugaccuggacagagauugagccuccccgguagcugccccgcuucuucuugguuuucucaugccgaaaggacuugccuuuggugaacuucaaaaccugauuggcucgcucuccccagucuccggcugcaccucgcugguaaguagagagggagauuaacacagaggaggaccaugcuggagcccugucacuuuauucuuucuacucccugcucaaggaaaccugaacccagagaagauucccaccaaccugaaccaagaauuguccucucugacacuacccauccucccucccaagaauggcacagaucucucucucaccuuggcaucaaaggaguuguccgcaacucgugaauccaccucaauuuccuccucccugacccuucggaauggggaugaugcccuuuuuucucccuacagaagaaugaaguaggaaauuaaagacagaguggucauguaacaguucuccugagugauacacaugggcacauguaccaggucacgccaggcagagcugucaagaugauccuagauuuuucuacuuuuaaagagcuggcuccugagaagaaagugagacaacuuacuuucuuccuuuuuggaaauguguuaggggucugaagcuuuaucuucuuggccugaggagucucugccuccuuggcagccucauucugcuuccgcuucuuuaaugaaccuacaaaacaaaaagccagacucaggccgaguacaguggcucacaacuguaaccccagcauuuugggaguccaagguaggaggaucgcuugagcccaggaaauucagaucagccugggcaauauagugagauucugucucuauaaaaaguuaaaaaaaugagccagacaugguggugcaugcuuguagucccggcuacucaggaggcugggguggaaagaucaccugaguccaugagguuaaggcugcacaagccgugaucaugccauugcacccuggucugggugacacagugagacucuaauaaaaaaaaaaaaagguaaccaguuuccuguucuuccucccaguuuccacaacuggaagcccaguggugggccuccucucacuacccuacucucaaagaguauaucccauccugauuuggggggacaaaacccagagggcauguucauuggguacagaccugauuuggaaacuaccacugccgccuuuuucuuuucuucuuccuccuccucacuguucuuagcugcuuuuccauucugggcagucagugcagaggugccauuggccuugggggcuuguggucuuggagagcccuugcccuugagcuucucuuccucuuccucacuggagucaucagaagaagaacuguugcugcucucagccuuuccuuucuuugcagaggcuggcuuggaaggggcugcaccuccugcuaccuucuguggcuucuucuuaacugcagacuuagaugucuucucuuccuccuccucacugcuggagcugucugaaucagagcugcugucccuacuacccugaggagccugcuuggcaggcagagauagagcugcuuuggcagucgccuugggcuuagugguggccaccaucuucuuugucuucuccuccucacuggagcugcucucuuccucacuggagcugcugucagccuuucucgucagaagcuucuggccaccgcccacagguugcuugggggcugcagcuggcuucacugcaggugacuugguggugacagcuggcuuauuugaagaauucuuggugguaccagcuggcuuagaaggagcuucaucauccucagagcugucagagucuagacacagaagggauggaaucaacagcuccccaaauuggauucaggggagcccuuagcagcugccugagagcaucucacugaacugagggccuccauaugccuuaccugagcugucugaagagcucucugcugcuuucuuugcuggaggugguuuagugguugcuuuagagacuacugccuuaguuggggguuucuucucuucuucagaacuugaaucugaggagaaccuguagcauuaugcuggguccagagucccaacccaaccaggacagcaauaaaaagaaugcaaagacacgcacagagccuuagcucugucuugcuuuaagcaaaaagcaaccgaaggauggaaggcuuucucucucccuuauuccucauccccuccuccagacccacgcugaggggaggcugcaucccucugacucaccagacucaucacugcugucuucacugcuuuccacaggcugcugcuucuccacagccuucuugggaggcuggguucccagagacuucuuuggugggggagcagaaggcggggggacugaacuguagggaccuguuuaaaaaggauagugugaugguuuuaggauaugucuacaacuuuuuuugauacuacuuucuuguagaaaugaagcuuaauuccccuucacuugaguaugggccagaaucaaugacucaguucuaacagaacauggugucaccucugagucuagguuacacaaggcacuggagauuucuccuugcuuuccuggaucacuagugcucggagaagcuagcugucaugucaugaggacgcucaugcaccucuauggagagguccaugugguuacugcagcugggcccugaccacagucacacagcuucgcuccccauguccagucaccugguuuauuuuucauggguuuuuuuugcuccucuuccucgucacuggaggaauccucacugcuagaacucuuccggguaggggugguagcugcuuucacuggggccuuggccacaacuugcuuuuuagguacagucugcauuagaaagaaaauugauuaccacaggaaaaugcugacccaaccaauccugccagggaaggaagacacacacacaucacacccuggucaccucugcccugacagaaguuaugguccagaccuucuuggggguggcugcugccuucuccuccucugagucaucacugcuacugcugcugcugcugcuacugcugcuacuggcugcuuuaccauuggcuauuuuaggugcugcucgagcuggaauacccaagaaaaagaaagaguaaggaguauuagggcaagucaggaccaugaaaaaccuccuuccuaugagcagagaacuuaggaguccaccauuuuuuuuuuuuuuuuuuuuuuuuuuuuuggagacggagucuggcucuggcucuguugcacaggcuagugugcagugguucaggcaacucucccgccucagccucuggaguagcugggauuacaggugcccaccaccaugcccagcuaauuuuuauauuuuuaguagacacaggguuucgccauguuggccaggcuggucuugaacuccugaccucaagcaauccgcccgccucagccucccaaagugcugggauuauaggugugagccacugugccuggccaggaguccaccaauucuuucaacuuuagagcagccaucgaggagaaugccagccaugguuuaccacaucaaaggauaccuuuccuaucccauggcaggaauaaaacugucuucuuagaaaagaugacauaaauaaucucaauacgcccucuaaaaucuuucacuucaaccuccauucagagaaauaaccuaacccucaucacaaguuacagaaaaaaagaaaaauucucauuugucucauagaaugaacauacaagaguaaaaauggcagugaaaagcacaacaaauagauauuuaagugauuacaguggaaugggaugugugaaaacauaaaaugucuaugaaaugucacaaaauaccaaauggauaccauuaaaaaaaauacacauuuuuucuugcugcaauaacuuucucuauuuacuagcuccuaugaaaucuuguuauuuauuaguaaaaccuuuaaaauuaaaagaccaguaaucaacaccuccaguucaacaaacaguaccauuucaccccugugccaaaucggcaauuuuaacuccaguccccagagcaaucugguccccagcccagccucuugggaacagaaacaguaccugguuugggaggggcuuuagucugagcuuuaacugucacagguguuaucuuuggcuucugguucuuugguggcucauccucggagcuugagucagaaucagaaucagagcucuuggccuucuuaggaggagcuuuggcugccuuggcuuggggcuuaacucccuucuguuagaaaagacacaaggagagaaaucagcaaaagcuuccggguacccaaagggcauccuagguuccuuuuauuuuuaggggccuaauggagcaguaagagcaaaagaaagcuaaggacaggauacggaaagggcaaaaaacaacaaaguucagccacuugauacacuggcccuguuccugccuuauccugccaaagcucccaggaaaacacucucucuuauucuuggagcccugaauagugucccagaagaacccaaacuccucaagcagaauggguuuaauuuccucuagauucggagccugaccucaaccucacacaucccuuccagaccucauacuuuuaucagcucccugaaaauccccagauuuucuuccucauaaucaccuauuguauugccgccaucaccccuugguuacaagcuagaggccaagauuuuagguuucuuccuuucuaauccuuaaaccccuuuuucuucccaaagcugcaaaccuggacaggcuguuucuuuugguccuccucaucaucaucaucacuggacucuucacugcugcuacucucugaugcuuuggcugcagccuucccaggaggcagaccgacucgcuuggcagguacagcugaacaaacacacaggucccaguaagaaucagccaugugaaacaagcaggcuguaaauucuuuuccuggcaccaccaagcccaccugcuacucugccuuaccagccuucuuugcuggaggcccuugaacuuccuccuccuccucgcugcuguccucacugucacuggaugaggccuucuucuuagcuuucuuagccacugguccauuugccuguaacuuucgcucugggaccuuggcagaccugcugagguagauuggaccaauuucuaggggacuggaaucuucccaaaccaagaaacacagcccagccuaucuugggggagaaaauagccaaaauggaacaggaaaggcuuacuugagccagaagcuauagaugucuaagagggaagaggcauuggcauccugcugugucuguagaagaaaaagagcuggguaaggaaauuauuuuauccugguuaugcuuucauuaaauguggccuguuacauacauaauuacuaaauuugguauaaauguuacaucuucauaaaacuuuugcuacgugcauaaaucaggagaaaaauauucuauuuguggauuucccaauuucugauguaaaaaacgggcuacuccuauguuugcggcaccaucuaaccaucuaacccccugccugccaaucuauauugaucaaaguccuaaaacaaaacaaaacaaaaaaucagccagucacgguggcucaugcuuguaaucccagcacuuugggaggccgaggcaggcagaucaagaggucaggaguucaagaccagccuggccaacauggugaaaccccaucucuacuaaaacaaaaauuagcccagcaugauggcagaugucuguagucccagcuacuugggaggcugaagcaggagaauugcuugaaccuagaaggcugaagcaggagaaucacuugaaccuaggagaucgcgccacugcacuccagccugagcaacaagagcaagacuccauuucaaaaaaaaaaaaaaaucacuuuugacugggcacaguggcuuaugccuguuaucucauguuaucucagcacuuugggaagcugagacaggaggaucacuggaugccaggaguucaagaccagccuaagcaacauagcaagacccccaucucuaccccucugccaaaaaaaaggcucucucuuuacucuagcaauguacuaucuaagaauguaaucuuauccauuacuugaggguacaaacacuaauacaagaagguuuuuccugcaauguggauuauaauaccaaaucauuagaaauaagccuccaggcgggaugcaguggcucacgccuauaaucccaacacucugggaggccaaggcgggcagaucgccugaggccaggaguucaagaccagccuggccaacauggagaaacccugucucuuagccgggugugguggcaggcgccuguaaucccagguacucgggaggcugaggcagaagaaucguuugaaccccagaggcggagggugcaguaagcugagaucgcgccacugcacuccagccugugcgacagaccaagacucugucucaaaaaaaaaaagaaagaaacaagacuaguaaguacuguauugaauguaaagaacugcauuuaagggccaggcacgguggcucaggucugcuguaaucccagcacuaugggaggucgagguaggcagaucaugaugucaggaguuugagaccagccuggccaacauggugaaaccccauuucuaccagaaacacaaaaaauuaacugggcaugguggugcacaccuguaaucccagcuacucaggaggcugaggcaggagaaucgcuuuaacccaggaggcugagguugcagugagccaguaucacaccauuguacuccagccugggcgacagaguaagucucaaaaaaaaaaaaaaaugcauucaggccgggcgcagguacgcuaacacuuuggcaggccaaggcaggaggaucacuuaaggacaggaguucaagaccagccugggcaagacagugagaccuccaucucucucucucucucuuuuuuuuuuuuugaaauggaauuucgcucuuggucgcccagguuggauugcaauggcacugcgguugcuuggccugugguggcuaaacgccuguaaucccaacacuuugugaggcugaggcggguggaucaucugagaucgggaguucgagaccagccugaccaacauggagaaaccccgucucuacuaaaaauacaaaauuagcugggcgugguggcgcaugccuguaauaaucccagcuacucaggaggcuaaggcaggagaaucgcuugaacccaggagguggagguuguggugagccgagauugcaccauugcacuccagccugggcaacaagagcgaaacugucacaaaaaaaaaaaaaaaaaaauuagccagguguggugguacaugucuguaguccuagcuaccccagugacugaggcaggaggauugccugagcccaggaguucgaugcuacagcgaaguaugauugcaucacuuuacuccagccugggcgacagagugagacccucuaaaagaaacaaacaaacacaaaacaauacacagaagaguacaggaucaggccaggugcaguggcucacgggccuguaaucccaacacuuugggaggcugagguggguggaucaccugaucaggaauuugagaccagccuggcugguauggugaaaccccaucucuacuaaagauacaaacauaagcugggcguggaggcgggcgccuguaaucccagcuauuugggaggcugaggcaugaggcugaggcacaagaaucgcuucaaccugggaggcaaagguugcagugagcugagauugcaccacugcacucccgccugggcaacagugagacucugugguccaaaaaagaguaaaugaucagagucaguacagaugggaacucaccuuuggacaaauuaccuuaucucccugagauuauuuucuuuucuauaaaauggagauaauacuacacaucucauuaaguuauugagaggauaagacauaaugcauguuggccgggugcgguggcucacaccuguaaucccagcacuuugggaagccgaggcaguagauucuugaggucaggaguucaagagcagccuggccaacauggugaaaccccgucucuacuaaaaauacaaaaaaaaaaaaaaaaaauuagccaggcaugguggggcacaccuguagucccagcuacuugggaagcugaggcaggagaaucacuuuagccugagaggcagagguugcagugagcugagaucgugccacugcacuccagccugggcgacagagccagacuccgccucaaaaaaaaaaaaaaaaaaaauuaaaugcaugugaagggcguagcaucugacccuuaguuagcucuucacaaagauuagcuuuucucacauaaaaccauuucagaauccuaauccugaggccgggcacgguggcucgcgccuguaaucccagcacuuugagaggcugaggcaaguggauuucuugaggucaggaguucaagaccagccuggccaacauggugaaaccucaucucuacuaaaaauacaaaaauuagccgggcguggugguacgcgccuguaaucccagcuacuggggaggcugaggcaggauaaucacuugaacuugggaggcggagguuacaaugagccgagaucgcaccauugcacuccagccugggcaacagagacuccgucucaaaaaaaaaaaaaaaaaaaaaagaauccuaauucugaaauguccaauuccauccaguccacugugaaagcacucuccgcagucuccuuaacagucaacucuaaacaguuucauuaagaaagcaguuagaucacauggcagccugucccagcuuaaggaaguuuugaggcugaucugauucuuugcuuucgcagccugauucugcuaaaagugcaagccauccuuccuagucaugcuaucaucccugcugaagacccccccucucuccucucucaaagugucuucccaugcaggaauguccguugauguagauuacaaaccuuucacauuccugguucucuuacucuuacauguguuuggagcauccuaaauugccauaacuaugguacagcuuucacuuuuacaagauuccucuguaccagcacugagauugcuacucuuacacaucaucuuacugaaacucacaaaaauccuauaaaguggaugaugacaucccuguagaaagacucagaaagguuaaauaaacugcccgggucacguaucuaaaaaguggcagagccuggucccaaaccuagguuuguuugauucaauuagccaaagcuccaagcccacuacuaugccuacuugguagggcuguugaugacucucaauucucaguguaacucaaaacaaaacucugcuucuacuuucauucauuuucuucuuuacaaacgaaaaucccagacuucauucuaaagaaauuucacuugcuuuugaaucccaguaaaugugacugaggcuaaggucaaaucacgguuugccucacccaacgaaaagccccccagaagaugccgaagaaccaacguccucaguggaacaagacucuaccuccccgcugcacucugccagccauguggcuuggggccacgaggcucccacgcugccgccgcugcacaggucacaagaaaaaagcaacaagacucagcgauaucuacucagacauggaggaagguaagcgaccgaggccgcaggcuuucucuggucacugccgaggggucggcguaaaggccuugcagacacuggacuggcggacccccagacuuccccaccuggaaaccuaagcacgucagggccugaagccuuguggucaucucagcccgguccccgccccaagcccggaacucacagcuccugucgcuuuggcgaacuuauuggccaccucugagaguugguuaucgcgcaggaagccgagcacgaggggauacaggucgcugggaaccacgcggcgaaugccggcguccgccauccuccaggcaauacgcgucacuaccguugucgacgcagcacgacucaggaacccaacag

SEQ ID NO: 18947 - RNA, 4475 nt, Homo sapiens
uaagucagcccuagaauuauguagguugaaggcucccaguggacagaccaaacauauaagaaggaaaccagagaucuggugcuauuacgucccagcgucugagagaacgaguaagcacagaauucaaagcauucugcagccugaauuuugaagguaaguaugaacaauuuauauauaauuuacuuggaaaguagaacauacauuaaaugaaaauauuuuuuauggaugaacuucuguuuuuccuguguuuuaacacuguauuuugcaaaacuccugaauuauuuagcugcuguuucucuuacaggaguguguuuaggcacuaagcaagcugauuuaugauaacugcuuuaaacuucaacaaccaguaagucuucaaguggaauuuauuauugauucuuuuauguuaauuuguuaggucaaaagaaaaaucuuuagagcaaaauaaaaguuuugcucuuuauuaggagguucuuuagauauuacacuuuuaauuggguagcuuauuugcauguauuuugaaacuaucuaaaguaaauaguguuuccuuuguaugcuuaucuuuagcuaauguguuuuuuuuuuugguuuuaaaauaaugcuucuagugaaaaaaaucacaaaaaccucaacacuguaacguuugagagcaacggcuauucaguucgguuaaaccgaaaagagagaaaaagaaaaaugauaagacuauaucaugauuaaucauugauguucauuucucauuucacugagcaaucuaaacuacuucuacuugaaccuaacauagguuuggcuguuuuuuucuuuaucugauuuaauugaaaauggauuguuuagauauuaaauagaccaaaauuagauaucuauaucuaaaacuaauauucucuauuaaaaggagaagacuuagaaauauaaauauauuucauaacuucuucuuaacuauauuauuauugugaaaacaauagaaaaguaaaacuaaaggaauuauuuuuaauuauuaaagacaaaccaugauuccccaucacaauauguuccuuuggcauauucucuuuuaguuuuuuauauacuuauuuuuuccauugcuuauguuacuuauauuuuccacagcuguagugauuuguauguaauuaguuacuuaaauagagcauuucucuaugcaauagcaagcagcagugugguuucuagaaaguauacaaacagagauauaugcucaaguguuuuuugaaagauuaacuuuucuuaccucuggguuucuuauuuguuucacacauuuccugcccugacuaaucuuuugaaauauuaauuuucuuuaaaucuuucaaaaacaucauagaaaagaugggcaaaagguaguuuuauucagaacuuugaaucucugaaaugucuuuuuucuacuaucaggaaaauuauuucuccuuuuucaagagguaaaaugaauucuuguuuuacaagccauggcucuguuucuuaauguuuucuauaaucacucacuuuuuuuuugcuuuugacaaacauucaaaaugcuaaugauucaaggauguccucagcucuguauguguucuaagaguucuauguuuuuucuccacagaaggcauaagaacuaggagcugcugacauuucaauaugaagggcaacuccacccuugccacuacuagcaaaaacauuaccagcggucuucacuucgggcuugugaacaucucuggcaacaaugagucuaccuugaacuguucacagaaaccaucagauaagcauuuagaugcaauuccuauucuuuacuacauuauauuuguaauuggauuucuggucaauauugucgugguuacacuguuuuguugucaaaaggguccuaaaaagguuucuagcauauacaucuucaaccucgcuguggcugauuuacuccuuuuggcuacucuuccucuaugggcaaccuauuauucuuauagauaugacuggcucuuuggaccugugaugugcaaaguuuuugguucuuuucuuacccugaacauguuugcaagcauuuuuuuuaucaccugcaugaguguugauagguaccaaucugucaucuaccccuuucugucucaaagaagaaaucccuggcaagcaucuuauauaguuccccuuguuugguguauggccuguuuguccucauugccaacauuuuauuuucgagacgucagaaccauugaauacuuaggagugaaugcuugcauuauggcuuucccaccugagaaauaugcccaauggucagcugggauugccuuaaugaaaaauauccuugguuuuauuaucccuuuaauauucauagcaacaugcuauuuuggaauuagaaaacacuuacugaagacgaauagcuaugggaagaacaggauaacccgugaccaaguccugaagauggcagcugcuguuguucuggccuucaucauuugcuggcuucccuuccauguucugaccuuccuggaugcucuggccuggaugggugucauuaauagcugcgaaguuauagcagucauugaccuggcacuuccuuuugccauccucuugggauucaccaacagcugcguuaauccguuucuguauuguuuuguuggaaaccgguuccaacagaagcuccgcaguguguuuaggguuccaauuacuuggcuccaagggaaaagagagaguaugucuugccggaaaagcaguucucuuagagaaauggagaccuuugugucuuaaacgugagagcaaaaugcauguaaucaacauggcuacuugcuuugaggcucaccagaauuauuuuuaagugguuuuaauaaaauaauaaaauuuccccuaaucuuuucugaaucuucugaaaccaaauguaacuauguuuuaucguccagugacuuucaggaauugcccauuguuuuucugauauguuuguacaagauugucauuagugagacauauuuacaaccuagaaguaacuggugauauaucucaaauuguaauuaauaauagauugugaauaaugauuuggggauucagauuucucuuugaaacaugcuuguguuucuuagugggguuuuauauccauuuuuaucaggauuuccucuugaaccagaaccagucuuucaacucauugcaucauuuacaagacaacauuguaagagagaugagcacuucuaaguugaguauauuauaauagauuaguacuggauuauucaggcuuuaggcauaugcuucuuuaaaaaagcuauaaauuauauuccucuugcauuucacuugaguggagguuuauaguuaaucuauaacuacauauugaauagggcuaggaauauagauuaaaucauacuccuaugcuuuagcuuauuuuuacaguuauagaaagcaagauguacuauaacauagaauugcaaucuauaauauuuguguguucacuaaacucugaauaagcacuuuuuaaaaaacuuucuacucauuuuaaugauuguuuaaagguuucuauuuucucugauacuuuuuugaaaucaguaaacacuguguauuguuguaaaauguaaaggucacuuuucacauccuugacuuuuuagaugugcugcuuugauauauaggacauugauuugauuuuuauuauuaaugcuuugguucuggguuguuuccuaaaauaucuggguggcuuaaaaaaaacucuuuaacuuguaauaaacccuuaacuggcauaggaaaugguauccagaauggaauuuugcuacauggggucugggugggggcaaagagacccagucaauuacauguuugguaccaagaaaggaaccugucagggcaguacaaugugacuuugaaaauauauaccguggggguaguuuuacccuauaucuauaaacacuguuuguuccagaaucuguaugauucuauggagcuauuuuaaaccaauugcaggucuagauaccuccuucucagcacuauuaaagcuccuaaguuagaggagugccuaaaacugaguuaccuaaaguuuacuuacauuaaaguaugaauauuaauuuuagaaauuugagacuuuauucuguaccagcccuguauaauaacagguuaucuaggaccuuccucugagguaggucuaaauacugaucucugaggcggaacuaacguuuuggggacucagcaucucugccagguuccaggauuauagacagaagaguccugucauaccacuuucuggaaaaguccuaauuucauguaauccuuuuauuuucaauaaaaacaaauagcuaaauguauaaccaacuaugauguuauguuuucaauaauuuuguaaaacagcucauauaaauaaaauuuuuaauuggaagaacauucgugcuuuuaaaaauuuuuuuuaacuacuucuaaguauauauucuacuucuaaguauucuuaccuucucuuguaucuguauccuccauuuuaucuccacugauacuacuuaguuucagcuccgauuauuacucaccuggccucuugcuauacuguucaaguc

SEQ ID NO: 18948 - RNA, 219028 nt, Homo sapiens
cucagcagcccccccacacccuggugaggucaggcggaggcucugccgcugcggccgcaguagcucagcuccuauuccugggaagccuggaacggggacuuuugaaaauaacugcagcggcauucggguuaggguccgugcucuccgccugcgccaggacagggugaaguggucggggcgagcagagggugcgaaggugcgggugcuggugccucgcagcaggagggagccccggcugcgccgcgcgacucccucuuuggcccucggagcgcagcacccggcggacaagcggcgggacgccaggacgcggcgagcaaggugaggcaggguccugaagucacaggggcuccagcagccgcuucccugccuucggacccggcgcugcgcggugcgcggcgaggaguugcgaucuguaccaggggcagaggagcagaggagcagggaaacagcuucauuuugcccgccgcccccucuuuuucucccgcgugcuggugcgcgcccucauccuuacaccuucgcaucccuuucugccggucccucuggcuccgucggacgccuggguucuucuaggaccccagaacccggcuuuccugugcuucuuugucaucucuccaagaucuucuccucugggccucgcuguugcugcccugacggucuggggucccgcugcccgccccggcccuacugucucuugcccucuaacaguuucugcuuugugccuccuaauccaucucuccuucagaaucuucuaacuuaggaggcuccucugcuggcucccaagucaggagcacacuccucuucuuccucgaagcuuuuaacuuagcucugaaugucuucagcucugaauauuuugacuuuuuuguuuguuuguuuguuuaauuacaguugacuaaugauuuucuuggaggcuuauagucuaggcuacaguuuacugaaagugaugagaucauuccuucacuaaauagccuuaguaaauaucaacuagggaacuuuaaaguuucuuucuagguuucauuaacuuaguccaagaacaauagccacuuaaaauguauguauauauguugguacgcaaucuucguacaugguccuaaaucugauucuucccuggcugcugagcaggccugagagagaggauuggugggaauugugaugccuggcuccauuucucuaauuguaaacuaggauguuaaucguuuuaauguagucagaggacuuuagugguuugggauaaagucgcucaaguuagcauaggcugguaacuaagcacauugaauggagacuaagagacgcugggauuuaaaacugucucuggagggcaccugcuuucuuuuuuuugaagccacaguuucuuaacaguagauuucauguuuguauaaacccucuaaaagcagcauauuuuaaaaccacguaguuacaaaaaagacuacucacucuuagcgauaucgcuuucuccccauguaguugugguguuagcucccauacugagguucauuugcucacuuucauacugcaauuagugugugaagaaagcugaauggagaagcacaaaguggaggcaaauaccagugaacaagcacaugcugacauacgcagcuguguuuuuggaaauagacuguaucuaguguucaaauuuaaaaacugagaaaaaugaaauaauucagcauuuaugacaucauuuuacaucuaaaaauauuagcucccuuaacugcaaguucuuauuaauauccucauacuuaacgguaaaagaguuguuugccugauguaugaccaaguguugccauugacacagugugcacuaauuggcagcaaucucagaagaaaccagguugugaaugaagauaauggcuaaauuucacuguccugguagcacgucuuauggcagugagaugagaguaguuucugcugcaacaucaaaugauguauuuaaaaaacagauaaauaagagcuucaauuauuaaaaagcccaagguuuucaaucugccauuuuuauaagcacacuucaaaaaguguagugugauuauauaaggcucaguugauguucugaagaaaguaguuuucacaagaaaaguaaggccuauugcuuaucaauuuaguuagauaacuugcagaugauuuguaguuucccaauugauuugguaaauuccugaguuuacuugagguuuauuaaaaaauggaauguaguagggaaaggguacuuauucuaauaggcccacuuucuaagucuguaauuuucuuagcaaacuauucucaaaauacauaaaaacuuacaacuuuuucaaggaaaagaguuuauacuauuuucuuacuuuuuucuuuucaugcuuauuauugauacaaaaucuaagcuaagauugcugcuaaugugauugcauaguaagacuauuuauauuugccaggaaaagaauaaagguggaugaguuagccauaagcauuuugcucugaaucuucaauaugacucaauauguguuugauaguccaucugguacaccuagagguuagcagacuggauauuucugauauuacuaaauguaacugcacuuacuuauuggauuaucuucuuucucauuuuauguacauuucaaauuaugcuucuucauguaauuugacuugcaguagugaaaugagacugaccaauuuucaaauuguuugauuuuuauugauguuugauaaaccacuaaaaccucuugaaaauauuuuuuucuuaaauccacugauugaaaccgauguauuuuuauugcuaugaaauaauacaacaaauuuccaggaauuauuucagaaaauguggaaagacuguagagaaaugaauagcccuagagaaaauaucucaaaauuauaaaaauggcuuucucaaguuacugauauucauaacaaucagguuuuuauguaucauucauucauuuacuaauucauuuuacaaaaucuacuggguacuugugugccaaggcccuguguuaggcacaaugauaaaccuuauaaggcaugaucuuugcucuuguggaguaucacagugcuuauauucuaccagagaauacagacaauaaacgagcaaacaaaugaagaagauccuuauagacuguaguaagagcaaugaaaauaaguaggggaauaugauacagauagcuaggaagggccuacuuuagugugggaagucagaaaaggccuuucagagaagaugauugagcagagaccugaaagagaagagagaauaggccuaccuugucaggaucugggagaacauucccgagauaacauucuugcagagagaagaguaagagccaaggccuugaggggggaaaaagagacuuggcguuuuugaagagcagaaagcaagccagcauggcggauuaaagaagauguuacagagccuagaagcagcucaauaaccgauaaauaggacuuggagguccugagaaagaauuuggguuugauucucagaacaauaggaagccacugaagagucuuuccuggggaaggucauuggcuuaaaaaaauuauccagggaaauuuaaaaaaaaauguuuugcagaggauaaauagaaugucuacucauucagucauuuauauuaauaccugagaauaaaaaaaacucuaugaucaguaugcuaaauaaucauguaauucgguuccucuacucuguuuagguaaggggaugggggaaugggaacccugaggugaguauguuaaaaggcaguuuacuuuccacugucacauugugacuugugcuacaagguaaguugucaccaacuuuauuaaaaaucagaucauuguucaacuuaagaauuuauuuuucaaagaaugauaucuuauuuucucauggaaauauguuuccuuuggaagguuggaaauuuuauuuuguauaaaggaauaaccuagguuuuagaaagggccuuuggaauuuuaagaagggcuuaucauuuucuuuuaccuguugccucuccaacauuuucaaauggccauaccuuuauuccuugagagauuaggguuacuguguuuccugaggcuuaaaugaauuuauugcccuaagcccuuccuugaaagcaauccagcuuugaggucuaguuggucccaaauaggaaugcagaugauuauugacauuccauaggaguaaauccuaauauugugggggaauaaccugcaaaauaaccuucaucagugccugcagggucaacuugauuugaucccagccuacuuucccauauguccuuauuauucccuuucacaaaucucuauugguuuaaacugauuuuccccaguuuggaacuuuugugcuuagcauuauuccuggcauagaguacgugcacagugggugcuugucaaauggaugccaugccuuucuuuuuugucauuucaaauuccagguccuauuacacuauuccccauugaacuagaucucccccucugaaggugaacagcagucacacacuugcccuguugugucauaauuaugcuuauuugaugccuggccaucuccccacuugccucuggcuucaugaaggcgaccuagaccucauccgguuugcucauuguuguauucugagcacccagcacaugguaugcacuuuauaaauaguuauugaauaaugaauaaauacugucuugugauguuucuccuauuaauuuuuugauguuagaucauuuaauacuguuuuacuuuucacguguuugguguuccgaagugguuucugagagagguuguagagcauacuuguuaagagcucaagcucuggagcuaggccaccuagguuucaauuccagcuaggagacuuaauaguugugagacacugggugagucaguaaaccucccuguaccucaguuaucucauauguaaaaaagggguaauagaacuugccucuuaugguacuugcaaagauuacaugaauuagcuaggcccacuuuuucuuuucucuuuuucuuuuucuuuuuuuuagacggagucucgcucucucacucuaucguucaggcuggagugcaguggcaugaucccggcucacugcaaccuccgccuccuggguucaagcgguucuccuaccucagccucccgaguagcugggacuacaggugcgugccaccacgccaggcuaguuuuuuguauuuuuaguagagacaggguuucaccauguuagccaggauggucucgaucuucugaccucgugauccaccugccucggccucccaaaguguugggauuacaggcgugagccacugcucccggccuaacuuuuuauuuuuaguggagacaggguuucaccauguuggcgaggcugguuucaaacucuugaccucaggugauccacccaccucgggcucccaaagugcugggauugcaggcaugaaccaccucccccggccuaggcccacaauuuguuugcaauuuuuaaauuucuaaagcucugaaaacugaaaaagauuuuauuugguaacuuagaugccaaaacucaugugguggcaaaaccugacuuaaacugacauaggguauuuauagucuuuauucuacuuaauguugaucuuuauuuuguuuugcuauagaauuacuaauauguuuaugggguugcaccauagacccuaaugguguauuacauaacauaugguauauaaaguauauuuccugucuaaaggucuggacauuucuaaauucagaaacacaucuggcaccaagauuuuucgaugagauuguacaccuugcaguaaacugcuuaaaucagggccuugcacauaguauguuguugcugugggugguggagauuagggagguaaauaaacuacuuuaucuuucccaauagcuugcucauaauaguuaccauguaaauauauacugauuuacucaugcaauaacuguaaauagaggacuggcugugugguucucaugucauaggaaaauagauauggcagggucauguaauugaaaugagccaagacucgucuguuaguacucucaucugguaccauucagagcaguuuaguuuuuguuuuucuguuguuauuuaaaccaaccuaugcuucuuuagcacaagagagucuuuuguggggguggggguaagaaauucaguuaagaacuuauuuaaugugauuagacacuuauuuuuuugcaguuguugaacauuuauugaacugcuaauguguauagaaaucuguauuaagagcaagagaaggccgggcaugguggcucacgccuguaauaccagcacuuaaggaggccgaggcgggcggaugauaagguuaggagaucgagaccauccugaccaacauggugaaacccugucucuacuaaaaauacaaaaaugagcugggcguggugacaugugccuguaaucccagcuacuugggaggcugaggcaggagaaucgcuugagacagggaguuggagguuucagugagccaagaucgugccacugcacuccagccuggugacagagcgagacucaguuucaaaaaaaaaaaaaaaaaaaagaaaaagaaauagaaaaguagaaaagagaaagguagaaaacaaaugagacaugauuccugaccuuccuuagccccagcgcccugcaugguuacauggggacaugagugugcguuacaauucuuuauuuuccucuguaaacuugacaucauuaagauuaaaaacaugcaaaggaaaacccaagaguuaauugaaaacucuucuuagcguccaugauaugaauuggguuuuaauuauccuaacacaaccccccucaguauuaucuuuauauaacaucuugacagccuuuuccuuucuaacuaaacuaaaacaacauggauuuucuuguucuuuaccaauacacaauugguguauuuucuuuuguuuuugguagagaugaggucucacuauguugcccaggcugguguugaaccccuggccucaagugauccucaugcuguggccucccaaaguauugggauuacaggcaugagccacuguaccuggccuguuuuuuuuuccuucgguuuugugggguugccaguaauuacaugucucaaaggauuuuuucugcaguuuucuugcaguugaaaacuaguccuugaaacuauucugccaauucauucaacaaauacuuauuaagugccuauuauauuccaagcauugugcuagucuaaacaaauagaaucucugucuagugcucuuuccauuacuuuggguccuucaaaguggagcacauguacugauugagcaggguggugacaagguggugcucccaggagccacaaaauaaagcagcuuguauuuucuugaagcaucuguuuuacacagagauuuaggagaacauuaacugguagcuauuuaaaaaucuuuaaacaaauucagauacauucugccuuagaacgcaauauucauagaaaaucugaggcaaaccccaauauuucagagaaagucucugcuugcaagggcagcugugguaacccugagaugacccuuuggaaagcacugagguggugcuguacugcccgaaucuguucuuuuagucaaacacccaaacauuuucauagccguaaauucccaugaugaccugugggaaaguuaauggacauaaauguuuuucucuguugcgcaauuucaaggguacauguugguuacccuuggucuaauggucuaaaucuaaacauguguugaguucuuacagaguuuuuaauguugguggguaauggcuaagagugacuaugaaggaccugccuagggaaugauauuuucagaauagagguuauuaggccugacgcaguggcucacuccuguuaucccaacacuuugggacgccuaggcgggagcauugcuugagcccaggaguucaagaccauccugggcaacaaagcgagacccugucucuauaagaacaaaaaaaaauuuaaaaauuagcugggcauggaggcacacgccuauagucucagcuacucgagagguuuaggcaggaggaucccuugagcccaggaguucaagguugccgugggcuacaaucacaccacugcucuucagucugggugacggagugagacccugucucaaaaaaaaaaucuaaaaaaauuuuuaaaaaaggcuagagguuauuagaacacaaggaccacaaacuuaaagcagcacaguucauggugucaaagcuuugccuuguucugugcacacuugccugucucacugauuugaaguucacuuuugcuaacuuuaaagcugcuuucauuuacagcauaguauacaaauugguuuguuaauugcuggccacugaaauaguuaauacuagaagaaaguugucaaggauuaagugcuuugagguugauaaaagguuucuacaguuugagaugguuuugaaaauaggccagcagagcauuggaggaaugccuguuacaacgugaugguuuaauuugcuccagaugagaaagaugaagaagaaaaaggcaagugaagaaagggggugaaaguaaauggaguaagucaaacacuaaaucuuucaacugauuuucauuauugcagucccacuuucauuguuguuguuccaugccagacauaguucacagggccugacauuguuauauuguuguguuacugcucaaaucuuguaaggacauggguauagaggauugugauuaguggauggucuuuaucgucuacaggugaagugcuuuuacagucuauucaguaaaaggagauaagaguuuugcuuguaguuuguagaguuuucuuucuuggucccacuuuuaaaaaaauggugauacauuucuaaagaucacuucauuucaacaaaguuuucuguuccacucuuggauguuucuuuuuucuuuuaagacagggucucauucugucacucaggcuggagugcaguggugcaaagucaaggcucacuacagcuucaaccucccaaguucaagugaucuucccaccucagccucccaaguaguugggacugcaggugcaugccaccacgccuggcuaauuuuauguauuuuuuguagagacaggguuucaccauguugcucaggcugguccugagcucaagcaauccuccugccucagccucccaguuugcugggauuacagacaugagccacugcaccuggccucacucucagauauuucuuaguggaaaggcaguagagcuuaauggcuaugaucuugaacccuggaaucauaggcuuggguucaaauccugacugccuuuuguugggcaacuugcuucaccucucugagccuuguuuaucucccuuguaaacuaucucaucuaguuuaaggauuaaauuaauaaugcguauagagugcuaagcacacuuaagccacauaugaaauauaacuauacuuauuauuauuuucauagauuuguggcuaaauuaguugauaacuuggagcauacuauaggaccuuggccaaucauauaugaagcagaaaugugaggggaaauugugugucuucuuuguuuauauugucuuaauccuagcuggaaugcuauuuuucgaaugugcaucucguaaauggugaguagacuguuuagaaguaacacuaguuuucuggcagacaagaaaguuuauggugaauguuggcuuauuacuuacucaaauauggcaucacauugauuccaagaaaaaugucaguuuuuaauacaauuagcccaauauauauuuaaaugugauacuguuuggguuaauaggauuuuaaauuuuaauauccauuuugaaggaaaaggguuaugcaggauaauguauacuaugaacaauguuaucuuuuaaacaugaaaacauuugguuuucugauaaucacaggggucacacauuuuucugauuuaucucuaauuguuccagauuuuaaguccccaaagaagaaaauacugaagcauuuguaauaguuaagccauugggaagagguauaauucuguugugaauaaugucuuccuauggauuuugaguuguuaugguuauuucaaguuuuuaucaugguuacuguaauaacaaaucaaauaauacccuaagagaagauaaaaguuugauaguaccuuugauaaaugaauggauaagucuaaauggaguauugagaacagcuuuagguguuagagggauagacuaaucuuuuaaguugagaguacaugaaucuaccuuuccuacuuucuuacaugaugcccuuuaguuccaaugucagacaaaugaugagagagauaauccuuggugaugaaaugccacaggugcacagaagggaaaagaccagguaacauauuggucauauacuguauauucacagguuuuuaugaccguuauuaagauaauguauauucaagugcuugaaaagcuuagcucacuauauugaugaaauauauuauuuauuagcagugaugucuacauuuauaaauagugaucauucucaguaucauuugaugauaaaaaggcaguauucaaauuuauauauuuuuuagaaaaauuagacuuacucuaccauuaggucauuagcucaaaccuuaaauaaagauaauacccuuuauuuuuagagcaucuuucuuuugaagcaugauuaacuguucuuauucuguuuauuccuguggaauaugcacaaugaguuuaaguaaauugcagaaggguuacauccugugagguggagcuaagaguaggccuuuaguuucuaauccaaugcuuuuguacuaaugauauaaaaagcucuuggccgggcgcgguggcucaugccuguaaucccagcacuuugggaggccaaagcgggcggaucacgaggucaggagaucgagaccauggugaaacccuguucuacuaaaaauacaaaaaaaaaaaaaaaauagcugggcgugguggcaggugccuguagucccagcuacucgggaggcugaggcaggagaauggcgugaaccugggagguggagcuugcaguaagcugagaucgcgcuacugcacuccagccugggcgacagagcgagacuccaucucaaaaaaaaaaaaaaaaaaaaaaaaaaagcuguuuagaccaaaggauccuuuaauaucuguagccuuucaauugaugggguuaaagcaaaaugucaguaauugugauagcaauuugguauuuaucaaaaugaguuuuggauucaguaagaauuuuauaaguacuuuugguaucauauagguacaguauccacgugaacauuuaugaacaagcaauuauacguaaagcacucuacuaggagggagaaaauguauucacugcccugaaauagguuacagucuugccaggggcaacagagaacaugagucaauuugauaucggccaauacuaauauuauuaccaagcagccagugacuaauaaaucauuauugcacucauuaugagccugggacccuuccaagugcaucugaugcauugauacauuuaaaccacauaacaauacuaugagguagaaacuauuauuagccccacuuuacagaugaggaaacugaggcauauagaugcuggauaacuugccugugguuacacaccuaauauguauaagaacuaggaguaaaauccauguagucugauucuugagucuaugcuuuuaaccacaacacuuccuuucaugcuaucucugacagaggccauuauauaacagagcaugauaucuaaaaaaggcauguuagaaaacagauucuagagaaauaaagagaaaugaucagaugaggguguuaaaguuggaaagauaguuugaagaaggcacuuuuaaaggaggucuuauugaaaagcaaggaacguauuucugaauauuucaaugcucaaagcuauguguacauaugugcaugugugugcacagguguguguugguauaugugugugggcguguuuauuuuaaacuggaaaaaaacuuuagagguuaaaacaaauugacaaucuuuuuacugacagcuaaucagagcucuguuuuuguguacaauauuuugacuucacaauccugugucgaaaaaaauauuuaacggcuuuauuaagauauaauucacucaucauacaauuuaccuguuuaaaguaauauaauucaguaauguuuaguauacucacagagcugagcaacugucaccacaauuuuagaacauuuuuaucaccucagaaagagaaauuuguuuugaaacaaauguggccacaaagaggauggaacuagugugucuguugguacuacugcuugucuaucaaaauguucaugauuuaugcucagucuaacacagaccucaugcuguuuuucugcagucuagcuccaaauugcuguagagcuccuccuccuuugaauuuaauuuugaucggugacagucuuucaaggcaguauguauugaucuaauuuugaauucucaauucaaguugauuguauauuuguauuugucauaaagguauugaucuuaguucuaaauagcaaagccagacucguauuuaaaacaaaacugcuaaacccacuaguaugaguggcuaccuccuugucuguguaugcucuauagugggccagagccaaagauuucugagaaauuuuauguguauacacugauauuuuuaauuacuucuaaaaguuauaccugauauagguuacuaguggacagaugauugagguaaaagcaacuccuccacgccauuuuuuuuggcuggggcauaguauuggggugguguguuauggaaaaugucuuuuuuuugagacaggguuucauucuguuuucuaggcuagaaugcaguggcaugaucacagcuuacuguagccuugaccucuggggcucaaauguuucuuccaccucaaccuccugaguagcugggaacacaggcgcacaucaccaugccuggcauuuuuuuuuuuuuuuuuuuuuuuuuuaguggaaaugaggccucgguauguugcccaggcuguucuugaacuucugggcucaagugguccucccaccuuggccucccaaagugcugggauuacaggugugagcgacugcauguggcugaaaaaugucuuauaaaauguauuccaugauacuauguacagauaguaugaaauaacuggaauuaaaaaaaauucggccacugacuuuucagcuauuuaggguucaaaaaagauacaguuaguguuuauagucaaggacuguguuucuguccagugggaguuaccaaaccaaauaucucuguguguguugggggaggcaggcuguucccaggucuucauuaaaguaauaagcuacagucaguguuaucuuucagacuaaauaauuacuauuuccuuucuauuauuaaaaaaugaccuucagacauaauuaaaugucuuaaagaacauaggugucuuuuaaaauguguuaaucuuagguugcucucuuuuucuucuuacaauuuuucuuacuuuuaauuuuaccgaauuuuucuuucagaaugaucuugaaaugucauuuuacacuuuuucaguauuuuuaaaugccuauuaucuacuuggguuguuucuacucaggggccaaaguaguuuuaguugaaguuaaagugaguugauaaaaugauuuccugugaaucuuaaguaaaguuuuuauuugcauagauggaauuucugcuuugccauguauggcaaaagguguggugaucucacagcuaguagguaggauaaaaucaauuaagguggcacugcugucacuagaauaaaaaaucuaugcauaccuuuauauuaauuagaugaaagcuccucuuuaucacuaagcucaacaguugacaucaccuggagucagggagucaggugccguggaguuaaaaacagaaagcaugcucgauuuagaaauucuggcauauauguaugaugcuaccuuuucucacaacuagauuuugguuauuaagccauugugauauugggcuauguuaaaagacauuagaaaccuguucauuuaagacaagccaaauuggucugauauaagagggucaugcugaaugagaaaguaucacauaauuuaggagagaggauuuugaguaaugugaauauugaguuuucugugacuugguauaucauuuauugauuuuaaaaaaugaacccauuacauuauacucauaaacuauuacuucacaauaguuugauuuucugcuuaaaucagugccuaaaaugguaaagucuuaaaugguuuagaaugacucugcauguagguuagguccaucuaccuguuuuauauggggaucugcuuuaucugcacauaaagaagauucgcuagcuuuaauuagccuuacuauguagggcagcacuuucucuaaugagagaaaaugagguauuuuacacaaauuaauucaacagaaauuagugacuaccuucuuuaaaccaggugauggggaugcaguggugaacaaaguucuaucuucauucuaugagguacucacagcauuauaugcacucucuuuguucuuuucuaagaacauuccauucaaaggaauaggaaaaguggcaggagaaaacacacuccuuuccuuuaaggauguaguuuagcauuugcacacaucacauucacacauaucccacuggccagaacuuaauccuauggugauaccuaagcuggaaaauguggcccuucacugcauggacaagcaaaaauaauuauuacuauaugagccgggaagaacagauauuggggaauaacuaauagucucugcuauacauugucccuaauguaaaccuuuaaucauucaucaauuuuugacuuaucuggagauauuaucucuaugacaucagcuacacauuugcuucaugguaaaaauuaagacuucucagcagaguauacaaguccaucaugacuugacuccugccugucccuuuagcaccucucucaccccauccaaaguugcagccuuauggggacuacuuggacuuccccaaacuagccaugcucucuuaccacacauuuguacuugcuacuuguauuaguuuguuuucacacuacuauaaagaaauacccaagacuggauaauuuauaaaggaaagaguuuuaauugacucauaguuuugaggggaggcccucagaaaacuuacaaucaugguggaaggugaaggggaagcaagcaccuucuucacaagguggcaggagagagaagagugaaggaggaacuucuaaacacuuauaaaaccaucagaucucauuagaacuaucacgagaacagcauggggaaaacugcaccugugauccaaucaccucccucccuugacacauggggauuacaggucccucccuccacacuuggggauuauaaauugagaugagauuuggguggggacacagagccaaacgauaucacuacucauccuaaacugcugccuacuuuuuguccuugagguuucaguuuagauagcaccucuucuaggaagguuuucuugagccuccuguaccucacaccccuguuauguguuucuuucauguauuuccauaguauuguucaugacucucuuuagcaaccuguauuacaaguaguguuuuuccuucucugucucucucccuggauuaugaauuccuugaggacaggggcuaacucaguuaucuguauugucugucaugauaccugcuccagaguugaguuuacuuaauguuuguugguaagaaaaugaaugaaugaauauuuaguuuacuaauuaugacuccuugauuaagaugucaacucuuccuauuuaccaucuggaaacugcaguacuuagaguauuuuccaguagcuaggacuggguaauuuuguaagagguauugauaaaauaaaauaauuugaaauaaacaucagaugauuaauauaugaauuauagaaggcacaaacaauugauguguaagaguuaggaagagcccuagggaucauuuaauccaacccuucuagaagauuuuaaaaggacacacgacuaauauauagagagaaguuaaauuacuugcucaagggccuccacuuucaaggaucuugcaauaucguuaaacagaugauauguauagacaugaaagaggugauugagaaaaaauugccgaaggaauagaaaugauuggaauagucaggguagguuugaucaaggaucuuggcuuugcagugagccuuggucacuggguaggauuuugauaugagaagacauucaagauauaggcaauguauaaauaaaaguggaaagacaaggauauacgggagaauuuugagaucucuuuaguugagugauauuuaguaguaagagagaauacagaaaaauugggccagaaaauggagggauuuaaauaccaggcugcugagggaaaccauuggcaguuuuaaguaggcgaguaauacaguuuuuguauguuguaucugacugauaggugggcuggguugaaggcugaaugggucaugaaacuggcauauugucuaaugugccaauuuaaaaauaugaacuuaauggguucucguuuuugcucaaaagcaaaaacaugauauacuaucaauucccaugauaauuaacauaacaauaucaguguuuuucuuaauggagaaagugaguguaaguagcaagcuuauaguauuaguauugcauauguauuagucaugacauaccauagauaauuguauaaauuuucacguuacgccaauaaacuguaaaaauuccagaaguaacugagaacgugguagcagcugcagcaucggcccaugcuauuuugccagccauucggagacugcauaaauuaacuaguggcaugaacucuccuggugcauuuuggagccauuuuauucaaaaauuguuuuguagaaagugaaaauguuauacuguauuuuggcaaaaauaagaagaacaauaagcagagcucucuuuaguguauuaagcaucaucuaaaaaugaaaagcgugaggggagaaccuuuacuucaugugccugugaggaaauuuugacuuuguauagacaaaaaguauguacacagagaaagauuuguuauauaaauaguauagcucauuuguauagucaagggugucuuccuuuccuuccuuccuuccuuccuuccuuccuuucuuccuuccuucuuuccuuccuucuuuccuuccuuccuuucuucuuuccuuccuuccuuccuuucuucuuuccuuccuuccuuucuucuuuccuucuuuccuuucuuucuuugugacagagucuggcucugucacccaggcuggagugcaguggcaccaucucagcucacugcaaccucugccuccagggcuuaaggaaucccccaccaaguugcugggacuacaagugugugccaccaugcccagcuaauuuuuuuuaaaauuuuuauuagagacgagguguugcuguguugcccaggcugguuggucucgaacuccuggccucaauugauccagcugccuuggccucccaaagugcugagauuauaggugugagccacugugcccagccgagugcauuuauuuaauagcuguguacacuuggacuuaacucauggcuuuaacccauggcuggcuuuaacuuagccuuuugaaagucuauaaguuuauagcuucagacacauauuaauacuuacuuuuuaggaccuaaugaaaacaguuuauauuaucauuugucuuucuacuaggaguuggaaggaaauuuucaguuuaaugaaguuuuaaguuauauuaauuugagucuagaaaauuuguacaacuuuuuuugggaaaccuucaaaaguauuuguuucagaugguguaaaaugaaaugcauaaauaccuauuuccauaauaucuuuguacuugaaaauaauauaaaguuaaccuuauguacccuucugaaaauuaaaagcauuuaauaaaguauaauuuuuuuaaauuuuauuauuauuauacuuuaaguuuuagaguacaugugcacaacgugcagguuuguuacauauguauacaugugcaauguuggugugcugcacccauuaacucaucauuuagcauuagguaucucuccuaaugcuaucccucccccuccccucuccccccuccccccuucccccaccccccuucccccaccccacaacagucccuggugugugauguuccccuuccuguguccauguguucucauuguucaauucccaccuaugagugagaacaugcgguguuugguuuuuugucuuugcgguaguuugcugagaaugaugguuuccagcuucauccaugucccuacaaaggacgugaacucaucauuuuuuauggcugcauaguauuccaugguguauaugugccacauuuucuuaauccagucuaucauuguuggacauuuggguugguuccaagucuuugcuauugugaauagugccgcuauaaacauacgugugcaugugucuuuauagcagcaugauuuauaauccuuuggguauauacccaguaaugggauggcugggucaaaugguauuucuaguucuagaucccugaagaauccccacacugucuuccaccaugguugaacuaguuuacagucccaccaacaguguaaaaguguuccuauuucuccacauccucuccagcaccuguuguuuccugacuuuuuaaugauugccauucuaacuggugugaguugguaucucauugugguuuugauuugcauuucucugauggccagugaugaugagcauuuuuucauguguccuuuggcugcauaaaugucuucuuuugagaagugucuguucauagccuuugcccacuuuuugaugggguuauuuuuuuccuguaaauuuuuugaguucauuguagauucuggauauuagcccuuuguccaaugaguagguugcaaaaauuuucucccauucuguagguugccuguucacucugaugguaguuucuuuugcugugcagaagcucuugaguuucauuagaucccauuugucaauuuugguuuuuguugccauugcuuuugguguuuuagacaugaaguccuugcccaugccuauguucugaaugguauugccuagguuuccuucuaggguuuuuaugguuuuaggucuaacguuuaagucuuuaauccaucuugaauuaauuuuuguauaagguguaaggaagggauccaguuucagcuuucuacauauggcuagccaguuuucccagcaccauuuauuaaauagggaauccuuuccccauugcuuguuuuccuccaguuugucaaagaucagauaguuguagauaugcggcguuauuucugagggcucuguucuguuccauuggucuauaucucuguuuugguaccaguaccaugcuguuuugguuacuguagccuuguaguauaguuugaagcagguagugugaugccuccagcuuuguucuuuuggcuuggaaucgacuuggcaaugcgggcucuuuuuugguuccauaugaacuuuaaaguaguuuuuucccauucugugaagaaagucauugguagcuugauggggauggcauugaaucuauaaauuaccuugggcaguauggccauuuucacaauauugauucuuccuacccaugagcauggaauguucuuucauuuguuuguauccucuuuuauuugcuugagcagugguuuguaguucuccuugaagagguccuucacaucccuuguaaguuggauuccuagguauuuuauucucuuugaagcaauugugaaugggaguucccucaugaucugguucucuguuugucuguuauagguguauaagaaugcuugugauuuuugcacauugauuuuguauccugagacuuugcugaaguugcuuaucagcuuaaggagauuuugggcugagacaaugggguuuucuagauauauaaucaugucaucugcaaacagggacaauuugacuuccucuuuuccuaauugaaugcccuuuauuuccuucuccugccugauugcccuggccagaacuuccaaaacuauguugaauaggaguggugagagagggcaucccugucuugugcccguuuucaaagggaaugcuuccaguuuuugcccauucaguaugauauuggcuguggguuugucauagauagcucuuauuauuuugagauacgucccaucaauaccuaauuuauugagaguuuuuagcaugaagcguugcugaauuuugucaaaggccuuuucugcaucuauugagauaaucaugugguuuuugucguugguucuguuuauaugcuggauuacguuuauugauuugcguauauugaaccagccuugcaucccagggaugaagcccacuugaucaugguggauaagcuuuuugauguguugcuggauucgguuugccaguauuuuauugaggauuuuugcaucgauguucaucaggcauauuggucuaaaauucucuuuuuugguugugucucugccaggcuuugguaucaggaugaugcuggccucaucaaagaguuagggaggauucccucuuuuucuauugauuggaauaguuucggaaggaaugguaccagcuccuccuuguaccucugguagaauuugucugugaauccaucugauccuggacuuuuuuugguugguaagcuauuaauuauugccucaauuucagagccuguuauuggucuauucagagauucaacuucuuccugguuuagucgugggaggguguaugugucgaggaauuuauccuuuucuucuagauuuucuaguuuauuuguguagagguguuuauaguauucucugaugguaguuuguauuucugugggaucgguggugauacccccuuugucauuuuguauugugucuauuugauucuucucucuuuucuucuuuauuagucuugcuagcagucuaucaauuuugaugaucuuuucaaaaaaccagcuccuggauucauuaauuuuuugaaggguuuuuugugucuguauuuccuucaguucugcucugaucuuuguuauuucuugccuucugcuagcuuuugaauguguuugcucuugcuuuucuaguucuuuuaauugugauguuaggguuucaauuuuagaucuuuccugcuuucucuuuugggcauuuagugcuauaaauuucccucuacacacugcuuugaaugugucccagagauucugguauguugucugcuuugaaugugucccagagauucugguauguugugucuuuguucucauugguuucaaagaacaucuuuauuucugccuucauuucauuauguacccaguaguaauucaggagcagguuguucaguuuccauguaguugagcgguuuugaaugaguuucuuaauccugaguucuacuuugauugcacugugaucugagagacaguuuguuauaauuucuguucuuuuacauuugcugaggagagcuuuacuuccaacuauguggucaauuuuggaauaggugugguguggugcugaaaagaauguauauucuguugauuugggguggagaguucuguagaugucuguuagguccgcuuggugcagggcugaguucaauucuuggauauccuuguuaacuuucugucucguuaaucugucuaauguugacagugggguguuaaagucucccauuauuauugugugggagucuaagucucuuuguaggucacucaggacuugcuuuaugaaucugggugcuccuguauugggugcauauauauuuaggagaguuagcucuucuuguugaauugaucccuuuaccauuauguaauggccuucuuugucucuuuugaucuuuguugguuuaaagucuguuuuaucagagacuaggauugcaaccccugccuuuuuuuguuuuccauuugcuugguagaucuuccuccaucccuuuauuuugagccuaugugugucucuguaugugagaugcauuuccugaaugcagcacacuggugggucuugacucuuuauccaauuugccagucugugucuuuuaauuggagcauuuagcccauuuaccuuuaagguuaauauuguuaugugugaauuugauccugucauuaugauguuagcugguuauuuugcucguuaguagaugcaguuucuuccuagccuugauggucuuuacaauuuggcauguuuuugcaguggcugguaccaguuguuccuuuccauguuuagugcuuccuucaggagcucuuuuagggcaggccugguggugacaaaaucucucagcauuugcuugucuguaaaguauuuuauuucuccuucacuuaugaagcuuaguuuggcuggauaugaaauucuggguugaaaauucuuuucuuuaagaaugucgaauauuggcccccacucucuucuggcuuguagaguuucugcugagagaucagcuguuagucugaugggcuucccuuuguggguaacccgaccuuucucucuggcuguccuuaacauuuuuuccuucauuucaacuuuggugaaucugacaauuaugugucuuggaguugcucuucucggggaguaucuuugugacguucucuguauuuccugaaucugaauguuggccugccuugcuagauuggggaaguucuccuggauaauauccugcagaguguuuuccaacuugguuccauucucccugucacuuucagguacaccaaucagacguagauuuggucuuuucacauaaucccauauuucuugaaggcuuuguucauuucuuuguacucuuuuuucucuaaacuucucuucuugcuucauuucauucauuucgucuuccaucgcugauacccuuucuuccauuugaucgcaucggcuacugaggcuugugcauucgucacauauuucucaugccgugguuuucagcuccaucagguccuuuaaggacuucucugcauugguuauucuaguuagccauucaucuaauuuuuuuucaagguuuuuaacuucuuugccuugaacuaaaggaggagguucgaacuuccuccuuuagcucagaguaguuugaucgucugaagccuucuucucucaacucgucaaagucauucucuguccagcuuuguuccguugcuggugaggagcugcguuccucaguuggaaaugcagaaauuacccgucuucugugucgcucacguugggagcuguagacuggagcuguuccuauucggccaucuugucuccacccccgagagaaaaaguauaauuuuucugugauuccuuuuccuacucuguuggaacaucugcuaaacuuuagcccaucauacuucuuaugcuuguauaacaacaugaaaaccuguaauaaccaguuuuuggcaucauacauuauuauaagacuuugucauaauauuucaggaagguaaugcuguugaauguacuaauaaguuacaaaauuaauuuagaugauuuccuagcuauaaccuauugaaaaucauuuguuuugguuuccaaucugauugaaauccuaaaaauacuuaaaauaauuuacagaguagcauguaauaggaaucguucaauauacaucagcacacauccuguguauucauuacaugaaaugguacucgaacauugugaauauaaaguuaugguauaguuuuaauuaagacuguggacucuaaaccugaccuaaaaucugauucugucauuugcuacuuguguuacuucauuuuauugcgucaugguuuccucaucucuaauggaggaacaagagauuuuauagaaauuagauaaaguaguguaugugaguguuaagcauaguaccuagaauaugauaagauuuaauaaauguuaguuauuauuuuauauaacuaguauuaucugguuaugaaaggaacuuuggcuuuuaguuucaaauuuaucuuucuagccauuuuauuuaagacguuuauacaagaagaaauacauaaagaaugagguaaaugacaaauuagcaauguaauuguuaucaacuaguggaggcacuuuuagcaggcaaauuacucauuauuauggucaauuauuuuggcaaauaauuaaagaaaaugaaaaagaagaccaccagacuaugaaugacuuugccuuuaacugaugcugauagaauuuguuuuaaaauuuuuucacuauuaggaaguagccugguuuugacuaaacuuuuuaaaaagaaaaaaaaguuuguuugaaauaauuacagauucacaugaacuugcaaagauaguacagagagguccuggguaccugucacccaguuuccccaaaugacuacaucuuauguaacuguaguauauuuucauagcccagaaauugauauugguacaauguguguauauaguucugugacauuuuaucacauuauggauucauguaaccaccuccacaaugaugauacagaaauauuucaccauaagagacauaaauuacagaacucaagaggagggggaaggaaagaaaauuuguuguauugacacauauuuugcuuaccauguucuuucuuccuuccugauguuccaagauacccucuuuuaucauuuucuuuugguuuagauaacuucuuuuaacuaauaggguagguaugcuggugacaaaaucuuaguuuuccuuuaucugagaaugcuuuaaucuccccuuuauuccugaagauuuuguuuuugcuugauauaggauucugaguugacaguucuuaucuuucagcacuugaaaaauccuuugugucucuucuuuauggccuccaugguuucugaugaaaaaucugcugucaugugaauuguuuccccugauagguaagguguuucuuucacugcuuuaaaaauuuuuuauuuguuaacaacuuucaaaaguuugauuaugaugugguuuagagucaauuuucuuauuuuauuuauguauuuuuuaauuucaauauguuuuugaggaacaggugguguuugauuacacgaauaaguucuucagugaugauuucugagguucuguugcacccaucacucaagcaguguacacuguacccagugugaagucuuuuaucccuugccacccccaucccuuucuccugaguguccaaagucuaauguaucauucuuaugccuuugcauccucauagcuuagcucccgcauaugagugagaauacaugauguuuggugguuuuccauuccugaguuacuucacuuagaauauucugauauguauauaaugaugcuaccuuuauccagguugcugugaaugccauuauuucauuccauuuuaugucugaguaguauuccaugguguguguguguuguguaucuccacauuuucuuuauccuagaguggauuuucuuggguauauucaauuugggauuugcauggcuucucgauucuguagguuucuuaucucuuugaguacuuuuucagccccacccucuuucucucuccuucuuaucucucauauugcaaauguuagaucguuuguuauagucccuaaagucccuaauucuguauucauauuuuuuucaguuuauuuuaucuuuguuuuuaagguuggauaauuaguguucuucuguuuuacaguucacugauuuuuccucugucuuuuccauucugcuguugagccuaucuguuggguauuuuauuacaauuauuguauuuuuugcuuuuaaaagauccauuugguucuucuuuauaucuucuauuucuuuacugagacuuuauuuuuuugcugaggcucuugguuucaaauguuuucauaauugcucaaugaagcauuuuuaugauggcuacuuuaaaaucuuugucagauaauucuaacaucgcugucaucuugcugucaacaucuauugauacuuuuuuuauuauacuuuaaguuuuaggguacaugugcaccaugugcagguuugucacauauguauacaugugccaugcuggugugcugcacccauuaacucgucauuuaacauuagguauaucuccuaaugcuaucccuccccccuccccccaccccacaacaggccccauagugugauguuccccuuccuguguccauguguucucauuguucaauuuccaccuaugagugagaacaugcgguguuugguuuuuuguccuugcgauaguuugcugagaaugaugguuuccagcuucauccaugucccuacaaaggacaugaacucaucauuuuuuaugacugcauaguauuccaugguguauaugugccacauuuucuuaauccagucuaucauuguuggacauuuggguugguuccaagucuuugcuauugugaauagugccgcuauaaacauacgugugcaugugucuuuauagcagcaugacuuauaauccuuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaauaaucaccauucuaacuggugugagaugguaucucauugugguuuugauuugcauuucucugauggccagugaugaugagcauuuuuucaugugucuuuuggcugcauaaaugucuucuuuugagaagugucuguugauauccuucacccacuuuuugaugggguuguuuguuuguuuuuucuuggaaauuaguuugaguucauuguagauucugaauauuagcccuuuguuagauaaguagauugcaaaauuuuucucccauucuguagguugccuguucacucuuuugguaguuucuuuuguugugcagaagcucuuuaguuuaauuagaucccauuugucaauuuuggcuuuugguguuuuagacaugaaguccucgcccaugccuauguccugaaugguauugccuagguuuucuucuaggguuuuuuaugguuuuaggucuaacauuuaagucuuuaauccaucuugaauuaauuuuaguauaagguguaaggaagggauccaguuuuuuuuuuuuuuuuuuuugagacagagucuugcucuguugcccaggcuggagugaaguggcaugaucucggcucacugcaaccucugccuccccgguucaagcgauucuucugccucagccucuugaguagcugggacuauaggcacacgccaccauuccuggcuaauauuuguauauuuuuaguagagacgggguuucaccauguuggcaaggcuggucucgaacuccugaccucaagugauccaccugccuugaccucccaaaaugcugggauaacaggugugagccaccacacccagcccuauugauacuuuuuuaaugcagcugaaucuuccugguucuugguauggcaaaugauuuuuuugauggcaaccuggacauuuuaggcauuauaucguaagauucuggaucucauugaaacuuucuuuuuucuuucuuucuuucuuucuuucuuucuuucuuucuuucuuucuuucucuuucuuucucucucucucucucucucucucuuuucuuuucuuuucuuucuucuauuuaaaaucuugcccuaugaaugaaacuuucugucuuagcuggcuucaucugauacugcugugucaggggagggagggcacugccucauuacugccaggugggucuagacagccagguuuccuaauugaccucucuugauaccuaagagggugguuuuuccuuacuggugggugaggguggaaguccuggcuccucacuagaccuccagugauaucucccugccugagagggcuaagagugccuuguuacugcuuuacacauagccuucacugacaucauuagggggauggucucacagccacuggauaguggugaaaguccuggcucuccacugggccucuucugaccccaucccagcgcagaaaggaguguguuucauuacagcauugugaagguggaagucuaggauucccacuaagccuuuggugacguggaugagggugcagccauauuuuuuucuguaguguuuagcuggaguagaguaauuauugucuaaaaauuuucuguccuaauauucugcccuuuuucugauccucuggcuagagagagcagacuuuucuucuucuguguuuuugguuugugcucacugucauuucuagguugccaacuucuucagcuuuauaccuugaauauauuaggcaaaaagaacacccaggaaaaucuccacugugcuauuccuuggguccugaggucccuagcccaucugcuucuuccugccaccuuucagaaccauuuuauguuuuuauauacaauauccaugauuguuagccauauuuuguaggagaaauaaggaaaaaaaugcaucuaccucaucuuuccagaggaaguuugacuuauuuuggccuugcugacuuuuucguaaguuauuauaguuugauuauaucuugaaaccagaaacuauuccuuguccuaacucaggagacauuuuggaguggcuuuauauucuauuuugcugcuuugucaauagaguuauuuaaaguuaucauuauguaggcaacaguuccuuaguuuguaaggcaaaaugcugaaucuaagaaacauguaccacauaugugucuguuauaucuguaagaauuuacuuauuuaaaauccuguuugcguuaaggguaauaaaagugaagugauauauagaugacagauuucaugagagaaaaauuuugaagucagaauggggaugaguaucauacugaauucaguaauguauuauauauaaugcuuaaguaaugauuaacguauacauuauugcaguaccgguuaacuagugaucacauaauucucaucgaaauuguuuagagacauaaaauauuggcacaggguauuguuuuacauucuuugaaacaguaaauguagauuggauugaggaaaaggcuaucugcuuuaacaauaaauuuccuagguacuucaguagcuuacugugaauuuacuuugcccugucuguuguauuacucuuaaaggaguuagagaauauggcuucaaaauaauaucaguggcauugcuuuccccugcucuugcaggugaaauccacugauaaaggggaagaagauccauugauggucauaaauaaaauuuauccuaaaaguguaaaauauucagagcugaauacagcucucuauauaucagcccucugaguuuauagaugaggaaacugaagcccaguaauguuaagagaccugggaaaaguaacaagcuacuuagaaggaacugggacuugaauucagauucucugauccuggggccacuauauuuuccauuagcugguacagugagggaagaaucagaccuagaagcugcccucaaagagucuacuggagcagaugggaagggcaaaaguaauuguaauacuugguagaaagugaccuuucccauaaaagagauuuggauaaaguuuuuugaaauguaauucuuuaagcauuuaaacuguacuuuaauuuuguacuaugcauacauaaaaggaaagaagucagaaaucuuauuuccagacucuuuuagauaaagagguccccaaauuuauuaauuuuuauuuugaaaaaguauacucgggauaaaaauguggaugauuaugucugguuuagaguguuucauaauuuaauuaaccuaagauaaauuuauauaaguaaauagauaaaugaauaaauguacucacagaagauauauauauguguauauauauauauauuuuaaagaguagauucaguggauagaaguuucaaagaguuagaugucaccucgguauaaggagauuuuucugauaaagcuauugaaguacggaaugggccaucucaaauuauagggaguucacauuacuagaggugguuaagggaaggcuaguuaacuucuuaacagggaugagaguuuagagggaaauuaagcauuguguaaguggcaggacccauuugaucuguaaaguucccuuugaacuuugagauuuuaugauuugaauuauuucaaauuuugccuaaacuuuggaggcuugggcauaguuuaaauauuguauuuuucucauuuucaauaagagaaauccuuuauuuuccaauuuuuagaguauuuaaaugucaugucuagcaguaaaaaauaauaguuuuuuuuuguagcguaacauccuuauuuguuaagguuauguuuuaugauuucaccaaauuuguauuucaucauagguacauauaggacuaacacauuuuaauacaugccucauagacuggaagaauuucaaucuacauauuucauaugcuuucuauuuuuuuaaauuauaaaggcaucuaacacacauggcaaaacauuuacagaaacccaaaguauccaugaaaaauaagucuucucucucuggaggcagccauuguuaucauuuuguuuauuuacuuugcuuacagauguuuucuaugcaaauacaagcauguguguauauccucuuuuaaacacaaauggaaguacgugauacacauugaucuauggcuacuuaacaaaacuuuauauuauaaauauuucuauaucaggacauaaauaccuaccuuauucuuuuauuucucauauaauuaaaaaaauugagauauaauucacauaccauacaauucaccuuuuuaaaguauucaaaucaguguuuuuuuuuaguauguucacaaaguugugcugccauuacagugaucugauucuagaacauuuucaucagugaaugccuauauacuguuggugggaauguaaauuaguacaaccucuaagaaaaacagucuagagauuucucaaagaacuaaaaguaggucuaccauucagucuaucagucccacuauuggguaucuacccaaaggggaaaaaaaaagccauuauauaaaaaagacauccgggcaugguggcucacgccuguaaucccagcacuuugggaggccaaggcaggcagauaauugauggcaggaguucaaggccagccugaccaacguggugaaaucccaucucuacuaaaaauacaaauuuaaccggcugugguggcgcacuccuguagucccagcuacuugggaggcugaggcaggagaauugcuugaacccgggaagcagagguugcagugagccgagauugugccauuguacuccagccugggcagcaaagcaaaacuccgucucaaaaaaaaaauccaucuucaugcauauguuuauugcagcacaauucacaacugcaaagauagggaaucaaacuaagugaccaucagcugaugaguggaugaagaauauaugauacacacacacacacacacacacacacacacacacacacacacacaccauggaauauuacucugccauaaaaaagacugaaauaaugucuuuugcagcaauuggauggaacuggaggccauuauccugagugaaguaacucaggaauggaaaagcaaauauaauauguucucacuguuaagugggagcuaagcuagggguauucaaaagcauacagagugauaucauggacacuggaaucucagaaggagggagauugggaggagaaugagggaugaaaaacugucugugggguaccauguacacuauuugggugacagguacacuaaaagccuagacgucaccacuauacacuucauccauguaaccaaaagccacuuguaccccccaaacuauugaaauauauauauauaucuaucuccuuuuacucaucccauuuguucuauaauaaagucuaucuccccucuccccaguuccuggcaauuaugauucugcuuucuguuucuauggauuugcuuauucuagacauguuauauaaauggaauaauacaauaaauggccuauugugucuggcuucuuucccuuagcauaacguuuucaauguucgucuuaguuauagcauguauuaguacuuucuucuuucuauggaugaauaauucuacaagguaugaauauacuacuacuuauguuuauucauuuaucgguugauggacauuuggguuauuuucacuuuuuacuuauuaauaaagcugcuguuagcauuuguguauaauuuuguguguguuauguuaccucauuauuauuauuauuauuauuauuuuuuagacagagucuugcucuguugcccagucuggagugcagugucaugaucucagcucacugcaaccucugcuucccagguacaagugauucuuugccucagccucccgaguagcugggaccgcaccacaugccaccacgccuggcuaauuuuucuauuuuuguagaaugggguuucuccauauuggccaggcuggucucaaacuccuggucucaagugauccauccgccucggccuuccaaagugcugggauuacaggugugagccaccaugccuggccuauuaccuuauuuuuaauaacuccauaguacugugucauuuggauguuuuauaauuuaucuaaauagucuccuacauagagacauuaugguuagguauggacuuugugauugauauugaaaacagccuugcacauuucuguguacaauugugagauaaaaguugagaguuggaauuucugcagcaaaaggcaugugcauuuauaaauguauccucauugccccucagagaaguuucaucaauuuauuccucuaaguaccuguuuccucacaaccuuucuuaaaaucuuuugaaucuuuguagcauugugauguucauuuuuauuucuaauauauucaugcuaucucucuuuuucuggaucagucuuuuaagaaguuugucacuauuauucagcuaauaaaauccucagcaacccaacuuucuuuuuugagacagggucucacucugucauccaggcuggagugcaaaggugcaaucauagcacuccugggcucaagggauccuccugccucagcuucccaagagcagguaggacuacaggugcaugugaccacuuccagcuaaguuuuuaaacauuuuuuuuuuuuuuguagagacagaguuucauuauguugcucaggcugaucucaaacuccuggccucaaacaauccgccuaccuuggccucccaaaguguugggauuauaggcaugagccacuacaacaacccacauuuugauuuucuugaucauuuauuguuuuaguuuucuauuucauuuauuuuuguuuuuuauuauuucuccauuuguacuuucuuugauuuuuauaacauuguuuuucuagcuuauuaaacuagaugcauagugcaucuauuuuuagccuuuuaaaacaguuuuauuuuguuuuaaauugauacaugauaauuguucguauuuaugggguacaaugugauguuuugauacauauauacauuauguaaugaucaaaucaggguaauuaggauaucagucaucucaaauacaugucauuucuucacggugagaacauuugaaauccucucuucuauuuuaaaauacauuauuguuaacuguagucaccccgccaugcaauagaacaccagaacuuauuccuccuaucuaacuguaacuuuuuguugagcaaccucucuucauuaccugccccccacucucgcccagccucugauaaccacuauucuacucucuacuucuaugagauaaacuuaaaaaauuccucauuaugaguggaaucauaugguauuuguccuuucguucuugucuuauuucacuuagcauaauguccucuaaguucaucaauuuugucacaaaugacagguugcauuccuuguuauggcugaauaguguuccauuguguauguauacaacauuaaaaauuaauuuauccauugauggacacuuagguugauuccauauuuugguuauuguuaauagugcugcaguaaacacgagggcauagguauaugaugauagauacauauauauacuuggaauugugauugcuagaucauaugguaguuuuauuuuuaguuuuuugaggaaccuccauacaguugucuauauuggcuacccaaggugauccacagagucaaugcaauccuaccaaaauaccaaugauaguuuuuauaaaaacaagagaaaaacaaucuuacaauuuguauggaacaacaaaugaccuagaauagccaaagcuauccuuagcaaaaagaacaaaacuggaggaaucacauugccugaguaaggaaaacagcacgguacuggcauaaaaacagacacauagaccacuagaacagaauauagaaccuagaaacaaauacacauauauacagccaacugauuuuaacagagguguuaggaacauucagugagggaaaggaaagucucuucaauaaguggugcugggggaaauaggauauccauaugcagaaaaaugaaaaguagacccuuaucucucaccauauacaaaaaaaucaaaucaaaauggauuacagaauuaaaucuaagaccugaaacuacuacaagaaaacauaggggaagugcuuuaugaaauucuuuggggaaagaaauuuuuggcuaagcuucaaaagcauagacaacauaagcaaaaauagacagaugggauuacaucaaacuagaaagcuucuacacagcuaggaaacaaucaagagugaaguggcaaccuacagaaugugagagaauauuuucaaacugugcaucugacaaggagauaauauccagaauauguaaggaacucaacucaauagcaaaaaagaaaauaauaugauuaaaaaauuggcaaaagagcggaagagcuguuucucaaaauaagauauaaaaauggcugacagauauauuaaaaaaaugcucaacaucacuagucaucagagaaaugcaaaucagaaccacagugcaauaucaucucaccccuguuagaauugcuauuaucaaaaagacaugaaauaaaugcuggggaugauguggagaaaagggaacuuacauauuguugguggaguugugaauuaguacagccacuguggaaaauagugugaagguuccuaaaaaaaucuaaauagaucucccaugugauacagcaaucucacugcugacuguauauucaaaaggagggaaaucaguauauugaagaaauaucugcacucccauguuuauuacaacacuauucacaauagccaggauaugaaaucaaccuaacuguaugucaaaggaugacuggauaaagaaaagcugauauauguauacacacacacacacacacacacacacacacacacacaauggaauacuauucagccuuaaaaagaauuaaauccugucauuuguaguaucauggauaaaacugggggucauuauguuaagugaaauaagccaggcauggaaagacaaauauugcauauucucacucauauacaaaaguugacuucauggagguagagagaagaaugaugguuacuagagguugggaaggguagcaggaggaaugaagagagguugguuaauguguaccaacauacaguuaaauaggaggaauaaguucuaguguuuaauagcacaauagagugacuguaguuaacaauaauuuauugaauauuucaaaauagcuagaagacuugaaauguucccagcacaaagaaaugauaaauguuugaggugauagauaacucaguuacccagauuugaacacugcacauuauaugcuuguaucaaaaauauuaugugcaccccaaaaauauguccaauuauuauguaucaguuaaaaaaaaccaaaaaucaacaucacuguaacaaaugguauuuguauucuuauuuuuuuauagauauugacaaguuguuccaaaacccaugcucccaugaugagugaguuuaacuaucugcccacccccuugacauaucugauguacuuuuuuuuggcacaggugugcacacaauuugauagaaaaauaauuuauucuuguuagggaguauuuaaaaauauuuucaacuuuuauuuuagauacaggguguacacauaugcagguuuguuacauggguauaucgcacucagguagcaugcacaauacccaauagguagcuuuuuaacccaugccccacucugccccucaccccucuaguaguccacagugucuauuguuucgauauuuauguccauaugugcucaauguuuagcucccacuucuaaguaacaauaugcagcauuugguuuucuguuccuguguuaauucgcuugugauuauggcgucuagcugcaucuauguugcugcaaaggacaugauuuuuucuuuuuuuauggcugcauaguauuccuugcugucuguguaccacauuuucuuuauccaguccaccauugaugggcaccuagguugauuccaugucuuugcuauuaugaauaguaugaugaugaacauacaagugcacguguauuuuuggcauaaugaucuaauuuccuuuggguauguacccaguaaugggauugcugaaucaaaugguaacucuguuuuaaguucuuugagaaaucuccaaacugcuuuccacaguggcugagcuaauuuacauucccaccaacaguguauaaguguucccuuuucucugcagccucacugacaucuguuguucuuuuacuuuuuaauaacagccauucucacugguguaagaggguaucucauuguggucuugauuugaauuucucugaugauuagugaugagcauuuuuucauaugcuuguuggcugcuuguauaucuuuugagaaaugucuguucauguccuuugcccguuuuuuuaaugggguuguuucuugcugguugauuuguuuaaguuacuuauagauucuggauaauagacguuuguugaaugcauaguuugcaaguauuuucucccauucuguagguugucuguuuguugacaguuucuuuugcugugcagaagcucuuuaguuuaauuaggucucguuugucaaauuuuguuuuuguugcaauugcuuuuggggacuuauccaaaaauucuuuguccaggcugauguugaaaagaguauucauagguuuucuucuacacuuuuuauaguuugaguucuuaaauuuuuaauccauuuugaguuauuuuuguauauggugaaaggcaaguauccaguuucauucuuuugcauauggcuagccaaguaucccagcaccauuuauugaauagggaguccuuaucccguugcuuguauuuguuggccuugucaaagaucugaugguuguagguguguggcuuuauuucugaguuuucuguucuguuccauuggucuaugugucuguuuuuguaccaguacuaugcuauuuugguuauguaaccuuauaguauaauuugaaaucagguagugugaugccucuggcuuuuuucuuuuugccuuggcuauuugugcucuuuuuugguuccauaugaauuuuagaauaguuuuuucuaauucugugaagaauaauguugguaguuucauaagaauaacguugaaucuguaaauugcuuuggguaguauggccauuuuaaugacauugauucuucaaauccaugagaauggaauguuuuuccauuuauuuguguugucuuucauuucuuucagcaguguuuuauagugcuccuuguagagaucuuuuaccuccuugguucuugguguuccuagguauuucauuuucuuugugacuauuguaaauacgauuguguucuugauuugacucucagccuggguguuauugguguauacaaagguuaccgauuuucauacauugguuuuguaucccaaaaucuugcuaaaaugguuuaucaguucuaguagcguuuugguggauuuuuuaggguauuuuaauaauagaauuauaucaucagcaaagagggauaguuuaacuucuuuuuuuccuauuugguuaccuuuuuuucauucuguuucaugauugcucuggcuagacuuccuauacaucuuuuaagccuuauuguauguccugauauuuagcuagagauggcugaaucuuuucuuacgcuucucggauauucacauuucuuuuucugcgaauuuacaauuucaaaucauuugcccuauuugugcuuuucuuuugaauuuuaugaauucuuuuucuccuuugaauuuuuauucuuagucacuuuuguauguuacuauuauuuuauccuucuuuguugauugucuuuuauuuuuagaugaucaauuuuacugugguauaauuuaccugcaauagaauaugagauaccccuaggaaccuacuagaaugucuaaaauuaaaaaaagaauaccuaacugacaaugcgaaggugcuggcaaggauugugagcaaguaaaacucucauacauugcugauggaaguacaaaaugguacagcuacccuggaaaacaauuuggcaguuucuuacaaaguuaaauauacacuuaacauaugauccagcaaucucauucaaagguauuuaccauagacaaguaaaagcuuauguucacagaaaaauauguauacaaauguuuaugguagcuuuauuuauaauugccuuaaacugaaaacagccugagugguuuucagcuggugauagaauaaacaaacgugguguauguacaccaaaauauacuacuuaacaauaaaaaggaacaaaguacugauacauacaaaaauuuggaugaaucucaaaggcguuaaugcuaaucaacuaaaagaggucagacucauuaaggcuaaauauauuaugauuccauuuauaugacauucugggaaaggcaaaauuauagggacagaaaacaaguuagugcuugcuggagaaugggggugaaaaguggaugauuccacaucaaggaaauuuggacagugauggaauuguucuaugcuguaucuugauuaugguuguaauuaugacuauuauauguuugucaaaacucagcuguacaccuaaaaagugugaauuuuucuauauguaaauuacaccucaauaaaccuaauuaaaaauuuuaaaauuaaacccaugugauuugcauuauaaauuggaccaccauuugugauuaugaaauaugaacuugccaauaaacugcuacaggugacgcuaaacuauaaggagccccuucugcugcgucuacuaauuaaauacuuugaaugagguucaaaaauggccaauuugaaaauaaaaguaacuuuuaaaacaaaaguuguuacacagauauucaauugcagaaagaguaagagcuuugcucaaaaacuugaauaugacauucacauaauauccacuguuucuaggaaaaaaacuuauaauaaugucugcaucuguacauuacuuuagaguuuguaagguacuuuuauauaugccaucucauuuugaauuauugcaaaacaaugccucacuagcaaagaauaaauguucccaugaagcugcaagccccuaugacuaugaauacaauugugaaguagggauugucagaccccaagguucauuuucucccugagugacacuuaauccagagguaaaaaucagucucagauaguagaacaggccaaguuaugugguaaggcugugguguccccaaacagaagcaacuuugauggaagaaaacagagaauacauguaaacauguauuugugcacauuuguauuacauggcugcugagagaaaacagcaggcuguuuccuuucuagggccuguuuauuucugagcauaucuccuuggugagugcuccccacaaaauacuggugcauaauacguaacaucuuuccuuaaucauaaugcacccccuacgucccuggucccaggccuuuucucaccauguucccucguuuuugaauauacuuuuauacucccacacccuccacaaggcaguaauuuaaaccucauccauccuuaaggaccagccccaaacguccucauucacccaagcagaaguaauuacuuuuuguagauucccacugcauacugcuuaacuuucucuuauagaauugaucacauuuggcauugccucauauagauguuugauugcuuccaguuguaaacucauuaaguaccuagccuaguucauuggagacccaccacaccagcuagcagugugccuugcuauacuguaaggucuuagcacuuucacugaaguucaggcauaaucaagugugccacaugauuccagaaagcaccaagccaagaggaaacacagagguggauguggaaagcaaaauacaauaauaaagcaaaaguauguuucucccuguguuagucgggguuguucagagagaaacggaaccauuaggagauuaucuaucaagggguggggguugagagaaggggagagagggagagagagagagagaagaagaagagaagaggagaagagaagaaaggagagaggugagagaaagaaagaaaagaaaagaaagagaaaaaagauuuuaaggaacuguggaagccuacaggcuggagacccagggaagaguuaauauugaagccccagccaaaggcagucuucuuguuugggggugggggacagaaaaggagcagucauuuuucuauuaaggccuucaaaugauuggaugagacucaucaacauuaggaaggauaaccuacuuuaugcaaaguaaccugcuuuacucagaaacgucuagaauaaugguucaccaaauaaccauguugacacauaaauuaaccaugagaccuuuuuuucucuacaagaugcuccacaagucucuucuucccaguccuucucccaaugcaacgacugcagugggagccaccuccuuaaaaaggaagcaguuuuaucuaaggcaugcuaaacaaauuccuggaaaggucuaacuaaaugauaaugcuucagaaacuauagugaucacauaaccaaaaaaauuccaaguuauuuuaaaguugcagauaaaucccaauuguguauaauaauuuaucuugugauuggugaguuuuguuacauugcagucacauuuaaaaaaaaucucucagaagaauuaauuucaaaauaaaccucaauccuggaacacauuacaacauucucuucuuaugcuccucuuucuaaauaagguaccagugaccucaacugaaacugcaguuuaacuuuauuaaggaagaagaaauagaagggacaaaaacuguuguaaaauaaauuauaaauauuaauaaucacuaaugcugaaauuucuagugcucaaauaaacauaaaauuagaaacuggucuguucugccuauggaguagcgauucuuuauuccuuuacuuucuuaauaaacuugcuuuuacuuaaaaaaaaacugucuuaacuauuuuaaugaaguauuugaaaacaguuuuuuucccacaaauaucuuaugacacagaaauagaaccuagcagacuauuacacuagugagcaaauaaugaacuuuugguaaagcauacccaaccuucaguuagaauaucuccugauaauaagaaagaucucauugaaauuuauuaauucuuuugugucuaguagauaacuuggauggcacacagugcuuugauuuuuaccugcccagaauuuaacuccucauccuauccuacaugauuuucuuuuuccucucccccuuccucuuuuauuccaugucacugggaauggcaggucuugcaccaaguaauggcaggucuugcaccaagcaagccagaaaccugagcuuuagucuuuauuccuccccacuuuucacuccugcauccauucuaguagugaaaccauucaauagcuuucaauuaauccuuccucucucuuuuuucuuaguucagauucuuuaguuugaauuacucuaucaguuuucuaacuuauccacugacuucaggacuugccuuccuucaguuuguucaacugcauuuugagaaauacugcuaaugcuauucugaagucacucuugcuugaaaguauuucaguggcuccccaguaucaucaguauaaaaaaaucuuuuuuugaguuacacauaaacccuucaguauggaccugaucacuugcuaauucucaucgucuuccacacacagcaaacaaacugacuuuucugcugugguuuauguuuuaucucccuuauguggcucccucugccuggaaugcccacuccguuccccacuuugccuaguuaacccauauauguugucuaacaaagacuaaaaucaaccuuugucaccucucagaagcuuuacagacacaagaauauuaacuguaguguauugaacuugggaaaagagcaaugaucugagauacugagucaaaaagccucacagauaaucuaaacaauuuccaauccaaaggggcugaaccaguaguuuacaauguauuauuucccccauacuauucauauguguagugcauucuaucaguaacucucaauauaaguagugaaucuccagaagggaagggaacacuucgggagggauaauucaaugugcacauguugggacagaggaaaagaaagaaaagaaagagaagcagccucacaaaccuaagaaaaucuuaucaaauuuuuauagugaaacaguuuggggguggguggcauugaaucaaaaaugacuuuacuggagguccaguuuucaaauguagauaauaauuaugggcacagagauuuuauauagaguuuacaacuugacaauaagcucuuacaaaaucgccaguggaaaauguuugccauggucauaaauucagugaccugcuugaaagaugugugguauuuacccuaucuugcuccagccagcucauacagaaagcagcagcauaauccaaaggaguggggacauccauggaaaauuuccuggccuggcaguuugcaugauaagugaagaaaacacgauuuacuaagaaaaaugcagguggaacccccacagcaggaugaggccaacaaauuuauuacacuaggugaaauacacaugaaugucugcugccaggucagacucauaaauaugcauuaaaagagauucugaacccuuaugagaaccaguuuuuucucaaccuacaagggcugacagauuuaugguugaggguuuuacuucacaaacaaacccuuagguagaaccuacauuucugcuaaggucauaguguucuuucacaccaaggagacuccuaagaagaaacaaacaguuuuuuaacaguuuauacagguagaacauuccaguaaucagcagauagcaaaaucugugacuauaaugagcaacuaaaauggaaaaaagcagaaaaaauaggacaagggagucagaaaggacagacauuuuuucuaaucucuacuuugcuacaaauuaguuagcuaugaggaccccaguuuccucauuuauaaaguauguuaaggguaggaagauaauaaaaucuuuuaaggucugucccagcauugaaacaguaggauuugaucuagagugaccucccugacagauacgagggugaaauagaggcaggcucacaugacaguuacuggcaaggaagagaaauggguagucaugacugguggaagugaguaaaaguuacaaaaguaagcuggacauacagucuggguagccaacuuuauauuguuagaaaguuuaaccauucuuuuccaaacaucccuucccacaacuuucaaaauuauuccuuaacucuucuaugacuuucuauuguuauauucuacauuuguaucacaauaauguuaacaucaaccccuaguacagguagggcugaaauuucagucaaucuacucuuauauccacagccaaguauauguagagaggaugauauugggggaugauaugguuuggcuguguccccacccaaaucucaucuuaaauuccacguguugugggagggacccagugggagguaauugaaucaugggggcaggucuuuccuaugcuguucuugugauagugaauaagucucacaagaucugauguuauauaaaggggaguuucccugcacaagcucucuuuuugccugcugccauccauguaugaugugacuuccuccuccuugcccuccaccaugauugugaggcuuccccagucauguggaacuguaaguccauuaaaccuccuuauuuuguaaauugcccagucucugguaugucuuuaucagcagcaugaaaacagacuaauauaggggagaagggagaaauagagggaaugaggacuucuuucuucauuugugggguuuuuuuuuuuuugagagagugucucacucuguaacccaggugauagugcaguggcacagucuugguucgcugaagccuugaccuccagggcucaagcaauucucccaccucagccuccugaguagcuggcaauagaggcacucaccaccacaccuggcuaauuuuuaaauguuuggagacaugggggucucacuguguuucccaggcuggucucaaacuccugggcucaagugucuucccaccucggccucccaaagugcugggauuacagguaugugucacuaugcccagccucuuucuccauuugacaucaugauauaggcuucaauucaucaggaagagaaaacaauucuaaacuuuuguggaucuauugcauagcuucagaauacauaaagcaaaacugaacaauaagaaaaugacaaaucuguucauguccuucgcccacuuuuugaugggguuguuuguuuuuuucuuguaaauuuguuugaguucauuguagauucuggauauuagcccuuugucagaugaguagguugugaaaauuuccucccauuuuguagguugccuguucacucugaugguaguuucuuuugcugugcagaagcucuuuaguugaauuagaucccauuugucaauuuuggcuuuuguugccauugcuuuugguguuguagacaugaaguccuugcccaugccuauguccugaaugguaaugccuagguuuucuucuaggguuuuuaugguuuuaggucuaacauuuaaguuuuuaauccaucuugaauugauuuuuguauaagguguaaggaagggauccaguuucagcuuucuacauauggcuagccaguuuucccagcaccauuuauuaaauagggaauccuuuccccauugcuuguuuuucucagguuugucaaagaucacauaguuguagauaugcggcguuauuucugagggcucuguuguguuccauugaucuauaucucuguuuugguaccaguaccaugcuguuuugguuacuguagccuuguaguauaguuugaagucagguagugugaugccuccagcuuuguucuuuuggcuuaggauugacuuggugaugcaggcucuuuuuugauuccauaugaacuuuaaaguaguuuuuuccaauucugugaagaaagucauugguagcuugauggggauggcauuaaaucuguaaauuaccuugggcaguauggccauuuucacgauauugauucuuccuacccaugagcauggaauguucuuccauuuguuuguauccucuuuuauuuccuugagcagugguuuguaguucuccuugaagagguccuucacaucccuuguaaguuggauuccuagguauuuuauucucuuugaagcaauugugaaugggaguucacucaugauuuggcucuuuguuugucuguuguugguguauaagaaugcuugugauuuuuguacauugauuuuguauccugagacuuugcugaaguugcuuaucagcuuaaggagaucuugggcugagacaaugggguuuucuagacacuucucaaaagaagacauuuaugcagccaaaaaacacaugaaaaaaaugcucaccaucacuggccaucagagaaaugcaaaucaaaaccacagugagauaccaucucacaccaguuagaauggcaaucauuaaaaagucaggaaacaacagaugcuggagaggauguggagaaauaggaacacuuuuacacuguuggugggacuguaaacuaguucaaccauuguggaagucaguguggcgauuccucagggaucuagaacuagaaauaccauuugaccuagccaucccauuacuggguauauacccaaaggacuauaaaucaugccgcuauaaagacacaugcacacguauguuuauugcggcauuauucacaauagcaaagacuuggaaccaacccaaaugucuaacaaugauagacuggguuaagagaauguggcacauauacaccauggaauacuaugcagccauaaaaaaugaugaguucauguccuuuguagggacauggaugaaguuggaaaucaucauucucaguaaacuaucgcaagaagaaaaaaccaaacaccacauauucucacucauaggugggaacugaacagugagaacacauggacacaggaaggggaacaucacacucuggggacuguuguggggugggggaaggggggagggauagcauugggggauauaccuaaugcuagaugacgagcuagugggugcagugcaccagcaugucacauguacacauauguaacuaaccugcacauugugcacauguacccuaaaacuuaaaguauaauaauaaauaaauaaauaaauaaaaauauuuaaaaauuaaaaaaaagaaaaugacaaaucuaccaauuggaguggaaaauuguaaaccaccucucucaguaacugauagaacaagcagacaaaaaaaaaucuauuaugguuauacauaauuugaauacaauuaucaagcuuaauuuauugaguauacauagaauauuucagcaaguggagaaaaugucuuaucacaaguauggacagaacauuuauuaaaauugaccauauacuaggccaucaaacaagucucaacaacuagugaaaggacugaaaauuagaguauauucucugguuacugugcaauuaugcuaaaaauaugaaacaacuaaaaauagccauguauggauauugaaaaacauuuuuaaacaacacauggggugaaagaaauccuaauagaaauguaaacuacuuaaaacugagcaauaacaaacacugcauagcaaaacgugugaggugcagcguaagcaaaacuuacaggaaaauuuguagccuuaaaugcuuacacagccuucaucacuuaacgacagguauacauucugagaaaugcauccuuaggcaauuuugucauugugugaauaucauggaguguacuuacacaaacguaugugguauagccuacuacacaccuaggcuauaugguauagccuguugcucacaggcuacaaaccuguaaugcaugugacuguacugaauacuauagguaguugaaacauaaugaucuguauuuguguaucuaaauauaucuaagcauauaaaagguaugguaaaauaugguauaaaagauaaaaaaugguacaccugcauagggcauuuaucaugaauggagcuugcaggacugaaaguuguuaugggugucagucagugagaagagaaugugaaugccuaggauauuauuguacacuacuauagacuuuauaaacacuauacauuuaggcuuuacuaaauuuauaaaaaauauuuuuucuuugguaauaaauuagccuuaacuuacuguaacuuuuuacuuuguacacuuuuuaauuuuuuaaaacuuuuugccucuuuuguaauaacacuuagcuugaaacaaaaacauauugcacagcuauacaaaaauucuuuuuuuauauccguacauauauacauauaauuucuuuauauaagcauuuuucuuuuuucaugaacuggaagaauuaauauuguuuuuuauuuguauaaauguaagggguacaaguucaauuuugguacauggguauauuguauaauggugaagucuuggcuuuuaccauauauaugccuuuuucuauuuuuaaaauuguuuuuuuuuuuuuuuuuuuuacauuuuaaacuuuuuuuuguuaaaaacgaagacacaagcauauacaucagccugggccuacacaggguuaggauaaucaauuucacugccuuccacuuacacaucuuaucucacuggaaggucuucagggcaauaacgugcauggagcugucauuuccuaugguaacaaugcuuuuuuucuggaauaccuccugaagggaugugcagcugcucagcucagcaaaggcaccaacucccaagggggcaauuuucaguuucaguucaggugagggugugugugugugugugugugugugugugugugugugugacucuucuggauggcccuguuuucaccaggaugcagggcuccaccaaagcgcuguuugcucagcagcagagugcagauucagcucaggucccuaggggcagggugcaggcauggcugggagaagauggagcuguucugccaaaguauggguuccccaggagggacugcgcagccucaacucugccugaggggaugggggaaggaguggguggagcaguuccaccauuucuuggccccacagggaagggacaguuguucacagcuggacuugaggauauagggccacuaagcaggggugguuugagggcaguuuagucucagggaagaagaugugcugugacuacucguacucauccuggggcaagacauacucuagcauuagcucucagugcaguagcccugugggccacuugggguggggcacaguguuggcuucuuaucuguggggggagcacagcuuuguggucucuaggcagcucccucagcugagcuuaaugcuagugaggacugcaggggaccccaguagugaggauuguagguauccaaaggguugaugggggcugcugggauccucuugccuaccuuugcaccauagagagaaguuccuucugguucccagguuaucucacaugggggauggggugauggaguccuaguauuuccuuccguucuuuaugugacucuccugaguuucugugcucaccaagguuuguguuacuccuuugacgcacccugguguucuccauuaguuauuuucauuaaaauauagcuguuuauuuguuguuuugcuugucuuuauggaagggaggagggcuaggggcuucuagucggccaucuuccucucuacccauugugcuuuucuagugauacuguucugaaggcuggauccaacagaaauugugugugugcagagauguguaaauaagaaugcgauauuauagucaugugucacauaaccuuucggccagugauuaacugccuacgaaauuguggucccauaugauuauaacggagcugaaaaauuccuauugccuagugaagucagaucccuccuaauguuguagugcaaagcauucuucacguguuuguggugaugcugguguaaacgaccccacugugcugcuucuagugguauaaagguauagcaauacuguuauauauauaguacauaauacuugauaauaaaugacuguguuacugguuuauauauuuacuauacuuucuauuguuauuuuagaguauauuccuucuauguauacaaaaaccuaacuguaaacagcuucaggcagguccuucggaagguauuccagaagaaggcauuaucaucauaggagaugacagcuccaugcacguuauugccccugaagaccuuccagugggaugcgauguggagguggaagacagugguauuuaugauccugacccuguguaggccuaugugcuugugucuuaguuaaaaaaaaguuuaaaaaguaaaauaaaaguaaaaauugaauaaggauuauagaauaaggauauaaagaaauacaauauuuuuuacagcuguauaauguguuuuaagcuaaguuauuacaaaagaggcaaaaaguuaaaaaaaauuuaaaagcauauaaaaaaaguuacaguaagcuaagguuauuauugaagaaagagaaauuuuuuuauaaauuuaguuuaccuaaguguacaguguugauaaagucuacaacaguauacaguaauguccuaggccuucacauucacuuaccacucacuuacugacucacucagagcaaccaacuuccaguccugcagguuccauucaugcuaagugcccuauacagguguaccauuuuuuaucuuuuauacuguauuuuuacugcaccuuuucuaaguuuagauaugcuuagauacacaaauacugacuauuauguuacaguugccuacaguauucaguacagucacaugcauuagagguuuguagccugugaacaauaggcuauaccguauaaccuggguauauaauaggcuauaucaucuagguuuguguaaguguauucuaugauguuugcauaaugaugaaaucaccuaaugacacauuucugaguaccuauccccauuguuaagugaugcaugacuguacuuacaaugagaaacuauuggaaacucucuauguauauaccaaugggaagaauaaagaauugucucauuguguucaugggcacguaccuuaaugacuaaugauuuugagcaucuuuccauauauuuauuuguuauuccauauaucuuugaguauguguucagauuuuugcccauuaaggaaaaaaacuagauuuucuuucauuguagaguuguaauuuuuuuauugauucuggauguaaaucuuucaucagauguguggguugcaauuuuucuuccugguuugugguuuguccuuucauuuucuugguagucuuucucagaacaaaauauuguaauuugauaaagaucauuuugucagguuucucuuucguagaucauguuuuucauagcuacaagaucuuugccuaaccuaaaauccugaagauuuucuucuaucuuuucuuccagaaguuguauauuuuuggguuuuauauuuagaucugugauccacuuugaguuaacuuaaagcaaauaagauuuauuugcuaggaauacuuuuauuuguuuaacucauaaaauaaauauguuaugaaaauguguuacuaggaguuauugccuccaguugguauuuuggaagcaugggauuguuagugacauuuaagcucuuuugacccuggccagaaguuagaacuauaguugauuucauaauuuagugacuuaaaaguguguaguaucuggagcaaaucguuucaugaaagaauacuuaccaauauuuauuuuuacuauuuuaccccuguaguucuguuucauuaaaaauaaacacuuguccugacccacuaaacagauuucaugucucaugacugguuccagauaauuuaaaaagcauacuggcuuaacuaucuuccugaauuggaacucacaaucuucaccaccuccacuacuaaauaaauauuaccugucauuacccuuuucugucugcuuuguaacaauucuacuugguuuuucucuaagcacaguuuaauuuuuguuaugacuuuacaaauuuuuagauaauauacuaucagcuauguugucagaaaaaaaacaguaaauggaguaauagaaggaacuuauugugauacuguagaauuuuaguaucuauuaaaauagcgauguccagcccuggaggagcuauaacucuuccguauuuguguuucauuaccuauuccugucuuaguugaguuucuuuuacuucuauguagcagaaacacacuggagcuugcucuagccuaauggagccuagggaggccaagggcaggaagcuagaagggcucaguaacuuuggaagcuauucuugcuucuuguaucauuuguguuccaggcuacguuggcucuguuucuuuuuaugugaguccuuuacaccucugucuuucugaagacuggcuuucucugauuucucugugcauaugacugcccugagacccugggauuacuucuggccagacuagaauugcucugcuccaauucccaggagagauaguauauauaauuaguuuaggacaaguuccacuucuggucuaaucagcauggcccaaagguaguuagauuggaaagaacaacccauguuugccuuguggguagaugguaugcaguucucagagacugagaagggugcugggucuacugcaaguucacaaaaugcugguugguauacauuuaccuuuuaaaaugaauuuuaauuaauuugguuuucagaauguagaaguuuauaaaaaguucauuguauauuaaaaaagacugaguuaaggauuacaaaacuagaaaagucacacugacaucaaaggaugacuauucuuuuauuacuuucauguuaaaaauaauuaagcuuauauaacaaauuuagucaaauauauugaccacagaguacucuuuauuuucaaaggugguagucauccacauagugaacgucuugucgauccagcaguugaagguguuauaggcuaaagaaaauuaauauuuaaaauauuagacaugcauuacaaauuuaccucugaagaguuuucauuuagauauauuaaaauuccaaguuguagggaagggaagauaugagacccaacauuuauuguguuucugccuagucagucaguuaacauauuuuauuucauucagaccuuauagccacccuuugagaaguaggcguuguuauccuagaagcagugaagaaauuaaaacacacagaaaacagcuagcaaauauguagugaggcuagcauuuaagcucaagucugugugacucuacaguuucuucucucuucacucuacuguuuggggguaugaaaguauauuuauuaaacuuuucuaaaagaggcuauaaguaggacuauacagaagcuauucaguucauuuucuugucugugugcuuaagacagucucagugucaaacauaugauaaucauuucuccauaucuggagcaaaaagagagucaugucaguuaccuaauguuagucacuuaagcacauggauuuuuuagaggucauuacagugauaaaucaauauuuuaaaauagcaguggcuucuucaguuuggagagaaauguuuuuuaaccuuauauucuaaaccuuaaugcaugcuaaauugggaauuggagggaaaaagggaaagcugaccuuucuuuuuuagucugaacaaacaagaagaggaaagcaaagacuggcuaaauaguauaaggcaguauuuuaagcuuuccauguuuauucacuugaaaccuguuauuuuucaaaaacacauuuuuaagugaaaaaucagaaaauauauaugcuuuagaaauuauuguuaaagacaaauuuuguaacauaaaugcuuuauguaauaguuacauaaaacaaguuuaaguugucugguauugaugauauagaggaaaaacuauccuucaaauauuugugaauuuuaccugugaguuaaugaugguuuaccuucuaauuuaucaaccuaaauggccuuguccaauacaauuaaaaugaacaauuauuugguuuauuguaacuucagacuuagucggaaaaaaauauauaacagcugcuaggguguaauugcuaaaauaacuauaauaauuuuugucucugcauggugaagaauaugcauuaagacuuuagcaaaagauaagacugugcucucuuuguaaguagucugaucaaauguggcucaugacuuaaaauuaauuugauauaaaguaaaucuagcuuaauucuuuauuaagaauucacaaugaccuuuuugaaauagaggaauuugagaugaggaugagcuagaugcuccagaguucacauugcugcuacccuuuagggcauaaaaggagcaaccaaaaucaugcuauuuuaguucuuuaauaguuuggcuauuccuuuacaagcuaucuuuucuagggacaaacuaauauagcaugacauacuuuaagcaucaaacauaaaagaguuuugaccaaacugcucucagcauuucuguucugaaaguaccuaauuaaaaguaacccugaguuacuggcccagauauuggcccaguguaggggaaaugaagcccacuuagaguuaauggguugaaccaauuguccucuguaguucauuucaguaccucuaauguuuuucucauugguaagcuuugagacaggaugggagcuuauuagugacacaguuuucuucuucugaagcuaaacucuugguauugugaucuuuugaccuuuuauucgcucuaacuucuugauucccuuuuuccacuccucuaaaguacagcacauauacagguucauugauguacaaccaaauuuuacuguaguggugagcaugguuuauggauuuaauuaauugaccuauuagugaaauccagcuuauuggcagucuuucacgauugaaauucuaacuagucucucugcauaucuauuuagaucaucccuuaaccccaaugcuaggcugcugcuagguuagaucugaaagcacuaccggcagucaguuuugcauauucaguuaauuauuugguuucuuauaaaccacuucucuauuuuuuucuuuuacuuauucuuugcuuccaauuucuuggcuacaguuucuuaguucuguuugcuguuuagucagaggaccaguagaaaagagcauuuuccuuuuccuuuucaccagauucagggacaguuucuguguucuccugguucaggucucuguaagucaccauauguggcuuucaacccugucagacguugaccuuacccuuuuaaacauuuuguagcaguuuguuuaauuagugggaaauagaauucauagauagugugaccuacuuauauacauauaacaaaaucaauaccaugauuauaauauaaagaauaaauaaauauaauuuauagugaaacuguacguauuucaggauaugacugugagggcccaacuguacuagaagauguagugaaguagugaaugcuuguaccuacuucuuuuuuuuuuaaaacaaaaaguuuuuuaaugucuguagccuaaucuuggaaaugaagcuuguaccuacuucuaaagaauuaaguucagguuuaugagaaguaacaagguaauucuguauagaaaacuacagaaaaugaaaaauuagugguacauguggaccauaacauaaaaauguuagaauaaauaaccacagaugagacuuguuuguauauaauaagagaaagaaggaaauacuugaagccgagaaaacaugucaugacaaauuacagacucucaaaaugaagaaaaugaggaaguacgauauucucacaaaggacuugggccauauuuauaaggguacugagaaaguaauuuccuauauugugauagagaacaagacccugaugaggcaucacagaaagcauauuuccuauuuugaaauacuaccacuuuaagacaugguuuagauuccuggugccucaaaagaccuugaugaccaaauucuucucuaggugaugagaaauagagaggauggauuagaaagagaaacaauaaaacaguaagguauggagaagauggggcaguagaugucucuauaccaaaaagauagaaaaauaacaggcaaucaccaaaugaauacuuucaauauggguuuuuacaggauauguuucuuaguguuacagaacauuuuuuuuaacacauagaauuucguaauuugaaacauuaauuuaaguaauuuuuauucuuuuaaaaaauuugcucuucaaaauucaacuucaguaauuuuuauugagaucccuaugguucauaugucucuacgaauuuaauaaugcuuuguuuguaaucuuuaagaauggacucaaauauccucugccauuuuuugcagagguuccauugcuuuugcaguaacugcacuauuauacuaaacucuuuucaacaaauauauaauuagaaaugcucuaguauguagugcauagaguggauauauaauuuaguuuugagacaacaucuuuauuugauucaagcuucugccuccguaaagacuuuguccuaaauuauugggcuuuuuucuuaacuucuugucaaaucuaccuguauuaguauacacaguucguauacuaccuguguauuaguauacacaguuccugguguuuauuguguuaaguuucaccuggcagaguauuucccucuucugggaaaugaggccauucuuuacuguuugggacugcuccauguauuccauaacacuuaccucugcccaccaaaugcucgugguuucucucaauaauuuugagugguaaaaguaccccaacacauuuccaaaaugcuccucaggggcauuggacucauuggcuauuccuagcuaaauguauaugcuugcauuucuuaaaaaacaaccuccacaaauuuuauuuaugauuuaaaaacacuuaagguuaauccccauuuucucuuggaagaggagucuuuuuucagugugacuguuguggauugaauugugcccuccugaaaccuagauguugaagucccaaccccaccaguaucucagaauguggugaaguguggagauaggguauuucaugguagacucuaauucaauguaacugguguccuuuuaagaagagguuaggacauaggcagguucagagggaagaccaugugaagauggccaucuggaagccaaggagagagaccucagaagaacccaacugugcugacauguugaaucuguuguuuaagcugcccaguuugugguacuuuauuauggcaaccccagcaaacuaauacaaugacugauugauacuucuuaauauguguuauuuccauguuaguauaccaagauagcaguauaauuuagugguugcaguucagauuuucaagguuagaauucugacucagccacuuagcaauggugaccuugagcauauuaauaaacucugagaagccucuguuuuuuuuaaucuguaaaaugaggguaauaauacguucuucucuggguuguugugaggauuugguaaaguaacuaauguaaagugucugguacguggaagaauucuauaaauaauacuucuuuuuucaucugcuuccauuuuuagguauacuuugcauuuucaaaaaugauguaauggcauacuuguuagauggacauuuauuguggggauuucaggcugccugauucguggaugagggagagguuugcgggucauagggcuuuuucaauaccuuuauacucaauaauaugcauuuaacacuuuacaaagucauaguaccucacauccaggucuacaugaugcacaaggauuacccucauugugccucaggagauauuauuguaaccuuuguuuugcuuacauaacuuccuuuaagacacaguauaccuguccccugggaauaugcugagauaaguauucuuccucuguauugcauagugccuuagcacacauaccuucauucauagcauuuauaugcucuguuaugucuguuuucuccaugagacugaacucuuugaauguagguacuguuccucguucauauuuauauuccuaauguucugcacagugccugauucuuuguagaugugcuauaaauuacauauuaccaacauuuaugaguaaugcuaagugcuagaugcugucucugucucuguuuuacagacgguaguuaagugcucacgguaacacaguucagugguagagcuagaauugaacaccaugauagcuuauuugcagggcccaugcucuuaaccauuauaauauaaugucucuucccugagaauggaagggucaucaucugguauauuguaggucaguguagcccagagagggaguuuggaacauuuaauugguaggaccaagaaccugaagcacgccuuaccugaaagcaaguugggggugugugugcauguccugaugcuuggaaaagaaguuauauuuuaaugcacauagucugcuauauuauuuguacuacugguauugaagguuuagauaaaauuuguaucucugaaaugcacuuucuucauuaaaaaugaauuucuauagugauauagagugaaauuuccuaguaagcccccaaaucgcuuaaaauggaugucaucauugacugugcucccuuauacguugauagcaggguuaagaugauugauauagcuuuagggaauuugcuauauuuguaguggaaacagcgugagaagaaaagugaagaugcugcuuguaacaguuaaaacuucagauuucuuaaaugcuuaggagaugaacuguuccagaauuuuguuuuauuguauuuuuauuuacaacugauuuuaucuccuuaauaucaauguauuuuucauuuucaauacuuugguuaaauuuuuuccugcugacucauggcugucauuacagcuguuacaguaaaguguuuuagagaugcuguaggaucuguugagacuuguagaacuauuugcuucuacaauauaugaucccggauuguuguacucuucuuauguuccuugaacagcuuuugcauuuucuucuaugucaugccuuagugugccuuccuucagcuccuuaucuccuucuucugauuuuuugcaugcucaaaaccaguuggccaaacagauuuagaauuguacaugaaggacuaaggugugcgucaguuacuaacaugaaugugcauuugugcuugagcuuugugauaucuauucugucucugaggccucuuuuuuacuuguuucuuuacuguguuuugaauagaugaaguuacugcaaaauugguucauucuagacauacuauaaaaugaugucaauuuucagucugucuauuaaaagggauaguuuggcuuaauagucagaaguucagguacuuuuccaguagauuguuuuagugacauuuugcaauugauuauuauuggaaaguaaaauucuuucugccuuaaugaaagaaauugugcuuuaauuuauccuguuuaaaaggaaaagucaacaaauauuuugggugauaaauucaugaccagcauucauuugggcacguugcauaacugagcuauaguuauugacccagaagaaguaauaccucaucaggauagcaaaggauuauaauuguuuugaaagaucaagacgcuagccauggauuuaagaguggagaacuaugaaagcacuugguguuuaggaacucugagaggaacuguagaaugaaauaaaguagagcauaauaggaagguggaagcugauaaagacagagcacuaaauuaguguggcauacuuuaauuaauuaguguguguaagagaaauaaaaaugagggggggaguaggggaagggauuucuggagauacuacucuguaguuucauauuuagaagacaaaucaaagcuguuaauagacuguugacuuugagcugcaauuauugauaucaguaugagaaacagugggcugacaucagaauuuaaagggcuaaggugguaacacuauguaauggagaggcuuuaaaaucagacaguccuggguuagauuccuggcaucaucacuucuggcuauuuugacauuggauaacuucauguuuucuaaaaagccuagaaaacguguaccagugccugucuuucucuuuguauucaucauuuugguagauuacuggaagaugacuguuugggccuaaaggaagcuguccaguuuuaaauuguuguuguugcuguauauccuuacauauaauuuauugucagguauaugauuugcaaauauuuucuccuauucuguaggauuuuucacuuuuuuuuuuuugaaauggacucucgcucuguugcccagacuggagugcaguggcacaaucuuggcucacugcaagcucugccucccagguucacaccauucuccugccucagccucccgaguggcugggacuacagguguccgccaccacacccgacuaauuuuuuuucuuguauuuuuaguagaaauggggguuucacuguguuagccaggauggucucgaucuucugaccucgugauccacccaccuuggccucccaaagugcugggaguacaagcaugagccacggccccggccgauuuuucacauuuuugauaauguccagugaugcacaaguuuuacauuuugauuaaguccaaauuaucuauuguugcucaugcuuuuggugucaugucuaaaaauccuuugccaaaugugaggucauaaaaauuuguuuuuaucuaagaguuuuagcucuuaacagguuuuugauccauuuuaguuaauauuuguauaugguauacacaaauguauauguauaugguguauaccucauucuuuugcaugugacuauccaguugugccagcaccauauguugaagagacuuuccucuccucaaugaacagucuuggaacacuuauggaaaauaguuaaccauagacacguggcuuuauuucuggacucucaauucuauuccauugaucuauccuugugccaacaccacacuguuugauuaccacugcuuuauaguaaguuuugaaauugggaagugugagucuuccagcuuuguucugcugugauuaccuuuaaagauuaaucuuugcugaaaaaaagucccaaggaacagggacaaaguacagugugguuuugacaggggaauaaauacucugggaggcuguagcugagauagauagauuuaagugcucggaggcugauaauaaagaaaugaauaaaaaaguaaaauauauugaacaccuauuauaugucagcuguucauauauccucacaacaaacuugaggaaguggguauuggcuccccauuuuuaccuaguaacauucugagaauuaaugagaugaaguaauuugcuugugcagcuagaaagugacagcugaaccuaugucauuaagcuucuaaaggccuauuaccaugcugccuugauaaugaaacuaccugaauaaauguaucaaccagggucuaaucaagagaaagaaaucacaugaguuauuugaacaaagagaauuuaauauaaauaauuauuauguaaguauauuaucuacuguaaauuaauugaaaggguaaaaagguauuuuuuuacccaggacagauaaggcuuuccuguccgauacaauagccacuagcuacauguggcuuuugaguacuuaauuaugacuuuuacaauuagcuagucaguuucuacaaauaagucaguugagagucugaugaggauuguguuaaaucugcaggucacuuuggggaguauuaccaucuuaacaauauuaaggcuuccaauccaugaacaugguauguuuucccauuuauuuagaucuuauucuguuuuucagcaauguuuuauaguugccagaauauaaauuuuguacuuuuucuguuaaauuuauuuccaaguauuuuauguuuacauugauggaauuguuuuaaauuucguuuucagauuguuuauugcacauguauagaaauaaaaucuauuuuuguauauugaucuuguauccugcaacuuugcuggacucauuuuuuuacuucuaauagucuuccaucaauucuguaggauuuucuacguacaagcucaugucaucugcucugaaaaaauaaaguaaaaauaguuuuacuuccuccuuuccaauaugggugccuuuuuuucuuuuaaaaauuauuucccugaguuuuccaagaugaauuucauuuccuuuucuugguuaauuucccuggauagagcuucuagcacaauguugaauagagguagugagagcagacauccuuguuuuguuccuaauuuuagggggcaagcaucuaauguuuuaucaucaaguauaguguuguagacuuuuaaaaauauuacauuaaauuauuauucaucuuucuuucuuagagcugagggucuugcuguguuggccaggcuggucucaaacuccugggcucaaguaauccuccugccucagccuccugaguugcugggauuucagauaugagccacuaugccuagcauauucaucuuuauuacugaauuuuuuuugcaaccccuuaaauuucugugguugaggugagacccucacuuacuuuacaucaguuuuggcccugugguuauagaagauuugggggaaauuguaaaaaguccuaaagauucugaauucagauuguuuugcaagugucuuuauauucuauaucuguuuuaaagaaaccaaaucuguaacugacaguucaugcauucaucaugguagugagguuaauuuuaagaugccaugccaagauuuaauuaacaggcauuugugcaaaucaacagccuuaguucuauaucaaaugauaaaguaaaccauauccuacuuuaacuuuuuugaucuauuguugaacugugggucugaauguguuccauaagaugguuucuacuguggcuaugaagauuguagaaaagauagagcuaccuacacuucucuuuaugucuucugucauuuucuuaaauuugcuaaaaauauuuguuauagauccagaaaaacuguuaccuuuauucagaccugcaugcuguacucccuugaaucccuugcacaguaaaaguagagugaccuaauuuaguaacauggugauuucugcuggaaagauuuguaucugaaauacugcuuucuaaggaguucugacuggugauuugccaguuuuuuuuuuuuuuaccauauuugaaaaucacuuacuaaaaagaguuaaaacucuaguacauugacuauaugaauuuuaucagaacagguuuuaauuguuuuacauuuaauugacuuguggcuuuugaucgaauaggauguuaaacaguauuucaucuauuuagagggaaauacuuugucuuuuuaauguaauauugaggaauaugauaaacuccuaaggaggcaguuuauaauuuaauacaguacucacaauauuucuaagacugauugugauguauaaaucagaguggaccuuaaagaggguucuuaauucauauuagccuaugucauuuuagcaaaagauuaauacuuauuuuuuaagaaaugugauaauaaacuugucauugauaaagaaauacuuuuaugucuucuuguuguuauuuagauguugcuuaguguuugagcacggacuuuagauuucagcuauagauucacuuaaaaaccagaauucuucagcuuaaagaccucuugcacaaagaaagcaaaaugauguuuuuuuuucuuuuacuauacuagaagaauaucauguuauaaaaaugcugcuugcaucuagauuucaagaguuacuuggaacuuaauaauauuuuauuauauuagagauauaggcauuuuuguuuuaagauaguuugugaaucucauuuugcuuggauaaacagcuuucugauaaggugaucacuguaauauaaaagcacuuaagaauuuuacccuuuggaacauggagggcaaauugaauuauagcuuguuagcauggagaugaggaaaaaaagaaacaaccugcaccugcuugcuuaaacgcaucccaaauugaaagcuuuaauacaugaagccacuuaguuuucccuauaaaaugcucagcaguuuuuuaucuucacucaauuuaucuauagauuuccacuuaaaaucuuuuguaagcguuuuucuucuuucuccuucauugucuuuuucuuguuuguaauuuauugugggagaaauaggauuuuccaugguaacuaggacccugagagguguuuuauauucugugguuucagauuuucucuugguuucucucucucucucucucucucucucucucucucucucucucucuccucucucucucucucucucucucuccucuccucucucucucucucucucucacacacacacacacacacacacacacacacacaaauugagauuggacaucuuuucuuaugcuuauucuuuuuauugccauucuucugugaaaggccuguugaaauauuugcucacaggauugcucaccuuuguuucauuauguuuucuuuuuuuuauuauuauacuuuaaguuuuaggguacacgugcacaacgugcagguuuauuacauauguaugcaugugccauguuggugugcugcacccauuaacucuucauuuaacauuagguauaucuccuaaugcuaucccucccaccucgccccaccccacaacaggccccagugugugauguuccccuuccuguguccauguguucucauuguucaauucccaccuaugagugagaacauucgguguuugguuuuuuguccuugcaauaguuugcugagaaugaugguuuccaguuucauccauguuccuacaaaggacaugaacucaucauuuuuuauggcugcauaguauuccgugguguauaugugccacauuuucuuaauccagucuaucauuguuggacauuuggguugguuccaagucuuugcuauugugaauagugcugcaauaaauauacgugugcaugcgucuuuauagcagcauguuuuauaauccuuuggguauauacccaguaaugggauggcugggucaaaugguauuucuguuauguuuuuagaauauuuuauguauaaugaauauuaaacauuugccuauguugcacaucuccuggcuuccaaucucacacccccaugccucuucuuaauuauguuuaugguguuuuguaccauauacaauugcaacuuuuuguaaccagcaaacuuaaacauuauuuucuuuaugggcucuaaguuuugugucaacccuuagaaagauuuugugacucauuaaaaauuguuuuaaaaaauucuccuuuaucugucuucuaguuuuuuuuuuuucuugagauggcgucuugcucugucggccugacuggcgugcagugguacgaucuuggcucacugcaaccuccaccucuuggguucaagcaauucuucugccucagccuccugaguagcugcgauuacaggugcgcccagcuaauuuuuuguauuuuguuuuuuuuuuaguagagacgggguuucaccauguuggccaggcuggucucaaacuccugaccucaugaucugcccaccucggccucccaaagugcugggauuacaggcgugagccacugugcccggccucuacuacuuuuuuuuuuuuuuuugagacggagucuugcucugucgcccaggcuggagugcaguggcgcaucuccgcucacugcaagcucugccucccagauucaugccauucuccugccucagccucccgccuagcugggacuauaggcgccugccaccacgccuggcuaauuuuuuguauuuuuuuuuuuuuuuaguagagacgggguuucacuguguuagccaggauggucucgaucuccugaccuucgugauccgcccgccucagccucccaaagugcugggauuacaggcgugagccaccgcacccggcccucuacuucuuuuacgauuuuuucauauugcaauauuuaaucuaucugaaacauaugguauagauaggauuuuaaucuccucuccccagcauagccaguuuccccuaaaguguuuuuugagaaguuuuaucuuccuacugauuucaauugccacauucaugauauaguuaauaaccauauguauuuugaucuauuuuuagauucgacucuguucauuccucugucuguucccacacuaguaccacacuguaauaguuacuauauauauuuuuuacuacauuuuaauauccacuggaaaaaguuuccuugccucugccuccacaaccacccuccccaaacaccagccaugauguuuauugcuuauuuuucuuuuuuaagcuuauuggacaauuuuuauguguucaguucucccaaugaacuacagauucaacguacaaaauguccaccuucuccacaaaaaaucugacucuuuuagggaauuugauuguaauuguauugaauuuguguauucaauuugagggaaguuugcaucuuuaugauuuugaguuugucuguuccuggauaugguguguguguguguguaugugcgcgugaguguguguguuuccauuuauucagggucauuuauucuuuuaugugcuuccauaaaauuuuauuuuucuuuuuauuuauuuauuuauuacuuuuuuugagaugaagucucacucugucgcccaggcuggagugcaguggugcaaucucggcucacugcaagcucugccucccggguucaugccauucuccugccucggccuccugaguagcugggacuacaggugcccgccaccacgcccggccaauuuuuuuguauuuucaguagauacgggguuucaccagguuagccaggauggucuugaucuccugaccucgugaucugcccaccucagccucccaaagugcugggauuacaggugugagccaccguacccggccauaaauuuuauuuuucauaugucuuucauacaucuuuuaaagcacauuuguaaguuuuuuuuuuuuuuacaaacuuugcugcucucagguaggugguauuuuuuccaguacuuauagaauaugauauugguggaauauaagaaauccuuguuuucauggaccugacauucuuguaaugggccucucauugugcuaauuuuucaguugauacuuuugcauuuuccauaaaccuuauguuaccuauaaaucauuaauuuuuagacaaucauuuaugauccugcagcagcaacauuccucaggaacuuguuagcaaugcagauucucuagaccgaucccacaccaacugaaggagaaacucuuuccagcaauuugugcuucacaugucuccaaacucugauguaugcucaaguuuggagaccacugauguaaauaauaauuuuaugcugucuugcucauauuuucauuucucacauuuuuuaaauugcaagauguguguguaucagggcucaguggauuacauagaaugagcacugacugaauaggcugagacaaaucguuaacauccauggguaagaugggaggggaaugaugagacaugaauuauuccuuaauuucuuaauuccuuaauuaggugaauaaggaaaaaguaaaucagagagagagagagagaaggaaagaaagaaggaaauuaaguauacaauuuagggugaggauuuuagugguugacagagggaagucugauucaaagaucacuccuauagauaaguaagaauuguaacauuaugaaauugaaagaaauaaagacagcuaagccuaagccuggcauuugauacuuaaugaauguuuguaagaugaaguucagucuuugccauaugagggucaccaccauuagaaaaucauauagaauugcauuaauacaaggauaauacuuucaauauuggcaaaaaagccaauugcaaugaugagucagaugauaccaugagccaacaauauaccucaaaggcauuccuaaagccuauuaugaaugacaacaugagaagggacuaccaagggaucuugucaggaaagaaggaggccaggugugguggcuuaugcccauaaucccaacacuuugggaggccgagacaggaggacugcuugaggccaagaguuugagacaagccugagcaauauagugagacucuccugucuaaaaagaaaaaaagaaagaaagaaaagacgggaggaaugauauuaagcaguggaacugcaugguguaugguguauaccuauagccaacaugaaguacaaugauagugaccacaugguggugacaugggcagauugcuucagugacuauagaagggaagcugaaauuguugagaagagugugucagccacucuggcacuuggccaggaaaagggagaaaccuaagaaacaugggaauccagucuuuuugguaggaguuuagaccuaaaaguagcugugaacauaccucucuggacccccuaguuguagcauaagaugcuggucaaggggaaaccaggcaggcugaucauguacuuaaaaugagcguucugaaauaggcuuuagcugcaaccuuuaguauagugcaacuguuauuuuguuagggugcgugugugggagcauaccagauagaccuaucaauuuuuagauuuacuguagugaagaaucaccacucaaugcaacaguuagugcucagguauuuuaggauaagaccucuuuagugccacaggugggagaggagaauaagcuaaaugauucuaugaucuaacacucugggacauuuaaaaaaaucaacuuuugucuaacaaacuauuuuuuaaagaacacaauucuguuaaacuucagauuuugcauuuucaagaugauuuugaauuuuuguaaugcugcuauauauaauuuaauuuagaggagugcaauuaugugcaguuuuucuagauuuugcgguuuuuugauuuugucguguuuagcauuuuucacuaauccuuucugucaguuuucuuuucuuaccacaguacuuaucaaaauuuuauuugaagacagaguacuagagaaacuccuaaaauuucuuuuauauagcaucaguuuaauucauaagugagacuuaccuuauguagugugaaauuggcuaaggauaucucaaaucugauuauuuuaaagcuauuaguuuuuggacagaguaggaaagagugauacaguggguuuuaauuaaacgcuaggucauaaacuggaaucuuuauuugaaauauuaucuaagauaggugcuugagaaauauuagauuugugaauuacuuaaauacuuaugaauaaaauugcuugaacuuaugcaagauaucucaacuaucauaagcaguuuugucaguuuuguuucuggugagcuauauugaauauuuuaagggcaaaacuacaauuaggucguuggcagguaugugcucugaguaaugauuaguuucccuuuuauucaugagggugucauggccaggggaaagugugcauuuuuaauuacaauacuugucucguuauauuuuuguucugucugguuuuauuucuuugaaagcucuuuaaaaaaaauguuggccuuucuaugucauaucccgucugcacaucuacauagucccgacuucagggcagaaauaauauuuucuacuuuuuuuguuucuucuuuauuagaaaauuccaaacaugcagaaaaguacaauauaacaguugcccauguagccaccauguagcuguguaaaaccucaaaauuuugccauuuuuguuuuagauccucaacaaaaaaagauacaggugaagcuccuagaguauccuuccacaauugcauuuuccuacuauccucuccugggggaacuacuguccaaaauuugguauuuaucauuucccuuauuauuuuuguccuuuuucuauaucuguguguaugugugugugaguguguauguauauguguguacauauguguacuuguuuacuucuucaguuuacauuuuugucuaauguaaugcuauucagauuuaccugcucuaguaucuccuauuaugaaaacaaaauaaaacaaaacauuaacuacuuguacauuaugucucauccaacugccacccauuucucuacucucuauuaaaggaacacuccuuguaagaguuguguacuuauuuccucucucccuucuaauucuuaaacucauacuaaucagcucaucuccauuacuccacacaacccagucuuacuuaacaaggucuccaguugccucucugucacuacacuaaguugucauuucucacuuccuuacuuaaucucucagcaacaucugacacacuugcuuacucuuuucuucauauaacaccuuauuuugucuucuggguuaccacaccuuccugguuucccuucgagcccacggccucuccuuacucuuuuuuaccagauccuuuuugucuuuuuauuucaaaaucaauugagcaaaaaaaauacaggauuaaaaguaaacaucucucccaucucauauuccuucucacaaauaaaggcuauaaacaggcuuuauguguugugcaugugcaugcacaugugugugaauucauaggugaaaacagugccucaauuaaaauagcauuuauuuguuuccuguuucuauuaugguuggugcgaaaguaauugcgguuuuugucauuaaaaguaauugcaguuuuaauggcaaaaacugcaauagcuuucacaccaaccuaauauugguuuuauaugugcuucuugcuuauauuauuuccuuauuuuaccauuauauguuauuguuuucacuaauuuguguaaguuaaaauuauuagcccuuuguugccugucauguguguuaugaauuauuuuuccuaguuuaucaguugccugagggccuuggcauauuugaaguacagaguuuuaauuuuuuucuaugaucagauugaauagucuguuaugauuucugauauuugggugcugcuugccuucuucacugcaugauuauaaauaauuucacuuagguuuucuuuugguacucuuucagcuucauuuuguuaccuuuaaauuuugauccuucuggaauguauuucagggcaacaagugaaauaguggauaaccucugcuuuuuaaaaaaaauaaacacaaccaaauggcuacccaguuguccugaaaucacuuauucaaucauccccccuucucuuacuuguuugaaaggccaucuuuaccccagaguaacucccugcuguauuugcauuccucacaagaucuugaaauaauuuauuuauuuuuguuuuguuuuucaagccacugcaguaaaguucuccccacugauauugaaacugcucuugguaaaggucaccacucauauuauaauuguuaaaucaaguagauguaucuuacuuggucuugaauuuguugaaugcuguugaacuacucuuccuuuuuagcuuuuaucucacaauucucauaguuucccuccuaccguucucucuguuuuccuuacuaauuugucuucuuccauuucuuugggauuccaccuucucauggggaauauauucuuuuucugcuuuuuauuuauuuauaauuuuugugggcacauaguagguguauauauuuaugggauacaugagcuguuuagauacagacauguaauuggaaauaagcacaucauggagaaugggguguccauccccucaagcauuuauccuuugaguuacaagcaaucuaauuauacucuuuaaguuauuuuaaaauguacaacuaaguuguuauuaacuauaguugcuccuguugugcuaucaaauaauagaucuuauuuauucuaucuaacuguaguuuuguacucauuaaccauccccacuucucccuacccagcuacccuucccagccucugguagccaucauucuaccaucugucuccaugaguucaaucauuuuaauuuuuagcucccacaaauaagugagaacaugugaaguuuaucuuucugugccuggcuuauuucacuuaacacaauguccuccaguuccauccauguuguugcaauugacaagaucacauucuuuuuguaguuaaauaguacuccauuguguauauguacuacaucuucuuuauccauucaucuguugauggacacuuagguugcuuccaaaucuuggcuauugaauagugcugcaauaaacaugggauugcagauaccucuuugauacauagauuuucuuucuuugggguuuguaauuagcagugggauugcuggaucauaugguagcucuauuuuuaguuuguugaggaauugccaaacuguucuccauaguagugguacuaauuuacguuccaccaacaguggacaaggguuuccuuuuaucuacauccuugccaacauuaguuauugccugucuuuuggauaaaagccauuuuaacugagaugagaugauaucucaguguaguuuuauuuuuauuuuuauuuuuuggagacagagucucacucugcugcccaagcuggagugcaguggcucaaucucagcucacugcaaucucugccucccggguucaagcaauucucuugucagcuuccugaguagcugagauuacaggcaugcaccaccacgcccaucuacuuuuuuuguguguacuuuuaguagacauggauuuucaucauguuggccagcuggccucaaacuccucaccucaagugguccacuagccucagccucccaaagugcugggauuacaggcgugaaccaucaugucuggcccucaguguaguuuugauuugcauuucucuaaugaucaaugauaucagccaccuuuuuauuggccuguuugccauauguaugucuucuuuugagaaaugucuauucagauaguuugcccauuucuuuuucuuucuuuuuuuuuuuuuuuuugauggagucuugcucugucgccuaggcuggagugcaguggcgcgaucuugguucacugcaagcuccaccucccagguucacgccauucuccugccucagccucccuaguaacugagacuacaggcgccugccaccaugcccggcuaauuuuuuuguauuuuuaguagagacaggguuucacuguguuagccaggauggucucgaucuccugaccuugugaucugccugccuuggccucucaaagugcugggauuacaggcaugagccaccacacccagccuguuuugcccauuucuuaauuggauuauuagaauuuuuucuauagaguugcugagcuccuuacauauuuugguuauuaaucacuugucagauggaugguuuacaugugggaaaaaauagaugcaaauuauccaucuaucguugucucuucauuuuguugauuguuuucuuugcuguguagaaacuuuuuaacuugaugugaucccauuuguccauuuuugcuuugguugucugugcuuaucagguauugcucaagaaaucuuugccuagaccaauauucuggagucuuuccccaauguuuucuuuuagaaguuucauaguuugaggucuuagauuuaugucuuuaauccauuuugauuugauguuucuauauggugagagauaggggucuacuuucauucuucugcauauggauacccaguuuucucagcaugauuuauugaagagacuguccuuucccuaaugcauauucuuggcaccuuuguaaaaaaugaguucauugaagauguauggauuuauuucuggguucucuauucuguuccauuggucuaugugucuuuucuuauuccagcaccaugcuguuuugguuacuguagcucuagaguauaauuugaggugagguaaugugauucuucugauuuuccuuuuuuuuuuuuuuuccucagaguaacuuuggcaauucuggucuuuugugguucuuauuaauuuuuggauuauuauuucuauuucugugaagaaugucauugguauuuugauagggguuacauugaaucuguaaauagcauuggguaguauggacauuuuagcaauauugauuccuccaauccaugaagaugaaauaucuuuccauuuuguuguguccacuucaauuuuucaucaguguuuuauaguuuucauuguagaggucuuuaacaucuuugguuaauucuuagguauuuuccuuuauguguggcuauuauaaaugggauuacuuucuugguuucuuuuucagauuguucacuuuugacauauagaaaugcuacugauuuuuuauguugauuuuguauccugcagcuuuacugaauuuaucaguucuaauaguuuuuggguggagccuuuagguuucuccaaauauaagaucauguuaucugcagucaaggauaguuugauuucuuccuuuccauuuuguaagccuuuauuucuuucucuugucugguugcucuaucuaggacuuccuguacuauguugaauaacaauggugaaagugggcauccauauuuuguuccagaucuuagaagaaaggcuuucaguuuuuucccauucaauaugauacuagcugugggucugacauaaacagccuuuauuguggugagguguauuccuuuuauacccagguuuuugaggguuuucuuuuuaucaugaagcgauguugaauuuuaucaaauacuuuuucauuaucaauugaaaugaucauaagguuuuuguccuuccuucuauugauauuauauaccacauugauugauuuauguauguugaaccauccuugcaucccuggggcaaaacccauuugaucuugaugaauggucuuuuuaauguguuguugaauucaguuugcuaauauuuuguggaggauuuuugcaucaauguucaucagauauauuggccuauaguuuucuuucugugaugugucuuuguuugguuuugguaucagggcaauacuggccugguagaaugaguuuugaaguauucauuccuccuccauuauuuggaauaguuugaguaggauuggcauuauuucuucuggaaagguuugguaaaauucaucagugaagccaucugauccuguacuuuccugugcuggagacacuuuauuacaguugcaaucucauuacuuguuauuggucuguucagguuuuggauuuuuucaugggucagugucacuagguuguauaugucuauaaauuuauuaauuuauucucgauuuuccaauuuauugucauguauuugcucauaguagccaguaaugauccuuugaauuucugcaguaucaguuguaaugucuccuuuuucuucuuugauuuuauuuauuugggucuuuucuucauuuuucugucuggcucaggguuugucaauuuuguuucucuuuucaaaaaaccaacuuuucauuuuguugaucuuuuguauuuuuuuuuuucauuucaaugucauuuauuucugcucugaucuuuaugauuucuuuucuucuacuaaguuuggguuugguuugcuuuuuuucuauuucucuaagaugcacuguuagguuguuuauuagaauuuuauaucuuuuugauguaggcauuuauaacuauaaacucuccuuuaaguacugcuuucacuguaucuuauagguuuuguauguuuuguuuacauuaucauuuguuucaagaauuuuuugaauuuccuucuuaauuucuuuuuauaaaaucugcugugagagaacagcuucuaaauuucuucauugacccacugaucauucaggaguguauauuuuaauuuucauguguuuguacaguuuccaaaauuucucuuguuauugauuucuaguuauauucuauuguggucagagaagaugcuugauguaacuucaauuuuuuugaauguuuuaauacuuguuuuguggcccaacauaugaccuguccuugaaagugauccauaugcugaggagaagaauguguauucugugcugguggaugaaauguucuguaaauuucuauuaguuccauuuguucuauagugcagauuaaguccaauguuucuuaguugauuuuucagucugggugauguguccaaugcugaaaauggguuauuaaagucuccagcuaugauuguauuggcaucuauugcucucuuuaggucuaauaauauuuacucuauaugccuaggugcuccagugucgggugcauauauguuuacaauuuuauauccucuggcugacuugaccccuuuaucaguauaaaaugccauuuugucucuuuauaguuuuugucuugaaauauguuuugugauauaaauauagcuauccuggcucuuuuuuugguuuccauuugcauggaauaucuuuuuccauucccuuauuuuugaacuaaguauuucucuacagguuauguguacuuuuuguaggcaacagaucuuugggucuuguuuuugaaaaccauucagccaaucugugucuuucgauuguaggauuuagucacguagauucaauguuguaaggacuucagccauuuuguuauuuguuuucugguuguuuuauggucuucucuuccuccuuuccuucccuccugucuuccuuuagugaaaauaauuuucucugguuguauauguuaauuuuuuauauaucugauauauguuuuuugauaugagguuaccaugagacuuucaaauaauaucuuauaacucauuauuuaaacuguugacggcuuaauacugaauguguaaauaaucaaacaaauaagcaagagaaaaccagagaaaaccaauaaaacucuacacuuuaacuucuuccccuagcuuuuuaacuuuuuguugucucuuucuuuucuuuuugagauagggucucacucugucauccaggcuguagugcaguggugugaucucagcucacuguagccucgagaccuccuggccuuaagugauccacccaccucaaccucccuaguagcugggacuauaggcaugcaccaccaugccuggcuaguuuuuguguuuuuuguagagacaggguuuugccauguugcccagacuggucuugaacuccugggugcaagugauccacccaccuuggucccccaaaguacuggggcuacaggcaugagccauugugccuggccugauguuucuauuuauaucuuguuauacuguuuaugcugugaaaaguuguaauuauauuucacuguguuauaauauucugugguuuucagugugcuuaucauuaccaguagguuuuguaccuucugaagauuuugucuugcucaauaauauccuuuucuuucagauugaggaacucccuuuagcauuucuucuaggacagaucugguguugaugaaauuccucagcuuuuguuugucaaggaaggucuuuauuucuccuucauguuugaaagauauuuuugccagauauacuacucuaguguaaaaguuuuuuguuuuccuucaacacuuuaaauaugucaugucacucucuccuggccuauaagguuuccacugaaaagccugcugacagauguauuggagcuccauuguauguuauuuguuucuuuucucuugcugcuuuaggauccuuucuuuguccuugaccuuugggaguuugauaauuaaaugccuugagguggucuucuuugagcuaaaucuacuugauguucuguaaccuucuuauacuugaauauugauaucuuucucuagguuugggaaguucccuguuauuaucccuuugaauaaacuuucuauccucauuucucuaucuaccacuucuuuaaugccaauaacuccuagauuugcccuuuugagacuauuuucuagauauuguaaguauacuuuauucuuuuuuauuuuuucuuuugucucucuauuuucaaauaaccuauauucaagcucauuaauucuuucucauguuuuaucaguucuacuguugagagacucugacucauucuucaguaugucauuuguauuuuucagcucucgucugauaggauucugaauucuuucuccguguuaucuuuaauuucauugagguucaucaaaacagcuauuuugaauucuccaucugaaaugugacauaucccugucucucuaagacuggucucugguaccucauuuaguuuguuuggugaggucauauuuccuggguggucucaacguuuguagauuuucguuggugucugggcauugaagaguuauguauuuauuuuaaucuuugcaguguggacuuguuuuuacucauccuuccugggaaggcuuuccagguauuuaaagggacauggguguugugaucuaagucuuuggucacuguggcuauauuuucauuaaugggcaucucaaaccucguaacgcuguggcucuugcaaacucuuggagauacugccuugguuguuuuugcuaagauccagaagaauucuauggauuaccaggcagagacccuuguucucuuccccuaauuucccccaaacaaauggagucucucucucucucuuuucugaguuguuuagagcugagggagaggugacaccagcaccucuguggcaaccaccacugggacugcacugggucccaccugaugcuagcacagcccuggguuuugcccaaggcucaugguaaccacuuccuggcuacugcuuauguucauucaaggcccaagugcucuacaaucagcauguggugaauccagccaggcuuguguccuucccuucagcauggugaguucucccuggcccuggguguguccagagauccugucugggaguuaaagccuagagucggaaaccuuaggaaucuaccuggugcucuagucugcuguuacugagcuggcacucaaguugcaagacaaaguccuccccacuuuucccccuccuuuccugaagcagaggagccacuccuuuuggccauccuuaccccagggcuguaaugaguacuaucuagcuaccagugauguucacucaaggcucaagugcuccucagucagcuuguggugaaugcugccuguccugagucuuucucuucagggcagugggcuccccucuggccagggcagguccagaaauaccguccaggagucaaggccuagaauuggggacuguaggagccugcuugguccuuuaccccacuguggucucuccacauagcuaacacaucuaggaauguucugggucacaugugaagccagcauggcucugagucucucccaaaacccacagugaguauugccucacuaccacugcugauuuuucagggcccaagggcccuuuaaucagcagaugauuaauccugcuuaggacuggguccuucccuucaaggcagcagguuuccuuuuugcucagggugucuguagaaaugucaucugggaacuagggccuggaaugggggcuucagaacugugccugcuguccuagccuacuguagguaagcuaguaugcaaguugcaagacaaaaucaucuuuuucccuucuguccucaaguggaaggaaggagucucuccuguagcugugaacggugcugccugggguuaugggagggcugaugcaagcacucccuugggugcaccagcuugugucucacugggucaugugcaccccacauccacuggcuuugagcccagcauaacaccaggacuugccuaggaauugcaguccuaguggccuggacugccuucucacuuuauuuagaaugccagagcgcuuuagcccaugguagcagggcuugauggaacucagguucuaaucauugggauaagcaauuuaucucuuccuaggccuggucuaaaugcucccuccauggucguuggcugaguuuuuccccuuguugcucucuacucugacaggguagcacugaguuccaauggaaaguccccauuacugcaaucucucuccucuagugcacagauucucccucugcacaauguggccacugccaggggauggagggguggugauguaggcgauuaagggcuguauauccuacaaucuucagggccuuuuuccuuaauuugauguuaaaacaagguauugugaucauucaccugauuuuugguuguuaugaaaguucuuuuuuguguaaauaguuguucaauuucgucuuccuacaggagagaugaucacuugaggcuucuauucagccaucuugcucugauugccuucacuugaguaacauuucccaaucucaucacuucacuuguuacuuaauuggcuaaauauuccuacauugacacuucuaguuccaaucuaaaucuagauguaaucuuuucaauuuucuguuagacacuguuugguguguccuaugguacauaaauguguguacaucaaacaauuguucuccuuuuuucaauauuuuuccuuauucucuacaugcuaccucacuugauaucuucauccucaucccaguuauuuaaacagauuuugugauuuuguuugugaucuccuuaucccuguaauaccuauucaugaucuuuuagucaaucaguccuaguucacucuggcuauccucauagacauugucugggcucuuaucucaguucuugacuguagaagaacuuucuuaacugaucucuagauaucuagucuaucucucuuccauccccauauuggagcugugcuaauuuucuuuucuuuuuuuuaauuacuauuauacuuuaaguuucaggguacaugugcacaaugugcagguuaguuacauauguauacaugugccaugcuggugcacugcacccacuaacucgucaucuagcauuagguguaucucccaaugcuaucccuccccccuucccccaccccacaacaguccccagagugugauguuccccuuccuguguccauguguucucauuguucaauucccaccuaugagugagaauaagcgguguuugguuuuuuguucuugcgauaguuuacugagaaugaugauuuccaauuucauccaugucccuacaaaggacaugaacucaucauuuuuuauggcugcauaguauuccaugguguauaugugccacauuuucuuaauccagucuaucauuguuggacauuuggguugguuccaagucuuugcuauugugaauagugccgcaauaaacauacgugugcaugugucuuuauagcagcaugauuuauaguccuuuggguauauacccaguaaugggauggcugggucgaaugguauuucuaguucuagaucccugaggaaucgccacacugacuuccacaaugguugaacuaguuuacagucccaccaacaguguaaaaguguuccuauuucuccacauccucuccagcaccugugguuuccugacuuuuuaaugauugccauucuaacuggugugagaugguaucucauugugguuuugauuugcauuucucugauggccagugauggugagcauuuuuucauguguuuuuuggcugcauaaaugucuucuuuugagaagugucuguucauguccuuugcccacuuuuugaugggguuguuuguuuuuuucuuguaaauuuguuugaguucauuguagauucuggauauuagcccuuugucagaugaguagguugugaaaauuuucucccauuuuuuagguuuccuguucacucugaugguaguuucuuuugcugugcagaaguucuuuaguugaauuagaucccauuugucaauuuuggcuuuuguugccauugcuuuugguguuuuagacaugaaguccuugcccaugccuauguccugaaugguaaugccuauguuuucuucuaggguuuuuaugguuuugggucuaacauuuaagucuuuaauccauuuugaauugauuuuuguauaagguauaaggaagggauccaguuucagcuuucuacauauggcuagccaguuuucccagcaucauuuauuaaauagggaauccuuuccccauuucuuguuuuucuccgguuagucaaagaucagauaguuguagauaugcggcguuguuucugagggcucuguucuguucauugaucuauaucucuguuuugguaccagcaccaugcuguuuuggugacuguagccuuguaguauaguuugaagucagguagcaugaugccuccagcuuuguucuuuuggcuugggauugccuuggugaugcgggcucuuuuuugguuccauaugaacuuuaaaguaguuuuuuccaauucugugaagaaagucauugguagcuugauggggauggcauugaaucuguaaauuaccuugggcaguauggccauuuucacgauauugauucuuccuacccaugagcauggaauguucuuccauuuguuuguauccucuuuuauuuccuugagcagugguuuguaguucuccuugaagagguccuucacaucccuuguaaguuggacuccuagguauuuuauucucuuugaagcaguugugaaugggaguucacucaugauuuggcucucuguuugucuguuguugguguauaagaaugcuugugauuuuugcacauugauuuuguauccugagacuuugcugaaguugcuuaucagcuuaaggagauuuugggcugagacaaugggguuuucuagauauacaaucaugucgucugcaaacagggacaauuugacuuccucuuuuccuaauugaauaccauuuauuuccuucuccugccuaauugcccuggccagaacuuccaauacuauguugaauaggaguggugagagagggcaucccugucuugugccuguuuucaaaaggaaugcuuccaguuuuugcccauucaguaugauauuggcuguggguuugucauagauagcucuuauuauuuugagauaugucucaucaauaccuaauuuauugagaguuuuuagcaugaaggguuguugaauuuugucaaaggccuuuucugcaucuuuugagauaaucaugugguuuuugucuuugguucuguuuauaugcuggauuacauuuauugauuugcguauauugaaccagccuugcaucccagggaugaagccccuuugaucaugguggauaagcuuuuugaugugcugcuggguuugguuugccaguauuuuauugaggauuuuugcaucaauguucaucaaggauauuggucuaaaauucucuuuauugguugugucucugcccggcuuugguaucauaaugaugcuggccucauaaaaugaguuagggaggauucccucuuuuucuauugauuggaauaguuucagaaggaaugguaccaguuccuccuuguaccucugguagaauccgacugugaauccaucugguccuggacucuuuuugguugguaaaccauugauuauugccacaauuuuagcuccuguuauuggucuauucagagauucaacuucuuccugguuuagucuugggagaguguaugugucaaggaauuuauccauuucuucuagauuuucuaguuuauuugcguagagguguuuguaguauucucugaugguaguuuguauuucugugggaucgguggugauauccccuuuaacauuuuuuauugcgucuauuugauucuucucucuuuuuuucuuuauuagucuugcuagcggucuaucaauuuuguugauccuuucaaaaaaccagcuccuggauucauuaauuuuuugaaggguuuuuugugucucuauuuccuucaguucugcucugauuuuaguuauuucuugccuucugcuagcuuuugaauguguuugcucuugcuuuucuaguucuuuuaauugugauguuagggugucaauuuuggaucuuuccugcuuucucuugugggcauuuagugcuauaaauuucccucuacacacugcuuugaaugcaucccagagauucugguauguugugucuuuguucucguugguuucaaagaacaucuuuauuucugccuucauuucauuauguacccaguagucauucaguagcagguuguucaguuuccauguaguugagcggcuuugagugagauucuuaauccugaguucuaguuugauugcacuguggucugagagauaguuuguuauaauuucuguucuuuuacauuugcugaggagagcuuuacuuccaacuauguggucaauuuuggaauaggugugguguggugcugaaaagaauguauauucuguugauuugggguggagaguucuguagaugucuauuaggucugcuuggugcagagcugaguucaauuccuggauauccuuguuaacuuucugucucguugaucugucuaauguugacaguggaguguuaaagucucccauuauuaaugugugggagucuaagucucuuuguaggucacucaggacuugcuuuaugaaucugggugcuccuguauugggugcauauauauuuaggagaguuagcucuucuuguugaauugaucccuuuaccauuauguaauggccuucuuugucucuuuugaucuuuguugguuuaaagucuguuuuaucagagacuaggauugcaaccccugccuuuuuuuguuuuccauuugcuugguagaucuuccuccauccuuuuauuuugagccuaugugugucucugcacgugagauggguuuccugaauacagcacagugaugggucuugacucuuuauccaauuugccagucugugucuuuuaauuggagcauuuagcccauuuaccuuuaagguuaauauuguuaugugugaauuugauccugucauuaugauguuagcuggugauuuugcucguuaguugaugcaguuucuuccuagucucgauggucuuuacauuuuggcaugauuuugcagcagcugguaccgguuguuccuuuccauguuuagugcuuccuucaggaucuguuuuagggcaggccugguggugacaaaaucucucagcauuugcuugucuguaaaguauuuuauuucuccuucacuuaugaagcuuaguuuggccggauaugaaauucuggguugaaaauucuuuucuuuaagaaugucgaauauuggcccccacucuccuggcuuguagaguuucugccgagagaucugcuguuagucugaugggcuucccuuugaggguaacccgaccuuucucucuggcugcccuuaacauuuuuuccuucauuucaacuuuggugaaugugacaauuaugugucuuagaguugcucuucuugaggaguaucuuuguggcguucucuguauuuccugaaucugaauguuggccugccuugcuagauuggggaaguucuccuggauaauauccugcagaguguuuuccaacuugguuccauuccccccccucacuuucagguacaccagucagacgcagauuuggucuuuucacauaguccuacauuucuuggaggcuuugcucauuucuuuuuauucuuuuuucucuaaacuucccuucucacuucauuucauucauuucaucuuccgucgcugauacccuuucuuccauuugaucgcaucggcuccugaggcuucugcauucuucacguaguucucaagccuugguuuucagcuccaucagcuccuuuaagcacuucucuauauugguuauucuaguuauacauucuucuaaauuguuuucaaaguuuucaacuuccuugccuuugguuugaauuuccucccuuagcucggaguaauuugaccgucugaagccuucuucucucagcucgucaaagucauucuccguccagcuuuguuccguugcuggugaggaacugcguuccuuuggaggaggagaggugcucugcuuuuuagaguuuccaguuuuucugcucuguuuuuuccccaucuuugugguuuuaucuacuuuuggucuuugaugauggugauguacagaugggccugugguguggauguccuuucuguuuguuaguuuuccuucuaacagacaggacccucagcugcaggucuguuggaguaccuggcccugugaggugucaggcugccccugcuggggggugccucccaguuaggcugcuugggggucaggggucagggacccacuugaagaggcagucugcccguucucagaucuccagcugcgugcugggagaaccacuguugucuucaaagcugucagacagggacauuuaagucuguagagguuacugcugucuuuuuguuugucugugcccugcccccagagguggagccugcagaggcaggcaggucuccuugagcuguggugggcuccaaccaguucaagcuuccuggcugcuuuguuuaccuaagcaagccugggcaauggugggcgccccucccccagccucgcugccgccuuguuguuugaucucagacugcugugcaagcaaucaggagacuccgugggccuaggacccucugagccaggugcuggauauaaucuccuggugcgcuguuuuuuaagcccgucggaaaagcgcaguauucgggugggagugaugcgauuuucuaggugcggucugucaccccuuucucugacuaggaaagggaacacccugaccccuugugcuuccugagugaggcaaugucuugcccugcuucggcucgcgcacggugcacgcagccacuggccugcacccacugacuggcacucccuagugagaugaacccgguaccucagauggaaaugcagaaaucaccugucuucugcgucacucacgcugggagcuguagaccggagcuguuccuauucggccaucuuggcucccuccgcuaauuuucaaauauauauuugucuauauauaugaucuggcuaaaaauuuuaguuauauauauuauauauaacuaaauauauauauauaacuaaauauauauacaacuaaauauauauauaacuaaauauauauauaacuaaauauauauauaacuaauauauauauaacuaaauauauauauaacuaauauauauauaacuaaauauauauguguguguauauauauauaucuaaauauauauaucuauauauauaucuaaauauauauaucuauauauauaucuaaauauauauaucuauauauauucccuggcuaaaaguuuuaguuaaaguuaaaucccacauaaacuugaucacauguguuuacuucucccuuccuaacuucaugaaaaagagaguaagguaauggaaaaacucaauaagacaaagagaacaggaguaggagcauugauaguuguaagguucaaacuaacuuuuacuuauugcaauggaaguuucaacuugaauaucuccuucuacaugaacuucugagagaaaccaacuaauucuucccauaaaacuccuaauauuuuaagacuuggagguaccuggucuguggaaggcaggaaugugucaugagauuggauacaugaguuauuuguugaaaaucuuuaugauaaguggcugcaguuccauauccuaucaccuacucccugcuccucaggagaccaaauaguuuauuuucuggagaaucugaauaagaauaucccagacucagaaauccaggcacaguaggaggguugguugaaauaagaagacuguguuauucuguuuugugcugcuauaacagaguacauuauaauuuauauauaacagauugauuuacaaugagcagaaauuuauuucucacaguucuggaggcuaggacguucaagauaaaagaggcuggcaucugacaagggccuucuugcugugucaucccauggcagaaguuggaagggcaaaaagaggcagagggagagagagaacacacaagaggaagaugaacuugaacuuguccuuuuauaaggaacgcauucccaugauaauggcauuaauccuucaugaggguggugcccccauggcuaaacaccuccuguuagaccccaccucccaacaguguugcauugaggucaaguuuccaacacauucuuuuuugggggcacauucaaaccauagcagagauuaagagaaaauuugcauaccuaauuucaggaccuguauguuucauccuagaugcaauuagugaaacagggcaugaguuauuuaguuuuacauuaucagauuucuaguaguaaucuagauauagauuuuucccuuuucaacaucuucuaaauaauuguauagucuaaacauaauuaaaaaauuuuaacaucucaaauucucucaucacuuuaacauguuuuagaaaagguaaaucgaaggucaguucaugugagaguguguaaaauauuaauuucauuuaaccuacucaguuucuuuacuuguaauaacagaauuauaagcagaaaaaugauuguacaaauaaacauaaaugaugucauuugauuuauuugcuuuuuagaauuaugaaaacccaauaaauagaguuuuuuuuccucuucuauuucuuuuccuuaaauucaggggcuggaagagggcugacgacaaugaagaaucccuccuccugcuugcuuaauuauuuuagaucuucacauaacuucuuuuuucuuuuucuuuucuuuuauuauuauuauuuuuugagacagggucucacucuaccacccaggcuggagugcaguucugugaucuuggcucacugcaaccucugccucuugggcucaagagaucuuuccaccucagcccucugaguagcugggucuacaggcacauaccaccaugcccagcuaauuuuuguauuuuuauagagacgggguguugucauauuguccaggcuggucucaaacuccuggacugaagcaaucugcucgccuuggcaucccaaagugcugggauuauaggcaucagccacugcacccagccaacauaacuuuaugaauaaacuaaauugcguauuaugcauuuuuauuuucccaauguaauaaauugauuuuauuaacaagagauauuuaaguaaaauuuacauuuugcuucccaauauaucugaaacgaauagaauaaauacauaaaauauauucuaccuucccaguguuauacaucggcauuacuaaaauguagauauuuuagauauaguugaguuuaccaaaacucaccuacucuuuuccuacaaaaauaaucaccaaaacaaaaauucagugcaggccaagaaaauauuucuauccgcuauuuuaugucuuucgaauuucaaaguacuauaccuuucuagcuuauauuuuuuugcaaccaauucuaaaauuguguucccuguuuauagacuucucagaccccaaguuccugagguaacaugggaaucagugcugucucuauguguguguaucuauguggcauguauuugccucaacuccccccuucuaacuucucuugucuaacccaacuucauacaggguccuuaggucuucugauucucaguuuauuccaauuuccuguauaaauagucccucuugucugcaggugguauguuccaagacccccaguggaugccugaaaacguggagaguaccgaacccuauauauacuauguuuuuuugauaacugagaccgcuacuaaguggcuaggagacaaguggcauauauagcauggauacacugcacaaaaggaugauuuacaucccaggugaggugcagcaggauagugugaaauuuuauccugccacucagaauggugugcaauuuaaaaacaugugaauuguuuauuuugagaauucuccguuuaauauuuuuugaacugcagaaggccaaaccauggauaagggaggacuacuccacuugguugcuuuuccauggauaaucauuaguuacugauuucacaugaaauuuagucaauaguauuuagugauucacuauuaaauuucauagauauuuuuacuuucaguuuuuuaaauaagauucaauuucuuaauuuucuuaagauguaauaugaacauuaaguacaggggcauacauuuuuccuuuaauucaaccaugaaaaguauaaaaauauuauaaaaacagaaguugaaaauuccaguguuaaucuucauaguaaauauuggcuucuuuuccuccugaacaggucauuauccaacuuuuagaggugauggaucaucugcauagaggggaauugguugcugcaauacuucguaaccgguauauuuauggaaauaguuuaacuuauauaacgucuuuccuauuuauauaccuaacauagcaggcauucaauaaauauuuguugaauacuugguauaaaguaaguauuuacuguaugaaugaguuagagaaugacuaagugacaaagaaauugaauaaagaggauguuagugacaauguuuccugagauaaugaaaaaauagagaauauauuuagaaaauguaauugguauaaauuaugagcaccuggaauacaaucaguggagauauuuauuugaauuuuuaguuuuaaaggcauaucugaauaaauacagguauccauagcuuaagaauagaagugccaacaacacauuuuuaaaaauaggauuguccugugauuguauauauuuauauuauuuaaaaauccaguuaaaaccuuuucagggaguuacuaugagauauuuaaagcuucuucugacaaauuaggauuuuaaauuuauuauuuaaagaaaaauagccuuguuugcaggugugacagagucugucuuauucccaguagcuugauuguacaguuuggaugaaacauuuggaauaguauguuugaguugucuguauccuggcucugaugcuuacuagugguauagccuugggcaaguuucguagucauucuauaccucaauuuccucaccuaugaaaugguguuaauaauaguaccuacauugcaggguuguugugaagauuaaauaagugugaaagguggggcauguaugaaaguguguguguguguguguguguguauguguggagagagagaaaaaauagagagcgggugugagugagugagcugggcagauaguaagcaguauauaugagcuaguaugagggaacuuuuaaaaguucauggaaaaaauggaaauaaaagauaaaaauaaaaaacaacuguuucuuaauauaagcuccacccaaaucaaguugcuuuuuuaaguguugauaccagccauuuaaagaacugagcguccugggaauuuaaccauaucaaugauguuucuuuuacauuauuaagugaagaaaaaugggugcucuuuaaaggguuuuuaagacuaggaaacaaaaagaagucagaaggagccaaauuaguacuguaagaugggugcuuaaugauuucccaucaaaacucucacaaaauugcccuuguuugagaaaugagcagaagcauuguuauggugaagaaggacuuucugcugaagcuguccuaggcauuuuucugguaauauuuugguaacuuucucaaaacacucucauaauaaacagaugauauaguccuuuggcccuucugaaaauccucaagcaaaacgucuugaucaucccaaaauaacuguuguugugacuuuugcuugugaccagucugcuuuuguuuugacuggguuacuucuaccuuuuccuagccauugcuuugauugugcuugucuucagaaucauacugguaaggccauguuucauuucauguuacaauucuuugaagaaauacuucaggaucuugauccuacuuguuuaaaauuuuccauugaaagcucuuuucuugucugcagcugaucuauguguaauuguuuugguagccaucaaguggaaaguuugcucaacuugaauuuuucaguuggaguuguguaagcugaaccaacugugguaucuaugguguuggguaucaugucugcuguuauucgcugguccucuuuaauuagggcaugagcaagauuaauuuuuuccuugcaaauucauuuggaucaucugcugcugagggcuucaucuuuaacaucaucucaucccuuucuaaaaugaguuauccauuuguaaacugcugauuucuuugggggcauuguccccauaaacuuuucauaaagcaucaacgauuucaucauucuuccacccaaacuuugugauaaauuugauguuuguucuugcuucaguuuuagcagaauucauguugcuuugauagaggcucuuuucaaacugaugucuuauacucagugcuucaaacuggguccuguucaggcauuuauaacacauuacuaugaguuuauuuucaugcaaaaaaauugaaauccaugcauaguuuuuuucaaaauacacauuuugcaugaacuuuuugaagaucccucauauuauucaaauauaaaagugagauuuuaauuauuuugaaaauguaguauuuguguuuuucaauuccgagguauuuuaaaauacaggcauguuguaaaaugaacagaaaacguaggaaagguugagguaggaagggaacauauauaaaguuacuguuacuugacagauaccauagaaggaauuuuccauaauaauccaauuagagaaauaacaugaugggugccuguuuguuggaauguauacaguagucccccuuuauccaugcaggauacauuucaaggcuccaagguugccugaaacugaggauaguaccgaauccaacugucaucaaucagaacauauuucugcucaucucuucuacucacaaauauaaacauuuuccaucuuaacuaagcacuuuucauacacuguggucauaacuuuugcaguuugagugugacagcagaacuagcacaagcugcuucuuccuucuccacaauuucaccaacagauuucuuucuuacuguugaucugagcaaccucagcauguguuuuuuaaaaauuaauuuuguuuuaaguucugggauacaugugcaggaugugcagguuucuuauguaguuaaaacguguguucugguggagggagaacauacuuuuguaagucaagaacuuugacccuuucacuuaaaggaaacccuuuauggcuucucuuugauauauccaagucaccaguaucacuauucuugcacuaugggccauuauuaaguuaaauaaggguuccgugaacacaagcacuaaauaccucagcaguugaucuacuaacugaacuggcuacuaagugacucauggguggguagcauuuacggcaaggaugcuggacaaagagauaauucccgucgugggugggguggagugaaguaggauaguguaagauuucaucaucuuacucagaaugacacacaauugaaaacuuauaaauuguuuauuccuggaguuuucuauuugauauuuucuuuagaaugugguugaccauggguaacugaaaccaggggaaagugaaaccaugcauaagcagggacuacuguacuaucaucugggcuaggguggaauauucagcuuaggggcuguaaaacagacuugcucacagauacagaaaauaggggaaucauagcagggauaauauguggccauguugggugaaaacaggaguagaucaggggauguugaauuuauagcugcauguaucaguaguuccuucuuuauuguugcuguguaauauuucauuguuuaaauaugcaacaauuuauucuaucuauuuuccuguugauagucauuuaaguugcauccacauuuggcuauaaugcauaaaacuguuauuagaauucuuguauaaaauuuauuuuggccacaugcacucauuuuguuuggauuuacaguauacuagaaguggaacugcugggacauagaguaagcuacuguuguuuaacauuuguagaaacuaccaaacguuuuuugaaaauaguuguaccauuuuauacucccaccaauaauaagugagaaucuuuacuaacacuugauauuguuagcuucuuuaauuuuagccauucuguggguguguaguacuuccucauuaugguuuucacucuucauuuuccucauguguaaugauaugaauagguuuucuuauguuuauuagcuauuuggauauauuuuagaagcauauguucaaguguuuuggccauuuaaaaauggguuauuauuuuauuuugauuauuaggagguuuuaguucacucuggauauauagguauuuguacugugaauauuuccuuccaguccauggcuuacccucgaauucugguauuugugucuuuugaugagcaguaguucuuuuuaaaaugaaguucaguuuaucauuuuucuucuguuaugcuuggugcuuuuuguaucuugcccaagaaaucuuugcucuuccaaauuugagguuuucuuccaaaaguuuuacaguuuuagcccucacauuauaaaugcauucuugaccgcaaaccagagaagugaauguauggccuagauuccacauaagaucuaagugauuaauaagaccacuuuacagaagaaaaguucuuuguacuuuuaauucuaagcuaauaccuuuguaaauggcaagguaacugaaugauaacuugagcuaaaucuggcauugcagagagaccuagucuuauggacccuaguuuauaacacaaugacuuuugagucuucucuuguaaccuuucuuauaaauaaagccccuuugaaagaaauauaauucugauucuaaguaaugugauccagaacauagaaaauaaugggaaguugcauaguucaaaugucaaaaccugagcaaaacguugcuugcaugcauauacaaauuaugggucaguuucaaauuccaaauacaguaaaacauaggaaaaggcucacaucuggaaucacagcacuuugggagguugaggaggguggauuaucugagguuaagcguccaagaccagccuggccaacauggugaaauccugucucuacuaaaaauacaaagaaaauuagcuaggcaugguggugcacaccuguaauuccagcuauuugggaggcugaggcaugagaaucgccugaaccugggaggcggagguugcagugagcugagaucgugccacugccuuccagccugggugacagagcaagacuccgucaaaaaagaaaaauggaauauaugaagggaauaaacucuuuuugacuaagaaaguuuuaucccagcaugagaaugguuuaagaucgugaaaguuauucauagaaugcauagauguaaugagaaccaaaaguuaaaauccaaagguguuugaaaacaauuacaugcuccuuuuaagaauagaaaagagcccuuaaaagacauguacccuaaaacuuaaaguauaaaaaaaaaagauuagugacagaaacuugcacuuauaauaugaaaaaauuaucucucugaaacaacaauucagcaucacacuuaaugguaauauguaagaguuguuccuuaagcagcaauaaaauaagaaugcccacaaucaacauaauauugaauauauaucuguaaauucuguccaaugucaguaaagaggcauaauuaauggaaggaagaagagaaaauuaaccaauuccuagaagauaaauagugcugggaaaacuguauauccacuugcaaaagaaugaaacuggauccuuauauuacauuguacacagaaauaaacgcaaaauggauuacauaccaaaguguaaggccugaaaucauaaagcuucugaaaguaaacacaagggaucagagcuaucaggaagagcuugacaaaaaagaaaagaaaacacaagggaaacacuccuugauacuggccuuggcaaugauuuuuuuggauaucaccccaaaagcuuaggcaacagaaacaaaaauaaacaaguugggacuacauaaaaaucuucuucaugggaaggaaaacaauaaacaaaacgaaaaggcagccuacauauugggaggaaauauuugcaaaccauauaugugaugaggguuaauaucuuaacauaacuuacauaacucaguagaaaagaaacacaccaaauaacacaacuuaaaaaugagcaaaggaccugaauagauauauuuuaaaaaauaauacauaaaaauggccaacaggcauauaaaaaggugcucaacaucacaucaucagggagauguaaaugaaaaccacgaugagauaucaccuugcaccuauuagguuggccauuaucagaaagacaaaugauagcaaguguuggagaggauguagagaagagaacccuuacacacuguuggugggaauauaaaaugauacagccauuaugguaaacaguauagaaguuccucaaaaaccugaauacagaacuaccauaugacccaguaaucccacuucuggguauauaugcaagaguaauggaauuagcacuuccucgagauaucugugcuuucauguucauugcaacauuauacacaauagcuaagauauggaaacaacuuucaauggaugacuggauaaagaaauugugacacacacacacaaaugggauauuauucagucuuuuaaaaaggagauaaugccuagagaaaauuuuuacaaucuacccaucugacaaagggcuaauauccagaaucuacaaagaacuuaaacaaauuugcaagaaaaaaucaaccccaucaaaagugggugaaggauaugaacagacacuucucaaaagaagacauuuaugcagccaacagacacaugaaaaaaugcucaucaucacuggccaccagauaaauacaaaucaaaaccacaaugagauaccaucucacgccaguuagaauggcgaucauuaaagucaggaaacaacaggugcuggagaggauguggagaaauaggaacacuuuuacacuguuggugggacuguaaacuaguucaaccauuguggaagacaguguggcgauuccucaaggaucuagaaccagaaaugccauuugacccagccauccuauuacuggguauauacccaaaggauuauaaaucaugcugcuauaaagacaugcacacguauguuuauugcgacacuauucacaauagcaaagacuuggaaccaacccaaaugcccaucaaugauagacuggauuaagaaaauguggcacauauacacuauggaauacuaugcagccauaaaaaaugaugaguucauguccuuuguagggacauggaugaagcuggaaaccaucauucucagcaaacuaucacaaggacagaaaaccaaacaccgcauguucucacucauaggugggaauugaacaaugagaacacuuggacacaggaaggggaacaucacacaccagggccugucgugggguaaggguaggggggagggauaacauuaggagauauaccuaauguaaaugacgaguugaugggugcagcaaaccaacauggcacauguauacauauguaacuaaccugcacauugugcacauguacccuagaacuuaaaguauaauaauaaaaaaaaaggagauaaugccauuuacaacaacauggaugaacguggaggacauuaugcuaaaugaaauaaggcagauaucgaacaaaaaauacuguauuuuuuuauuauuauacuuuaaguuuuaggguacaugugcacaaugugcagguuaguuacauauguauacaugugccgugcuggugcacugcacccacuaacucgucaucuagcauuagguauaucucccaaugcuaucccuccccccuccccccaccccacaacaguccccagagugugauguuccccuuccuguguccauguguucucauuguucaauucccaccuaugagugagaauaugcgguguuugguuuucuguccuugugauaguuugcugagaaugaugguuucuagcuucauccaugucccuacaaaggacauaaacucaucauuuuuauggcugcauaguauuccaugguguauaugugccacauuuucuuaauccagucuaucauuguuagacauuuggguuaguuccaagucuuugcuauugugaguagugccgcaauaaacauacgugugcaugugucuuuauagcagcaugaucuauaauccuuuggguauauacccaguaaugggauggcugggucaaaugguauuucuaguucuagaucccugaggaaucgccacucugacuuccacaaugguugaacuaguuuacagucccaccaacaguguaaaaguguuccuauuucuccacauccucuccagcaccuguuguuuccugacuuuuuaaugaucgccauucuaacuggugugagaugguaucuuacugugguuuugauuugcauuucucugauggccaaauugucucagcccaaaaucuccuuaagcugauacgcaacuucagcaaagucucaggauacaaaaucaauguacaaaaaucacaaguauucuuauacaccaacaacagacaaacaaagagccaaaucaugagugaacuccaauucacaauugcuucaaagagaauaaaauaccuaggaauccaacuuacaagggaugugaaggaccucuucaaggagaacuacaaaccacugcucaaggaaauaaaagaggauacaaacaaauggaagaacauuccaugcucauggguaggaagaaucaauaucgugaaaaugaccauacugcccaagguaauuuacaguuucagugccauccccaucaagcuaccaaugacuuucuucacagaauuggaaaaaacuacuuuaaaguucauauggaaccaaaaaagagcccacaucaccaagucaauccuaagccaaaagaacaaagcuggaggcaucacacuaccugacuucaaacuauacuacaaggcuacaguaaccaaaacagcaugguacugguaccaaaacagagauauagaucaauggaacagaacagagcccucagaaauaacgccucauaucuacaacuaucugaucuuugacaaaccugagaaaaacaagcaauggggaaaggauucccuauuuaauaaauggugcugggaaaacuggcuagccauauguagaaagcugaaacuggaccucuuccuuacaccuuauacaaaaaucaauucaagauggauuaaagacuuaaacguuagaccuaaaaccauaaaaacccuagaaggaaaccuaggcaauaccauucagaacauaggcaugggcaaggacuucaugucuaaaacaccaaaagcaauggcaacaaaagccaaaauugacaaaugggaucuaauucaacuaaagagcuucugcacagcaaaagaaacuaccaccagagugaacaggcaaccuacaaaaugggagaaaauuuuuucaaccuacucaucugacaaagggcuaauauccagaaucuacaaugagcucaaacaaauuuacaagaaaaaaacaaacaaccccaucaaaaagugggcgaaggauaugaacagacacuucucaaaagaagacauuuaugcagccaaaaaacacaugaaaauacuguauuuguaaaugucaaauagaaacacaggggcaggagugggaagaaaugggaagaagaaggucaaagcaugaaaauuugcaguuaggugaggugaauaagucuagagauguaaucuauggcaugaggacaauaguuaauaaugauauauucuauucugaaaauuuuccaaggaaguagauuuuagauguucuuaccacacaaaaaggcaacucuggaaggugauggauauauuaauuuguuuaacuauaguaaucauuucacucugucuauguguaccaaaacaucauauuguacacuuuaaauauaugcaauaaaaauagaaagaaauaaaaagguuaggcuuguauaucuauaaaagcuaagucuuaaaaacaaccccuuagugcuagaacuaaugaguuauaaaaaauaguuggauauaaauaaaaauuuuuaaaaacaguaccuuuugucuguaucagaaaucgccauuuagaagauauaauggcaaacaaucaauuuauaauagccguaacaaaaaugucuaggauuuauauuaugaauauuuaaaaauucugcucagagacaggaaagaagacauuuuaaaaauggacaguuauacauaccaugguucuugauaaaagacugaaugcuaagaagagauacauuauuuccaaauuguccuauacauucuacauaaauuuaggaggauauuuaaaaauuuggcaaagcaaaucuucaauaaguuaaugaauaucugaaagaaauguaucuccauuauuaguacauugucugcuauguaguaauugcucauuaauuuacuaaauaaaggacuaguaaaaaaucuauauuuguucuguuuaugaugcaacaaauauuuaugguguaauugguaagaacuaaacauugucacgugcaaaagcaugaugaaaagugaugaguucuucuacucauugaccuucuucugggggugugguguggucagauaauaaauauauaucacgaagaaaauuguuaugaaaaauuaauaagguagguggaaauauaaagaguuaagagugagcggaggucaguguagaagggcauuaacuucuuauuagccuugcauguguuuagucuuguaaucuaccauccaucauauauuuuacccuauaugaaguuuuauucuagugcuuuaugagcuauagggagaagucagccacaugugguuugcuuugauggaaacaguauacuuaucugaacauccucaugcaugcauuaugguaaugucuaggaggacacguuguggugagagucaccaguuuguuguuguggcgguauuuucugauugcauuccuggagcuaauagcauuucuguaaugcucugacagaguuucagucuuccaaauguagucuuucauagaugaaacacaguauaaaauaucgucugguauuuccaacacaggagaaagagugccaaacacuguacaaucauauuuuuaccauuuuaacaaauauuauucaccacuuacuggguagggugcuagggauauagcagugaauguuaauacaugguuuucuguguagugggaaauacacacaaauaauuguguuucuuaagugcuguugaaaggacauauggggugcuacugacuguguauaacacauauauacaccgggucuugggagggucaggacaggcuuuaugagugaagucauguuucuucuacuucucuccauuuccacucuacuaccaccaucuuaguucaagcuacucucaucuuuugccugacguccugcaauaaccaauugguuaguucauuuuucucuagguucuaauuagaguucucuuuucagaauucaaaucuagccauguugccuuuucgcuuucaaauuauucuauagcuguaucuuaauuuuaggauaacauccaauguuaaucucacauugcacuacuaugcaugaaggcaugaaaaagcaugaugcauucacagagcuauaaucaaaaucagaugauuauuaauuauaauaauaaggagcaaaguaagaaaaggcuggagaugaguuaggagagggagguauggaucaaguuaagaagcauuuuauguuuaugcuaaagaguuuacauacuucacagacugcagagaucuacugaagcuuacaaacagaagagugaugugaucugccuuauacugcuagaaagaucacuuugguggcuguguggauuauuuggggaaggaggacgggaaaauuaggagaccagugaucagucuauuguagcagucaaagaaagaaaugaaaagagucugaacaaaggugauggcagugggaaugaaugaaagggaaugcauuugugaaauacuuagggaugaauuuuacaauguuugggaaccaacugguuucuucacacucuaggcagaagguucuuuuaaaauuguuaaucugauaaugucaccuagacuguccuuuccuguuuaugacuauuaaaauccuacuuguuccucaagacccauacugaauuccauacccuacauaaagccucaucugaucaauccaaucacaagaucaggagagcuucuugccucugaacuacuuuaccacugcaaugaauuuuaucauguuugguucugcauugaaguaauuugagccuuuauuugcuuaugccuaagggagcccuuucagagagugacuggcuguaucuaauguauuuuuauauccuguauuguacauaaugcaagauuuugcacauaguaagcuuucaguaaauaccuguagaaguuguaccauuuauuaacaauuacuggauggugauuuuauucaguaaaaugguuuagaguaguuuucuuuuguuucccacaguuaacucuuacuuauaguuaaguaauuuaauauuaagugacagucuuuaagacuguaaaguaggcuaacugaauuuaguauagauucuaggaauaagcccagacuuuuguacugacguaauguauaaucaugucuucaugguguagaaugucaagggaauacagggcugggaaucaggucauuccauguuuaaaaauauuuagccuuuacuauuugucaagugguguccucaucugucacauguaagaauuggaagauggaaaucuuucuuuucauuuuaaaagucuaaaauuauauuuuuaagacgaagcacauaguacaugcuaaagaaacacauaugugauuaacuucauauaaaacaaauuuaacaaggugaucagccauuggagauaaguccuuuuauuaauuuaucauaauuugguuuucucacuuucaaugaagguaucuuuucuguguuuuuugaagauuaaaaacuugugagggucugguuuuaucaugggugaaguaagcguggcaauaauuguaagccaaaucuuuggcuagaagaucuagccaauaaaaauaauaagaggguaacacaugaaauucugagaccaguuacuuuuuauacauuggaauuauuuugguuuaaaaauucuguagguuuugguuauccacuauuauugucauaagaucuuaugguagacgcacaugaaauuuaucaccauauuuguuccuauaacugaagaguugcauguuuucauacaaaggauaugggcuuguuaguaauguugcauguuuuauauauuugaaggaauuuuccaggucauagaaaguauaucuguucuuggggagaauaauugcuacuccaauuucagucauccuaccuaucuugaguguugcuguucauauuuacauucuuccugugcaaucucaucuaccgcaauuauuucaguccuugccuacauacuaaagaccuuucauuuauagcucgagucucaauuuuuucugagucccagacuaaaaguuguuuauuuucucccuccacaauuuuuuguuuguuuguuuggacucuacaaguaauacauauuuauuacagaacacuuagaaaaauagaaaauuauauauaugcaggguaaauaaucacauaagauagccucuguuaacaccucgauguauuuucacucuagucuucugauacauuuuuaaauguaacuaagguuuuacuuauugaauaugaucuaguuauaguagugugguuaagggugaggcucugaagucugccaaauauaggugucauucaaacucugcuacuuacuagcugugugaaauuuggaaagugucuuaacuccuaugaguccauuuccucaucuguaaaauaaagugauaucacugugugggauuguucuguggauuaaauaaaauguuuguaauaugguuaaguuccugucauaugguaaaugcucaguaaauggaagcgcuuacuguuuuauuauacuauauaucaugucuguaccucccuguuuuucuuauuagauuuugaauauuuugacaucaguaaagacuuguaguuauaauagcugcauggcauaagccauucugugguacaaacaaugucuuaauauuagauauuuaggccaauuccauuuuggggguauugggggaaucagcccccaauauuucaauguagguucuuuucuauuuucccuaagugucagcuggucucagaaauaaagagacagaguacaaagagaagaauuuuauagcugggccgcuggaggcgaagucacauaucgucagguucugugauauccacuugagcugcaaaaccagcaaguuuuuguuagggauucuaaaaggggaggggguguaugaaaagggaguaagucaaaaagaucacaugcuucaaagggcaauaaaagaucacaaggcaaaggcaaaauuagaauacugaugagggucugugugccgcugugcaugcauugucuugauaaacaucuuaacaggaaacaguguucaagagcagagaacuggucugacuagaauuuaccaggcuggaauuucccaauccuaguaagccugaaggcacugcaggagaccaggguguauuucaguccuuaucucaaacccauaagacagacacuuccagagcaaccaucuauagaccuacccucaggaaugcauuucuuccccagggucccaauuauuaauauuccuugcugggaaaagaauucagugauauuucuccuacucacacuuccaucuauaggcucucugcaagaagaaaaauauggcucuguucugcccaacccuguaggcagucaggccucaugguuaucuucccuuguucccugaaaaucacuguuauucuguucuuucuuagggugcacugauuuaauauuguucaaacacacauauuuuacaaucaauuuguacaauagugguccucaggugacauacauucuccgcuuacgaagauaacaggauuaagagauuaaaguaaagacaggcauaagaaauuauaagaguauugauugaggaagucacaaauguccaugaaaucuucacaauuuauguucagagauugcaguaaagacagguguaagaaauuauaaaaguauuaauuuugggaauugauaaauguccaugaaaucuucacaauuuauguucugccucggcuccagccggucucuccguucggggucucugacuuccugcaacauggggguauuaguuguaguagugccuuccauaucuguuauaauuuaucuuuuuuccuucuauuuauugauuuuugcucuauacugugucaaauccucucuuuacucccuuuaauguacauuuuguuugucacauugguuuaguuuccuuuaguuuccucgaccaacguaauuuauaucuuuccucaucuuaucuuacuuggcuuucucuuccuggcucauugaagucauguuuccuuauucaauaaauaguguuuuucaauauauuuccauugcugcuuuccaugcuaguuguuuuuguuuuugucuguucauucucaaaggaagaaagauucccugaaaggccuuuguacuguuguuuaaaauguuuuuuguucauggucuuuauguggcugacucuuguugucuagaucuuuacuuaaauauccucuccucugagagguuuccuuugaccauccaaucuaaaguggccaccuguauacugucuauugucacaccaucccaauuuaauucucuccauaagacucaucauuccaacuauuagauauuuuccuucuuuauuuauuuucuauccccuuucacuggaauagaagcuccaagaggccaggcaucuuguucaacuuguuuacugcuuuaaucgcagcaccuacaaccauuucuuacagacaaguuacucaauaaauauuugcugaaugaaugaauaaaggaauuaaccauuuccccucugucugugcucuugugcacuaaucccaccguuuucucugauuuuuauccaugagucaauacuaauagaaauaaacgauugaauaaauaaguaggguagaagagacaagucuuccuuacagaagaauuccauauuuuauuugugaauguuuguuuguauauauaccuucuuuagaggcuggaacuuuauucuccuuccacugguguuaauuuaaugauucacuuacaaagaaaagaauguggaauggaaaaaaaaaugguaacuuuauagugaagaaaucugacaaauacuaccagcaguagacagaauacccccgcccccugcccccgcccccgcccaggauggccacauuuuaauccccagaaccugugacuaugacacuguucauggcaaaguggacuugcagaugugauuaaguuaaggucuaugagaugaggagauuauccuggaccguucaggcaggcccauugcaaucacaaggauccuuauaaaagggacacaggugcgagucaggaaaaggagaugugaugauggguccagagguuggagugaugcucuuugaagauauaggaaggugccacaagccaagaaugcagguagccucuagaaucuggggaaaaaaaauaacaacaacaagaaaaccaucucuccccugaagcuuugccaauaguuaauuuuugauuucugaccuccagagcuguaagaucaucaacuaggguuguuuaaagccaccauuugugaucauuugucacaguggaaauaaguuaguaugccuuauuuucagagucuggcacaaaggcuuccuaauauauaccaggagcuguaauuucugacuugauauaagcacaaagaggaauugaugguagugguggucagaaaggggcacacaguaaaagguacuagaacucuggcugcuuuaaaaagcaacaacauugccaggucucaguuucagugcuggcacugguuuuccugacucugucuacaagauauuuaacaguaaguugggcaagguaggaucagaaguaacuagcuauuuguuauuuaaaauugaauauucaaauauuuaucuauauuuuucuuauccaauuguauaauuuaugcucauugagaaguauuuggaaaaauuauaggaaaguauaaucccacugcacugaaagcgcuguuaauauuuuggaucucauaaauacaaauguuuauucaacacaaagauuccccaguauuguaaacaugacauauccaauguccaaucccauguaaucuuagcccugaguaccugccuugucaucuauauucuugguauuguuugaugacaccaccauucacucaggugucugacucagaaacucgggcaucauccuggacccuuucucauccuucacacucaguuagucucuaaguccacuucuccuucccaauuauuucuccaauucacucccccugcuguuuuauccuuauuaucacuuccuuagauuuggcccacauaauuugucagcuagaucauuaaaauauccuucuaaucuguuuuuuuuuuuugcuucuagucuuagcccuccccuucuccccugacaguuucucucucucuuugcagccauaaugaucuuucugaaauguaaauauggucauauuguuuucuuguuuagauuucuucaguggcugccaguguggcaaggucucuuauauggcuccugucuaccucaccaggcuuuucuccugcacagagcaugcauugcagccuuccccaacacuggaagaugacccguucccucauauugccacccuucuuucuggaaugcuuucucucauauguugggccuaacccauuccuguuuaucauucaggaccucucugugaaacuuucacugaaauauaugccaugccucuuccaagcagaauuagguguccuuuucuuauuuauuuauuuauuuauuuauuuauuuugagacagugucucacucugucacccaggcuggaguacaguggugcaaucauggcucacugcagccuugacuucccaggcucaggugauucucccaccucagccuccugaguagcugggacgacaggcgugugccaccaugccuggcuaauuuuuguauuuuuuuuagaaaugggguuuugccguguugcccaggcuggucuucaacuccugggcucaagugauucacccaccucagccucccaaaguacugggauuacaggcgugagccaccacauguggccaaguaucccuuucuaauggcuccccuagcauugacucuuuuuuuuuuuaaauuauauuuuaaguuuuaggguacaugugcacauugugcagguuaguuacauauguauacaugugccaugcuggugcgcugcacccacuaacucgucaucuagcauuagguauaucucccaaugcuaucccuccccccuccccccaccccaccacaguccccagagugugauauuccccuuccuguguccaugugaucuaauuguucaauucccaccuaugagugagaauaugcgguguuugguuuuuuguucuugcgauaguuuacugagaaugaugauuuccaauuucauccaugucccuacaaaggacaugaacucaucauuuuuuauggcugcauaguauuccaugguguauaugugccacauuuucuuaauccagucuaucauuguuggacauuuggguugguuccaagucuuugcuauugugaauaaugccgcaauaaacauacgugugcaugugucuuuauagcagcaugauuuauagucauuuggguauauacccaguaaugggauggcugggucaaaugguauuucuaguucuagaucccugaggaaucgccacacugucuuccacaaugguugaacuaguuuacagucccaccaacaguguaaaaguguuccuauuucuccacauccucuccagcaccuguuguuuccugacuuuuuaaugauuaccauucuaacuggugugagaugguaucucauagugguuuugauuugcauuucucugauggccagugaugaugagcauuuuuucauuguuuuuuggcugcauaaaugucuucuucaaggagaacuacaaaccacugcucaaggaaauaaaagaggauacaaacaaauggaagaacauuccaugcucauggguaggaagaaucaauaucgugaaaauggccauacugcccaagguaauuuacagauucaaugccauccccaucaagcuaccaaugacuuucuucacagaauuggaaaaaacuacuuuaaaguuuauauggaaccaaaaaagagcccgcaucgccaagucaauccuaagccaaaagaacaaagcuggaggcaucacacuaccugacuucaaacuauacuacaaggcuacaguaaccaaaacagcaugguacugguaccaaaacagagauauagaucaauggaacagaacagagcccucagaaauaacgccgcauaccuacaacuaucugaucuuugacaaaccugagaaaaacaagcaauggggaaaggauucccuauuuaauaaauggugcugggaaaacuggcuagccauauguagaaagcugaaacuggaucccuuccuuacaccuuauacaaaaaucaauucaagauggauuaaagauuuaaacguuagaccuaaaaccauaaaaacccuagaagaaaaccuaggcauuaccauucaggacauaggcaugggcaaggacuucauguccaaaacaccaaaagcaauggcaacaaaagccaaaauugacaaaugggaucuaauucaacuaaagagcuucugcacagcaaaagaaacuaccaucagagugaacaggcaaccuacaaaaugggagaaaauuuucacaaccuacucaucugacaaagggcuaauauccagaaucuacaaugaacucaaacaaauuuacaagaaaaaaacaaacaaccccaucaaaaagugggcaaaggacaugaacagacacuucucaauagcauugacucuuauauuuugguguuguuaggagagauugaagucccaguacucauaguaguuguauuggcaagagucauuauaauagcuaacacuuaaauagcguuacuuuguacuagguacaaaaccuuuaugcauauuaauuuauguuauucucauaauaacuuuaugaaguagauacucaucauuauuauucccauuuuacaaacaaggacuuugaggcacagagagauuaaguaaauugucuaaggccacacaguaaauaagcauggauccaggguucaaaugcaggaagucuagcuccagagucuuugcauuuagccauaugccagucuuuuuccuucccuggaaugcaaacucccugaggacaaggguuuugccuguccuguaucaccucuccugugucucauuaccuaaaacuaauucauggcaguaauaaauacuucucaugaugaucuuuuuagagagugcaggaagugaauguagaggaauguguccuccugucucuuccuagcagaauuaggugucccuuucuuacagcucccauaguauuagaucuuauuucuguggugucuguaguagauauuaaaguuccaauacuaguaguacauugguuguauuggcaagagucauuguaauagccaccuauggcguuuacccuaaggccaagcuaguucugcuuauuuugggugugcauacauuuacgcugauagguuaaguacuauuaaugaguuggaagccuggaaguugauaaagguaauuuuuucuuuuaacagauguucacuucccuccuuuuucagucuuuuauuuuuuccccuuuucaucuucccagcaaacacaguuacaaggugagcguuagaaagauuauguaaaauuuucaaaggcuccugaacaacaguuguguaauguucuauuuuggguuacaugugaccaggaauauggacccaugaaauaauucagagccuuaauguggaugcuucuaaaaauauauagccaaaggacaaaguuuuccuuugucuuucugguuaucagugcugugugauauuuugaccccuucccuccauucgacacuugguuuucuuuguaccauugcuuuguuucagauuaaaaugaaaagaaaaagauuaauaccuuuuuucccuggaagaucuaccuuuucauuggauuauaguuuccaugccugucuuugggacuuauuaauagcuauggcaauuuaaaggcuuugugauccacagauaggcauacuaugauucucuucuaagaguccuuaauccaccauugagagaagggcaauguguccuccucccuuccugaggcccucuguauccaugguguguuaugaaaugcaugauccugaagguaaagauguuuuccuauaucagcacagcacgacauagcugauauagauaugagcuauagauagcuagaauaaaauccucuagugaccuuugcagucuguuuuaggggaaacaaacaacagaagcagcagagugaauccaaauuaaauuuaauguuguuuuugacaggaagagcugugccuggauguagacagugucauuucuuuuucccuggcacauuauugaaaauacuaauauauaacuuuguccaaauuuggcugagaucagccauuguccagggcuggcaggucucucucucuuuuuuuuuuuuuuuuuuuuuuugacagggucuccuucuguugcccaggcuggagugcaguggcucaagugauucucccaccucagccuccugaauagcugggacuacgggugcacaccaccacgccuggcuaauuuuuucuauuuuguagagauggggucucgcuauguucaccaggcuggcuuagaacuccuggcccacaagcgauccucccacuugggccucccaaagugcugggcuuauaggcaugagccaccucaccuggcugacuccuacuuuugacuucucaaacuugggaggcuacucaaaucagugggaggucacuuagaacacacuuuucucucuagauucccugaagcagugcuaagucuaauaaggccucuagggagcgauaauuauuugaucucuggcccccaaugccugccccuuaauguuacauuuauccuuuacucaugugauaugaaggggaaaguauauuaauacuagcuuucaaguauacuacuauacuccuucccauuucccuuuaaggguaguuuauuuaccugauugaccuuucuguuguaaaggcagaaugugauacugaguguggaguuugaaaaccacuguuuucuggucuugacucugccaacuuaacagugguaccaguuucuuucuucuuccuuuuuuuuuguuuuuagaacagaaauacuuucuccugucuugaaaauuaaugagauaauaugcuugaaucacuguguucucccugaaagguggacccugaauaaauucaagcugauuuuuuugaaaggagcugaaggcagaguuaagucuauuuguuuuucuaagaauagcuguggcuccacaaauaacauacuacacuuuuuuuagagaggaaaagauuguagagauaguguuaacccucucaaauguaaaaugacagggaaucugauauucaaaggugagaucauuuguccaaguucauguagcaagguaaagggccaagacaugaguacccagagguuugguuuuucuuuuuuuuuuuggcacaauuaagaguuauuuuugccucagaaaucugcauuucacauauuuaaugcaaaauaaaacccuucuuugguaaaauacauucuguuagacuuucacuauuguacaguccaugugaugaacuuaguauuuauaguuaaauuaguauagccuuuaccaccauuuuuguauguaaaauacuuucccucuuaucuaaauaguuccaguaguuucuuuucuguggguuggauagaaaguaaguauugaucuaauaaucacugggugguagggagauggauaaaaauagaauggaaacucaacccagucuguucuaaacuuugcuaugugugcaauucugauguauuauauggccuuaaacauauauuuaaugacacaucuacauccaggcacagcccuugcuguuaacaacauuguuaauucaguuacacuucacucuccugccucaguuguuguuuucccuagaaaagacugcuaaaaucauuacacaauuucuuuccagcuauuuuuaggcccaugucuuaguuuucuauugcugcuguaacaaauuaccauaacuccagugccuuaaaagaacacugauuuguuaccuuacaguucugccggucauuggccuaaaauuaaaggacuguguuccuuucuggaggcuguaggggaaaauccguuuccuugccuuucccagcguccagaggccaccuaugugccuuugcuugugucucucuuccuccaucuucgaagccagcagugcugggucaaaucuuucucacaucuccucacuugaaccucugcugcuuuccucuuccaauguugaggagcacaacugaauaauccaggauaaucuccccaucucacagucuuuaacuuaaucacaccugcaucaucucuugcuauguuaggcaacauaugcauaggucccaggaauuaagauguggacaucuuuggggacccauuauucugccuaccacacccuauaucuaugucaacuauaccauacugugaguuuucuuuuggaggguauuaagauaauggcuguuuucaaguuaaaaaauuauuuucaaaaauauuuaucacaaaucuuugucccagugcccuccaugcaagauaguuuccagccauuaugaauaauuguuuaauauuuuauauauacagucaucuguuguuaucuguggggcauugguuccaggacccccugagacugcaaaaauucacagaugcucaagucccugauaacauuaauacauuguaaucaaagcccauucaaauuuuuuccaguuaucccaaaaguguuauugacagcagaaagcucaacuucagaauuaugcauugcaauuaauuguaaugucuuuuuaguguuuuucuaucuggaacacuuucucagucuucucuugacuuucaugaccuugacacuuuugaagauuacaggccaguuaauuugcagaaugucccucaguuuucauuagucuuaauuguuccucaugauauuauugagguuuugcuucuucagcaggaauugcacagacaugaucuucucauugcauccuaucagguggcaccugauauugauuugucccauacaacuugauaacuugauuaaggugguaucugucaggccucuccacugcaagguuacuuuuucuuuuauuucuaauuaauaguauuucugaugagguugagaauacuuugagacuauacaaauaucuuaucccuuaucagacuuucaauauuucauuuauugcaucaauauggaaucauaguuuccuauuuuauuguuauaauccuugauuuauuuugaugccaaauggucucauauuuguaugauccccuucaagcugguuuauguaucuuuuucacaagucucaaucauccuuccuuauguuuggaguuuaucuuguacuuucugagugcuucauuacauuccaguucaucuuguacuuucucugcauuagcucuggaaucaggcaucaugguuccuuuuaguggauaaucauaucucgaaccaaaaucuguuugcuaggagugcucauugcuauuccaguauugcuguuccaaggcccuuuugauggagagagcuaggaaauauuuguauacauguauauacacacauaaauacauauacacauuuauacauauauguuuauaucuuuauccauugaaaccaugaguucucaccaauaccuucaauuuuaauccaauaccauagaguucauucuaguuuucucccuuuucaugauuucacuucucaauugguaacauuaagaaacaugucucuuauuauuugaccaguuccuucacauguagccaaugcccuguugacacacccuugccuccccgacucugacuuccagaaauccuggcuguagcugccaccucccugcaugaauacccucauuuuguuugcauuucaccguaccacaucaguccaccauugauguagucuuccugcaaugacaccuuccucaucuucucaagccccacaaagagucucuauggugcccucuucauagggcaugccuacuuugcuuggucccacuaauggauugaacuguucaggaaggggaagggaaggaacauuuucuguacuuugacgaguuguugccaccuuuuuccuuacaaccaugguaaggauuacuacccuuguacuggauauuuacuuucuauuguuguaguuccuauaaauucugcuuuccuguagucaacauccacauuuuaaaauuauaauuuaugagauuuuugcuugucaauuugaguccuuuucuucagauuaauauuaauuuguuuacugguuuauuauuauuacugguuugauuuuugccuaauaagguguuaaaaaugaggcaacuggaaauaagaugauuuucacguaauuaugguauaauuuauagaaacacuacugcuuucucauaauacuuuuuguuauuuuuauguucuucauuuaauuuuuuuucuuuucacuaacuaaacaaacagcagugauaaauauaaacuaucagcaaagcuggcuuagaagaaagaguuuaaaaaaaaugagacaggaucucuauguuguccaggcugguuuugaacuccugacuucaagugcuccucccaccuuggcccuccaaaguguugggauuacaggcuugagccacuacgccuggccagagugaagccuuucauuuuugaauagagguauuuuaaaaaccuauugcacaguaaccuauuccugguuauuuaggguuaggaacaugaguucaaaaagucugaccuccuuagcauggcauagaaagcucuucacauuagguucucagauuuccuuucuagccucaguuucugcugcuucucauuuugguacucugugcuauuacuguaccacauuauuuucccuucgccaagugugccacauucuuuuguauuucugugguagugugcgauuacccagaagguagaucaagcacaugcuuggaacaccaaacagacauagguaccaaacaaugaggaagaaaaagaguauuugauguuucaugucaucaucaaggaaauuagaucuuuguuggacuuccuuacacuuaauucauaauuuagaauuauuuauauuuugaaauacaugugagggagcaccauagccuuuucuguaauuaaggccccuguacguuauuuuaggcccuucucugugccuuugcuuuugcuggaucuuagcacugugaacccugccucugagagaauugcaugauauuccaucccacagcauuuuauuuauuuauuuauuuauuuauuuauuuauuuauuuauuuauuuauuuucgagacagaguuucacucuuguugcccaggcuggagugcaauggugcgaucucagcucaccguaaccucccccucccagguucaagcaauucuccugcuucagccucccaaguagcuggaauuacaggcaugcagcaccacgcccggcuaauuuuguauuuuuaguagagacuggguuucuccauguugaggcuggucucgaacuccugaccucaggugauccgcccaccucggccucccaaagugcugggauuacaggugugagccaccgcgccuggccuccaucccauagcauuuuauugcacaucuaucauaacacuuagcacuuuguauaacaauuuuuaaaucaucucuccugaccaaaccaugaaguccgugaggaaaaugacaucuucccaucuagccaucuauuucgugcaucuaacccggugauuuaggcaaaguagagacucauuaaguguuguuaaacugaauaauuauugucuuguuuauagaugcaggugguagcuuuuauagcagagauugaauuaugucucuuuaacuguuaccgcacuugauucauuaguaucuguucggauagaauuugacauguccaggcaguccaguuuguuaauauaacaaacuguucagagaauuggcaguguucagaaauaagaaaucugaaaaaucuguaagauucauaugcaacacgaugauuuacuggaggcuuuuuuuuuuuuuuuuuuugacggggucuugcucucacccagguuggagugcaguggcacgaucuuggcuugcacaaucacugcaaccucugccucccaggcucaagugauccucccacuucagccuccugaguagcugagaccacaggcaugugccaccaugcccagcuaauuuuucguauuuuugguagagacacgguuucaucauguugcugaggcuggucucgaacuccagagcuccagcaauccaccugccucagccucccaaaaugcugggauuacaggugugagccaccauaccugacccuacugguggcuuuuucuuccaucuuguccaguguucugacaaucaggauuuagccuuguauacucauguucauucaauugcauuaguucuuuaaaaaucguagaaucuuuucaguuagauuuggauuagaguuguagguacuuucugauuuguucacuuuaagcaguucaaggagaaaacaaugaaaaauuuuguuguuggauggauaucacauuggcucuuuugcugcuuaaauaucaucuauccauggccugcaggagccauagaauaucuuaacucguugggguccuauuacgauaguccugccccagacuacgaaaaguuuccaaaggucaucuuuugaguuugaagccaucugaguagaaaguuuucuaauggcagugguucccagaugccaguuaguucauggaagcugguuuguuauggauauugucacaggucugcagugauguaugagaaacaacaguguagugauuaucuaccagaaagcuaacuuuauugauuacaaaggaccauccuuuauucugagauuguucuuuacacuuuuugcuuguucaaaugcucuuuuguccuuaauuuaaugaaauuaaauuuacgauguuaaucaaggacuguaucuguaucuuuauaugaaacccuugagacaagauauguuucagaacuuacauucuuuuuggauuuuagaaagguagcagucuguauauccuauauuacauaacagccccagcaggguuugaggugacaccccauaaucaguuacaguaauguuacugcagugaaauauaagaauauuuauacuaagugagagaaaaagccugugaauagccucaugucaguucaggucaagcuugacugccagaugaguucauaucaguucagauuuugcugccaaaugaguuacaggcaagaaaaaauugauuuccaaguguuugaauuuugaaauuguggauaagggguugccuuuuaaaauguccuuacuuuguaaaauaaaguugaguauccuauguaggaccccaaaauguuuuugaaauuucauugguccacaaaauccaaaacuugggaaacagcucuugaaagcuauugaagugaguauaacauuacuguuacacucaucccuagccaauaauaauuuuccucucuauuuuguuugcaaggaaauacauugcuguugguuauaaucuuuggauguuguaaaaaucuccaaauauacuuuuaaucaaaguagauugaaauuaaguuuaucuuguagcaauuuuaggacgcuggggcaggagagaagguugcagccugaauccauccacaauucccagugauggauuaggauucugugauagggauggguucuagcuugacaaguccucccggcugcauuuguuuggccaaauagauuagugaggagauuggucuguuuuggguaagggcaauaguaaauaccuaugugcacuuagguuaacugauuaaucuuuggcauuuguagcuuagguuucuauccaucagaugggguuaacaguucccaucucacaaguaugaaaugaguuaggagcuauggaaguacuuugacaaugaagaucacauuagcauauaaaauaauaaucuuaaagaagaaguuauguaguaugaacuaauagaaucaaaacaacacagcugcacaauucuuguccuaguaaauuugucuagaaaguagacuugguaaaacaauuauuugaccuaacugggcuauaauuuggcucuugcuuaaaaacaguauuucuccguucuaugugccaguuauuuauuuauuggcccucagcuucagauucaccauguguugccugcucugugaaaauggaccugaaccuuuuguuuucuauuuauuuauuuauuuauuuauuuuuaauagauuuuuuaaauuauacuuuaaguuuuaggguacaugugcacaaugugcagguuuguugcauauguauacaugugccauguuggugugcugcacccauuaacucgucauuuacauuagguauauauccuaaugcuaucccucccccaucuccccaccccccagcaggcccuggugugugauguuccccuuccuguguccauguguucucauuguucaauucccaccuaugagugagaacaugcgguauuugguuuuauguccuugugauaguuugcugagaaugaugguuucuagcuucauccaugucccuacaaaggacaugaacucauccuuuuuuauggcugcauaguauuccaugguguauauguaccacauuuucuuaauccagucucucauuguuggacauuuggguugguuccaagucuuugcuauugugaguagugccgcaauaagcauacgugugcaugcgucuuuauagcagcaugauuuauaauccuuuggguauauacccaauaaugggauggcugggucaaaugguauuucuaguucuagaucccugaggaaccuuuuguuuuuaucuuuuuuuuguuuugaaccuuuugaaugguugcuuccauuaccaccugacacugaaguuuugucaguagagggugcuggaaaggcacaucaggaaggaaguacuuugacaauggugaccacuuuaacauaucaaaucauaauuuugaggaauaauuauaugguacaaacuuguauaguauuuauauguucauauaguuguuuauauaaaauuuauauauuuauauaguuguuauauauaauauguauaauuuacauagcauuuauaugguuuugcuucaugguucccugugugcuugcucagcaggcuguuuuuugagcaucuucaccagugcucagcuucuuuacccaguggucaguagcuucucauggugcccccagagacaguuuuauagcagaguauuucugguaggacacuuuccagaagguguauuuugagcaugucacaaaggguggguuucugacagauuccagcuaaugagcaccacagcagcuucucuacccuucauugugcuguggcugugcccucuccaauaaugucuggaucucagccuugagcagaagucacuuucuuuggugcucuuucucagcccuagggguaguugcuccugauaucugugauucuuugauucuuguguuuuuuuuuagaaucucuuuacuuauuacuagccaauuucucauuacuccaauuuccuguuauuccaacccucugucauaguuaauaauuucuuauguacaacucucccuguucaaauuacuaugcgguuucucucuccugaguagacccagacaguugcaaccaauuaaagaucucucugagccaccauguaucacuggcaagccaauucuucagagaugauaucguuguaucuguaguugaaaaaauucaaauaucuuuuagggaaaugucucaaaauccaaugaaguuuagcuguucuucccaugggguuucuguguaccuauguauuugucucucuuucucuaucuucaugucccaccaccuuaacugugaguucucacucuucucuccuucuccaucuauuugccuucauacacuuaguuuccaaccccagcauugcuuuuggcuucccugcgucucaauuucugucuuggugaggcagcgauauaaaagaucauaaauuaaugaaaucaaggacaugaaagugcuuuguaauuaguagaguaccauacaaaguggugauauuacuuguguuuauuaaauaguuuucucuucuauguuuucaaauguucaauuauguuuuauuuuaagagcuuugugggugccuucagggguacuuacaaacuaguaaaauagauacaucaauacauagaauuauuagacaagacugaaugugcugggugcuaaaauaggggaacaaaugaggaaacaggagcccugaaaauuagaauuuaauuguggucugaggauucauggauuauuuccaaggagaaucaucugaccuugaaggaccuuaccugcaauuuauuaaauguuuguggcacaaaugagccuugcaauacguacuuuacauauauucucauauugaaucuuuacauucauccuuauauucuuaaauuauuuuaugucuuagacugauuucaaaauauuuugcuugaagacagauuuuuguucauuuguuuuauuuuuaauugaaacuuaccuccaguuaugugugaaaacucaguggcaguaaaaucuacaagauagaacauuauguugcuuuucagguauuuucuauuuucauauucauucauggauaccuacauuuuaaaagaugguugaacacuuuucaccugagaacuagaguaaauauaugauaaucucuauauuuaaaaagggaaacguuuuguuuaaaaauugaugacucagucucuuuuuuuuuuuccauaagagagugugucaguaggcuucuaggagauggcauacuuuaugaaaaaauguagcauacuauuuaaauuagaggugguuacgcuuugaaugcaaaguauccugucaaaucacaggaugagugcaucucccaguggaagauguugcaaagugcaagugaguaugagucuucccgaaagcauuugucuuuauagcuuggauucuaugagaugcccaccaaagacacuuaauuuuuuaucuuagaaagucaagauggaugagucuucagauuuauuaggaacccuucuuuaguuuugaauauuuugugaugaauccauacuuuaucuuuuugcagaugagauggaaauguccuguuucuuuggcaaauaauaugugagcauagcacauguagcuuuuuuuuuuuuuuuaaauaggcuaugauuugaucaguguuuucugaaguauuaugugcgugcuacuggugguauauguacccguagaaauagacagacuaacacaauuugaauauauuuguuacuuauuuuaacgcugauuaggaaaaaaagccugguauaucacacuugucauuucuuagauacuacugaaguuaagacuaugcagguaaaaacaccucacccagaccaagugaauuacuggugcaguguucaggcaugcccaagaauguauugcugcauucuuuucauagauacagcaacacucuaccagaaaauaguaguauuuaaauauacaaaguauuuauaacauacauaauugcaaauuggaaucgguucuaugcucuuuuuuuguuuuguuguugaggucaguauggaucaauggauaaaaauugaauuuuuaaaauguaaaggugcagacugugagggaaaucuuauuaggggaugauuuugaugaaguuagucauguagcuuuagacaaacuugaagaccaaauuuagcaaacugucugaaucaucugcuacuguuacagaaggaccaacugcaaagaaaacaacuaucacacaaauuugaugaaaguauuugaaauuuguauuuucauaaguaugaugagaaugaaccucuuuccuuguaugucagauguguagagacacacauucuggugugaaaccuuucaauccugugcuuuuuugaaacacaaagugugcuauacaaaguccaccugagagguuccuuaaaaaguugaacauagaguuaucauauguucacccagaaauucagaaacuccuaggugcauauccccccaaauuaaaaacuaguacucaaacaaauguacacccaugugcagggagggacuauucacaauacccaaagguggaaagagcucaaaugcccauuaacugauggauggguaaauaaauugugguauguacauauaauggaauacucagccauauaguauauuagaaguaucaguacuucuaauauacuaguaaaugguggaugagccuccaaaauauuauguuagugaaaggagccaagcacaaaugauuagauacuauaugauucaauuuaugugaaauacuaaaauagauaaauccauagugacagaaugcagaugcaaggggcuaggggcagggaggagagaauggggagcaacugcuuaauggguauggguuuuauuuuggaguugauuaaaauguuucacaacaagauagaagggggugguugcgcaacauucugaaugcacugaaugccacugaauuguuuacuugauaggugcagcaaaccaccauggcacauguauacuuauguaacaaaccugcacauucugcacauguauccuggaacuuaaaguaaaauaaaaaauuaaaaaaaaaucacuacuuuuaucuuauguggauuucaccucaguauggaaaaaauaagacuuacccaguagugugguaugugugacauuuuauggggaauaggaugauguuagguugugcauaagcauuucuuauuacaggaguuaaguauguauuuuuacaauugucuucuuuuuaugagaaauuauuaguuuccuauuugcaguaauaaguuuuccuuuaaagauaaauguaaguuuuaaagaaaaaauaagaugguacugauaugacacaugaaggcaguucacaaaugaaugaaaaauggcagcuucaaagagacauuuuguuuuauguucaagccaacuaacuuuaauuuuuauuauguuauuauuauaauuauuauuguuuuagagacagagucucgcucuauugcccaggcuggagugcaguggcaccaucauagcucauugcagccuugaacucuaugacucaagugauccucccaccucagcgucccucacaggcauguaccacuacuccuugcuauuuuuauuuuuuauuuuuuauacagaugaagucucacuauguuguccaggcuagucuugaacucuucccacuucagcuucccaaaguguugggauuacaggcgugagccacugugccuggccaauuuuuagugagaacauauuagacacuaguugcuguuuaugaaaguugaacgagaugugacuuuugccuuaggaaaaacuuccaaccuaaaggugauaagccaaaucuauaaauaauucaaggaagaagcugaaugugcccagugagacuggaacagaggacaaacagacugaggccaagaccagguaccuguuugguuugauuaccaguaccauuucagaaaaugcuagaauaggcuucuggguguaguggcucaugccuguaaucccagcacuuugggaaaccgaggauggaggauugcuugagaccuggaguucaagaccagccugggcaacauagcgagaccccaucucuaaaaaaauaaaaaaauuagugggcauuguggcaagcaccuguagucucagcuacucagaagacuaaggugggaggaucacuugagcccaggaguucgaggcugcagucaccuauaaucacacuacugcacuccagccugggugacagaacaagacccugucacuaaaaaugggaaggaaggaagggaagaaggaaagaaggaagagggggagggaggaagaugcuaggauauauaggaagaaauuaaacuaaacucuauguacaagugcaaacaaaaccccaacuuaauauuggcauucgugguugauggaaagaugggaguuggugggaaaccauuuuagagcaaaauuugcuuuugaaauuagaaacagggagaaaaauuacuuaauaaaugcagcaggccgggcgugguggcucacgccuguaaucccagcacuuugggaggccgagguggguggaucaucugaggucgggaguucgagaccagccugaccaacauggagaaaccccgucucuacuacaaauacaaaauuagccgggcgugguggcacaugccuguaaucccagcuacucaggaggcugaggcaggagaauugcuugaacccaggaggcagagguugcagugagccgagaucaugccauuguacuccagccugggcaacaagagcgaaacuccaacuaaaaaaaaaaaaaaaaagcaacagauaauguaaucaaguuucauauacugugguccuuuuugccucuaccuuuuucucucucaguaacuuggaaguccucugggcuuccucucucccuaaaaaucucacauuuaaagguagcauaguagagggcuugagaauauaugcucuggagcuagacugcuuggguucaaauuccaguuccaauauuuacagaucguguaaccuuagucaugucacuugauuuuucuauguauuuguuuuaucuucuguaaaauggggauguuaauaguaacugcauuauaaggcuuugguaaggauuaaauaaguuaaaugauuaaaugugguaagcauuuauaacacugcuuggcacaugguaagugaucaaacaaauguuagccauuaucaucaucuccagucaguaaauccugucaauuuugucuccuaaaagucuuuuugaaugucacccacuaccacugccuuaguuuaagaucuuauguugucacaauugcaauugugccuuaacuagucuugcacccgcacccucucuccuaaccauccccucugucucacuugacugccugacauacucuugcuuauucugaaauacucagcucagaugucaccucugugaaacuuucccugauccucugugcuaguccacuuagggcucuccaugugcacuuauauccuuuggaacauaucucauuuauagcauagcuuauauaguacugugacuguaacugauguuccguggguuguguccaccuugaaggugagaaacuggguuuacuuaguuuugaacuuccacccuaaacacagccccugguacaaaguagaugcuuauuaaaugcuuggguggauuauugaaugggcucugccuguagaaagcuaguuuacagucuucauuugggaagcuaaguugaacacaccuaagaauaaauaacuaugaacauuguauaguaacugcugaaagaguuuagaaagaaaaggggagugcuggggguaaucaaauuauacuucaaaaagguagagcuugauuuagaacuuaagaaugggcagaacuugugugaacagagaggcagccacaaucuacuaugcaaaagggauguuuuaugaguugaauggguggugacagaaaaaaaggaaaaaaaaaaagcccagccuuagcaaaacagagaagagaccagucuaauuaggguguguguauguguguugauggggggaagguauauguugaaaacuacaaguagaucauaaccuauaaacaggguguguucuaaagauuuauuuacaaaccauuuguuuggacaugacacauaauauacaugguuucuagccagcucaaaauauuguauuuaaccuacuuaguagugaacuaucccagggacagugcuccagagccugggagcagagagucaggaaaggugcgauggauucugggcuagaagacagagugauagagaaauugagauuuguuguucuccuaugacccuuucugcaccuuuuuuuuuuuuuuuacaucucaguuucucuaagagaaaguuucucuaucccucaaggcaccccaugcugcuaacuuccuugaaacagaaccccauccaaaguugcuagggcucuaaaaggcucucucucaccuccagccugccucauucccucagggcaacagcucuuugcuauuugaagaaacuugacucaacucauucaugccaaugugugaauaacugauagccaccucauccuggcagcuguacuuacuuuaauuuuaacagccuucuuguuagcucaaaugaaccuguaauugcuggaauuucuggcacugguacagagcaaacaaugugggaggggggugaggguuacagagagagagagagagagagagagagagagagagagagagagagagaguuucacuguaggagaagauauuuugagauaaggaaagcuuuggccaagagcuuugccuaauuuuccuuucuucuccaccucccucccccaaauuguucuuguguauuccucuucacagguuuacuauaggcugcaaguuguuuauuauuauuacuuuuuaagaauaacuucuguagcaguucuggguauggugguacuguguuuuuuaguugugugcaaaucugggauuaccuguaaugggaaauaggguugaauagauaagguggggcuggggguugaggggaccuugaaaguggagucuacaaauacauccauagaaauaaggagucauggaaaguuuuugaauaaaagcuuaagaugaugaaaccaauaaagguggcaaaaugaauucuaaauuuugaauuagaaaugauggaguauuauguuuacucuuggcuugggauugguuuauacagaaucauauuucugguuaccauuuuucaugguucugggcauucaccuuuaauuguuaguaucucucuccuuggcugucuguucucuguggcuccugagccaaucuuccuucaggauuaauaugcuccuagaagcuuuuaugacuuuuguauuaccaacuagcacauaagggcuuauacauucuguuucugugucccaaaauucaagucuaauguuagcaaaacacaacucucauuuauaagacuuuuuuuuuuuuacuuuuuaaugaaaauuuccagccuuuccaaacauaccccaaaaacacacuggagauagugguuaaugaucugcaucaguuagcccucagagcugcaggaaccuccacacccacucccuaaccuaugcauguuaaaccauguuguagauaagcucuucccuuuggggaaccccauugucuuuuauucuuuauauuguucauuauguaaauauucuugauauuucuccuccaccagucugcacaaaggagaagccagaaaauggggugagaaagggauuugagacauuuccuuaagccuaaauuauaauucucucauuggaacaggauucauagaucuuuaaucaaauauguuuauuuuucucuguuuugaacguuaaaagggcuuguucgcauugggcccucuugugugucauuuguauauuuugcucuugacugcucagcauaccauuuacauuaccagguauuggugaugugcagugacuugcuugguugaauuugcuauuucauuuuuuugcuccauguaguggagcagugauuguuaaaauuggauuuugugguuuacucuuucgucaugacuuguagcaacaguaauuuaauaggauuuaacaguccaaagaauauacuuuuuguccuuuucauuuaccaguccacaaaaugacugcuuuuaggagauauuguuucauuuuucaauauucccuggccuaggugguaacaaacuaauaaaaugcauucauuugcuuuaccaauccuaucuugacuuagaaaguugauuacugacauuucccuuccuuaugguaguuaaguguuuuccuuacucaguucaguucagcagucaccuauugauccauucacacccccauccucauucuucuaucauaaaguuauuauauaccuacuaugcugggcccccugccaggcacacauagggucugucaugcaaacaucaaaaggagccauuuagguaugcuaugugcaauuguaacauuuuauuuuuucuuaugauucaaaucuuaguuuugggaggaaaaggcccuuuaaugauuucuuauuuaauuaucaucagaaaaguguaguuaggcauggaggagggaagaaccuaccucugcuggcuugauuucaccaaaaucgccuccuauaauuggguuacuaugugacaggcacugaguuagguauaauacaaacauaaggaaggcccaaccucaguucucaggaauuuauagucuagggagacauagaagcaguuuuaacccaaagagagaggagcuauaauauucaaaguaucacaggaggauagcaaacccauuaccuguaucuucuaagggaugugagggaaaguuucacugagggagguuugcuugaacacuuaagcaugacuagaaguuugcuugguagaguagaagggcagggaauuccaaguggaaucagaugugaagucacugaggcaugaaggaguaugacauauuugaaauguaugccaagaaauugcuaauuacuagaugaaagagaacucuguggaauuggcauugggaagauauuucugguacagguauagguugaucauuuauguaacuuuugucauauagcuauucuguagcuuccauuaacuauuccuuacuucuccucuccuccagccauuuaugugaagacuuuuuuuuuuuuuggaggggagguguuuaggagucauauuuguaguuuuuccuuaaaaugaauauuaauauaaauauuaauacaauacagaggugacuaauaaacaccaaauuagguaucaggagaccuggcuuauuguuuuccacuucucucagcggcuaugucacuugagccaaggcauuuaacagcucuguuucuucaugaguaaaaugggaauauuaaugccugcauugccuaccucaggaucagguugaaaaugaaaaugaaacuguuaaaaauaaagagguauaauaaacucuuuuacuuggaauucugcuggcugagguuaaacugacauuuaaagcaaguaaaauacuuuguggaguaucuggauagaaaaauuagguuggaaaauaauucuuacuuccucauuaacccucuaugucugcccuuuagucuuugaaaugucauuuagcuuauuucuauguuuccaaacuaacaugauaaaaauuuuaaacuuccuaauguucuggcauguauaucuuggcccuuucaaauucucaguguaacuauuaaauagcaauugauuuaagaguuaggugaguaaaauauaaguugguauauuucguagucaaucuugaauaauucauaccuauuaaguaguuugaauuacuaaugagauacugucuaucauuucuuguuccauauggugguaggacacaaguuuuguuccauuuuagaaauguauaagaggguccugauucauucaauuaggauugggagguuaugagacuuuggccuucugccuucuuugccauuuuuccuaauucagugacaaugcaggcagcaguuauuaguagcagcaaaugacauuuccauucauuuuauuuccuuugacccccaucuuccccauuagauugagugguaaucuacugaaaucugauaaaucacuugaaacaugaacuucuagacuauaggagcaugagcaauugcuuccaauauaaauacuccuggcuaacccuucuuuagaucagugguucucaaaaucuaucacuauggauauuucagcaggacagaaaauucuguaaaccacuuaagucauccugcucugaaccaucuuacauacaucagaagaaagggaaagaguacugcuauggaugagauaacacaaugguauuuuacauggaauguaacugaauuauuuauacuagacuaguauugauccugucaucauaaucacuauuauaugacacuuguggaauuccaagagguaguuaccccuccucccuuucugccuuugcaacuuagagaugaacuaguuaugugaauuuggauaaaacaccuauucuaaucaaaauauaauauaaaaugguuguugagauuuuucuaccaggcccuaaggaaauaaucugucaauuugucuguuuuucacaaaacuaaaugaggaaauggucuggcuuauuuucucuuuguuuuaaaaucuauggugccauugauacccaguuuaaaaacauucuucugaaggugcuguugauuaaaucauuuuaaugucccccaaguacugccuguuuuugaagauuauuuggaaaauguggcacauucaccaacucacauucuccucuuauucuguacuugcuuuuuuuccuuauaaguuaguggaaaggcaacuggucaguuuuuucacucaauaaaaaagaaggaagguguagacagcuuuuaucugggaaugcuuuaagucauugagagaauauuuuuaaguguuaacuacuuuuugaaauuauuggcagaaucuuuuaauccauuuuaacauaaaacaguugacuaagauggaaagauuuuuauuguuuacauaaaagaaaucaccaugguuuuugcaucauugcauaaaucuaagagauugugcauacauaaaaaggaugagacaaagcugaauguuaagugccaaaaucaacgaaagcuugcguacuuacuggguauuugacacugagcauaauggaaugugguuccacagagagagaauacuaaauauuuagacccaaggacauguuucucugauagcuucuuauccuaaucuccuagcuaacauuauuaacccuuuuugaaacaccucuuucuuacacuuagauuuccuccuauuaaagcucacccuuggagauucuaaaccuucuauacccaagcaccuacacucacccacucaucucuuucugagaucuucaugaauuccuuuuguuuauuauauggaucuuugggugaauuaucuugguuuacuaugaguaguaaagcacaaucacaauuucucuccacuuacagcucuauuuuuccaaaggucacagcuccaucauucagcucuucugucgguaucccuuucucaucgauucccuggaauuuuugaaccagggcugugagguauacagccagcaauguugcauaguacuuuagaguugcugcccaacacagguccaucucucuucacaauucauguuuguuccuuuucaggcucagaguggugaaggaaguuacuaagauuagcgugcacuaugaagucugggaggugggcuuucagggaccugcuuacuuacucugaggcucugaccuuugccuuagugugauuuucucaccauccucuuuuauuuugugggcaaaggaucaaaaagauuucuucaacauugagugcuaaacauuagcaagaaugcgugguuucuggucccuguaaugaaagaauauuuuuaaaaccauagacucaaauuaccauguaagauaucacagaagcaaauggaauuugagcuggaucuggaagaauggguugaguucaggaaaguggaguuuggaagagauuucaugcaagagggaccucuggagcaaaggcgagaaagaacaaagaaagcuuuugacauagagaacuggaaguugguguuaugauuuacuacaguaaacuggaagaguagguuggccgguauguacugaguucuuagugcuaggcuuaguuacuugauuaauuauuugauugaucuacucauucaacagauuguuucucauagcccacaggauaaaauccaaaccuguuuucuggcgugcauggucuucugugaugugguuucugcauaccuuaaaaucuacuccacucaacacuauguacccacuuuucaguaauauugaacucuuuucagucauaucgaagaauuugcugaucccugcaacauguuguauuccuucacauguuucuuucuuugcacaggcuauuucuucuagaguucacuugauguaugcuucauucuucagccucaguugcaacggaauuuuuguuauuccucugcugcuguagaaugcuaggcuuauauuacuaaagcuucuacaccauauuuuguauugucagaauacaugccugcuucccucacucagcuuaugagcuuccugagggccagggauugugucugguucaccuuuacauccacaccacccaacauaguaccuaacauguagccaauucaauaaauacauacuuacuguaaaauuauucauugaucauuuacuuuacaucauguguaguuuuauuuuuaaaaagcgaucuagauggaaugggauugacaaauugaagacgggcaaugcagggagaugaguuauauguauuuuugaaguagcucauuuguuuaaaaaaaacaguaggggcuagauuccugggagauugauaaagaaaaaaagauaggacuuaaugacuggcaacuaugggcaagagagagggaagaauuaaagauaauaaaaaauaaagauaauacaacaaauagcaggauagugacccuuaaaaaaauaagguuacuuucagguaagcauguuuuuuuuucuaaguuggauuuccugguguuaguauuugucucacuccaccuuugcuccaaagaugaacacuuuguuccuguucaguuuaccagaacuaaguucaagauauaugugcuucucauuuucauaucuggccagcaguuuagauaugaaauauaaauaguucaacuacacugacuacaauuuccuaucaagggaagguaugcaguacauagguuuuuuuuuuuuuuuuuaaauauauaaagccuguuucugcuuuugggagcuacaacugaaguguuguaccaggcagaugcacuggggugcgcuacuauguagcagagccuagcugugcaucacagcucuuaacuuuaaaacuccagagaauuugaugagagagggauccacaagaacaugacaaaugaugagaguucaaaccuuaagagaaaaaugggcuuauugguaagagaccuuucuuuuccuuuauuuacugcuguuacuuacucauuaaaauagcaagccuguuauuuccauauguggcugugaagcgauauacaaaaaucaauuuuagauguauuguagaauucaggagacauauugguaaccaugcaaaaaucauaggaagcauguacaaagcuugauuuugaauaagauuucuaagggaauuuuauuuuacuucagacuguguuauagauuuauuuauauagcuuaaauguaaugcagguaagaaauaucuauauauacauauauuuaaaaaguuaaaauaaagaauagugacuuauguagaaauacauaauuucacucaguugccagaagguggcauaccagauuuuuuuaaaugcacaaagaaaaggaauaauauuaauagggauauaaaauaagcuguauuuaaagacauuuugaugcauuuuaaagcaaagaaauaauauaauuguuauuuuuugguagggcuuaauuguaaaacaugacagauaugaauuugaccuauuauagcuuuuuaucauucaacaauaauguuuauguguauagcauuuuaaaaguauacuuucaaauaguacugucauuaaggagaugcuguuuugaauuuaucauuccaaaaaagaaaaaauauuuuccaccuacuuuuuucauaggaaguuauuagauuuaguaucacauuuuggauaaggucuuugucaaggucuuucuaaagauauuauuaaacuaugacuuugauauaguuauggauuuaauaaugcaguagugcuugugagaugacccagaaaaaaccaagacaguuuauuuugaaaaaaagugagauaaggcuaaugcuuacuuucuauaugcugauaacaacauaaaugaaauaaauggaaauaaaugaaauuuuauauuagagcucaucaaacauuugccagcauacuuuaauuuuuuaagagaguugacugucaacagccuauacuguagugcuucuguaguggucucuauuuuuaaaacuggauuccugaggcaguaccagaaguaugucuauccaauguugcuuuuuguauuagcccaaaagagcuagauguaugacagaacuuaacaaaaaccaaaucuucugguuaggagacaguauaucuauuuauguguuuuuauuaauuacaagcaguaugaaaauaaaaagaauugguaguaaaugaaccuagaagaacauuagccaucuguucucugaaagcuuguaauaugugucauuugcuuucagguuuuuauggcaaagaaguauaucagcaaagaauugaccuuuaggcuuaaaaagcuacaaaauggcaaauuauuccaaggggcgaguauauauuuacuggaaaagugucuccuuguguccaaauuuggcuaguuuagucuuuuagaucaacugccaaucauuguuaugcuuaaugcccaucuuuauuccagacuuucugagacauuaagaaagcuucuaaaaacaaauaggaucuuauggcuuucuaguuaaggguuuuuaaaaguuaauuuacauaguuuaaaauuguuaugugugguuuuaacuguucaggauuuauaaauaugguuuauuaauuuacagcuaaaaugcugucaggguaugcuuugaaaaauuugaacuaaauauaauaaaacuacaauuaaccagguuucuuuuugcacuccacuuucaggagacggaggcaauugucauuaaaacaagccgauuucaaggauauauucaaaaaaucaacuucaggguauguccaggggucuacauuuuuccucaccuuuuuuuuuuuuucagugcgaauugguuuucaugaaagacccugagaauacuagaagacaguuaucaaguauaguuacaguaauggcuagggcacuguguuuauuaggaaaaaaguauguaaaucaugcuguuaaaaaugccacgcaucauuguauugugccuuauauuuuccaacaugcuuucacaaacauaaauuacuuugguuuucacgacaacacugugagacgggcaaggaaagcagcauuuucccuauuuuacagaugggggaagauaacacuggaggucagaaagcuaaccagggacacagcugcaguuggaccacagaugccuagcucugucucuucugccuucuuccucauggaaaaaguuugaaacaaguuuuuaacuuuuuaaucuguauuacacaaucaagauaauuuguuuucuaauuguuguaccucacaguuucccacuucgcaucugucugucugccucugugccugucugccagcuggagaccuuacuuucagacucucccagaccuagaaggaucuggagugugggagggcaagauaauggauguacaguuugcuaugacaacugguguugagcagccaguguucauaugcuaaggcaggccagggacugagaaagaagacaaucuuacuauagcuaagagauauucagcaggaauuagcaaccuugacuuuaaagcaguguuucucuaauaguuuaguagaccuggugugauaaucagcuguaguacuuguugagaaugcagaguacugggccccaccuucagauaucuacauuuuaaauaaucaccucaugugauucuuaugcacacuaauguuugagcacaucugccuuaaagguaaagaacuuuucuuuugguauauguauugcagcauagagaaaagaaccacuuuucucucagcaacuucuguguuccaugucaaaccauauuaaccagggcaguggggagcaaggggcaagcaagagugaugaaugacagauauuauuugcacacauugcuggauguacaucugaagcaugucacaauagcuacuguucauuguggugacuuugacguauuuuauaaagguuugugucuauuuuagacaugaggggcagaaagauuucugccaaaaggugaaaaauaagugaguuuugauauuuuaauaacaucucccaguuguuuuuauuguaaaguaauuuaaaaaacuguauagaaaacuaggcuauucaggguucugguaguuaaggguuuacuguaacaauguauuuacacuaauuuguguuuccuauguguauaucuagucugccugauuagauuauaauggucuuguggccagggaacauguguucuuuuguguauuuguaacaucuagcaaagucauaaguuauugauacuuauugaugacugaaauaacucacugagcauguaucuccuuucuagggguuuugggcuaggcagaguaaguugauugauuucauuugugaaguuaaaggagacaaucuuacacugucaguaaugguuaauauacuaagaaguuuucaguugaaauaacuguauuuuaguugacagaugugaaagugugguccuaauuaauaaaugugcuuuuucccuguuuagaguauccauucaagcucgaucuugccucuucacccuuuuuggaauacauguuauguuguucugugcuuuacaaaucugaaucugaaaaauugauauuucuagaaaccccuaaacauaaauauuuuuguuuaauuucugaacaguaucauagaaauuuaaacaaaugccuagacccuguaguggaagauucauaaaaaugcucaagugucucugacuuaaaucaagcugaauaaggaaauaaggaaugaaugaauaaauguaugcuagcuaaagggaaaauguagcuucagaauucuaugagaaguaacugauuauuuaaaacauauauuugauuuugaagacaugaagugguucugaacuuauuaguugaaguagacagacauagaaaggaagucaagaaacccagauuuagauuaccucuagcuuaaaucuagauucaaccuagaagaugaauucuguuuuuauucaaaauggaauuacuuugguuaguaguagaccaugagauaaaggaaaagaaaugauuucccuuucauuggauagccauugcauccaaauaauaaagcuaaaccuaaugccaaaacaagcugugauuauuuuacaacacaugaacacuugauguggcaugugcuaaugauguuguacaucauaggauuuuaauugaauuucuguuugcaggcacagcaauuuuaaauuacauacuuuucagcuagagucuacaauuuagaccuaugaccauacacuuggcaucuuucaguauaacugucucuguacucuuuagcuguuuguagaauuuaaaaucgcuaaagagaagaauucuaaauuggaaaacgaaaaggaucuggaaauagucaugaaaauagaaguauugaccagguugcuaagucucuuggauaguggcauagugggcaaauaacauuaccauaaggacaucuuuaagaaaacuguuggguuucauauuauggcaaugggucacaagguucaaguuugaaauugagccuuuuuugaaguguaagauuuucucauucauuauuuggucaaaaccuuuuauuuuuagaugacaguaguuucugugggcauauguauaugaaauucaguuuuaaugauuaaaccuaggaaaugguaaaaguuaaagcaauugaauauaaauggcucuuucucauagaaaauuuaaauaguguuaaauagucuuaauuagucauuaggauuagcuuucugugaaagugcugcugguuagcaaaauguuauuuugauuacucuauaaguauuuuuaaccaauauuuauaaauaggaagaggaagagauuggauaaccaggugaucuucuaaccucauuuuugguuauaacauuuaugaugcacaugugaauguuguaauaacuuuuuggauguaaauauacauuuuucaagguaguaguacuauuucauuaauuuaaaauugggauguugaagaaaauauacucuucuaaagaucuuucagaaauucagacuuuuagaaaaguauagguauuucugaaauaauauagaauauggcaaauguugaauuucuguaacuggcaugucuuuugagauuugguaugugauaugcuuauuacugaaaaaauuuucaaccaucauaaauaaacauuauuagaaguuguuuauucuuaccaaaauagugcaggauuuacaaauauaaagauuucaguauuccuuacauugucuucaugccacuuuggcagucuugcuucuauauuugaugcuaccaaaauuaaaaaaaauaagugaaacuauuuggaaagcuucauaugaauguauuuucauucaauagagccauauucuuaacuguucaguugcacuguacauuuuaaguggcuuuuuauuuugauaaguucacagauucaaucagaaaagcuaacaauagcuugacuauuuuauuuacucaaaguaguuuaaggagauacuuaggaaguugcugagagaugacuaaacaggugagugaucacuauuucaggugauagagauuuuuuuauuggaauauuuauuuuauuuaagaaaguauauauauauucuggaugauuuccuucaauauaugcuuauuuuuaauaagauaguauguuucuacauauuuuuucauuuuaaggagauuauagccuaaaauuaucaaauuaacagauaaauaucccucuugaccucugcuuuugguaauagcagguuuaacaacaguguuuuaaaaaucuuucaggauauauucuggcuucaauauauaauucugauuuucacuccucuguuuauaaauuucccuuucaauuuacucaacaaauacuuauugagugcuuuccaacgggccaggaauggugcuagauuaggaagauacaaagauuuagggauuccuucuugaaggacacauaggaauuugggaaagacaucuugggcagaugaaguaaaauagcuauagcacagggugugguaauagcauggccucuuuuuggagcauuggauauguuaccccuacugaugaugauaaaucgucucucuguauugcucuuaccaaacaauuuaaaaaugguaaucuaaaaucacauauguaaauaguacauaguauauauacuuaaaaacuauugauuugccaggugcaguggcucacgccuguaaucccagcaauuugggaggucgaggcaggcugaucaccugaggccaggaguucaagaccagccuggccaacgugguaaaaacccaucucuauuaaaaauacaaaaaauuagccgggcgugguggcgcaugccuguaaucccagcucuuugggaggcugaggcaggagaauugcuugaaccugggaggcggaaguugccgugagccaagaucguggcacugcacuccagccugggcuacagaaugagacucugucucaaaaauaaaaaaaauaaaauaaaauaaaaaccauugauuuccacuaccacaaccccaagcauacacaaacauccugguuuggaguuuaaagcauuuuuuuuuuuaaacagaugggaauacuuugaagcauacacggguagaaaaaaaaaaaaaaagaaaagccauaaagaguauagauagugccagaaaacaaaaugaagaaggaagggcaagaacuucugaauuucccauucaguguuacuccuuuuuacagccuuagugaaggaguaaaguuagucauaaucuguggaucaucggguccccaacaacuggaucuuuguucucugcucagucucucuguauuuuugcccacucaucccagcuccuaucuuagccccauaaccucuuucaucugacacccaacuauaaaaaguauuauguaaauaucaggaauuacuaccacucuggcuuuccuuuccccuuacagccagccauuaccuuccucaccccuauugucuucuccuuuggauccauuaccuaguguuccugccuuuucaacacacuagcaucucuuauugcuguuuuuucucugcccaacauggcacccuucuuaucuuaaggaaauguuacagauaggaagaauuacugcccuucacauugcuuaugccaucauggugugaggaauucucuacgcauauacaugagugugugccugcauaacauuguuuguauuguuugaugauuuugacuaauuuauauuucuugauaccuuugauauaaauccaaggcauagucauagcuacaaaagggaaugucuuuguagauucuuuguuggccuacuagguuucacacaguucuguuaaagaaauuucuaauguaaaacuuuccaauguaguugucuuugagaaacaucugggauuuuccauuuuuuauuguggcaagacuacauaucugaguaucuaguaagaaauuuuaaauguaucugauaguuuccugaaacaaauaaaggagacacacaugcacgaauauauagucauauauguguuuaagagauacacacaaacacacaugcauguaaguguauaaguguacauagccaugaaugugaacaauuuuauuuccuguaagaaggaacccuuaauguaucaagaauuuugcuuugcuguccagaauuuuguguguguuuuaaaggguuuaaccguccuauuugguugcuauccaaguacuuuuacugauugguggaacauaaacaaagcacacaauuuggcaugaucugcagucuugucuaagcauugugaauaacauggauauuuuagauuaaucugaagagacauuucagaacugaaaagauuacacagugccuguucauacaaacucuggcuagggcuauuagucuuuagcuguaccuaccacaggauuaaccaaaacuugcaugaaaaaguagauaauuucuuaggggacaucaggaaaaaaauggagcaagagauuagaaacaugauauauuaguucauuuggugaggugguacuggugacaaacuauacuagucaguuagcaaauuaaguuuuacuauaaaauuauuuaggaacauaugcauugagaaaaaaaaucagaguauuggcaauauauuuacguuuucucuuauacugugacugcuuaaauuauauuuucuuccugaacauucuuaaacaucuucuggaauuaagauuuuggaaaugguucuucaugcacagcuuuucuuuuaugguguuuuucucccacuucuauuuuucagugaacauauaauuggaggaguugauaucucuuuguaauccuguuucuuuagaauacauugagacauuuauagagugugguucacuucaaauagaaacaugcaucuuguggaauggucucauugggaagaacaguagggauucuacaagaguccuauacuaggagauugaaauuugguuucuaguuucucuuuugcugcuagcuugugauacaacauugggcaaguuagcuucucuggguuucaguguuuucguuuauacaaugaggguacugagaaaaaugaauucuuagaguccuaaaauuucaacaaaucuucuccuuuuacauucuaagaguuggcucuuuuuguagccuuggccaagacccaucauuguccuuuguuuguuacgucucugaacugugcauuucacagguauuuuuuaacugauuaguuaauguucauaaaaugcgucgaagagcuuuuauguauguugucuuucucuccuguuuuaugcaauuguacauaauagaagccaaguguucuguaaucaaaauaaguguuuccuacgaugugaccaaggguuuuuugacauuugcuauucuaaauauuaaaguagugggacacugagccugcauaaaauuauauuuaaaauauauguugaaucauuuuuguucauuccauaggugaacauauuuuuaguucuagaauguaaugggaauuauaauuacacuccauaguuaugacuggauucuccaccaggguaguaacaucugauuuguuuggaugcugccaacuuguaauuaggaugauuuuaccuggcugaaguuuauuucuaaauaauaugugaggaauaguguuguuaagugaauuaauaguguaaaguguuguucaugaacuguauuucugauuaaagggauuauuuuuaaggacuuuggcauaauaguuguuugcucaugagagguaauuauaagugacuuaauaauuuauuaaaggaaaaguaagaacugaauauauauacaucuccaccaucagauauaaugcuuuuaggguuuuagguguuuuagagugcugaggaugggguguagggaggcagccuuacuuucuuuucaugcugaacaaauauuaaaauuauugggguaccacaaaaacaaauauuaaauauuaagucugcaaggaaucuagacugaaaaauugaccuggaagauucaugguauuagauagcuucuuuggagcccaaugaaauucgacaaaaguauguuguuuuuuuugaaucaguugauuguuuauagaagaauaauaacuuauagaaggauauucuuauagaagaauaauaaucuuuacaauaaaaugaucuucacuuguuuguggugguucccuuuuugggaauuuggaaaacucuaccuuaacuugccuguuuuccacucaucaauguuugagaagucuucauagacagauaaacuccuggaaacacuucacuaccauguuuuuuacacagguuuuuggaucuucauucucagaaggugaaguagaccaggcacgguggcucacgccuuuaaucccagcacuuugggaggccaagucggguggaucaccugaggucaagaguucgagaccagccugaccaguauggugaaaccuugucucuacugaaaauacaaaaauuagccaggcaugguggcaggugcauguaaucccagcuacucaagaggcugaggcaggagaauugcugcaaccugaaaggcagagguugcagugagccuggauugugccaccgcacuccagccuaggugacagagggagacuccaucucaaaaaagcaaacaaacaaaaagauucauaagcuggaaaaugauugagucucuuuucuaaaacaucaccuccuuacuacauaauauauagcugcuuuauguuuuauauuuuuaaauguuugcaaaugcuucggguuuugaaaauuuguuugaaacucacuguggaauaagacauuucaaacuugauguguucauacauguguguggcuguguguguguguguguguguguguauguauuucuccuucuuuggauuucaaacaaguugccccugcugauuauaccugaggccuuuuugcuauauaaccauuaaggauuauugcagaaagccuucuaauguaaaauauugacuauaauuuauguguauuaauggcagguuaaaaaaaacuuuuaaauauauuuuggccacuagcgcauugauaaauauuccuuucucugacucauuugacaauuucugugagucuguuuugugugcaaguacuaaaaggaguuggauauguaauuuaacccuuuaaaaugcuugacuggguuuuugggggcuguuucuuuuguaugauagguugaauaaaaauuguauguaagguaaugauggcugacauaauuuuaauauuuacaaaguucauauauuacuugucaaucuuucaaaauaagcuuucucuuuccauauauguauguauguguauauguacauacugcauguacauauauguuuugugcuucacaggaaaauaguaguuugucuuuuugccuugauauuggucuguaucuuaaaaggaaggcauuugugauuauguuaguugauuucaugcuguauuucuuauauacuaaauuugguauuuuggaauuuuugaaaauaguuccuuacuguagaaacauucauguguguuucuaaaauacagaugaaaaagccucuuaggggacuaaaucucaaucuuuaaaaacuaggaauaauuuggaaagaauauucgaacgcuaacuauuuaaguuggaagcaugaguuuauuguuuggauacagacuugaaaguaaauaugagcuuuguuccugcagugauuuuuuaaaaauagguaguugcuuucaugucaaucaugaucugccuuuacuaagcuugcauugauggaaauggauaauucuguuuuuagguagaagcagaaggguacuaugauugugaauugccuauaucagaaguaaaauucuucagccuguaaauaaacaguucagcauaauacucauuuaaccuauauucacuuuuuagaauuguguagaaaauuugugaguuuguuuuggugcuuuaaacagaagcuuaaaagucacuuucagggcauuuacaacgcuauuuucuggcaguauuuugaaacaauauagaugagcccuuuauuugccauugcuuucaugaaauaccucaagcugccuuugacagcagcuucaauuuuugaaccuccuugacaaucgcuaaucccuauagguuaccggacccgcuguugagcuuuggaguggucccugcuggacaccugcuuggccagcaguguuggucuuuccucuaggcaauuugugagcugucugcgggggagggaggggaggagugggggggguggugaacaagaggggaaaggggagagaaggggagggcaguauugaauuagauuguugauagcgucccucugaggacugcuauuaagagcaugcuacucuguacuucgcugcugcagaagagagagugauauuuguguuacuacagcauguuguaaaugugugagauuuugcucaucucagcuuggaaauaagaauagggaaaggagagcaacuugaaucagaagcuacuagaagaaccugcagaguucugaagcaguuuauauucuucuuacauuuugccuucuccuagcuggaaagcagagggacuggaauuuuugaaacgggcuuuucccauaauggcauucuugauuuguguggccagagcuugcacaggaggaaagcaggcugcugaauuuagucacugaucucuauuagcgguagccuaaggcuaugcugagguuuauaucccauuuguauuguugcagcucaaaagaagauuguucagaggaugacaaguguauucugaguagguauguuguuguuucauuuucauaugaaacccaucuauguuuuuucuugcuacuauuggucagaaaucagguuaauaggugcagaauauaguacagugcugcaguaucccuguuaagguagaacaaugguauugcaagcuuaaaaaaaaaaagccuggcugcuuuuauuaaauaaagcugcauuguaugguaugcacagugcaguccuaaaaaaauauacugcagucaacgcuuuucuggcacuauuguugaguuggaaugauugaaucaucauauugcuuuaggggacagaagaauuuaaggagguaccuuacagcccuauuuuacagauuggaagcaucgguuuaagggcacuggcagaauccuuugcuuguucuccgcggcagccacugcugugucaguacaguguggaauggaagucuuaguugguagucuguuauggaaacgcucuuuacuguuauuguaguaccguggugacaacaugccauugaaauggaaaacgagcucuccugcuaucuggaaauucccaguuccugugcuuaaaacauccaggucaacuccacuuucuccagcauacauguaagugagagaaaauaggauauuaaagugggauuucauucaugaaucuaccuuguggcaaaaugggggcgggggagcccccaaacagcaacauccaaaaaccuacaggauuaaaaaccucaagcuugcuuacauuuaaagauguuggcaugcccacacuucaucauuguuuuguuuuucuaaaguuuauguuuauuuaaaguguuuaaugguaaucuaauuaccagugugaaaguacaaaggcauaccuaaggaauugcaaaagaauuaacuuuaauauuuaacauauguuggauuuguuugaauuuuugaauaucuaaaacacuuaggaugacuucuuuuguguaauggcauuaaaaauugaugauugauggugguguguuaaauaugguaaugccucuuuacuauuuuuucaugaauuaaaaacagaguuaacauugaucagaaaaugagucuuuuaauugagacuuuuauacuuuaguuguguaugaauauuaauauguuugauaguacaucuuucucaguuuuaucauucaaguucugaaguguaaguuugaauuugugcaaauuauaucucuaugagcaguuauauuauggggauugaaaaaguauucuacaaaugucuguuuuaaaaauguauuuuaaguaaauacguacugaagugcacugggaagucuuucuagaaguuuucaaaauuuuugaaaaucuuuuuaaauuugcaguguugcuuuaaaggcaaaauccaggagauauaauaaaauguucuuuuaaaguauuguucaugauccuuuuugguggaggaaaaccgaaucuuuuuuuaaagaaaauauuaguacgagaaaagcuuuugaaaagaauguuuuaaauuugaguguuauuuuuaaaauauuuaucaguaggaaaaauguggaaaacuucuccugccuuaguuuaauuguguauuuagagcuguggugaguugccauuuuuuaacuuaguuuuuguuuuaugugagguagagaugcacaauuauaucuaucucuuucuuugaaacccuuucagaugcugaggaagugugguuaugcucucaguccaaaagaagcaauucccuggaaaguguugaaaaaugaggccauuucagaguuaaauccuguggucauuuuauuuucagauuuuuuaaugcuccuuuccguuuaugcuccaggauauuuuuaucucuuuggguguuaaacuuuaugaaguaaaaaaaaaaauaggcuaguuuguaaaaauaaaccagcuauauuuguuuuucaaaaacuguuugucaaaagcacaaauuaauggaggugacaaguuaauggaggugagaaguuaauggagcucuuucacauaauucgagaaaauaggaugcuuccugacuuuaugcaucuuaacuggcaagaaaugacuaaagauuuaccaaaagcaacuuuauuauaaaaacaaaacaaaacaaaaccucacuaaaaucagguuacaauuauaaugguuauuaauguuucuaauauuccuacuauauuugauugucuaaaagauccaaauugcagcccuuauugccccugauuugucgauuuuuagagauggugaaauaaauccccauguuuuauuaaauucaugccagccacaagcucagauacaacucaacacaacauuuuaaauuaaucacuuucuuccuuuuaagugcuuaccucuuugaccugaugauaugagugaaucaauuuagaagauagaaccuacaaaauauaauagaucuugcauguugacuguugguuguugguaguacacauagguagaauggaaaaauauauucaaagagcuuaugguaggcugaaguauuuugacauuguaacagacuauuuugacauuacaacacucuauauuauugaauuggucuuaacuuauuuuucuuuuuauguauauuaauacuuaauaguaaguaaauaugcacagauagaaauuuaugugaaauguagcaagacuagcuuggggaguuuaaaucagguuuuuaaauauguuguuuaguuuuugaccauuuuagaucacaguucauugccucacuuggccaaaaauaaaaacaucauguuuaacauguuuuucucaucaguacuucucuauauuccucaacacauuuacacacaaaaugauacuuaaguauagcauaauuccacuucaaaaaugauaaagacugaauuagauuacugggucaaguaacauuauauuuguucucacaauuguuuggcuggcaaacauagguuuaaaugguuacuugugucuuuugggucuaaacucuuugcacugaaauagaauuguucaauucugacuccucaauaaaucgugauauauaggaaauuuaccuguaaaauaauguauaaguauuuaaaguaguauuuugaauauagaauucuucauaggugauauaagaucuuuuuguacguaugcuuguguagcaucaguauugguuuguaauguuuuaucauuacuuaccgugcuuugucaaauauacauuacgugguuuucauugaagacuugaguacuuugucaaagacugaaauuucaauaugaaguauuuuagguaguaguaaaaauguguuauagugauugagcaugugugggaaaaaucuaaacgcuccauggucucuuucuaaacccaguguaugugcugcuuugcuguagcucuuccauugaugcuacagauagggcaguacugcugugcuagugaaggcuacaauagagaacauuuuacuuacugcaaacaucgagcagcaagacuauuacuuuuuuccuuguggguuuaaaguccauguuuguuuucuuucuguuuguuuagaacuugaaugacaguugaaaugucccaacauuuuuaaguuuucuuuaugaugaagacuauaguauuuguggcaauauuaguagaaauagcaucuuauauaguauaaagcacuuaaaaaauuuugcuguaaugucauacuagaaaagugggauaucuuaaauacgaaagauucaggaaaauaauacuucagucucuagauugauugaugaucaaauagucuuuauuggguagacauauucuuucagcuuuagauuuuagcauugcaggguggugugccaucuauguggauuucugaagggauugucuugauagaaauagagugcuuggugacauguguuugcuuugcacucuguucaacaguagguugaaguucaaccuuagccugagggaggaucuccuggccaguguaaacugcauuaguaaagacucugccccugacaggugcaaaccauauaaauuacucugucauuuagccuaaauuaauaaagcugaaagagcaaucacaucuaaguguuuuuaugguguuuagguauucauuguuuuaaaacagcaaaugguuccuucaggcaaauauuauaggguuaaugccuuguuagaugcuaaggacacacugaaauagaacaaaauuagcacuagugauccuuucaucuuuucuuuuccagcagcgaguuuugacaauaauaguguggcaaggaggaaggcaauuagguaagaauuaaccagugaaauauaacagugaauucuagcaagacagacccugugaguuguuuuccuuagaauguuaccuuucucaaucuaaaagacaaugaauguuagugaacuagacuuguucuccuuuagucccugcacuuacauucaguuagcuuccuauuuaugauuuuuugauauguaaaaaauauuuuuauaguaaaugccaaaaaacacaacauucuauagcaauugccucuguaaugucuucaauaaaauucaguaccuggcauuuccugagaaaauauuguguauauuguauaaaugcuccuuguuuguaggugauucacagcacagacauaauaaaaauaugaauuuucuaaauuugacauguuucuauccccuaagauugucuuuuuuuucuaauuuaguaaauaaaagaaaacuuugugguuacagaaaucuuucuuaucuagcaaaauacuuauuaaauugauaaucauuugugauuagagaaaucuuucuuuucuagcaaaauacuuauuaaauugauaaucucaaaauagaaaagaauguuuaguugcuuugagaacauaaacuuuuacuugcuuugugucuacuuaauuuuguuuuuauuacuuaugcacaauuuaacaaaauuauguggaaaaauaacacaacuaacaccuaagauaaauuuuguguuagucugcaacuuuuguggcauguucuuugggaauuugcauugucugagcuugcagaaggacuagguugucauuuauuaauggaaaaucauagagauagaagugaccuuaaaagucauuuagaaaguccaaaccccuuuuaacacaggaacucauuccaugacaccucucgaagauggcauugcauguccuucuugaacacugucacugacaaagggcucacuaccucaccaaggcugcacccuccauucauggacagcuuuuccuugcauugagcaaaaucaguuccuuguaucuuuucucucccguucccaaugcagccuuauagagcuauauagaaaaaaaaaaauucuauuacauacacgcuuaggcgucuucucaugugacaugguuuucagacccuucacucuuccugguuguccucacguggaugguuuuuucauguuaaucuuuauguaagacacuacauuugaaugugaugcuccacauggggcccaaauagaagacaauucucuuccuuuaagcagaaucucugcuugucuuaaagggccugagauuauauuauuuuuuuuaauuauaggauucacacuguccccuagugaauuuacaguuugcaaauugccuuuuugaaggccuuacaaucagauugcuugcuccucacugucuguguuuauucuuuuagcuucuucagaucuuuuagucugaggaagccuggcaugugcaaaugaaguuaacauuuuguuuuaaagccuauuguguauuuuuuaaaaagaccucuugaaaucauuuaauauaacagaaaaauauugcacacaagacacuugcaagacaaagagcuaguguuccugucacuuucagauauuucaaagacauucacuggucaauaauuuaucuagauuccuuuuuuuauacuuaguguaucuuccaaguaaucgcuucccccauugcaaagaaaccacuuucuacagagggaagagaggcagaauuucauaucuccauaccaucaugggaaguacggaguuacugagaauuucauacauucugcuugaaacuuagaauauuuaguugagacuuaaguauggccaaacuuggggagacggagcgaugagaaagaaguaugggauaggcaaguauuugugcuaauaacuugcaguugaagaguuaagaauuacaaacaacauacaugauaaaauuuuagauugacauggcugccaugauguauugcuuuauauccucaagacuuugagaaaggcgguauaaacaugagauucuuggggaaucaguacauaaauaaguuacugaguaauucauuuuagaaaaugcucaguucuggauauuagcccuuugucagaugaguagauugcaaaaauuuucucccauucuguagguagccuguucacucugaugguaguuucuuuugcugugcagaagcucuugaguuuaauuagaucccauuugucaauuuugucuuuuguugccauugcuuuugguguuucagacaugaagucuuugcccaugccuauguccugaaugguauugccuagguuuucuucaagggauuuuaugguuuuaggucuaacauuuaagucuucaauccaucuugaauuaauuuuuguauaagguguaaggaagggauccaguuucagcuuucuccauauggcuagccaguuuucccagcaccauuuauuaaauagggaauccuuuccccauugcuuguuuuucuccgguuugucaaagaucagauagcuguagauauguggcauuauuucugagggcucuguucuguuccauuggucuauaucucuguuuugguaccaguaccaugcuguuuugguuacuguagccuuguaguauaguuugaagucagguagcgugaugccuccagcuuuguucuuuuggcuuaggauugacuuggcaaugugggcuccuuuuugguuccauaugaacuuuaaaguaguuuuuucccauucugugaagaaggucaucgguagcuugauggggauggcauugaaucuauaaauuauguugggcaguauggccauuuucaugauauugauucuuccuacccaugcgcauggaauguucuuccauuuguuuguauccucuuuuauuuccuugagcagugguuuguaguucuccuugaagagguccuucacaucccuuguaaguuggauuccuagguauuuuauucucuuugaagcaauugugaaugggaguucccucaugauuuggcugucuguuuucuguuauugguguauaagaaugcuugugauuuuugcacauugauuuuguauccugagacuuugcugaaguuaggaggagacuuugcugaaggagauuuugggcugagacaaugggguuuucuagauauacaaucauguugucugcaaacagggacaauuugacuuccucuuuuccuaauugaauacccuuuauuuccuucuccuaccugauugcccuggccagaacuuccaacacuauguugaauaggaguggugagagagggcaucccugucuugugccaguuuucaaagggaaugcuuccaguuuuuguucauucaguaugauauuggcuguggguuugucauagauagcucuuauuauuuugagauacaucccaucaauaccuaauuuauugagaguuuuuagcaugaaggguuguugaauuuugucaaaggccuuuucugcaucuauugagauaaucaugugguuuuuguuguuaguucuguuuauaugcuggauuauguuuauugauuugcauauguugaaccagccuugcaucccagggaugaagcccacuugaucaugguggauaagcuuuuugaugugcugcuggauuccguuugccaguauuuuauugaggauuuuugcauugacguucaucagggauauuggucuaaaauucucuuuuucuguugugucucugccggacuuugguaucaggaugaugcuggccucaucaaaugaguuagggaggauucccucuuuguuuauugauuggaauaguuucagaaagaaugguaccagcuccuccuuguaccucugguagaauuucaaacaaauuuacaacaaaaaaacaaccccaucaacaagugggcgaaggauauuaacagacacuucucaaaagaagacauuuaugcagccaaaagacacaugaaaaaaugcucaucaucacuggccaucagagaaaugcaaaucaaaaccacaaugagauacugucucacaccacuuagaauggcgaucauuaaaaagucaggaaacaacaggugcuggagagcauguggagaaauaggaacacuuuuacacuguuggugggacuguaaacuaguucaaccauuguggaagucaguguggccauuccucagggaucuagaacuagaaauaccauuugacccacccaucccauuacuggguauauacccaaaggauuauaauuuaugcugcuauaaagacacaugcacauguauguuuauugcggcauuauucacaauagcaaagacuugaaaccaacccaaauguccaucaaugauagaccggauuaagaaaauguggcacauauacaccauggaauacuaugcagccauaaaaaaugaugaguucauguccuuuguagggacauggaugaagcuggaaaccaucauucucagcaaacuaucacaaggaccaaaaaccaaacacugcauguucucacucacaggugggaauugaacaaugagaacacuuggacacaggaaggcgaacaucacacucuggggacuguuauggggugggggaaggggggauggauagcauuaggagauaugccuaauguuaaaugacgaguuaaugggugcagcacaccaacauggcacauguauacauauguaacaaagcugcacguugugcacauguacccuaaaacuuuaauaaaaaaaagaaagugcucaguucuuuuucaaucaccuuguauauuaaguuuauaacauucagcaguuacucaacugucuauuaugugccaggcauaacucugcugaggauuaggggcauaguccuugugaucauucaaagugauuauuuuuuaucuuccauacuaucuucauucauaagcaauuaaauagcuuaauuuauucuccugcugugaaaauuuggaaccaagacaaacagguuaaauaaauucuugcuuacuguacuuucaauauugauaauggauuuaagggcaauggaaacaccucagaagaaaaauuugucuggacuaaaugaggagacuugaacuggagguagauaacacauguuaaagugcauauugcacaggauggaaaaugaagcaauuuuuuuuuuuuuauuauacucuaaguuuuaggguacaugugcacauugugcagguuaguuacauauguauacaugugccaugcuggugcgcugcacccacuaacgugucaucuagcauuagguauaucucccaaugcuaucccuccccccucccccgaccccaccacaguccccagagugugauauuccccuuccuguguccaugugaucucauuguucaauucccaccuaugagugagaauaugcgguguuugguuuuuuguucuugcgauaguuuacugagaaugaugguuuccaauuucauccaugucccuacaaaggacaugaacucaucauuuuuuauggcugcauaguauuccaugguguauauguaaugcucaucaucacuggccaucagagaaaugcaaaucaaaaccacuaugagauaucaucucacaccaguuagaauggcaaucauuaaaaagucaggaaacaacaggugcuggagaggauguggagaaauaggaacacuuuuacacuguuggugggacuguaaacuaguucaaccauuguggaagucaguguggcgauuccucagggaucuagaacuagaaauaccauuugacccagccaucccauuacuggguauauacccaaaggacuauaaaucaugcugcuauaaagacacaugcacacguauguuuauugcggcacuauucacaauagcaaagacuuggaaaaugaagcaauuuauguuuaaaguucauagugucuuuuuaaacaacaagaauggaauacuauucuuuacauuggacagggaauaauuuacuguuugugugcuuuauagcacacaaguuuacauauauuaccuuccaagcaguaauaauuugaucucaaacucuaagauugaaucuuaguuuaaaauaaaauuauauuguguuuucaauuauacuaaaauauuuuucccagcauaacuuacuaugaugagguuaucuguuguuuuuacccauuucccccccacauuuaugucaugcuaaggcaagaacaugcccaguuuguuggagaggauuucuuauaauauaguucaauggaguaaugaaguaacuuaucuucaauaacaaaaaaauaaaaacaaguuucagaacuuuagauuaaauuuuaaucuagcauguauaacagauauucuaaacuucaugagacauauuccaaauuuuuaaaauguccuaguuuagcauaguuaaauguaauacaauuuauuuuccucuauuauagaagugcuaagcacuuaauuucauuccucccaaaaagcccuguaaguguacauccucucacuauuuuacgaauaaggacacaaguucagagagguuaauugcuuaauguuacacaucaaauuacaaguugagccaaaauucagauuuagggccacgugauuucaaagcuuguaauuucuccaaugccuuuucauuuuuauagacuuuugcuacuuucaugccaucuauuaauuauauaauaccuuacuaggguuagaagaaaagggaaauaugguagaugggaaaagcuuuuugaauuggguggugguauaggaagagguuagaaagcuuuacuugcuuacugucaaguggugaaguugaaggaaaauauugaggcaauuaucuuuacuugcucauaugauaucgggauuaacuccauugucucuugauguuuccauaguuccuugaagcacuauuccaucuucauugauuacacacauuucccacccaugguaauuagcugccacggacagugcuguagcugguguacucuuuuuagcacguuccaaggguucuaccccagucaguauauuuaguacuuuccugcagacauuauccucccacugcuuaauugcaugcaaauacucaaugaaaaaaaaaaacccaaaccucuauguauuucuuuucuauugcugccauaucaaauuacugcaaacgaauggccuaaaaugucacacauuuauuauccuacaguuuuuuuuuuuugagauggggaucucacugugucgcccaggcuggaguacaguggcaugaucauggcucccugcagccucgaccaccggacucaagugauccuccugccucagccuccucaguaacugggacuacaggcacgcaucaccacacccagcuuauuauuauuauuauuauuauuuguagagaugaggucucgcuguguuaccaggcuggucucaaacuccugggcucaagcuauccucccgucucagccucccaaaguacugggauuacaggcaugagccaccaugcuuggcauauuaucuuacaguuuuuucagaucagaaauuugguacuggucucacggggcuaaaauaaaaaugucagcaaggcugaggcucuaggggagaaucuguuuccugcucauuccugucauugacaaaauuccguucuuuguggcuguaggaccaagguuccuaucaucuuguuggcuauaaguuaaaggacaauuucagcuucuagagauugcuugcauuccagccccauuccucccucguuaaggccagcgacagcagguugaauccuuuucacauugccuucuggcucacucuucugccuuccucuuccauuuuuucaggacucauguaauuagauuaggcuaccuggauaaaacaagacacgccccauuucaaaguucguaaccuuuaucacauuuucaaagucuccuuugccauguaacaacauauccacagauuccugggguuaagauguggacaucuuuaggaggucauuuguuguaucuacaauacucuaguugaacacaaucauguugggcuuacacaugcguuguagaaaguguuccaauuaacccaagugguucuacaaauuuugcauuccuguaacuaaaccauauuuauuaaucucuggaucaguaguuuuguucuugaaaauuauaauaguuuaaacauuacauaggcaguucucagcccuugcaacaaugauuuccuggaaaucuuauuaaaaaguggaauuauccaguaacagaacuauaaucugggguuguguugaaaauaucaugaaaacaaguuucuccuauuagagcuuuuauugugcucuacauuuuauaaaauaggcacaauuguuuugauuacaucgauuuugcaagcauauacaaucauauaaaauacagauaugagugaaauugaagaugcuaguuauuuaaaaacuauuuuuuuugaaaauucagucuauuuugagaugguucacauagcccaagucucuuauuaaaaguuaauaguaauagugcuaccuuuugaauaaaaucaugaaauuaguuuucuuaauaaaauuugaugcaacaagcggaaucauucagaauaacuccacuguuaucagagccauuuaaaaaguacuaaagugugugcauaguacaaguuggcugaugcugauugcauuuuauugcauugaaaaaaauuucaaaggacucuacauuucuaccuucccaaaacauuuucaguuuauucaaaagacuguucaaaaucagauugaacauaaaggcuaccagaaaauaauaguuaacaaccagaaggucuuugcaugucucuggaaauucaaauaauacagguuguugagaaccuuaaaaaucuucaaaacauaguacugaauuagcuagcaguggcauaugauuaugugguuguugcuaaugcacuuuaguguuugguguuuggcaggugcagggggcaaauauugaaauuuugagugucagguaacaucuacugagugaaauaagaacaguuaaauaacaggugaggacugucuaugcuacucagucauugaccauuauguuugauucuucagcaaguuauggccucagaaguggcauuucuaaacuuggaggugcauccaggaaaguucugaucucagaucugguuaccaaacuuucuagacauugucuggcuccuauuauggcaggugcaggggcuugaugguauuuuaauuuauuauuuuuacuuuuuuuuuguagagacaggauauugcuauguuuccaagacuggucgugaacuccuagccucaagcuaucccccugcccccaaccugugccccgcaaagugcugggauuacagacaugagccaccacacuuggccuucugaugguauuuuaaauuuaaaagguuuagauugaaaauauuguguuuuagagcacuaaaauuuagagaaccaaauauuaugagaaugaugaauuggaguggcaagcucaguugaguguaugugggcaauugggcuuaauuugugcuuaugcgaucccucuguaccuaacugcacucccuucuugcuucccacauuuaagucucucaccgcagcuguuucuaaaaguucuaaaugaacuugcuuaaucauuuacaaguugcccuguaacaucuuuuauuuucacuuuuuuuucugguuucaaaaauauagagcuuuucacugaucaaugagauaagaccuugacaucauauaaugugcauaauuaucuuaaucaggguucuuucaauccacaagcugauaggaaccuuagaaaucacucuuuuggucauaccauuuaccuugaaagagaaugugauauuaaugcuugaucacuuuuccuccaucuguguacauuuguauuugaugauuuaacccagucuuaauuuauauuuccuuuuaaaaauaccauuucuucaacugcauuaaaauuaauauuaaagaccagcucuacaaaaucuuaacuagguuucucuuuauuaaaugugauuauaucagagcucuucucuugucugacagugaaacauguucuuaauuaauagucugaucuagcuuuaguuuggguggaccuacaaaauauuugaaauacaauuuugaaaaguauauggaugacacuaaauugugaaucauuguccaauagauaaccccuuagcaucaccaaauugaagugauuuucucauucguuacgaucacuuuccuacagagggugcgugcaugcagucauuucugaaugauucacagcuaaacaaaguucgugaaacuggaaacaaagguuugguuuuaaguagacuggagacuugguucauuaauauacuuuucauagaaauguugcugaagcauauagauagauacaauuagaguguuuuuuuuaaaugaugugcaguacuaucacaucaucaagaguuuugacuuucuuccauauaauuaaaauugcagauuauguuuuugaauagugaauauugugugauugcugauccagcccugcagauagccugaucuggaacaaauaacccuuuaaaauaauaguaaggaaaguugauauuauuuauuuauuuuuauuuggugcuuauaugcuaaauaugaacugauacccuuauggauuagagaaaaaaguuggcaaucguuuuguuauugugguuucuaugaauuauacaacaugauauuuguuaguaaagagugguaagcauuuauuauaauuuuauaucauuuaauuauuuggaaaguaauuguuuuuuauuaucaucucuuagcaagcaaguauccugacugcucuuuguuuuauuaucaucucuuugcaagcaaguauccugacugcucuuuguuuuccuaucaucuaguguggugccuggcacauagcagaugcucaauaaaugucgauuuuauaaaugaauuuagagaauaguuuuuaggucuguaccucugugcagaucacuucacaugaaaguguuaaguuuauucaucugauauaugcaguaauugaauauaguaguugucccuuaugcaugauuuccaacuccuuggaaugaguuacccaugguuaaccauggcaugaaaauaggugaguacaguaugauaagauauuuugagaaagagagagagaaaaagagcacauucacauaacuuuuauuaaaguauauuguuauaauuguucuauuuauuacuaguuauuguugauaucuuacuguaccuaauuuauaaaucagguaguuauguauguauaggaauaaaacguaguguauauggaauuugguauauccauaguuucaaacauccacugggggucuuggaauguauccaccgaauaaugggggcuauuguguaucauggucuuguuagagaauaaguuaugacuguauuuccuaugaaaagaacuaaucaaaaauccagauucuguucauuguugcugagaaauaccaugauacuggcacagacugaaaguaauuuuacuagaagcaaucuacuagugaccaaaauacuuuagucaugguucaucaaauuguaacugauaaggaaaauaagguuuuuuuaaaaaucuguucuacgauagaaacuacucucaaaguuaagaguuauuugacuuauuuuugcaugcuguucaucauaauggagaaaacuauuugagauauuuauguuuugaagcuaauaugcuuuuacuuaaaugauaauguguuuuguguguauaguuugauaaaagaaaucacugacuaggagaaaaagaagaccugacuaggguuuaggagaaauaaauuaaaaauuaacacucaaaaaaguauuuacauuuauguccugaauuuuuuauacuuaaagggcuucaaucuaaccauaaagguuuagcugauauuauauuuaaauuaaaugaauuuucuuuguguuaaaaaugauuaaauacaauggcuuuuacacauuacuuguuuagcaagagacaaaaaaugcauagcugugaauauguaaaagcaauauauuccaaagcaaaacaauuuguaguuuguaaguaaauuuggauuuucguuuguucuguugucauuaaacaaacauuuauugugaauaauuugcuggacugugcaauuaguuaaggagggugaggccaggaagccuugacuucaagaguguaggauuuggcuucuguucggcaagcagugacucacugaauaccuuugagcaagggagugcuuuucugagcuauaaauacaaucacaguauguauaaagaccauuauguaugugaaaauuauaauuaaauccagguaagagguaauacagacaagaacugugguagaggcagugagaguggauggggguugaaggauaggagcauucuagagagagauucaguugaacuuagcaguugauuggacaugggaaauggggaagaagcaagggucaaagguggucaaauaauuuuggugagagcaauugccuuuuagaauccaaauauuuuaucuauaguucuuuugaauguauaauaucaggauacaucggagauuucugaaauuucuucugacugaccaacauuuuaggaauggucauuaagaaauauguauguagucaaauucauuaccauuaagcauaucuuugacauaugaaaagauuggauuuugaagauguaaaaaugaugauugcuucaacaaguaucucauggagauggagugagugaggguaguagcauuuuccgacuagcuagggaaacuuuuaacaccuugacucccugcuacucucaucuacauggugacucuucuccccuuuugucugcuucucaucuacacugagagucagaaauuauaguuuggggugugaaacacugguuuaaaggacuguauaaaaggaaggaaaggaauacuucucuuuuuucauuuaucucacacagauuaagguaaguacuucauuacuacuucauaauucauagauugcuucugcaaaacacauguacacacaaucugaaaacgcuccaguuaucuucaauuuaaaauucccauuuaaaugaccaggagauuugaaugcuugaugccuacuaugucauuuuuaucacaaugguauguucuacccaagaacacauagccuucuuuuagccagagaacaugguguuucuacaaauaaacaucuuaccccuaaagagacaaauuccuugaugauuuauaauuuggaauagccccuccccaaaucaucagucugccuuccagaaaaacauuauaaauuuuguaaauaauuuuuaauauuuuagguaaugauguauaguugugacacauaaauauuuugcccaaaugaauccuucuuuagaauuacugcaccauggauaaacacuuaugguaguuuugguagagcaauuuuuguuauucacauuagcagaguugucuguggcuagauacugaaauugcucugugauauggacuggaauauuauggugaucuuaauuaaacuggcuuucuaggaguguaguaaaaugguggacccuaaaacauuuuaggugaaaaaccaggaaccaguucuagagcuaaagaccacauauauacucuuggaguaugguaacugugaauauguagauaggugagugggcuguaaguaacagugaagacuuuuugcaucuccuaacaaccugagagcuuauggccagcaauggauauguuucuuuaugggaagcauaguacaaaagggauaaacugaagucuuauaauaaaguuuuguggaaaaaaacccuuaauggugaggcagauaugcagaaaagggacaauaacuuuaauguuaaaaaaugauacuuagagucuuugcuuccauugagccacguaucugugaugagcuugaaagaacuauccuaagagugauucucagacucauuagguugagagccugucuucuuuuuuuguauuauucuccccugucuuaaaaauacuggcugucauauugaaaacguaugacugauuugauacuaauuuuuuccuacauucauugaaauaauuagagaugacuccaggccauuacaaaaaucaagacugagauuugguaaauuuauuacgggcuuugaauacauagagucauugggacucuuagggcugccaacuauauuucuuaaaacauggaaugcaaugguuacuacuuugugagucuuacucuuagguuuuuucauguuuccccuuaaaagauaaauaaacauucucuuaagaccuggucaugaauuacugacuuugugaaguugaauagaacugggaaauucaggaaaggauaggauuuucaccaccuuuuagcaguugauuaaugaaucuccuguucccaaaucgauuuaucucaguuauuucuaauugguuuugaguuuguggaaucugcuuuaauaauaaacucuaaaauuggguaacucagauguuugaauauuuaauaaaaaucuuaggaaggugaaacacaguucuuucuuaacgugcuuuuugauuuuaaugcaccuuagcaaaagagucaaauuuuaaaguugaugagcuacagauaaugggaguaaaaugacaccuugguuaacaaguccucuggaagcaaagcuccuagaaaauuggccugagcauugaagggguuggaauacccauuccaguuucuucauuuuuggauuaaagaaagagaaggcaagcucacugcugcagauauagagacuucucaaagggcaggcugggugcuagcuguagggcgaagcauccuucuagagggccuaugcuucaccagaggauuguaacuauuuccucugugcacugggaaggggacucuugacagugaugggagcacaugcuguuucuccuagcccacuucuacauauugccaucucccuaccaccauuaucacaugugcauucuuucaccuaugugguuuuauaaaagcaaggaagauuugaauucacuuguuuguauagaagguauggaaucaacauuuagaaaugcauucaucuucuaauuauuuuuaaauuacuucauuagaaauaaaauaauuaucucauucagaaaauagaauggauucuuacauaccuuaucuaccuaccauucauccauccauguaucccuuuauccauccauccauccauccauccgucuaccuaucuaccaaucuacccaucugcuuaucuugcuuucacacaaauauaagaaauguggagaaugagaaauaauauauaaacuaagcuuucuaaauagaaaacauuuuuggucaagaugaauuggacaugaugcaguuuaacugguauauaaauuuuaaaagaugaagggacacuaaagucuugaaauaugguaagcagagggagcaaauauuauuuugaaguucuuuaaggacaagauugagauauucaguggaaaugccuuuugauuuggguaauuaacuuucauccuguuauaguuaucuaauggaauaucauuugucuagcccaauucccuuaucuacgucauaguguuauaucuguuauugugaugguuggcauuagaguucagaauguguucuuuuaaauguugauaucaguaugugaaauucuccccaaauuucaucugaguuauuuucuaggauuuacuaccucccuaccccauaaguguugggagaauagcaugaaagauuuuuaguguugguauuguuuuuauggaaauagaaugguaaaaguaagugaucuucagauugaauuaauuaaaccagaaaauuacuugccuauaacagaauguaucucucugauauccuccuugugcuuauaaauuaagcauugaaaugcuaagugacuuauagccucuacugucugcuauuuuuaauuuuuuaggcuugguauaaaugggaacaauguaggcucuggauucagauguggguucaaaucauaguuacuagacucauggugaggccuuaaacucuccgagcuucaguucccugucuuuauuuuauuuuauuuuuuuauuuuauuuuauuacuauuauacuuuaaguuuuaggguacaugugcacaaugugcagguuaguuacauauguauacaugugccaugcuggugcacugcacccauuaacucgucauuuagcauuagguguaucuccuaaugcuauccuucccccuucccccaccccacaacaguccccagagugugauguuccccuucuuguguccauguuuucucauuguucaauucccaucuaugagugagaacaugcgguguuugguuuuuuuccuugcgauaguuuacugagaaugaugauuuccaauuucauccaugucccuacaaaggacaugaacucaucauuuuuuauggcugcauaguauuccaugauguauaugugccacauuuucuuaauccagucuaucauuguuggacauuuggguugguuccaagucuuugcuauugugaauagugccgcaauaaacauacgugugcaugugucuuuauagcagcaugauuuauaguccuuuggguauauacucaguaaugggauggcugggucaaaugguauuucuaguucuagaucccugaagaauccccacacugacuuccacaaugguugaacuaguuuacagucccaccaacaguguaaaaguguuucuauuucuccacauccucuccagcaccuguuguuuccugacuuuuuaaugauugccauucuaacuggugugagaugguaucucauugugguuuugauuugcauuucucugauggccagugaugaugagcauuuuuucaugugucuuuuggcugcauaaaugucuucuuuugagaagugucuguucauguccuuugcccacuuuuugaugggguuguuuguuuuuuucuuguaaauuuguuggaguucauuguagauucuggauauuagcccuuugucagaugaguagguugcaaaaauuuucucccauuuuguagguugccuguucauucugaugguaguuucuuuugcugugcagaagcucuuuaguuuaauuagaucccauuugucaauuuugucuuuuguugccauugcuuuugguguuuuagacaugaaguccuugcccaugccuauguccugaaugguaaugccuagguuuucuucuaggguuuuuaugguuuuaggucuaacauuuaagucuuuaauccaucuugaauuaauuuuuguauaagguguaaggaagggauccaguuucagcuuucuccauauggcuagccaguuuucccagcaccauuuauuaaauagggaauccuuuccccauugcuuguuuuccuccaguuugucaaagaucagauaguuguagauaugcggcauuauuucugagggcucuguucuguuccauugaucuauaucucuguuuugguaccaguaccaugcuguuuugauuacuguagucuuguaguacaguuugaaaucagguagcgugaugccuccagcuuuguucuuuuggcuuaggauugacuuggcgaugcgggcucuuuuuugguuccauaugaacuuuaaaguaguuuuuuccaauucugugaagaaagucauugguagcuugauggggauggcauugaaucuauaaauuaccuuagguaguauggccaucuucaugauauuguuucuuccuacccaugaacauggaauguucuuccauuuguuuguauccucuuuuauuuccuugagcagugguuuguaguuguccuugaagagguccuucauguccuuuguaaguuaaaugaguuauuacaaggauuaaauaggauacuagaaugugccuggcacagugcuuaguacacagcaggugcuggguaaaugaucuuauuccuauguuaaaacagacagaagcuauuuauuaauacuguucuauuuuaaaugugacagacauaugcauauaagaagccugugcaauagcuuuuuauagccugugcaauagcuucuuauagccuuggaaagauagcagcuauuuuauaaaaucucaucuguaacuaaagaguuccauuagugaaaugauuucagguagacaauaauauauuuaugucauuaaaaaaacuacaaauaacuaacaaaagcuuuaucuuucuugauuccuuucaggcaaacaccucauuaagaagauauauucuuuaaacaacaauuaauuuaugccuuauuaauagauguuacuuucaagcucacucuuguugguauuugaaaaagaaaaaagagagagaaguugcuaugauauuuauaauuucuuuguguaaugauacuauaaaugacauuuuaguugggggacaaaucuuucaauauuugaaauuuuaaguuuuuaauuuuuuucaacaaaaaugccaggcuuauuuuauauacauuaguuuacuucaugaguuggaaauuuuguucccgauuuuuucaaaacauguuccuuuguuucauaaugaaaguugaguauguguacacucaaacguuugugguaucauucagcuuuuguuugggaaguguggagaaagagaggaguagaaaagcuauuaauaucuuucgaauucaaugcaguaugaauacuuugacucuaucuuaaaaagccaauggaaaauggcuucuaccaucuuaaguuuuuaauuuauuucucaaggguggaaggaaauaccuugacagauuuagcccugaaauucaaaugaguaugagaacagguggugaaauuucuucuccaccugccaugcaacuuuaucacaagaaauguuucauuuagcaaaugcugcugcuagcagacacuucucuguuucagagcagaaaaacaaauggauggaaaguacuuugaggaaagacuuuuucuugauuuucuuuuuaaauugugagugugagcaauauguauuuuauuuuccuggggguuggguaguggauagucagugccuugauuaaccaaccuguuuuguuguguuguuaaaccauucauagcuuucuuguuuuuguuuucauuuuguuuuguuauuguuguuguuccuguauaccaacccacugacaccaacuuuaguuaagguaauauuauuaaucuggggaacuugaaauaucuauauuauacuuuugacacuaaugcaagagacuuucuuuuuuuucuuuuccuuuuuuugagauggaguuucacucuuucacccaggcuggagugaaguggcacagucucggcucacugcacccuccgccccccagguucaagugauuccccugccucagccuccuaaguagcuaggauuacaggcaccugccacugcgcgcggcugauuuuuguguuuuuaguggagacgggguuuuaccauguuggcugggcuggucucgaacuccugaucucaggugauccgccugcuuuggccucccaaagugcugggauuacaggcgugagccaccacgcccagccugggacuuucauucuuuuguugcagugaaauugaguuuuuagcauauauuguuagauuuaaccuuuuuugguaaugaaaugauggcaguuaaagcacuaugaaacaaaugagggaacuaaauagaaaaguguuguucauauacuuuuaccuuucuagcuuuucucuaauucauuucuucuuuuuucccuucagaaauuacaaacaguacaggaaaguguagagaacagucuuuuauucauagcaguaucaagauguugcuuuuuauuugaugugagcuagacauuaauguaccagugcaugaauuggcacacauaaccucucuaccaagaaaaguuaagugcuuuuauuguguuuucaugaugauaaucucaagaagcaccaaaauguucccuuuuccuugacaaugaaauuugaccacaccuggguuucuguauaacaugaacugcuauuugcaaugauagaaaccaagaaauugaaguacacauuuuauaauugaucaagaugauaucuuauuuuuuaaacacaaugguacugguuucaguggauugucgugggauuuauuuagguauggagauugaggagcauuggaagauuauuuguggcuuuugagucaaaugaugcaauuaagagaugcuuuuuccuuccucauauagcauuccaacaaacauauuuacuauaaugaauucuaagaguauaugguucucuauagaacgucuaccaaauuaaaccucuacagagggauucacugaagaaaacacauuuaagucagaucagcagagcacucuugcuuuggcccaccuaccaggacauagauaccaggacacaauucuucauugucauguugcuugcuauuaaaaaaaaaccacauuuguccauuuagugaguuuuaaauuuccuuugaaaaaauccauuuggaugaacaauucuaugcagacaguaguaggaguuuaugacauguuugcacuagcaauuuugagaguauaucuuguacucugauaauuuugcagguuuaaagauagaaucuuugugcauauucuggaauacugaugagguugaacauuuuuguaucugcuaaccauuggcaccuugaucuuugugaauugugugcucauaucacuuacauguuuccguucggguaauuuuaaauauguggacauuucgaggcaagauuacaauguuggcagcccuuuguuaacauaugacaauggcuuaggcuuuuuuuccuuuugucuuuaaaugcagugcagagaaaugccacagucuguguauguuugguuugaccacguuuacaaugcuuucaguaaaauggucagacagugccuccaucucuaagcuaauacucaucaaaaaaguaguuguuuucuuugagcaagcacaguugagugauucacguacacuuugugaaagauugcucuugugcuuuaugguuggucauuguuucaagaauaagacgucugcuguggugauuggguaggcgggggguggcaugcaagcaauaugcagacuauaauauuguagggaaaagagagguuuaauuuuuagaaacaaaauucguuaauauagucucucccaugaauaaucuuguagggcuggugaaaugggacuauuuagacagaauuugccagauucuaacuuaacauguaaaaguggauccaaauaacaacuguuuuaugcagauuuaggaaauuauuauucuuacaugagcuuauguaaaacaaaagcuuugcugcauaauuuucuuauaaacuucaaagccauuaucuacuuuuuuacucuuagacuugaguuuucaaauugaugggccuguggagagcagagauauucuguuagguagccuuggaagaauuagugauaauuaauaauccugcuguguuucauauugcuagcauuaccucauggauucaacccuaugacugggaaauuauuuaaaucaugaaauugcuugagaaaaauuuucaugagacaguaaauuccucuauauuaggauuucucaccuuuggcacuugacuuuuuugccuaagaacagcuuugaccuagagaacuguccuguuuuguaggauguuuagcagcauccccaguugugacagugaaaaaugucugcagacauuaugaaucauggggguggaaggaggggcaaaaugccuccugcucccccuccccacauugagaaugacuuguauguauauuguauuuaacuauaugaguugaaaaaacaucagauuaaaaacuguuauuuuuuuucuuggaauuacucagauaaucauuccuuuaagcauagauugauauaauuguggcuugggguuugcagagaaguguuaccuccuugcaauguugaagaacagugcucuucacauucaaucaauaaacuuaauaaaggggagauagaugggaauauugaaucugcuaagaagguuaacauggcauguacuguuaccaaagcagaaauuaguagggaguguuuugaauguuaaaaagucaaaagauacugauaaaacaucaugaaaaagauaauuuuaguccaggcuucuucagcuuuugaaguaauuaauuaaaaaggcaagcauauuauguuggcaagaaagggcugcauuuucacuuuuugcuuucuguuuuuaagagcaagagacaaaugacaaaguaaauaaguuguuacuuguaguuuacucaaaaaagcaauuuccgggauaugucauuguggcaaugugaauucagcuuuacuccuaucccuuuuacaucugcaguuucauaagaaugauaauugauggucauuuaagcacugcauaauaaagaaaugucuuuggaaugaucuacagaaagaagauucuguauucauucagaggacauauauuaagucuuucgugcuaggcucugugcagggaauacagaaacuaauaaaacagucugcuugaauauccuauuaauauaaucuggaugaauagacauuuucugguuagggauaacagucaccaucaaucaauuucugacuuuuccaauugauucuguaauuuuaaacgucuguccacaaaaguuguuuaaaauugugugugugugcuauauaucauaaauauaacuuaauucucuuuaaagcuaucucugaaacucugguggaaggcuauauccaguuucuuuuaugcuuuuuaaaaucuuaaguuauucucuucuuuauuaaauaucuaucagaauugaauuaaacaugguuauauauuauuaauucauuuuugguuauacuauggcucuaauaucauuaagaagaauugaugucauccuuaaggccagaauuuuugcuaauuauugcaagauuuaaaaccacuuaguuggugucauaauucaaaaagcagaaucuuuaguauggucuuuuucuuguuaaaacugaucaacuugggguuuuagguaugacaggaaaaaaaggugaaaccuuucugauauuggauagcucaguuagacaguuagaaaagcaaauaauucaaaauugaggaaauuacagaaaaaaugaagaguuccagcacuugaaaaucugcucuccuucuuuuuuccuaaugucuauuuuagcagucuuuuuagcagucuguaucaugaaugcagaaccaaauucaugagccaugggcuccccacucuuaggcaggugauccagagauuauuuuagcaauguauaccuauggagaaacacaagaucucuucuaaggaaugaugaaagguuauuaauaauggcacauuuuuaguauaaccugagauuuuuaaacuaucaaauguauugucauauucucuuugcaucuaagugaccuacugacuaagguucuccuauucuuacuuaugccccuugaaaauacuauugcugcaauacaugcaaauacagaauugccuguauuuauauuuuuaguauucauuucuuugaaaagauggaaaugugacuagauuguagcuauuaaacaaucccaaacugguaagugagagauacugcuagaaaaagaaauuauaucaugugaaaaauuuuguucaguugggguugauuagaacuacuacuaauaacagaagauaaaguaaugcauuaauauauaacaauuaaucuuuuacuuuuauuaauggggguuuggagugggaaucagacuagaccuagauucaaacccugggccaaccacuuuaauaagugguuucugacccuucuuuagucuguguauaaaauuauuggcaaguaccugcuauauaaugacuauucaauaaaugguagcuaucauuuuuaucuuuucaaaauuagguguuccaaauuaauuuuaacuauaugcagcauaauuugauggcauugcuaucuaaauaguaacauaucaacaguaauuacuguggccuuuaaaaacucugugacuauaauuuugaaccaccuuuuaaguugauuucucaguuaucaucuguauauucuguacuuggaaaccauuuuacaaauauacauuucuucuaagauaaagagugguacaagcguauaauauagugaaacaauauucaccauauugcauggucauaugauugcaauagugacugauuauuuuucuaaauaaucucauuguaaauuguacaaguuuuaauuuccccuucuuucuuauguaaaaaaacuuucagaucucucguggaagaggaagaccaacacaugaaauugucccuuggaggcagcgaaaugggccucucaucccauuugcagucuuccaaggcaggaccuacacgcaucuuuaccagcaauacccacaguucugugguguuacagguaauuuaagcugucucuuugguaguguuuacguagcuuuaaaaaacccaccauggauuuugugaugcaggaugucaguaguggaggagguuguggguguguaugugugaauaggaaauguaugguaacuauuuuuugcucaguuuugcugugaacccaaaauggcucuaaaaaaugaaguuuauuaaguaaagaaacaaaagacaaaaacuaaccaggagagaaaucuugauggaggaaugcacacauuccugagguuaaaaaauccucagaaucaauuuuuuguuugguuuguauaaaggacauuuugccaguaugccacuuucuuacagaauaccauaucugauuucauuccauagcaaucaaaguaaguauuacaaggucccuacacugaauuuuccuaguuccucauucacagccuguuuuacuaucaucuuuguaaugguucuaaagauuauauuuauuuggugucccaacucgcauugguaguaguaacugugggagaagagguuaggacugcuggaugcaaacccucugauacauguaauaaguaauaacuaaaauaaaagcaggggacagaaacacaguagaaagccaaaagaacaugaaacacagcaaucuggagcuauuuagcacggggauuagaagcuuaaguacuucugaccuuuguggacauuuucugacuucugugggcauugcugaauuagagagcaauaugguacuggauguccauuaaugucuucuaaagauaguuaaauuauauugguccucuuacuacccuuaauaagauaaggaaaauuugccuuucuaaaugcauauuuaaaagaaaucuccccagauggauuucaugcauaucccugaucaagaaccauuauaguaaagcuguauauagaauauaauauaaugagggacaagguuuauacuugcugugcauccucuguguuuaaauguaauuucaccggauuucauuuuccuuaucuccaaaaugugacucuugacuagcauaccucuaaauuuccugcuaguuucaaucuuugaauucaguaaaaucccauuuccccaguauuuccguuucuaauuggagcuggggucuaucuaagguucauuguccugugggucaucaauagauaugugagucaggaacgagaaucuuuccaucuccuggcaucuuaaagcuguguagggaaaagggaagauggccgaauagaacagcucuggucugcagcucccggcaagaucaacgcagaaggugggugauuucugcauuuccaacugagcccccacuggugauacccgggcaaacagggucuggaguggaccucuagcaccucuagcagaucugcagcagaggggccuguuagaaggaagacuaacaaacaagaaaggaauagcaucaagaacaacaaaaauggcauccacacagaaaccgcaucugaaggucaccaacauuaaagaccaaagguagauaaauccacaaagaugaggaaaaacuaauacaaaaaggcugaaaauuccaaacaccagaacaccucuucuccuccaaaggaucacaacuccucgccagcaaaggaacaaaaguggacagagaaugaguuugacaaacugacagaaguaggcuuuagaagguagguaacagcaaacuccuccgagcuaaaggagcauguucuaacccaaugcaaggaagcuaagaaccuugaaaaaaauuauaggaauugcuaacuagaauaaccaguuuagagaagaacauaaaugaccugauggagcugaaaaacacagcaugaggacuucaugaagcauacaaaaguaucaauagccaaaucaaucaagcagaagaaaggauaucagagauugaagaucaacuuaaugaaauaaagcaagaagacaagaucaaagaaaaaagaaugaaaagaaacgaacaaagccuccaagaaauaugggacuauaugaaaagaccaaaccuaaguuagauugguguaccugaaagugauggggagaauggaacaaaguuggaaaauacucuucaggguauucuccaggagaacuuccccaaccuagcaagagaggccaacauucaaauucaggaaauacagagaaugccacaaagauacuccucaagaagagcaaccccaaaacacauaaucgucagauucagcaagguugaaaugaaggaaaaaauguuaagggaagcuggagagacaggucggguuaccuacaaagggaagcccaucagacuaacaucagaucucucugcagaaacccuacaaggcagaagagaguggggaccaauauucaacauucuuaagcaaaagaauuuucaacccagaauuucauauccagccaaacuaagcuucauaaacaaaggauaaauaaaauccuuuacagagaagaaaaugcugagagauuuugucacuaccaggccugccuuauaagagcuccugaaggaagcacuaaauauggaaagaaaaaacugguaccaaccacugcaaaaacauaccaaauuguaaagaucauugacacuaugaagaaacugcaucaauaaaggggcaaaauaacuagcuagcaucauaaugacaggaucagauucacacauaacaauauuaaccuuaaauguaaauaugcuaaaugccccaauuaaaagacacagacuggcaaauuggauagacaaggcccaucggugugcuguauucaggagacccaucucacaugcaaagacacacauaggcucaaaauaaagggauggaagaauauuuaccaagcaaauggaaaacaaaaaacaagcagggguugcaauccuaguuucugauaaaacagacuuuaaaccaacaaagauaaaaaaagacaaagaagggcauuucauaaugguaaagggaucaaugcaacaagaagagguaacuauccuaaauauauaugcacccacuacaggagcacccacauucauuaagcaaguucguagagaucuacaaagagacuuagacucccacacaauaagagugggagauuuugucaccccacugacaauauuagacagauuaaugagacagaaaauuaacaaggauauucaggacuugaacucagcucuagaccaagcagaccuaauagacaucuacagaacucuccaucccaaaugaacagaauauacauucuucucagcaccacauuacacuuauuguaaaacugaccacauaauuggaaguaaaacacuccucaguaaguguaaaagaacagaaaucauagcagucucugaaaccacagugcaaucaaauuagaacucaggauuaagaaacucacucaaaaccauacaaauauagggaaacugaacaaccugcuccugaaugacuacuggguauauaacgaaauuaaggcagaaauaaauaaguucuuugaaaccaaugagaacaaagacacaacauaccagaaucucugggacacagcuaaagcaguguuuagagagaaauuuauagcacuaaaucccaauaggagaaagcaggaaagcuaaaauagacacccuaacaucacaauuaaaagaacuagagaagcaagagcaaacaaauucaaaagcuagcagacgacaagaaauaacuaagaucagaguagaacugaaggagauagagacacgaggaacacuucaauaucucagugaauccaggagcugguuuuuugaaaagaucaacaaaauagauagaccgcuagccagauuaaugaagaaaaaauagagaagaaucaaauagacacaauaagaaaugauaaaggggaugucaccacugaucccacagaaagaaacuaccaucagagaauacuacaaacaccucuaugcaaauaaacuagaaaaucuagaagaaauggguaaauuccuagacacauacacccucccaagacuaaacuaggaagaagucgaaucccugaauagaccaauaacaaguucugaaauugaggcaguaauuaauagccuaccaaccaaaaaaggcccaggaccagacggauucacagccaaauucuaccagagguacaaagaagagcugauaccauucuuucugaaacuauuccaaacaauagaaaaagauggaauauucccuaacucuuuuuaugaggccagcaucauccugauaccaaaaccuggcagagacaacaaaaaaagaaaauuucaggccaauaucgcugaucaacauagaugcaaaaauccucgauaaaauguaauccaucacauaaacagaacaaaugacaaaaaccacaugauuuucucaauagaugcagaaaaggccuuugacaaaauucaacacaccuucauccuaaaaacucucaauaaacuagguauugauguaaaguaucucaaaauaauaaguguuauuuaugacaaacccacagccaauauuauaccgaaugggcaaaagcuggaagcauucucuuugaaaacuggcacaagacaaggaugccaucucucaccacuccuauucaucauaguauuggaaguucuggccagggcaaucaggcaagagaaagaaauaaaguuuauucaaauaggaagagaggaaguuaaauugucucuguuugcagaugacaugauuguauauuuagaaaaucccaucaucucagcccaaaaucuccuuaagcugauaagcaacuucagcaaagucucaggauacaaaaucaaugugcaaaaaucacaagcauuccuauacaccaauaauagacaaacagagauccaaaucaugagugaacucccauucacaauugcuacaaagagaauaaaauaccuaggaauccaacuuacaagcgaugugaaggaccucuucaaggagaacuacaaaccacugcucaaggaaauaagagaggacacaaacaaauggaaaaacauucugugcucauggauaggaagaaucaguaucgugaaaauggacauacugcccaacguaauuuauagauucaaugcuauccccaucaagcuaccauugacuuucuucccagaauuagaaaaaagcuacuuuaaauuucauauggaaccaaaaaagagcccguguagccaagacaauccuaagcaaaaagaacaaagcuggaggcaucccacuaccugacuucaaacuauacuacaaggcuacaguaaccaaaacagcaugguacugguaccaaaacagauauauagacaaauggaacagaacagaggccucagaaguaaugccacacaucuacaaccaucugaucuuugcccaaccugacaaaaacaagcaauggggaaaggauuccuuauuuaauaaaugguguugggaaaacuggcuagccauaugcagaaaacugaaacuggaccccuuccuuacaccuuauacaaaaauuaacuuaagauggauuaaagacuuaaacguaagaccuaaaaccauaaaaacccuggaagaaaaccuaggcaauaccauucaggacacaggcaucggcaaagaguugaugacuaacacaccaaaagcaauggcaacaaaagccagaacugacaaaugggaucuaauuaaacuaaagagcuucugcacaccaaaagaaacuaucaucagaguguacaggaauccuacagaaugggagaaaauuuuugcaaucuguccaucauacaaagggcuaauauccagaaucuacaaagaacuuaaacaaauuuacaagaaaaaaacaaaccaccccaucaaaaagugugugaaggauaugaacagacacuucucaaaagaacacauuuauguguccaacaaauauaugaaaaaaaagcucaugauuacuggucauuagagaaaugcaaaucaaaaccacaaggagauaccaucucaugccaguuagaauggugaucauuaaaaagccaggaaacaacaaaugcuggagaggauguggagaaauaggaacacguuuacucuguugguggguguauaaauuaguucaaccacuguggaagacaguguggugauucaucaaggaucuagaaccagaaauaccauuugacccacaaucccauuacugggcauauacccaaaggauuuauaaaucauucuacuguuaagacacaugcacagguauguuuauugcagcacuguucacaauagcaaagacuuguaaccaacccaaaugcccaucaaugauagacuggauaaacaaaauguggcacauacacaccauggaauacuauguagccauuaaaaggaugaguucauguccuuugcagggacaugcaugaagcuggaaaccaucauugccagcaaaguaacacaagaaaagaaaaccaaacaccagauguucucacucauaagugggaggugaacaaugagaacacguggacacagggaggagaacgucacacaccagggccuuucaggggguggggggcuaggggaggcacagcauuaggagaaauaccuaauguagaugauggguugaugggugcagcaagccaccauggcacguguauacuuaugugacaaaccugcauguucugcacauguaucccagaacuuuaaguauaaaaaaaaaauaaaucccucuaauccucuaauauaugaaaacgagucuucggcuauuuuuguuuguuauacauaugaggauagauuuuuaaggugcucaaaaaaaagcuguguaaaugguuuacuuguugauuuuucaaguuaugggaagagagaauaaggggucaaacagauaggaaaaguaugugaggaagaaguguuuuugguauacuaaagugcucucgcuaaagaaaaauaagaaauaccucacuacuauacuccuaccuaauguaaugcccauaguagucaugaguuaaagccaauuauugugguccugcuaauuuuuaaaauuuacuagaaaccgaacaaugauugccacuguagugcagugagagauauuuaaagcaaugguucucaaauuuuagugcaugucagaaucaucaggagggcuuguuaaaacacugaacgcuaggucccaaaccagaauuuuuuaauaaaaaacucuggggauaaggcccaggaauuugcauuucuaacaaguuucuagaugaugcugcagaucaaggaacauaguuuuaagaccauuguucuagaggugggaccuucuuccaccgagucauggccuuuucuuuucucccuauauauuuuauggagguuauaaauuauuguuacaauggauaaacauuagagauaacuuaaauaucuaucaguaggugaaucguugcaugaaauauguugcaccaaaacuaugcaaugcugugcagccaccaaaaagaguaauaucuguacauauugaauggaaagaauauaagauacuaaaaaaaaguaacagggaaaaugugauacauccauacaauguaauaugauccagcuauuuuaaaagaugaaguacuaauacaugcuaucauauggaugaacuuugaaaacauuaugcuaauugaaagaggcuaaucaccaaaguccguguuuuaugugauuucauguuuuaugugauuccauuuguaugaaauguccagaauaaagaaaucuauauagacguaaaguagacuauugguugcuuacagcuagggaaauuggggggauaugagagugaaagcuaaagguacaggauuucuuuuugcagugauaaaaauauucuaaaguugacucuggauaucauugcauauaucugugaauauacuaaaaccauugauuugugcacuuuaaauggguaaauuguaugguauucaaauuguaucucaauaaagcuauuaaaaauguaacaaggcaauauguauuguauaauccuuuuuaucaguagaaaaauuauacaauauguauacacaugaaugugaaugcauagcaaaugguauggaaacacuagggaagcugaggaauaaugucaucuuuugcucuguaaaauccuauaauguuuaauuuuuauuuacaauggaaauauuuuucugcauaaccucuguaauaaaaaaauauauaacagcugacaaaacaaguguaacugggucucagagcccuuagcucugccaugccuuagcucauugguccaggcugagaaagaacagugaugugaaaguaaccugaaauuuuguguuacuugaagauaauuuuucuucaacugauuuuuuauguuguuacaauauuuccugugguaccauagagauaccacucuauguugcuauuaaaacccuucuaugcucuauuuaaaagucuauuaaaaauuauguuuucacaaauugagauuuuuaaggccaagcacuaacagggaacauuuuuguaucaaucuuaggugugguguugucaagagaacaagcuagagaaguguuuaauguguaaauguuaucauuguuuuaaaauuagcaauaacacauacuccggcuucaaaaggcauugaaaguagcugucaggggaacugauccauggggagaaacuguuguaauaagccucacucugcaggauuacccacugccaaauuguagugagaaggacauggguuucagccaaaacuagaauucuaaucgugccccuuauuagcuaguuaugugacuuugggaaugucauuuauacucucuggcccagcuuuuuuuauuuguaaucuggguaagagauuugaggauuaagugucacaauuuauggaaauaaggugcauaauaaauauucauuuauuuuccuuccacuugagguaaauggagaaggucucacagggaauagagcugaucagaaguuauggguauaccacagggaacuccugagccccugcgucauuaauggaccaggcucuggcuaugggaugugguuccucucagacuagggucuuuccucuuucucuuuaagucucaccuagacagagcagaacagugaggguaggagucauggugucucccacuggauaagauugggcagauggaugaggccacuuauuuucugccaggacuauugaagaaaacagaaaauaguuaaugaauuaaaugauuauguauuaauaugugauuauauaauaaaaaaagaaguuauggguauaccgaauaagguguccaucugguuggcuugagcaggcgguuggcuugagcaggucuagcagguuacucaucuccauuaaauggcuucagcaaacuaggcugucaaagaaaauuccuagaaagucauuugauaccuaacaggcuuggauuccuagaaucuugaacaaguuccaggauaauccaugacugaguuggcagggcaaaugacuuuuacucaaguaagaaagauuaacuaagguuagcuuaaguagugauugguaaaaucaaggauuauuucauuucccucacuccuuggcuacuacuacaucugugguuauuucucauggaaaccuucuauucuuucacuucucccuauuauuccagguugucagcaucuuucucuuacuguccuaucauaugguaauucacugaaugauaacuuuccuagcaccuucaguuuuuaaaauaauagcuuuauugagauaugauucacauaccauauaauucacccauuuauugugcaaaucaauggcuuuuaguauauucacaggauugugcaacugucaccacaaucaauuguagaacauuauaaucaccucaaaaagaagcccauauuuguuagcagucacuccccaguugcccccaacucuuuucucaauauggcaacugauugguuuggcucugugucccuaccuaaaucucgugucaaauuguaaucuccaguguuggaggaggggcuuggugggaggcaauuggaucaugaggguggauuucccuuuugcuguucucgugauagugagugaguucucaagagaucuaguuguuugaaaguguguagcaccucccccuucacucucuuccuccuguucucaccaugucagauacgccuguuucaccuuccgccaugguuguacguuuucugaggcuuccacagccaugcuuccuguauagccuguggaaugaugagccaauuaaacuucuuuucuuuguaaaugaccaguuccagguauuucuuuauagcagugugagaauggauuaauacagcaaccauuuaucuuuucucuguuucuguagaucugucuauucugagcauuucauauaaauggaaucauacaauauguggucuuuugugacuaguuucuauuacuuaccauaauguuuucaauguucaucuauauuguggcauauaacaugcuuccuuccuuucuguguucaaauaauauuccauuguguagauauuuuguuuauguauccauucauugauaagcauuuuuuucauacauuuuggcuuuuaugaauaaaagcuaugaauauucauguguaaauguccgugaggacauguuuucauuucuuuuugguauauaccuuagaguggaauuacuggauccuaugguaauucugucuaauuuuuugaagaacugccaguguuuuccaaaguaucugcaccauuuuauauucacacuggcagugcaugaggguuuuaauuucuccacauucuuaacagcauuuauuaacugucuuuuuaaaauuauuauagccaucccuguagaugugaaguaguuuugauuugcauuucucugauugcuaaucauguugaauaucuuuuuuuuuuaugcuuauggccauuuguaugugauucuggaagaaaaaaaaucuuauucuuguucugugccaagucaccaggaaagaagaaaacaaaccaaaacaaaagaaaaagaaauccuuuacccauuuuucaguuggguuguuuaucuuuuuauuacucaguaguaaggguucauacacacauauauauuauauuacauauauguguauauauauauuuuacauauauauguauucuagauacagaucccuuaucugauacaugauuuauaagcauuuucuccaagcaccuucagcuuuauggucccuucuuguucugcuaauugcuuugccauucuccaauucuuuauccauucagccauauaaucuuugcuucuguauuaucuuggcaaaguuaguaggagagagggucaaggaaaaugccuagaaggguuuggauuuuucacuauucccuaaacauauauuguguguucauaugccagugcauuuguacacauuaccucucccuggaaugcccuuacuucacuuuuccugucugauaaaccucaauuuauuuauaaugaccuuucuuucuuuuuaaaaauuauuuauuuuuaguuuagauucagggggaugugugcaaauuuguuacauggguauacugugugaugcugagguuugggcuucuaaugauuccauugcccaaguagugaacauaguacccaauagguaguuuuucagcccuucucccauuucucccuuccuccuuuuagaaucccaguguuuauuauuuccauuuuuguguccauguguacccaauguuuagcuccuacuuauaagugagaacauauagauauuuuaguuucuguuucugccuuaauuugcuugggauaauggcccccagcaguauccauguugcugcagaggacaugauuucauuguuuuuuauggcuguauaguauuccaugguguauaugauccaucuuaaauggaugguaccucuucuguuaaacuuuucuugacccaagcagaguuaguagcuucuucuauucauacauuuuaucuguuauaaauaucaccuaucagugagcuccucaaggucuaggaucuaaguuguuguuucuguaugccuaugaucaguacaugaugcugcuuaauaaauguccaccuuuuguauuauuaacauacuaguuaucauuaaaagagaugcuacuuugcuauaaagaagcuuuuuaguuugauguacucucauuugucuauuugcuuuuguugcuucugcuuuugaggaccuauuaaaaaaauccuugcccagccuaauuucaugaacauuuauccuguauuuucuucuaguaguuucaaaguuuuggauuuuacuuuuaaguauuuaaccuauuuauaguugguuuuuguguguggugagagacuaauuucauucuuccauauguggauauccaguuuuccuggcaccauuuauugaauagacuguccuuuccucauguguguucuuggcaccuuuauuaaaaaaaucacuuggcuguaaauacauggauuuauuucuggguucucuguucugucccauuggccugugggucuguuuuuaugccagaaucaggauguuuuguuuacuauagcuuuguaggauauuuugaaaccagacaguguaaugacaucaauuuuuuuauuuuugcucaugauugcuuuggcucuucaggcucuuuugcauuuccaaaugaagagacaaccuacagaaugggagaaaguacuugcaaacuaugcaucugauaagaaguuaauauccaaaauguauaaggaacucaacagcaaaaaaaaaaauaaauuauccaauuaaaaaugagcaaaagaccugaauagacauuucauuucucaaaauaagacauacaaauggccaacagauauauggaaaauuacacaacaacacuaauuaucagagaaauacaaaucagaaccacaaugcaaaaucaucucaucucaguuagaaugguuauuauaaaaaaggcaaaauauaacaaauucuggugaugauguggagaaaagggaacucuuaaauacuguugguggaaauguaaauuaguacagcaaugauaaaaaauaguauggaaguucccaaaaaacuaauaauggaacuaccauaugauccagcaaucccauuacuggguauauauccaaaggaaaucagcauguuggagagacauuggcacauucauguuuauugcaguaguguucacaauagcuaagacguggaauuaaacuaaaugcuugucuacaaaugaauggauaaagaaaaaaauuuuauaucuacaucuauauauaaaugugauacagauagauagauacaauggaauaccauuaaggaauaaaguagaaugaaauccuguaauuuguggcaguauggaugaaccuggaagacauuauguuaagugaaauaaaucaggcaaugaaagagaaauacugcauguucucacucauauuuggaaucuaaaaacguuaaucucauagaaguaggguaaaauagugguuaccagagacuggggaggguaggggagaggagaggacugggaaagauuggucaaugaguacaaagcuacaguuaggaagaauaaauuuugguuuucuguuacacaguagggugacuauaguaaauaacaauguaauauauauuucaagaaagcuacaagagaagauuuugaauguuauugccacaaagccacaaagaaaugauaaauauugcagaugauggauauaauaauuacccugauuuguucauuauacuauguauacaugcauugaaacaucacauuguaccccauaaauauguacaauuauuaugugucaauuauaauuaaaaauuaaauuuuaauaagaaauaauacauauaaagagcuuagcccugggauagagaaagugcucagugucuuuuuaaugcuauuauugauguuguuugugaaauaaauuaauuuggauggcagcuuauaaaucacuuucauauauacuuuccucauugauacuugaaaaaaaugcuaugagguacaaaaggcaagaauuguuaucuccauuuuauagauaaggacgcugaagcucagggagauuaggaggcuugcccaaguucacauagccaguaagugauaaauacugagacagauuugaugaugguguaguuuuguauuuuuauuucuacuagucuugcucuaaauugucuuaccuuuuaaaauacaaugucuauaaauauuguguucauuaacuauaaauguaaaaacauguauuagcaaaggcuaaaagauaguuuggaaugaaugauauaauaaauauuuuauucuugauagaaacagcagaauuacacagaaugucuucuugcuggcuugccuuucuuccguucaccuacugaaaagagaaaaaaaaaaucagggagaaaaauguuaacugccaguugaaaacaucccuuucauccuuaagaccuggaggccauaacgaggguaucaugcuucagcugguggcaguguauauuaauuacagaauacuuagguauauggaaacaaaucauuuccugauuacuggcgauacucaaaccuauaaagguggaaaaugccucguuacucuggcuaugugggccucuaguugauauuuucucauuuuaagauuggugccuauuggacugcucuuuuuguguuuuccucacuuauagcuauuuacuuucucucuucauuuuuaguucuaaagucaauguaggauaucauuuuauagucuuauccucuagcuaauagaauguuaaagaaauggguuauuguaagagccuauacagauuaacacguguugccuuucccuggguuaauuucucugaauguuuauccugagguaaaugcuuggguugcugauaaugucauguugaugaaguauauccuuuuuucucaacauuaugaucauaaaauaaacaacuuuaaaaauauaauguuaguacguuguuaacauaagaaacaggcauaaugauuaagauaauuuacauuuuauaaaauaagaguucaaauagucuagauucuugugguuuuuaugaaaaugauacuuuuaauuucuuuucauuuccugaauggcagcuagaauauagggaaaugaguccauaguuuuucuugggcauagcucuuggggcacucagguugggguacaauaaguuauucuuauucuucgaauugacugugcaucuuuaggauaaaaguuggaagacugucugccgcuuucccuuuuuaggccacuucaguguguucuuguccugcucucucaauugaguauuuuugguuauuugcuagugucgaagugauagagagggcuaucacauaccaacuugaaagucaacuaugcuggaauacauaauuugaauuucugauuguugcuaguauacaguaauacaguuuguuauuaauuauugaucuggcauugugcaaccuugguaaacugacuuaucaguucuagcagcuuuuuugguagauucuauagguuuuccuauauaggcaaucauuuugccuauaaauaagccugccugccugccugccugccuuccugccuuccugccuuccugccugccugccugccugccugccugccuuccuuccuuccuuccuuccuuccuuccuuccuuccuuccuuccuuccucccuuccuuccuuccuuccuuccuucuuccuuuucauccuuucuugcccucccuuucuuuucuuuccccuuucuuccuuucuuuuucuuuccucuuuucuuuuuucuuuccagucugaugccuuuuuuuuccuuaccuuauugcacuggauaaaaccucuagaaaaauggugaaagcaaucagucuuucaccauuaaguaugauguuaucuguagguuugaggaaguucucucguauucuuagcuugcuaaaaauuuauuuuaauuuucuaauuuuuuuuugagacaaggucucauucugucacccagacuggagugcaguugcaugauuuuggcucacugcaaccuccucccaggcacaagcaauccuccuaccucaggcuccagaguagcugggacuauaugugugugccaccacacucgacuaauuuaauuuaaguuuuuuuuuuuuuuuuuuuuuuuuuuguagagacgaugucucacuauauugcccaggcuagucucaaacagcugggcucaagcaauccuccugccucaaccucccaaagugcugggauuacaggcaugagccaccacaucuggcgaguuuacuuuuuuaaaaaaacaggaauggauguuggauuuugacaaaugccuuuuuuuucuguagucauuaagaaaugaucuuagcauuuuucuuuuucagucuguuaguauggugauuuauauugauuaacuuuugauugugaaagcaaccuugcauuggaguuauaaacucuucacuuggucaugauguauuuauuauucuuauauaucaguaaauuuggcuuguuaaaauuuuguugaaaauuuuuacaucuuugugcccgauggauuuugaucuuggcuuucugugauugucuugucugguuuuaguauuagaauaaugcuggccauguagaauaacuugggauauaugcucuccuccuaauauucuggauuuguuugugggguauugguguucuuucuuccuuaaauguuugauagauuucaccagugaaaccauuucaucuuagaguuuuccuuggggaaacaauuuuaaauuaaaauuuaauuuuauaguagacauguagcuauuuaguuuaucuguuucuucuaaaacuuuaguagcuugugucuuucacagaauuuguccauuuaaacugaguugucaaauuuauuggcaugaaguuguucauauuuccuuauuauccuuuuaauacuuauagaaucucuaguuuaugccacuucuauucauccuggcauugguaauuuguauauucucucuuuuucucaccuaauccgucuuguuagaguuuugucagauuuauggaucuucucagaggaacagcuuuuggucuuauugcuuuuucuguuuuucuguuuucuauuucauugauuuccacuaugaucuuuauuauugcaauucuccugccuaauuugggauaaauuugcucuucuauuucuaguuuuuuaagaaggaaacaucuuucauaggagguguuucuucuuuuuuaauauagucauugacugauauaaauuuccccuaaguagagcuucaucugcacuccacaauuuuugauguuauauuuucauuuaguucaaaaugcuuacgaguuuuucuuuugauuucuuuauggguuauuuagaaguauguuuuaguuucaaaacauuuggggauuuuccagagauuuuucuauuuuugauuucuaauauaauuaagcuggggccagagaacauauuaauaauuuguaugacuugaauccuuuuaaauuuuuuaagacuaguuuuauggcccagaauaugaucuaucuuguaaauguuucacauauaccugaaaauaauuugcauccuacuguucuucggugaaguauucuguaaaugccaauuaggucaaguugguugauaguguuguuucaguauccuugcuaauuucuguauauuuacugguuuuugucaccuuuaaaaucaauuauugagagaaugguauugaaaucuccaauuauaauuguaaauuuguuuauuucuauuuguaguucucucaguuugcuucauguauuuugaaacucugcuauuaaacacacagacaucuaaggaauuuauguucucuugguaaacugaccuuuauuaugaaguuaccugauuaauuuuugguacuaugcucugagaucuauuuuguuugguauuguagucaugcuagguuuauuuuaauuaguguuugcuuuguauaucuuuuaccauccuuuuacuuuuauuuuuguaaauuaacauacaguaaaagucaauuuuuuauuaguacauacuuuuaugaguuucaacauauauauuguuucauuuaaucuccagaauuaugacacagaaccauuccaugaccucagcauacucccuccuguuaccccuugguaguuauacccaccaccaucccuaaacccuggaagcuacugaucuguuuucugucgcuuuauuuuugucuuuuuggaaauguuacauaaaugacauuauaugaucuguaagcuuuuggggcugguuucuuuuacuuaguauaauauuuuaagauucauucauuuuguugucuaugucaauaguuuguuccuuuuuacuguugagcaguauuccaugguauggaacuuugugaggucucuucuucauucuccuccaccuggaccaucuuccgaauucuuuccaguugcuagggcucuauuuuggcccuuuggccugaaagcugggaccuuauuuucccugcucugccacacaguuaucauggcugcacccacaucuuggcccaaagacaaagagagaggaacugaauugaauauucaccacagaaagacaaucacugcuucucugaccaaggagaaagguuccucuuuuacaggguuuuaggcaucugccacccccacugucaccauugucacuccucuugcuaccaaugccuugaaauugccuugggauccaggccaggccgggaggggcggggcggggcgaggcgaggcguccucuccaagcucucugagcuuugagaaucuucuucucuuuaagaaagaaguggccgggcgcgguagcucaggccuguaaucccagcacuuugggaggcagaggcgggcggaucauggucaggagaucaagaccauccuggcuaacauggugaaaccccgucuuuacuaaaacuacaaauuagccgggcguggcggcaugcgccuauagucccagcuacucgggaggcugaggcaggagaagggcgugaaccugggaggcggagguugcagugagccgagauugcgccacugcacuccagccugggcgacagagcgagacuccaucucaaaaaaaaaaaaaaaaaaaaaaaaaaaaaaaaaaaaaagaaguagggggcuucuccuggagcuuuuucugucuguugacaggugacuguuuccagcuuacgugaugcccuaaguccaggucgggguagacugggaaauauaagauaggggguggggugagguggggacucaccaucagcuuggugagaguuugcauucugauuuucuuucuuaauucaucugcucucauuaauaugugguuuucauuuacuuuuaagcuuugugaaauugcaccaggccagcauuuauucuagagcaaacuuucccccaguacugaggcagaauccuuuugacgauggugacaguggggguggcagaugcuuaaaaccccagccuuguaagguuuccacucaugguuugaauagaaacgacuuccagcccuuugugaaccuuggagaguauuccuugugcucuuuuuuggcgguucuuucugcagacaaagauguuuaucauuacucgcuggaauccuugagggugacuguuuuucgagcucuggaauccucucugugugcugaucucucuucuuauauucuguccuaucugccuugauguccccagacucucagcucuaggagaauacuagguuuugccuggguucccacucccugcaccucugucugaaauccauaggcaguaaauuuagacagucauagggcucacccaauuuguuucuuaucuuucacagaucccuuuccuucaauguuuuuaaacuuuuuuuccauauauuuuuguuugauuuuaaagaguuucaggacguaauguaaaucgaaucucucuuacuggaaacauaaauuuauaggauauaauugaauaaguaauggugaaauccaaacuaaaaaugccuaauuauuuuagagaugauugugugagagauagcuuuacaaaggagguggaauuugggcagguguggugacucacaccuguaaucccagcauuuugggaggcugagacagguggcgguuggggggcauccuugaggccagccuggguaacaugaugaaaccccuucucuacaaaacaacaacaacaaaggaggucuaauuuaagcuagucuuugaaggaggaaggauauuccaggugaaaaaaaauuuuuaucaccaaugugaucguuuggagaacaaccugauaagacgggucagaguauauagggaacuaauaaaaaauaagguugggaucagaucaaagaagucucugcaaaccagaaguugugcuauauugcagugauggaaagucuuuacguuuuuaaagucuaagcaguguuauauaauaaugagcacagaguuuaaaauuaauauaaacauuuauguccagccuauauauuuguuuuaacuuaagugcaucuguuccuuuuucuguccuuugaauaaaaugaagagcagccucauaaaaacauggcugguauuguuuuuaucuaauacauuacauuuacauaacacuggaguaaggccauuucuuaacuuucuuuaguuccuuaaucuuuguucauagaacauauuuuccauuauaauuuuaacuacucuuuucaggauguguuucguuuuuucucuacuuaaaaugacaaugaucaaaacuagauauaauaugcuaguaaguuuguucuaauguagaauuuaguugaauuauuuguuuaucaaauuccuuuuaaauaccugacaguaucaauguagcuuuuuuucacaauagcauuauauuucacuugaaagcuauugacauccaaguaauuuuuauacaaauuauucauagcuugucugguuuccauguuauaauccuguaauaucaagucauauucuauucuguuuuaauaugaucauuuuaaaauuuaucaaacucauuagauguuucagacuuucuuuguuuccugguauuagauauguaccucucucuauuuaauagagguugaaguuuugauacauuggguaaguuuaauacagugaagagaaaaaacauguuuaaaaacauuaaacauuaaacauuaaaacauuaaacauuaaaaauagcauuaaaaugcuauuuuccagcaucaaaauagcauuaaaugacgcuauuuuuccaggauauggagaagaaaauaaaggaagauauggggagauuuauagaagaagaaagggaaauauuaaagaaauugaggacagacaaaccccucuuaaaucaaacccaaggcacagagacagaaaaguagagaacuaagauaaguguugagauagagagacuggaaagaugaugaguuuaaaucaacagaagcaguuuuaaggacauucugaaaaacuaauuagaaacugaacaauuugccuaaagcagagcugcauagguauaugguauacuagcauauggaaacagacaaaaauguucauguaaaucuuucaagaagagugaguacaaguuuggugaaagaaaaugauuuuacaguaaaaggacuuauuucgagugugcaggaaucuuugaaaggcuucuuaaauaggggaaaagauuuaugagugaaagcaaaaaguagauauauagaaggcagaugagaauuuuggaagauaaugaaccucucucuuuuucuuuuaauguaugcauacuucacuagaagauuagagaauaaaagguguuuagagaaaugacugccuucuuguacacaacaauguguauagucagaaggagcuucucuuuagacagaacugggauaucuggaaaauaauauacaaacaagauguuuagaauuuguuugaaaacaaucugaauugacagauaucauuuggauaaagauagacauaacguagaauaaaauucacuaauauggaauuggauaguggggucauucauuuaugcauauaaaaauaaagguuaugaaauguuuagaaagggacacuguauguugugaaaauaaauguaaaaccuuacaaaagcagauaacuugccaaagguagauacauuaagcguggaauaaaagacacuccgaauuuguuaaaaaugcucuaggugccuuaacuucuuuucuuuugggacaccagauuauacugagaaagguuaaaggauuuuuuaaaaaugauaguguaaagggacacaaaaugauaaaaucugugaaaagaauaaaagcucccggugucuuagcugagcaaagcuguccagaucuugagcauugauuacauaccuccacaagcaguuugaauggaauauggacaaaacaagaaauuacacagcugacgauacaugaugcacaagcuacuccucuuuucagagggaaaaaaaaguaauauguaguaggaauggaacauacugacauuauucaauuccaauuguaaaauauuugcaggaauauuuuaaaggcaggaggcuagcaaauaagccaagaagguuuuguuuguuuguuuguuuuuguucuuuaguggaagaaaauaauggaucagauacaaucauugcuuuugaauaaauaauccagaauuucuuuauaaagauauugucuacguaugcuuuagagaagaagaauaaaaaacuauuugauaaauaaacauaaagggggcauacaguaccuagacucaucucauuaguaucuugacaucucuuuuuuaugccaaugcccaagguauguuacuuuucccaagaaaaaucaaauccuuuaacuugccauuagcuauucaaaacuuuaaaaauaaauauccuucgaaccaacaacuccaguccugagaauaucucccacagauauacuuagacagcuaaguguauguacaaggaaguuaauugcggcauugcuuauaacugcagaauuugagggaaaaccugaguguucaacuaagcgggaauggauaaauaacuuaugacaugccccuacuguagauuacugugcaugcacuaaaagaaugaaauaaauccugugcacugagauagaagacuaucuguguuaucugcucaagugaauuuuaaaaugcacaacaguauguauaguaacccacuuuaaagaggccuuuauauauuuuaauacaagcauaauguagauuaugauauauagagaaugaggucuugaaguaugcuuacuaaacuguuaacagugguuacuucuaguaagugaaagagguagccuuuaaguuuuuaacuuauauccuucuguauuuugacuucaaaaaacauacaagcacauauuuaauuuuuuaaaccugaaauuuauaugagggauaaaacaaacacaaguuugggagccaacguuuucuccccaacuccugguucacuaccuuuucucuuaccuuaaccuuuaccacuaccacaaacuaccacaaacgaacacaaacgaacacuuuaagcacaacucauuuuauuauugggagagguuucacaaauaaguuccugguuuccaguuaacuuguugcaaaguuuacauccuacccaaugugacuacauggcuuuaaaguuaccagugguagcuucugaguaaaauuuuguuuguuuguucaugcguuaauggaacauauauuaaguaccaacaguaugccaaacacuggggaauucaaagaugcuagucucucaacuguuucagcugaugcuugacuauccucucccacacccuaguguccucauucacugcuucccaauacucuacauuugaaaggugauucccacaaauuuauugcaauuuagaccccauauaucaaugccgagaucgcgccacugcacuccagccugggcgacagagcgagacucugucucaaaaaaacaaaacaaaaaaagagcugaagugacucuucucaugccuucagcaugagaauauucccuuaaaauuggcaucucuuuuuauaagaugagcuauuauuauuuuacuucuacuuuucuaaauaacagagacagcagacgaauuaguaauggaaaauaaaaauaguggcauaggauauauaauguuuggguuuacaaagaaaaaggggcauuugugaaagauuugauauuuguuaacauaaacaugucaaucauuguuggaaaaagaaaaauaugauauauaaucuuguuuuaaaguguauguauaauguauaaauauuuuuggaauaaaaauauucaucucuuucccuagagggagaguggcuggaucagaucaucucuuugaaguuccaguucuguaauucaagcauuuucuuuaaaaagcuuuaaaauuaaaaugagaagcuuaacuaggguuuauacuacacauauguguaggaucaauauuuuuaaaacugcauucuuaauauguuaugccuuuugcucuuuaaaucugugaaacaaaacauaguuuuauuugaagucauuaaaauaugaaggggacagaguaaucaaugcuguugguucuuacuguauuauauuauuagaaagcaauuuguguauuuuguguaucugucuuccugguuuuuuauaaugaaacauuucuaucuuugaaacuacagacucaaucuugccaaaauguucauuuuuuguaucauuguuaaauugcauauuguucccuuuugguguacuuuaguagccuguuacaaucuuuuuaaauucguuauucuuaaucgacaaauaaacauuauauauaauuugucauguaaaacaugauauuuuaaucacaucaugguaaaugggguauccauccccuaaagcauacaucucuguacccacaaaaauuaaaaauaaaagauaaaaauugaaaaacaugauguuuugaaauauguguauguuguagauucaaccuguuauaaucuuaaaagugauugucauucuuccaacuuauaucaauagaacaacugucuauuugucguuaguugagaccaucaggguguagugaaaaagcuaaucaacaaggauucuucucaccagagcucugucacuccucugaauuguggcugcuagccuguuaauucuccacuaaaccuuuaggcauuuggagacaauuaagucucauguugggguuuccugggcuuuuuuuuguuuuuuuucaaacaaagauaauuaagucucaaacuugaaacuugaaagauauuuggccaggcagcagcaauguacugaguauaggcuucucaaagagaugaaguaauacaauuaguagaaagaacuaucguguacuuaauacaguugcucucuacuuuucuuucucaaccucccccaaaacaaaacaaaaccaagaugcuucagucaagcacuauaaaaggacuauuaaauuaucgcgaaaaggaauguuaagacagucuaauacucucauucugcagaugggaaaguagaagugcacauuguaauuauuuuucaaaauaagguaaaagcugauaauuguguaaauaagcaaaaguauauacuuuuuccuuaaucguuuuuaaccuaaauuagucuuaauuuuguguuauuccuacagugaaagaaaacaugcauugucacauaucaggaaaguugugcaguuauuuuuucuucucccgaauauucuguuggcuuuauguuccacauauguugcaccacauuaauauucaaacaauuuuagcacacgaagauuuguaaccucauuuuaccuugauuagugacucaacucauguucuuguuguagggcuuugaccagcuucgacuugaaggauugcuuugugaugugacccugaugccaggugacacagaugaugcuuucccugugcauagagucaugauggcaucugcuagugauuacuucaaggcuauguucacagguaguuugccuuuuaaaacucugaaaccacauuaaaacaauaugaaaaauccguguuuaaaucuuuuuuauuucuaacaugaaauuugguucuuuuggaaacagcuucaaaagaaguacacaacaguauguaugguuuucgguggugcuguuuuaacauggaaaauugaugcacuuuuuucauacuguccaucuuuaucucacagcuuuucuuuuucaagcuuauaucuagugggccaucagagacucuguguccuccuaguacaaucucuacucuaugucaaaaaauaggaagugagaacauuuuggaagcacuugcaucauauaugaccuccauuaguauagagauuaucuuuuuuaaguacuuucuuuuaacaguaaaaugugcagcagacugacucuaauaugacugcuuauauaagauaagacuuuccuuugauuuuauugcaucuaauuagcagcagaagugaguuugaccauaauuauccaccuucauuuaauugaaugucuuuuuauuuaagguggaaugaaagaacaagauuuaaugugcauuaaacuucauggugugagcaaagucggucuaaggaaaauuauugauuucauuuauacugcaaagcuuucucuuaauauggacaaccuucaagacacgcuggaagcugccaguuuccuacagauucugccaguuuuggacuucuguaaaguguuucucauaucugggguaagauauuuugaaaucugauuuuuccugugguagacucugauguagccuguuuaggacucaugaaaucugcugugcaggaaugugaaacuugccauuagacagaugugucuuguuguauguggucuguaagcaaggugagauugaaacaggugcauuuuuaugaaauagaaucauuuaauaaaagccucuguguuggccgggcaucguggcucacgccuguaaucccagcacuuugggaggccgaggcgggcagaucgucuaagguugggaguucaagaccagccugaccaacauggagaaagcccgucucuacuaaaaauacaaaaauuagcugugcaugguggugcaugccuguaauuccagcuacuugggaggcugaggcaggagaaucgcuugaaccugggagguggagguuguggcgaacugagaucacgccauugcacuccagccugggcaacaagagugagacuccaucucaggaagaaaaaaaaagccucuguguaaucaaaugacaugagauacuaauaauguuugaugaagauauauacuuuaacuguuugauaaugguauguaccauaaucugguuuuauucaccuuaaugacuauacaagcaggcuucuuaaauguaauugaauggaaaaguaaucugagcuucuagaacucuuuaaaauuucuucuuuuaauaagggagcuagaucuuaagaagaacuaauaccuaugggcaaaccuguaagaauguaagucuugauuccauagaaacauaucaccuacugaauaguguuuagccauuuuuuaauagauaagauaggacacauacaacuaccaaucgauggaguacuuaaugauagucacccaguuccugaagagaguguuuuauuuuaguugagaccuuuaaauuuuacuucuggggagauaaauggcuacauuggacagaaauauugccaagacuuccagaggucuuggagcuuguuuuucugauuaagaauucuggcaauauuaauuuuugguauauuuucuaacucauuauguugauggauauguuuucuauaauuuuuuaacucauaugaaucuuaauauagguaaauaauugcuguuagaucuuuacaacuuacauuuuuugaacauggaaccuucuuuaaaacacuaaguuucaagagagccauguccuuaauuauuuuauuauuaagguacuuaacuaucuuaaaagucagccaauaacuaauuuaacuggccuauugaaaguguguuuuuuguauguuugauuuuagaaaacucagacugcugucucacaauuacuuauaaaauuugaacuaauugcuacuuuuaaggguuuuuauggcagcauggugcuauauuguugacuuguauugucuucuuuauugcgaaaguagcccaagugaaguugguuaauucccaugcuauugcuugccuccauuacugaauuuaggugcuaaauuuuauuuaaauuugaucaugcaaggcccauucccucaagagcuauuaggaucucaccucugguugugucacuggcaugauauaacaacuucauuucaaggaaaaaugaaucauauugaaugugauuuucaaaaugccucaaguccagaauuuaauuuaguaguaacacuuaaagcuuguacuuauagacucuuaacauugcuuuacacugaucuuagcaacacauggucauccugagccaaauuaaggaaagugccaugauuucuuuggaacuaaucauuaacaagagacauuguuggccuauccucuaaugcagaaguuuaguacuuagaacuucagguauugauugugaucaauuccuuuaccugaaagaaaaugaccaaacuggauaauacacaauacaaaaaaguuauaguaauauuacugucacaauaauagaaaagaauuuuguucuagauaacuguauuuaaagcaauuuuauuuaaagaugagaccauagucacuuuguauugcuaauuuccaguaauuagacuguugguuccuuaaccuguguugaaacauuuauuauaauuguuuaacaauuuagaaaugucuucauuuuuauaaacacuuaauauugccuuaaauaucauguucauuuuuuuuuuuugcauccuuugcagacauccuaaaaccuauuucuaauggagaagaggcuucucuguagcaaagauuacuugugauagaguuuacuccuaccucucaguuuuagaauuuucuugccuaugaacuuuuaggaauuaccucuuuucuuugcauuauucuaccuuacuuguccuucauccuuuuuugcagaggauaugucuguaugguuuuagaguagaaaucucuucccucucagaauccauuguaauuuuugagaaaaucuggcagaugauuaguuccaggaacaugcaaaacccaaguuuuccuuuacccuucuuucaugcauucuguuuuuuuaguuaaaccuauguucagucuugcucuauuuauuuccccuuuccuucucagcaaucaagugaaaaaggaaaaauaguagcccaguguauuuucuacuuauaaaaacugaacaucucaagauacuauauuuuuuaaaggaggauuuuuugaaguucuuccaugagcuaaguuauuauagauaaauuuuaauauaauguucucauguuuaagaacggugugcugaaauaagauguuuuagaggaaauaggcuuuauguuuuuaaugauauagugauauuauaguucacauaaucaaaacacuauuuggguuugaacuuuuagacagaaaaauucccuucuaauacaauucuguucuauccuauucucaaucauuuguguggaggaagaagaacagugguacguaaagugugaaucaguaacagugguauguaaaaugcgaaucaguaaagaaccuagaaaacauguauguauuaguuuuaaaugauaacucuagauacauuaguaaagccacacucaccuuuggugggauagagauaccaguuuucuauaacagagcaucaguguuaauggaacaagagccaaccucccuucuaacuuugccaucauuugcaguguuacuuagugguuuauaggauguggcauuuuuguuuuugcuauguuauuuucuuggaguuauggaaaagaggacaaugaaaugaauacagaaggaugacaaugaaggauagauaugaagcaugguagguaaaaauuucuguaaaacuaaaaccacuuuuauauacuaugaagauaauggaaaauugccuuuguuuagucauaccuaaaaauuacauugguuuuguccuuaugacauuguauaacuacaacauguuaaauacugugcccauuagcuaguguuuuuuuuuuuguuuguuuguuuuguuuuuugaggcggagugucgcuguuguugcccaggcuggagugcaauggcaggaucuuggcucaucgcaaccuccgccucccagguucaagcgauuauccugccucagccucccgaguagcugggauuacaggcaugcaccacugugccuggcuaauuuuguauuuuuaguagagacgagcuuucuccauguuggucaggcuggucucaaacuccugaccucaggugauccacccgccucagccucccaaagcacugggauuacaggcgugagccaccgcgcccagccccauuugcuaguuuauaagaaaguuguguaaguuuuguuuauccuuuguuugcaauuugaaauuuuuagcaucuagcauuugccccacggaacuuuuguuauggaggauuuuaggcuaguucacaaaacaaccuaauuuaauguuagguugcugaaauagggcaucuguaauugaacucaaaagauuacaauuuaaauauacaaauauauagaaugaacaaaacagaauaaaggugagaaagaaaucacuuuauguuuguauaaaagcauuuuuuaacaagagaaugagauaugucauugggcuuuagacuuggggauaaucuuucuuaaaauaauuuuuuaauuguguuuuccccccuugaugcagguagauuacugguuucaccugcacauuuguuaucagugaugggguggagagcuuacaaugaaguagagagaaaguuuauugaggugacuggaggugaugaagaguuggagacaaaauaaaggagguacauaagugggaaggagacaagagagaggaauagggagaauauguuucucucaaaagaaaaacaaaaagaaucagaagucauuggagaagacaguuccuuuugcuuugccucuguuacuaaauuacugaggauuuccugcauaguacauauauuucacauuuuucauuuaaucuaaauuguauuuacccguaaagauuaacagacauguuuuuuaagauuuuuuuuucacuuuugagggcaauuuaaugcaaguuagagacaaauuguauagauaauuaaaauuaaaaaugaaucaaaauuauuucccuccccaccaaaccagucuugacuuccuuauugacagggcugauauugggcaaauaguacauagaaggccauccccguugcuuauggucggccauccauucugauugguugauacccaucuuuugugguuuuuaaauauucuaaauaucccuccuauaaccuugagcacccauucuugccuaucugcuaucugggacucugucugggaagaagaggccuagccugggcucaaaccucuucaaccucacaaaagccauuguaauaacuaacauugcauucaauaaaggaacugcauucaaagugcaaauaaauagagaauugaauauuuugggcuggagacaccaguggcauucaccucaaauagcauuuagaaacugaagaaagacaaagacugaaagagagagagguguuuauuauucaauuaucccuuuguucuuaccaaagugucucuucuuuguguccugugauggucucaucuguggaaggaggcuugagaaaagauaccuguacauucucugccugcugaaguaccuuguuggauuucuuccuagucuuauucuguggacaugguuucauucucugcauugauuguacuagauaucaggcugucauuuuaauaaacuagauagcaccaaguagaauuuggcgcauugaauggcuaaggaguuccccaaauuuuugccagauuucuuagucuuugcauuucccuugagaguacaaaagcagauacuggcugguccgagugcagugguguuuacaacuaauugaucacaaccaguuacagauuucuuuguuccuucuucacuuugacugcuucacucggcuagccagaaaaaaaaaaaaaaaagcagauacccauuuuuuucuaaaugggaauuucuuuguauaaaacaccaaucuuuuaaaaaaaguccuagauuucagaugaaaucuuccauuaaaauagcaaauuauguuaaugacaguguuuuggguacaucaguuauaauuugaauaguacagcagcagugaggaccaguauguuauugagaauaccacuugcaauauuaugauguuggaagugccuuuaggaugacuaugacuguuguuugguuauaaaagaauaauuuauaauaauuuauaucaaagaaauguaaaugagcaguugauuauuuuaagaacaauuuuauagguucccacaggugcuugaagaguuuuauccuuuuuuguuguucuuuuuuuuuuuuuucuuuuuuuugauggagucuugcucugucaccaggcuggagugcaguggugcggucuuggcucacagcaaccuccgccucccggguucaagugauucuccugccucagccucccagguagcugggaauacaggcgugugccaccacguccggcuaauuuuuguauuuuuaguagagauggguuucaccaugugggccaagauggucucgaucuccugaccucaugauccacccaccaaggccucucaaagugcugggauuacaggcgugagccaccgcccccggccuuguuguucuuuuuaaaugccaauguaguuauuuggauuaacuucuguuauaacucuguuuuuaagugaaccuucuuuggaauuguggccagguuuucagaugaaauaaaagaugaacucagaugaaauuucuacuuagaaauuuuuaaaauaagcuuuaaacuucauauuuuauauuuucaauguguauucuauuauauauguaaauugcauuauaaguccaauuauccauuuauggauauccaauuauccauuuauccuuuuauguauccaguggauaaacaaacacauguauccauuuaaaaauacugucuaggcuuaauguuuggagauuucuagcugagucacuuuuaagaaucaugauggagaaguggauuaaaaugaaccauaauagaauauuauguauuucucugggccauuguuuacuauaauuccaucaguuuuggucuauuuauauuguuaauuauuacuguagacuuugcuucuuuaauuucuauauucuaugauuaauuuuuaagcuuugauuacauauacuugcuaagaauuaauuuccuauuacauauuuuucuugucugugucucauuuugaaauuaauaagguuuuaguaauuugcuacauuaauucaacagguauccuauuuuuaauugcaucuaucaucguaucuuuacuuuuuauauuuuugauacuuguaguauuuagccuuuguuguauacucacaguauaguagcuguuguauaugagcuauagaaaauacuuagucuuggguaccccauaaauauauauaccaacuaugugccuacaaaaauuaaaaacugaaagaaauaaaaaaagaaaauacuuaguucuucugucaagaagauaacaguucggaagguuauggaauaccuuucucuggugauuuuaaagaaaaaaguaggcagcuauuuguauugguuagauggucugucaaagucuuuucuagucuugugugucuguauauaugaacguauugauauacagaagguauuuuccaaaugccuguaaauaaaauuuaaguuucuuucucauguuauucuagcaaucguuuucucacuggauaaauuugaagagggaaaaggugaaggaauuaaauaccuugaucccauuucugaauuauacaguuuggcuuuuaaucuuuaaucuugcucuguuuuacaugcuauaaauuuagauuucaguuuggugacuggcaacugguaguaucauuuugucuucuuaaaguacccauucuuuguuguuuuuuaguaaucauaucaauaaugaugagaauuugcauacuugggaauuauauuuguguugucaucaacuuuugcuuaacuguacuaauaaacaucuucaaaaguauaaaucaccuucacucuggggacgagauaauucuuacuugucuugggaagugaauucaugaccucaaauuccuuccacucagggugaauugggaaaacagguauugacuguaacuccauuuacaaaacuuaaauuuuugaaccaccgaccugcagcuccucaaauuggauuaaauggacuuuuuauuaaccacguuagaaauccaggguauuuauacaguguuaugcugucuauuucuagagacucauaauuuguuaacuuauuuuucuauuuuuuuauguuacaguuauguguuagguauuuuaaaaauauguagcuacuaaguaaaauaagcaauuaaacauuuuuguaaagcaaaucagcuacuuaaaagagcacaaauucuuuuugaguaauaaaucaaugauagacuggauaaagaaaauguggcacauguacaccauggaauacuaugcagccauaaaaaaggaugaguucauauccuuuguagggacaugaaugaagcuggaaaccaucauucucagcaaacuaacacaggaacagaaaaccaaacaccacauguucucacucauaagugggaguugaacaaugagaacucaugggcacagggaggggaacaucacacaccagagccuguuggaggcugggaggcuagaggagggauagcauuaggagaaauaccuaauguagaugacggguugauaggugcagcaaaccaccaugguacguguaauaccuauguaacaaaccugcacguucugcauguauaucccauaaguuaaagucuaauuaaaauaaucuaugaaaauaacaauguguguguguuaaccuuagagauuucagugauauuauauccuaacugggcugucauuuuaugcggaggaguaauguuuuuagcuuuguuucaguuuuuaaagaaaugucaacaggaggauuauuuuauuuucucuuaaccaucugccaaaucuguuaacuauacaggugugagguuaacaauacauugauaaaguuugugugauauugaggacacauaaccugacaaaauuuuaaaaacaaccaaacauuuaagucuuuugccugugaucugugucuguuuguauacauacacacuggcauuuuuuauuguaggcuuguuuuugugguuuguucuuuguauuauauuugcuaauauuauuuuuccuauuuuuccuuugaugagucaguuauuagagcauugaaaagagguucuacugaggaaaggccucucugucacuucucuucuuugucagcuuuucacuuuaugguauauuuugcucuaugguggggagaugguucugggcucauguugacgccagagagaaacagaaugugcugaaaguaagaguggcuaaggaaagcuguguugcccagauggaagcagucaucacagauaccaaaaucucauuuacaugagagauuuguuguagauauaccccucugcccuuaagaaagacauuuccuugcuuauauuuccagauaaauaauguugaaaauuaauuugcccuagggauaauuaucuuauuaaauuauuuucauuaugagugauaacuuugaaggaaccaaaaugaaugauaguaaugagugaugccuauuuacgugaaagggaaaucuaggguuuggguauuagagcuuuucuguucauggaucugcuagcugugugguauuuuuaagaauaaugacuaagaaguggauugagaugaaucauaauagaacaaccuucuauuuucccaaguuuccaucuggcaggaauuuuaucaguauuuugggggugggggugggauacauuuuugaggagagaagaguaacugguuuggccauauuccaguuauaacauuguuucuuagaguagcuucuaacuuacugacuuugaucauuuucuuuuagucagccuucuaguggauuaaguaaaggugguuugcaaauuaucuguuuguagaucauugauacauuuagauaagaauccuauuuguaucuauuugaacauuaaaagcauaauuuacucuuauucuagaacagguauuugugcuaucaagaugugauugccaugaaaguagucauguuuuaauuuuuuuuaauuggcuuaauaggucacuuuagacaacuguguugaaguuggacggauugccaacaccuacaaucuaaccgaaguggauaaauacguuaacaguuucgucuugaagaauuuuccugcauugcugagcacaggggaguucuugaaacucccuuuugagcgucuugccuucgugcuuuccaguaauagccuuaagcacuguacugaacuugagcucuuuaaggcuaccugucguuggcuucgccuggaagagccucggauggacuuugcugcaaaauuaaugaagaacauacgauuuccacugaugacaccacaggagcucauuaauuacgugcaaacgguggauuucaugagaacugacaauacuugugugaauuugcuuuuggaagccagcaauuaccaaaugaugccauauaugcagccaguuaugcagucagacaggacugccauuaggucugacaccacucacuugguuacacuaggaggagugcugaggcagcagcugguugucaguaaggaauugcgcauguaugaugaaaaggcccaugaguggaaaucguuagcccccauggaugccccaagguaccagcauggcaucgccgucauuggaaauuuucucuaugugguuggcggacagaguaauuaugauacaaaaggaaaaacggcaguugauacagucuucagauuugauccucgauacaauaaauggaugcaaguugcaucuuuaaaugaaaagcgcaccuucuuccaccuaagugcccucaaaggauaucuguaugcaguuggugggcgaaaugcagcaggugaacugcguaagugcauuuauauuaagcauagagacaaauuucuucacucagaaauucuuaucaaaucauaaaauaagcaguccuguaaaaucagauaaaaauguaguuaggguuuuauuuuaaaacuauuuuucugagaaaauauugaagaccaucuuuaugccuuaucugggcauauaucguuggcaagggaacaaauuguacguuacaaauacaucaguauauuguagcauauuucaccugugcaguauauauggucuucaucuugaagguucaucuaaagaguauacuuagcucauuuaaauuauaauaaggucuuggauagaaguuuggcauguuuucucauuuucugcuuuuaaaaggccauaugauauuuuacugaacagguuacaauccuucauuacagaaaacuuucauuguuucuucuuuuacaaaauauguuaccuauuaguggccacaaagauaauuuucuuuauagauuaaauguacaaaguucaacauuauccaaaguuuguucacugugaauauuaugaucuaugacuguuuuaaaaauaauucuguugacguaauaucagauaguuuucuuuuccauaagcccaucugguaagcuuuauuugauggucaccuuuuugucuucccaguauaaaauuggucauaaauguacuuugauguagaauacuuuggcuauguaaauuaacccaaaaagguaaaauuuuauuauuucagauaaaauugggauaguauaauuuuuccaaaaauaaaggcaggaaguccacauuuuauguugugacauauauuugucauuaccauuauuguuuggccuuguuuucaauuauuuuauucucuauuauaaauagagucugucacagggaggggaacaucacacaccagggccugucugggguuggggggcuaggggagggauagcauuaggagaaauaccuaauguaggugacagguugaugggugcagcaaaccaccauggcacguguauacuuauguaacaaaacagcacguucugcacauguaccccagaacuuaaaguauaauaauauaaauaaauaaguaaauaaauaaaaaauacaaaaaagacagaaagacagaaaggaagaaagaaagaaagaaagccagauguggcucaugccuguaguccuagcuguuagggaggcugaagcaggauugcuugaacacaauaaauaaauaaauaaauaaauaaauaaauaaauaaauaaauaaauaauguccuuguaguugaccaauuccaggcuccauagagcugggaaaguucaaaauauuggcauuggcucuggauaaguucagaguaauucucagaaucuuuauuuuucaauauucuaagaaauaaaagauaguuuaauguauuugagacuaagcuauuuaucagagaauagaauaacuguucucagcuuuuauacuuuccuguuuauaaaacccuuucuuguuagugacauggucuuuuuccugaucuuuucuacccaaaguuuuuuuuucuuuguuguuacaaugauauuuuuuucuaagaccagauuuucuagauuguuggacuaugucgcaugaucaugaacugcauagguuuuccaauauauuuuaauaauuggacuuuuaaaagcaguuaaggcauaaguguccuuaguguacaauuguucuuuaggccuccucagucaaccuacacacauuauuuucauguuauuauacuauuuuaaauuugcgguaucuggaaauaucuagaaggugcaaguagugacuugguuguuucuuagaaaaucccuguauaagauaauguuuucuuaaauauuuucuucacaaauaacaggucauuaacuuggucagucuucuuuucucaaaggaaguagcuccguuuuucaaagucaguccuugcuuguugauauuaucaccccuguuaauaugcggcuacuuagcuuucaauauauaguuccuaauacuaauuaaaagccauauucuucugggaguuuuuaaucuucaggccaaggagagucauuacauaaaaccaagaugcuagaggcuucuuucuuugaaccuaucccaacucucuuucagcugcuccuaugguauacccaucuaggaacuagaaauagaccacacuguugggcaaguggcucauacacaggaauccuugcuccugaccuucagaaaccaccccuccaucucugauuaaaaacagucuucuguguuucauuuugaaagggaaaagaaacaaggaaaucaugcuuuucuuaggguauuccuaaauucauauuuaggcuuuaacaauaaaauuucuaaagcuuaaccuaaggauaaugacuuaaaaaaauuuccccucuaaugguaaauauagguccauuuuaaucuuauuucauaaacugcauuuaaaaaaaggcacaugucauuauaauacaggcacaaaccaucuauuccaagaauucuaauucuaguuaucauccaauuauuugauauuuuauuccauuugaaaugaucuauagauuacaaaucuauaaugaccucauagauuuguaaccuauaaguagcuaaacuuuuguagaaaaugauugcgucccuuaaaaucagcauacccaucaaacgcauucuguacuaaacauuuuauuauauaauauauuggaaguuuaaaaaauauuuugugauugacuuaguaagugcauucaaauuuagagucuugauuucaggagaaaaaaggccaaaaagagucauuagauaaagccaagaagcaagagguuucauuuguuucugauccacuccacccccuuugaguucuuucuauguuauacucaaauagaagcaagaaguagauugucuugucacgucacauccuguauuacggagguaaccaaacuugaugaaaccugccuugauuacuauugcucccaaagaauaauauuaaugaaauuuccugaauucuauccaugaucguguuucucuuuauauaaauaaaaaaugaauuuguguuaguuggcauuuccaguuuucuuggacccauuguuuuugcagaauagcagauuuugauucuaaagaaacucuugccuauauuucugaauguuccugccagaaacugagguuuuaacauuuccccuacccuacaagcgcuuuuuaaaaauagaauuccuccuucaacgcacacauuaacaucuguuauaauaaauuaacauucccauuguaacugauuaaguugagacauucauaugccuauguaaauagaaggaggugaugggaauggguggcaggaagaggggauugaugggaaagucauuuaacaauuuaauagguugauuaguaccaguauaucacuucauacacacaguaacuauugccuguauauaauuauaaaaagaaaaauuugauggguacaaaaauaguuagaaugaauuaauaaggccuaguauuugauagcacagcagggugacuauagucaauaauaauuuaauuguauguuuuacaauaaguaugaguauauauaauuggauuauucguaacacagaggauaaaugccugaaaggauggauacuccaucuucuaugaugugauuauuauacauugcauaccugcaucaaaacaucucauguaccccauaaaaauauacacguacuauguacccacaaaaauuaaaaauuaaaaaaaaaacaguggcaacauuugcaagacaguuuagaucacuuuaaugcauuaggccuuuuaaaaucuuuccaugggguacuuggaccaaaggaaaccuaagcccauuguucaucaaaaaaagacugugugugugugugugugugugugugugugcacgcacuagcacacgugcucaccugguuuagugcugaaauauaauuccuucaaaaugcugcuuuccuuugacacugguuacaaugggaaacuaggggaggcuuagaguagcugucacuuaaguguaaaaggagucaguuauuucuggcaucuuucaaaauugugucauauaagaaaucaaucuucuauugaggcuuccuauauugaagaagauuaugacagcuccaauaucuuucacuucaguuaaauauuaauaaguuaagguuucaaauaaugaaauaacuuauagaaaacauguuagauguuuuucaaauacaugcacaauaaaacuacuaaaauuuauuaaaugccucuauaccccccaaaggauuuggggguuucuugaucacucaccagcguucuauguuucuagaguccaucuccccuguaugacagccaucacuguuuaaaugauuuucuuuaggcugaucucuuuccuaaucuuaaagaacaaauaaauuccacauccucuucugggaccgauucuggauuccuauggaauuaucucagaaaauaagaacuccugauauaugugagauaaccaaccuaaguauaauucuuaaauuggagagauucuuuaauguaaacacuaggccaccaaacuacugaaguuaauucucuagauuaggggccagcaaacuuuuguaaagggccagaaagagucuauuuccagcuuugugggccauuaaaucucugucacaaguaaucaacucugcuguuguaguguaaaagcaacccuacauaauccauaaacaaaugagugaggcugugcuccaauaaagcuuuauuugugaacaugaaauuugaauuuuauagaauuuucauaaguuacaaaauagucuugauucuuuuucaauguguaaaaaauguaaaaucauucauauuuuuaucuuuugggcccuacaaaacaggaaguagacuggauuuggccuauggacugagguuugcugccaccugcucuagauuuuuccaguugccucuuuaccauuuccaacucuuauagacuacgauugaagcacugcuuuguggcuccaacucuuugccuugcaucaucccuuacucccucuucccaucagaguuguugguacuaaccuauaucugagugucguguaaauauggaaaauggaaauaagagcauguguaucuacuuuuuaauuagauguauuuuauuuuaaaauaaaauacuauugauuuuacugauaacaauagcaacucugcauggagaauugcaugacaauaaaaguugacaauaaaaauuaaaugccuggaacagcuaaaggagaugcauuuuuagcuggaaaaaagcuuaagaaugauggacuauuauauaguaauuuuguuauuggugguuaauagcuaucuugaacugagggccuccugugugagaaaguacaaauggauucuuauaaccacuauuaggggaaaaugcaauuaagucacugacagaggaauuaucuuucuacauaggaaaauauuaauaauaauaaaaagugaauaaguauucaaauucuaacuccacuauaaaaagaauaagaagaaacuaauggaaaucacauuggaacaguuugaauuaaacauaagaaaggacaguuacaauccaaaaauuucaaaguuuaagucagagucccgcauuaagaaaaguguaaaacuauagugaauccugucuuuggcuucaagcagaugaagaugauaucuggaagucuuuuuagaccccguuucugauaggaugugugguuuaauuacuucuaaaagcuucccauuaauggcuuugcuaaugccaaguaccaaucaaugcacuagguuuucucuuauguggcgagagagagagaaggagagagagagagagagaauaauaauguaggauuuugcuuguccguuagguaaaagucaugccaaaggcaaauagaaaugaacauuugaaaaggcauccagugacuggaaauaguaaaaaaaaacaacaguacuggggcauguggcaguuuaacuuguuauuaauuuuagaaauaggguuuaaaagaaauagaauuggcaaggauccaggccuaaagcaaugaacaaagccaacaaagcaguagguaaaaaugagaauaguaaaagccuuugaaauaagacugaaaauucaaagcuaaaguaaguggaaaaggaagucaguagagagauacaagaaguggcaugauauaggugugcuuggaggagaaaagcauacuuugcguagugaauuugaugaugaaaugaaauuauugaauagagcggaaaaguagucucucucucucucucucucucucucgcucuccucucucucucucucuguguguguguguguguguguguuuugccugucaccauguuauuuuuuuuuaaguagagaaucucauucaaagguugauucaucaggauugcauuugguugcaaguagcuaaaccuaauuccaguggcuugaucaaauuguccuacucaauaaacuucugcuuacccgucgcugcccagaacuauaucauaugguggaccaaagcuucaagggaaccugcuaaauuaaauuucguuuuuagcuugguguagugcuucccuaagcaguguugugguucuguuaguuuaaaaaaguaggguugggggacgcaagaaauuggauuagcaguuggcagugucugcaauaaauaauaugaacuuuucaagucaaucuagaccucaugcuuuugaugaguucucuuaacagcuucucugccuuuuaaaaagugauuacauuuuccaucuuucuuggugacauuguucuguucuugagguuauaacagacugauugaaagauacuuaagugaguugaggucacuucuccaaaauacauuauguuaaaagaugauaaauacauuacugacaggaaguauucuuaauaaagaucuucauauuaugccgccaaccaucuucagguuaagaguaguacuggcugcaaugaugguggguauauacgaacuauuagcuuuaaaguauaaauguagagaaauuauuaucaguguccauuuuguagucuguauaugaauuaaagcagugggcuucagaacauaaaccaagaaguguguauauuuucauucucaauguaaaaguuugcuucuuauguauuaacguuuguuucuaucaacauggggacccagaauugaggaguuuuucauuucuuuugauuuuuuucauccuuucuuccuauguuuuuagagcaaagaaaauggagaaaugucaaauuauaaauauguaagcagauuacagaauaaaucuuagugauuucugcaaugacagaaauuuguuagauucuuacacuaucuagucuaauguaacauguacuaaugguuuauauuauuaauauagucucaauaauuacuguaagagcucccccaaagucuuacacauaucuaucauagcuauaauagauauguuucaaguguuuggauauuauuacuguuccacuuaagagaaaaauaauuaauugcuaaauuugaaguuaaaaauaauuuucuuuucuuuuuuuuuuuaacagccacaguagaauguuacaauccaagaacaaaugaauggaccuauguugccaaaaugagugagccccacuauggccaugcuggaacuguguauggaggagugauguauauuucagguaaacaaguaucaugugaacacaauauaauauauaagcuuuuaacuauaugguuaucuuuccauauagugguaguaauaauaauaauaauucaggcgucaggaguuugagaccaggcgggccaacauggugaaauccugucucuauuaaaaauacaaaaauuaacugggugugguggugcacgucuguaaucccagcuacuugggaggcugaggcaggagaaucucuugaacccagaagacggagguugcagugagccgagauugcgccacuguacuccagccugugugaaagagcgagacuccaucucaaaaaaaaaaaaaauccagaaaaacggagaaucaaaauauaauuuauguugauuuuagaaacuauuuuuguguguauuugcauaugaaugucuugggcauucuguaaauuuauaagaguacuaguaaaccaauccuguuguaagguauaacuuagaaaaaauuggaaagcauucaaauuuugcuuuccaguccccaugcucuguauucugauaaacaccauucauaguuucuguagcaacaauuaauucauuuuauuuaagauuuagcuaaacuaugugaaggaguguaucauuauauaacauauaaguucuccuaugcauaaaacgugcuuccaauaugcauaauaguacauaauaauguucauucucucuuucaguauaguccauaauauggguuuccuucuuccuuagcauuauagggggauucuacuauggugucauugcauaaauauuucugugcugauuaucuguauuuuaugcacaugaagauauauuuuucuguuaaaaaauucugaaauggcuauaguuuguucacagugucccaguagcaacuuucauucucaaauuguugguguuuaaaucaaucuacuguagaauuucuuucuuuuuuuaaugcauuuucugcuuucauucuccuguagaauuuaggaagaagucucacuuuaauguaaugaccaccucugguauugacauuuaacuuuguuagucagguuauuaucauuuggcccugacacacucugccugggacaauucuuccccauaugaaggccugccagugccaggccagcaguuacauuacuagagaccaaggguguaaaggcacuauuugugaccugauugaccacugccuuaugaaauuuuuaaucaauaagaaucaaugaaaggccuauaguauaugauuggcagguuucugguguuaaauucaugagcaacuacagaaugucuuauauuggaagagccauccagguaauaaauaugcucccauuaaucaaugauuuacaccaucuaucuauuuuaugugggcagcugcuguaccauuauaaugagagcuccaacuccucugagaaaaaugacaccugaauuguuuuagugguguuuuggcauaacuggcguauauugcagaaaugaccuucccaaucaagagugguuagaaacuauagcugauuuucaaaacaaugaacacuguuuugcuuucugggaauucuguaaagcacaaggaaaauauuuuuaaaaagcagaaggaaacagugauagugauuggcaucuggccauuugacaguaaagguuugaaugauuugacuaaagauuagcuuacuucuuucccuugucuacagaagguaucguuuaauacuuucauuguagagacugguuuauaugugaucuaagaguacacuuuguagaugauacagacuaaauuagauuaacaacaaauuggugcauguauaaaauuccacguauauucagcauucuaauucuuuagauuuuuaaauaugcauucugauaagagaugacauuauccacccucacucugcccacagaaaacucuauaaacauaaacaauucugaauauucuuauaagcuuuuacacaugugcaagacuuucaacuuuuucaaagcauuuugauaaauaucucacuucagagucacaauccugaugcaauaacuagaguagauauuguuuugugacaagugaggaaaugggaaccuggaauuuaaugugcucuagcccagugcucaguacccagaggguacccacuaaaaggcaguaaguagugaaugaugcuuuguaguuggaauuuacuacagacccaacucuaucagugaucaaaauauauuuuccuucagcaaagccuuuuaaauaccagggaucuacauuugagaaagucauugcaauaauguaagugauugcaaaaaaaguaauuguuuuguucuuuaagaagaugaaaaugcuauuuucuuuacuuuuaauccagagaauguauuuauagagggaagacaguccuaagaacaguauugauaagguauaugucauaauaugugacuaaaaguuaucugugacagagcuccuuuaauuacuuuugcauuucuauaauuauuuacuucaaaacuauuguuuucauucuuuaggaggaauuacucaugauacuuuccaaaaggagcucaugugcuuugacccugauacugacaaauggauccagaaggcgccaaugaccacugucagaggucugcauugcauguguacagugggagaaaggcucuaugucauugguggcaaucacuucagaggaacaagugauuaugaugauguccuaagcugugaauacuauucaccuauccuugaccaguggaccccaauugcugccauguuaagagggcagagugauguuggggucgcugucuucgaaaauaaaaucuaugugguugggggguauucuuggaauaaucguuguaugguagagauagugcagaaauaugauccagauaaagaugaauggcauaagguuuuugaucugccagaaucccuugguggcauucgugcuugcacacucacaguuuuuccaccagaagaaaccacaccaucaccuucuagagaguccccucuuucugcaccuuaagaucaucucuacaacuaagaugcuguaguucuaucuuugcaaugugucauaaauucucuucuuuuucccccuuaaguaguauauauguuaggauuacccucugguaauugauacagauauuggaaaaaagacaacauugauguuauuugugcucuuuguuuggccuagaauguuuauaaagugguaacacaaccauucuggaaauguaucccauagaagcugauguuuaacauaugaaaaaaaaaguauugucuauaaaauguuucuucaguacuuuuuaaaugcuguguauuggguguaagguauuugucaucuuacauuaguaaacccaauaagccaaguugaagguggauuauaguaaauguacaacugugcucacuaggcuucaaguaaaaaguuuuccuuucaucuuugacuguaagaugucaaagggaggcagccugcuugaacaggaaacaauacacaaaagguugccaacucgcaugagcuaccucccucuuuucauaaaguauuuuugacauaucugucaacccacuugacugugugggugcauugagaacacaaaguuuccuagacacacaggagaaguagcuuaaauucacuaauauuaauuuaaaaagcagcaugaacccucuacuuauaaacaaggguuugguguuuuuaaaguguguauacauacauacacauacacacaugcacauaugucaaauauaauuuuuuuaaaaauugaguggcacaucaaagaaaugugaaauuaaaaagaauucuuccaaaaagcagcuuccauuaaaaugggaauucaguaugcacauacugaaugcauauauguagaaccauacagaauuuagguggauaagggcuagaaauuuugagcaacaaaauuugucacuugaccagauuuuaucuucaaaaacuguauucuacuccuucuccuuugcuguugagguaacuugcauauuauauguauucuguauacucaguucauaagguuauuuagcacaaaguauagcagcuucaccuggagagcugcuuuugcucaguaaauucaacuuccauguuuuaucuuuuuuuguucaauaaaaacauuuaaugucauuuuggucugagaca

SEQ ID NO: 18949 - RNA, 48362 nt, Homo sapiens
cguggcggcacgucacgugguaccguuuuauauaacacuuugcugagacaagacaguuauuaggcggcgcggggcggccggcauggagcucccggaggcgcggcagggucaggagcucgguggcauggcggcgguggcugccccgauuuccuccagcugccacuccuugcuucguguccccggucccuagacgccucgucuccucccgugucccucuucccauggagucaguacggaucgaacagaugcugagcuugcccgcugaggucagcagcgacaacuuggagucggcggagcgaggggcaucagcggcccaaguagacaugggcccccacccaaagguggcugcagagggccccgcaccucuaccgacgcgggagccagagcaagagcagucuccggggaccucaacgccggagagcaaaguccugcucacgcaggcagacgccuuggcgucccgggggcgaauccgugaagcccucgagguguauagacagcucuccgagcggcagcagcugguggcugagcagcuggagcagcuggugcgcugccuggcggagaaagucccgcaaggcgaggcgcuggcgccggcgcccccggacgaggguagcacugcaagcggcaccguggcggcggaagagacgggggccgccgcggcugcggcggccaccgaggugugggacggcuuuaagugccggaaaugucauggguuucuaucagaccccguguccuugucguguggccacaccuuuuguaaacugugccuggaacgugggcgggccgccgaccggcgcugugcgcugugcggggucaagcucuccgccuugaugguggccacugggcgggcgcguggagcccggcgggcugggcagcagccgccgccgccgcugcgagucaacguggugcucagcggccuccucggcaaguuguuuccaggcccagcgcgagcgucgcaacuccggcacgagggcaaccgacuguaccgcgagcgccagguggaggcggcacugcucaaguacaacgaggcaguuaaguugggugaguccaacgcgcugccgggccggggcuggggcucgguggcuacaugagggagcgggagaacaaaccccgcagcgagaagggauuuggaccagggcagaagagggggcgggggacccauggacuguggcggggugggggaggggugauucuggggcugggucucugaguuuguucuguuuucacugcuuaucuguguuucacuguguuuguguugaucucgguugcuuuuugucuuuuccugcuacuucuguuagcuuuuguguuccugucucucaguccccguuccugucugugucuccuugcuucugguucuuuuucuccgucucuucguaucuuugucacuguuucuuucuuuuucggugucacugucucuguuccucugacucuccuucucccgcugcacuccuggucuccucuuacaccugcucgcaccuucccagcgaggagaggaacuucgcgcgcuccucgcacuugcgcccgguccucugggcuguagccagcaggagauguccggucggcgccugcguccgccgcucgcgccgccggguguugccccuuccggggccgcggcucccugugggguggguccggcauggaauuaggucaggagagcacugguugcauaagggccgcgagcggcccgggucgggcgccccucccccgcgcgagcgggcgggauuguguaaccgcugagguaacugaagugggccaccacgcucgcuucggaaaccaucccacgagcaugugcggggggagggggagcgcuugcgccccgcugcccugugacucauugucaccgcuuccuaucacacgauccucggcugaaauagaugcccccccuugcccgccccgccaacccguagccugugcccucgccuccaaccccuuuaaccuggccagcccggcgggaggccggcgcggcaacugcuuggggaucccuggggaccgugggcuggcuacgaaugggucacgccucugucccgcuuuucagugccgccugggaggguugggugggcuuugcagcuucaaggguaacgugggcagucccccaucuccagcuagacuagggcacccgaauuuccccagggagccgcucucugacccaccacgccuggacccaggaaguggcugcugagccgccagccgguguugcccagcucuggcaguuugccaggagcucggccguggggcgcggugucuggcgaagcaugccggggaggaggcagcagggcugggcaggcagggcccugggauccgaggguguccuggaccugacucuguggaguggaggaggggugugggccggagucuccacguguuuaaucuccacucaagcuugcaacagguaauggggggaggaggaggaggaaugaggacugaaggggcaaggcuggcagccggagaaggggacccuucuagcuccugucugugcacaagcaaggcagacugugagcugccaccaggcuggagugugcugcagaagaaaaaagacagaaaagacuaaacaauuugcuaaugucuuaagagcaaguaaugggcacgcaagcaagcccugagcacaccccuggggaaaaaaaaaacaucaaagccuguugccacagaggaagcuagaucccagaucuuggggaagagcagggcaauaugaaugaggcagguggaggucacuuaacucuagaucucuaaggcagauuccauaccuuuuagccaucccccaggggccaggaaagccccuuccugcccucacccuucuccucuguugccaccacauuccccuggaaguucuuccuugcaucuuuguuaauccccucagagaagucagggugaaaaugucaaggccagcuuuacccuucuaagaggaaaggaggcucucuguucuggaagauggccauuguguccguauuauuccaaguacugcacacaccuucagaaaaaggaaccugcuccccacaucccagcuucaaagcuucaaagucugaccaguuaucagugacugcccagcuagccgugugaccuugagaaaaugccuucccuucucugggcuugauuuucccaucugaagaauggguugauugagccagauaaucucuaauagccuguccagcucugacaucuaguaauucagaguuuuuggugagagccggccucaccuuauucccagaaaccuuguccaaguucauuuacauuuggccauuugaaaugagaggaugggaccauguaaauguauuuccauuuucuucaagaaaucuucauaugugcugggcuuuguagacaaagguguuacuaaugucaucagucauucccaccuggaaaaguaacuuggauuugucuucuuggugguucagauaggggucacaucugcccaccucucucuccuuccuaccuggccuguuuucuuguugguaauacugcacucauaaaccaggcugccggacacuagccguguguagccacaucucgccuaugucaaagugucuaaugcaccacugacaccacggggccucuaaugaaccacuugugagcgggggcaaaaaugacuuugcaguuggggaaccucaggcccagaguggcuggggguauagaaggcaggacaauauuaggacuagaaauagagccuaacccuuuugaucuccaguagaaaaguccuagaaaacuuaucauuugcucaagauccauacucauacaggacuuaacaccugcuugcgcugggggccauuaauaaagguuuuucuuucuuauuuugacagcuccaaaugaccacuugcuuuauagcaaucggucucagauuuauuucaccuuggagucucaugagaaugcacugcaugaugcagaaauagcauguaagcuccgcccgauggguuuuaaggugagugugggauggaagaggugggaagggguuguacuguagacagguauuggcaggaagggcugccucccuggagcauaggggcacuagagcucaagcagaacaggaagaagacuuugcaaaggagccaggguaaagaucccugggcaaagagugacucaggucugcaagggagcuggauucuuccccaauucagucuucaacucaugaccuucagagcagccugggcauagugacucucuagaauaugcacuugggagccagacugccuggguuuaugucccaacucugcuaacuuuuaugaccuuuguggcccugggcaaaugacuuaacuucccaguacuucaucuccucaucuguuaaaugggggauauucaaagcagcuacuaaagagggcuguugugaggauuacauaagcuaauaauguaagguacuuagaacagugucuggcauguagcacuauauaaacguucucuuucuucccuuccuuccuuccuuccuuccuuucucucucucucucuuucuguuuucuuucuuuuuuuuuuuuuuuuuuuugagacagaguuucccucucgcacccaggcuggagugcaguggcgcaaucucggcucacugcaaccuccgccuccuggguucacgccauucuccugccucagccuccugaguaguugggacuacaggcgcccgccaccacaccuggcuaauuuuuuguauuuuuuuuuguagagacagguuuucaccguguuagccaggauggucucgaucuccugaccucaugauccgcccgccuuggccucccaaagugcugggauuacaggcgugagccaccgcgcuggcuuuuuuuuuuugagacggagucucacucugccacucacacuggagugcaguggcgugaucucagcucacugcaaccuccgucucccagguucaagugagucucccaccuuagccucccgaguagcugggaucacaggcgugugccaccaugcccggcuaauuuuuuguauuuuuaguagugacgggguuuugccauguuggcuggucucaaacuccuggccucaagcaauccacuugccucagucucccaaaaugcugggauuacaggugugagccaccguguccagccuauauaaauguuuucuaucgccauuuuuaucauuuuccagggacauuagaaagaggaaggugagagugguguugcugcccuggugcuccugaaccucuacugauaggcuccuuggcagcuuggccaguuuucucugaagggauccucacacucacacaaugguugugccauuucaaguccuuaauauagucagucagccugccaguauccccaaggauuuaggucacauggggggugagaagaaaaacggccuggacaccucucaggaugccaggaugcaaagugucacuuucuguaucuuugccuggcuucaggacuggcccucagccacaugucaguacuuuguuuagaagauuagauuugagccugugcucuacuacuugcaaaccauggggagguggcuucacucucugaaccccaaguauccuuguuugcaaaaugaagcuauugauaucugcccugauugccucgcaaugaugcaaugagggucaaaagugaacguggccaagaggacauucugcaagcuauaaagcuuccuggauguagugcucugucucuacacaacccaaggaugccuuccucagaaaaccaauguauccaaguucaaguccaugaucccuuaucugaaucuuguaagaccagagguguucagaauccagaauguuuuauauuuugcaaggaccauauauuaggucucagugagcucuggacagcuuccuguaauccaacacacuauucagcagauuccaugaaaauucacacucagugggacaaauauuuuuaaacacuuuauaucaguuuaggucagguuuugccaucuaaugaauuuugaugucaagcuuaugaaaauaauggauuaucagaacuuuuuuggaucuggaaaccagauaaagcauguggaccuguguacugugcaaugaaugucaggugaaucuuguauguucuuucuugagaagguuuucaugagugaugauggauucauuuuuuuuucugagaagguuuucuugaguaaugauggauuaguaugguuuuuuuuccccaaagaacacauuuaguguuuaauacaagucaccagugucuuaacccaaaggagcuuuagugggggcacuuucagccucccaguagugcaagucagggagcugccuaggaguaagaggacuugcaacucuuuccaccuccacccuaagccuagauccuagggcuaaggaacuugauaguguggugagaagcagagcugagaagcagugaagcauuuuggaugaaaugggaaaagugacuucuccagugaaggaagaguugaugaaaguauuaaauaggaguuucauuuccccauagugaugaagugagaggugggggcagugaugagauaauuuauuuucuuggagguuaagagaagacgaacugaugccuauaauucaaaaccaccucccacccugauuugcauauuucccaacauuucuauguaaaaugccccaaguguagggguuuaucuggcagcccuauucucuauuccagccauccaaccagagugugugguacucagcacauccugcaggugauacagcucucaguggugugagcugguugcccugagcagguagaguauauggguuggccgggcaugguggcuuacuccuguaaucccagcacuuugggaggcugaggcagguggauaacuugagguuaggaguuugagaccagccuggccaacauggugaaaccccaucucuacuaaaaauacaaaacuuagccaggcauggugacgcaugccuguagucccagcuacucaggaggcugaggccggagaaucgcuugaaccuaggagguggagguuguagugagccgagauccaccacugcacuccagccugggugacagagcaagauucuaucucaaaaaaaaaaaaaaaagaguauauggauugcuacuugauaauaugauuagugggaucacacagaggccuuuccagucucccaacacuucuccccucuagcugcccugugauaucaugcaagccuuucccaaacacccuugguaaacacugcugggagaagcaacaagggaggccaucaacauccauguaucagccaagacaaggcuucagaaggagcugggggaaugcggaaaggucuucaagagguuuggagcaggggccacugcucaagaaggcagcuucagggcagccucugcagcgaggccauagccugagggcucuggggccugcaaagaggcauguuagaaaggggggcaggggaguauccagcagccacaaccuggaucacuucauucacuaaguuaggcuuaguacugccaauggaggaggcaagggagcaggccacuggguggagggacguccuagaugacucaagugaaaugcucuucaagccaaguugcuaguguccaccugucucaagacacacacagagggcagcccucucccccgcuacucuuuuuucuuccuucuuccccaggauguuccucugcccucccuagagugucuuucccagagcaguugggcuugggcccugaggagccauaaacuucuuuauacuuucuaaaguauguggugagggagcagaagugauccaggccccuaggagaguaagcucagccccugguuagcccucugaagggcagucugcuuuguggagaagagcauucugggaguccugagacugcaguucuaguuccagcuuugccacuagcgaccuuugaggucuuggagaggucagaucccuucuccugggccucuucugaaaacugaucaguuaguguaggugcucuuucaagccacuacugaggacugguucucugcuugagagacuaguucaaacgaacgcauaccugggcaggcccugaaagcugguuagcauguggucaaauggggguucuugcuacauuugauggucacuccguacaaugguggggcagagacaagguaguauggcagagugguuaagaauacaggcuuugguaucagucagucccagguucaaacccugauuccacaauuuaccagcuguguuacacugggcaaguuaacguuuuuggguuucaguuuugucuucuuuauaauggcauuagaacaguugcccgcauuuuagggcuguagauaagagaguccuuuuaaaauguuucacacaacagugagugcuguggguuaguuauuguuagagcaguaguguuaauaggcugaauaaaaugggauugaaugcuaauguuuccuuccaggcacauuucagaaaagcccaagccuuagccacccuaggcaagguggaggaggcacuaagggaguuucucuacuguguaucccuugauggaaagaacaagagagcaagaugugaagcccaaagagugaguugaaaugacaucagguccagcugccuacuggacccuccccucucugucuuaucuaggaaggggagugagggugcuguccuccuuggcauuugggguccugagugggugguucccuggguuaaggggacaaaagggagaugggaguguuaauugauugcccagaaacaccguccuucugguguguacgaucaguuugggcaguuucuacauuuuuguaggagccugugaggaauguucuugcuucuuugacucagggucuggauugucagugggagaaaaaccaaaaucaaguacauuaauauggggauugaggcucacugaggacauucuggcuguugaugagagauccagggcauggggcuaccugcuguuacauaacuuuucuuuggcugaaucacaguuuucaccagccacacaugacagccagccccugggaagggacguuggugguccccaccuccccuaucaccauacacagaacuccaaccuucagcuccuuugcuagaaauaaaacacacugccucacaaaugcuagucagagaccauuacaauauaaugcaagcagucguuccaacucuugggucccagcagaaugugguaguuauaaaagaaaaauggugugaaauacugagagcauuagugaaggcucagccaucuucaauucauggacuuuguugcuuauuguucuacaguuuacucugcuggugucuggguaaucggccuguaaguuggauucugacaguuggcgguugucucugcucuccuugugccccacccacuauucaccgcggagccuuacgguuucugucccagugugguuuggcagagcaguggauaaagaaagugagcaagagacagaacugguuucugaaggcucuagaaaggaauaguuagcaaaaucaaugaaauaagggaacuggcccuggauuuucugucucacaaaagaucuccuuucugggaaguugcuuugaauugguuugaguaugugaaaaaggugugcuugagaggagcacgguucggggagaauugcuucaagcuguggacccuucuccaaaucuuaaguguaguccaugauguaaugauaauaauaauagcuaacauucguugagaauuucuucugcauuauacacugugcuaggcauuuuauguggaguauauuauuuaaaucccacuacauuccugaggcuagguuugguuaguuauccucagguuacaggugagacagaugaagcuggggcuugcugacuuucccaaggucaugcagcuggugauuggugggaaaguauucaaacccaagucuaucugcuuccaaagccuggccucuuagcugcucugccauccugcuucccaugaggacauggccacagccuuagcacucacuggugaagcuggaucaauaguagcaauggaacuuuccaguuccaggaugaacaaaggcaguuagaagaaacuuaucuuuggggacggagcgugcaaaggccagcagaggcaggucucagacccaaggaggaaugguuucuugacucuuguuuguccauuucccagcuagccugagauguuuuuggugucaucaguugggcugaccugucucuccagucugcuuuuauagagaaacuguugucauuuccacagcugccuaaugguuggaggcaaggcauugugugaagcucuggagacccaaagaggcauaagucacaguuuuagucuucaaggaacuuaacaaucuugcauuuguuaacauaaaugccagaugaugcaagcgaguguaugcccgugaugaguguuacagaguucugaagugagggcgagaauuuagaggcgaauuuccacugggugugaugaggccauggcggcgauucagaacaucaagaguccucaguuguguuuauuuacuagaucauuccaguuucagggcuaaagauuugacagagaugaugcagguucaguugacauuuauaagcugccuucgaacucacaggcuguguuucuuuuuaauguuuguuuuuacugcagauucuuuuucccucuucuugaccuauuugggccuuucuaaggcugaggcugaaguggaauugacuuucauucauguggaaugaucauucucacugagaauugaccccaacuuuuguuuuccaaugccauugagaaggccuagagagagaucucaaguaguaaaaugaagaagggaacugcuguuauuauuucugcuuuguuuccuuugauuucucccuuggccuucuuuuccuucccaccacccucugcccuuucauccuugcaccuugugaugcuguguggcugccacugaagaguauuaugcucuuuuugggagaauuccaaggauacugccuccucagaacuggcuugguccuguugagucacgcauuagggcuucagaggaccaaccuuggcuccuguggaggagggaccucugaaagcuggcauuuauggccccgggugcugugaguaccuccccauuuaacuccugugccaacucauaacuggaaaguggguuucucagagcugaaaggaaacauaaggaucaaucugaggacuuugggccugaaugcuaggccucucccugggcccugggguggauaagugucuuaauucaauuccauccagugugaugagcauuuauuggguaucuguuaugugcccucuagaagcuggccgucuggcaggagagaaaggcuuacaucugugacacauuucuaggauaacauaacgugguguuguucaagaugcuauauuauggugcacucucuacuacuguguagaacaggacuggaauagugagggaagguagcacuugagcugagcuuugaaggcugagugggguuuggcuucauggcaagugcuggcaucugaaggaacaucaugaagagauugcugggggccagagaauaaaucaaacuggaguuugguguucugucaaauuuuguugaucaauuaauacccuaacuauguacccucagcacgggacuggagcuuccuuuaguggaucuccaaacacugcaggagcugcugggugguaagcacuggagcagguuuuagaagcaaagucaccugcucuccuuguguuacauguuucaguauauggaaacacacacacacacacacacacacacacacacacacacacacacacacacaauccuugcuaguacaggggaaacuuggggcaagaauguggacagugaauggugcaagcuacauuagaacgcacgucuacccucccagcuuauccaauugcaagggaaaccagcaagagacuggaaccuccuugcgccuaguacuuaaacuuaaccuaacauccucugggaggcaaaggccagcauaggggaggcgagguugggagaagagggaggaagcuggaguucuguuuuuccuaacaguuaacugcucagguucccagcuuugaagggauuaaagauccaggggugaugguggggagaggaggaagcaaaauggguaguggagaaaagaaacagugaggauccuagaagacauuuguagacuucuacccacugagguauuaugaacuucaaauuccccaagugagguuucucuccugacuuuaccucucugucucuuuccuccuagaugaguuuuaaaaucccacugcagauauuucugcggaguguuagcacuagcaugguggcucuuaaccuuggcuaggcaacagaggcaucuguagugccuucucaaaauccagauuccugggccacacuccagaccugggggagaugggaguacaaaguagagaccuagauuuuucauaaguuccccaguugauucugaugcccgcugaagcgaggaccccugcccuggugugguguguuagggacacugguccaaggcuuccucccuggaguucugcccugcaagcuggcucccuccccccuucacccuccuccccuucaccugggcaccuguagaaacuuaaguagugaagucuucuguuuuaugucacagcuucuccuuaguuucuuuucaccaucagucccgggggauucucaggaacauucucccgauauccugaagcuguuggcaccucacccuagauuaaaggaaaacguagagucaaugacuacugaaguuaccagccauaaucuaccaagguuguuacagguaaaacucaacucacccagcucgcucgugacgcuucguuuggcuguuuugugggcaaacguggggagugagcccucccucuccuauuuugguuccugagaaagaagaaauugagucacuagugguucuguucuuugcaaagaaccucuuaaagaugcaacugugaauuucaggcauggucccagaguuuauucauuacauugaaaaaaaauuaugaaacagggucucuuucuaucacccaggcuggagggcagugauaugaucauggcucacugcagccucagacuccuggucucaagagauccucccaccucagccucccgaguagcugggacuauaggcacgugccaccaugccuggcuaaguuuuuuuuuuuuuuuuuuuuuuuuuuuuguagagacgggguuucaccauuuuugccuaggcuggucucgaacuccuggccucaagugauccucccaccuuggccuuccaaagugcuaggauacauuuuuuuccaguucuugguuagauccagccgagagagauuuuacagagcuagaaaggaauuggcucacugccccugggccauaccauuuggguggguuuauaggcuuuggggaugagucugggaagagggccuaacaaucccuccuuucgagcuuuuguuuguucaagcugcuggccuuugagugccagcacuuauccugugcaaagacaacucugauccucaaauggauguaauuucauauuccugcacuaugccuuauacauaaguaagcuuccaauacguauuuguaacagagaagaggaaagagauguuggaaagaaaguugaguugaaggaccugggaggaagacagguauuuguaccuuucuuugaaaaccaggaaacagaacacaagagagauggguuccaggcccuggcuuucccggcagaggguaaguggucagaaguugaggaucagaagcgcagacuccaaggcagaguuuagcacugaaugccugggcaucuuuagggggcaguuuucccuccauucaugcccgguguucuucuccuguguguaagcccugggcucucauaaaaggacugaaaugcaggugcgcccaacuuuucuuaaaaaauggcagaacuuagaggaucuccugaaaucacagaacccccagugauuucaauaauuaagaucacuauuaaaugauugagaaugcuaauacugaacccaaaugccuggagugacuucuaauugcagcuccaucugaaaagaagaaaaacagcaaccuuggcuuuccaaugucaaccagcuggggaacaaggauuggauuuccacccaaacuuugcuuugcaaagcaguauacuccugaguggccaaugccuuggguucauggaaagucaagguuguaguauugcuguagugcuggagaaaaccccaacucccaaguuagacacagagaaaacccacauuauuuuuguccucaccucauuguuuucucccagcuauaugcuccccuuuuucaccugucugccaguuuuuuuuugguaggguuagagggaaacaacacgaugaguaucuugaccuauggacuauggguuuagauuagagagggguucuccauguaaaucugcauaaacauguuguuauugcacuuauuucuaaauccuuuuucaaauauccaucuccugggaaaauauucuugaaaaggcuagagacauuguugauuuuuuuugccaggugauuuugucuuuuuuuuuuuuuuuaaugcuuuucaccccaaaucuaguaaaaggaauaguuuguaccuuguucauuugaccaguguaacauacagaccuggagcaugagguaacuuggcaggccugugaacagaccugugccaaagcccuaccaaaaguccuuuuggagcuggaguuuggggaucgcagacggccgugaauggcagugagggcgagaggaacuauugagugacaggaucugccgucacugccugccuugguuuugcuaaagugguuacuggggaaggauuuuauaggaaggggaacuggugccuaucccuggcauuuccccuuuuuacaccugcccaaggaggcucuccuccuacauaccuuccuguccuugccuaaggaaguucccuaacuccacccaagcugggaaugccuugguugcagauacugugcagaaaagaaguaggaaauaaugccuuaugacggcccccaaguugagcucuguguccacuaugaguucgggguggggaucaggacucuauaguuucccuuuguuccucuggguaggaauaugagaggacaauauuaguccuaagaagauucugauauguggcccuuucuucauccaggacaaucuggagcucccacauuguucuagucaggaggaagcagcagccaggggagauggcagcagucugauggacccagcuaaagugaagggggauggucagcagcaccacaugaaagaccaggaagaagaggaggagaagugggaugcuaccucuccaaaagcugcuuccagcaagacuggaaaaugccaggaaaagaaaaggaaacauugccagauugaaucccaagaagaaacggggaugccuaauaaagccuccaagcaagguacuggcucuacccagagagaagguagcuuggaggagauccccgggcucaccaauauauacaaguuacuuaccucugucugggggcuccuuaggcucuggguguggggcccagcucuggcauuuacuagcugugugaccucagagauugcuaugaggcuucugugagaucauguacagugccuagcacacuguaaaaaguguucaauacuaauuauuaauauaauggaaagccaaggcaucaggucaagcacaguaucaacuaaugacaucccauacccauggggaugccacuuccuucuaggucagccucuugcuacccccauccccauucuaggaaugcaggaugaggaaagugaggucaggccucacccugcucauucccaguuguguucccauagguaggcaugugagaagcagcagcuguggcuugcuaucuuuccacgagagguuggcagugccaagauucaguuuuagcuuugaaggccuggcucaguccauugaguugcuguagcuucugcuguugacagaggugcauguugcauuugaaugaaguccccagggcuccuggacauuguuugacuugcauuucucuuucuguugggccugcuggaaaccucugagagccuacuucugagugucccauucucaacggcucagguguccacuaaaucaacucucugggaggugguggugagaguggcaaacugaaaaacgcauuggauuauuuugccucagaaguacuaucuaugaaaccgggguggcuccagcgcugacuucuugcuuucuaaaucgcagauccucccacugaucagggggacaaaccugcucucaguuuaccacuugcaucuuucgacgcaucugaccuugaaugcgcucuauguaugagguacguccuguguacuaucauuuacuuccugauguuucuucaucucuggugucuggaccuuucugcuagugaccuacugcuggguugguuagcauguaaaaagcauagcucuaacggaauggaaaucacaacguugauugucacaugggucagcuuguguccccuucccagagacugcauucccugcauuccuggcuccugacuuggaaaaaccuggagagugggaagggaacagucuauucacaggucacaaacugauggcccacugggcugaauaugucugaauaugucuuuuuuuuuuaugucuuuuuuuuggagacagagucuugcucuguugcccaggcuggagugcaguggugcgauuucagcucacugcaaccucugucuccccaguucaagcgauucacgugccucagccucuuaaguagcugggauuacaggccugugccaccacgcuuggcuaaguuuuguauuuuuaguagagacaggguuucacaauguuacccaggcuggucucaaacuccugagcucaagugaucugccugccugggccucccaaaguccugggauuacaggccacugcacccagucugaauaugucuuuuguuuggcccucaugggguuuguuuuucuuaaacgugaaugucuugagacaggacauguacucuccauuugaccacgcccccgccacccaccugccuuauuccaaccugugugucacaauugcauuacauucuuagccccuagagauaauuuaaauuuuggaucccagcacuaaucucaguuacaugggcaagagcucaaaguucaaggacuacugucaccaccacagacuauucuugggaagccaaguggugggccugacuagcuuuuguuuuguguugugccaugaauauuaguggugggccugagauacuuagccaaguaucuccccaccaaacagugccacaucaucucuacuuucucagaucucuggagaggcaaauuauucacaugcucccccaccccaaaagaaagaggcuaugauuaugguguguguaaccauacacaauuuuuuaaaauugcuuacaugucuuugauuucacagcugugacuuacuggcuuagaggagaggcucccugcucugucauuuacuggcuguugaccuggauggagcaagugacauucucugcuacuguuuucuugucaguaaaauagagaacaguguaccuacuccauaggguugucaugauuaauugagaaaaaucuguuuaacaccuggaauagugccuggcauauaauagauacucaguaaauguuaacuauuuuuuuuuccuuguagaccagagguccagaaggaaacuuugggucuauggaccucugaggauguucuauauauggauucuaauagauguauuaaugucucgaaguuguauguuaaaguauguggguuuuccaggacaagguccacauccuuuagcagauucacaaaugugucuguuuuccaaaagagcauuaaaaggaggcugagauauuugcacaaaaauuaagacgguuggcaggcugcuguucguugugcuggcggguccugcggggagggcuguggagcuccagauggacuaaagaacaaaccagcaaucccgagagggcccacagucccucugaaggaagcggguugcuucugcaggacccaggagacaccccaaauacucugggaggcaaauagccucggucgaguucucaagucccucucacucuccuccuggaaacagacuuggagcuguuggggagggcacgguggaagugagacuggcccuucaguuugcaugggagcugggugaggccugugacugcuguauuuccccaacuucccugguaaccugcaugacucagcaaaggcagccauaauccuccuagguacacaacuccagugaccugggaaucucacccccaucccccacagcagcugcagcaagaccugcccaaggagagucugagcucagacauaccuagcccugcccccacccaaugguccuucccuaccaacccugguaguggaagacaaagggcauauaaucuugggaguucuaaggcccugcccaccgcuggucccucuccacacuaccacagcuguuguuuucuggaaagcaccaccuccuggcaggagaccaaccagcacaaaaauagagcauuaaaccaccaaagcuaagaagccucauggaguccauugcacccaccaccaccuccaccagaacaggcacugguaucuaucuacugagagacccauagauggcucacaucacaggacucugcagacaacccccaguaccagccuggagccggguagacuguauggguggcuagacccagaagagagacaacaaucacugcaguucagcucacaggaagccacacccauaggaaaagggggagaguacuacaucaagggaacaccccguggggcaaaagaaucugaacaacagccuuuagcccuagaccuucccucugacagagccuacccaaaugagaaggaaccagaaaaccaaccgugguaauaugacaaaacaagguuauucuaacacccccccccaaaaaccacacuaguucaccagcaauggauccaaaccaagaagaaauccuugauuuaccugaauaagaauugaagagguuaguuauuaagcuaaucagggggauaccagagaaaggcaaagcccaaugcaaggaaauccaaaaacuggcacaagaagugaagggagaaauauucauggaaauagguagcuuaaagaaaaaacaauaaaaaauucaggaaacuuuggacacucuuuuaaaaaugcaaaaugcccuggaaagucucagcaauagaauugaacaaguagaagaaagaaauucagagcuugaagacaaggucuucaaauuaacccaauccaacaaagacaaagaaaaaaagaauaagaaaauaugaacaaagccuccaagaagucugggauuauguuaaaccaccaaaccuaauaauaaucgguguaccuguggaagaagaaaauucuaaaagucuggaaaauguauuugggggaauaaucgaggaaaacuuccccggccuugugagagaccuagauagccaaacacaagaagcacaaagaacaccugggaaauucaucacaagcagauccucaccuaggcacauugucaucagauuauccaaaguuaagaugaaggaaagagucuuaagaacugagacagagcaccagcuaaccuauaaaggaaaaccuaucagauuaaaagcauauuucucagcagaaacccuaaaagcuagaagggacuggggaccuaucuucagccuccucaagcaaaacaauuaccagccaagaauuuuguauccagugaaacuaagcaucacuuaugaaggaaagauagacauuuucagacaaacaaaugcugagagaauuugccauuagcaagcuaccacuacaaaaacugcuaaaaggagcucuaaaucuugaaacaaauccuggaaacacaacaaaacagaaccucuuuaaggcauaaaucacauaggaccuauaaaacaaaaauacaaguuaaaaagcaaaaacaaaaaccaaaguacacacgcaacaaagagcacaaugaaugcuacgguacgguacaccacauuucaauacuaacaauguaaauggccuaaaugccccacuuaaaagauacagaaccgcagaauggauaagaacucaccaaccaucugcugccuucaggacacucaccuaacacauaaagacucacauaaacuugaaguaaaggggugaaaaaaaggcguuucaugcaaauggacacccaaaaugagcagggguagcuauuuuuauaucagacaaaacaaauuuuuuuuuuuuugagacagagucucccucugucacccaggcuggagcgcaauggugugaucucagcucacugcaacauucgccaccggguucaagcgauucuccugccucagccuccugaguagcugagauuacaggcacgugccaccaugcccggcuaauuuuuguauuuuuaguagagacuggguuucaccauguuggucaggcuggucuugaacuccugacaucaugauccacccaccucggccucccaaagugcugggauuacaggcaugagucacugcacccggcccaaaacaaacucuaaagcaacagcaguuaaaagagacaaagagggacaguauauaaugguaaaaggccuuguccaacaggaaaauaucacaauccuaaacauauaugcaccuaacacuggaagucccaaauuuauaaaacaauuacgaauagaccuaagaaaugagauagacagcaacacaauaauagugagggacuucaguacuccacugacagcacuagacaggucaucaagacagaaagucaacaaagaaacaauggauuuaaauuaugccuuggaacaaauggacuuaacagauacauacagaacauuuuauccaacaacugcagaauacacauucuauucaacagugcaugaaacuuucuccaagauagaccauaugauagaccauaaaaugagccucacuaaauuuaagagaacugaaauuauaucaaguacucucugagaccacaguggaauaaaacuggaaaucaacuguaaaaggaaccuucaaaaccaugcaaauaacauggaaauugaacaaccugcuccugaaugagcguugugucaaaaacaagaucaagauggaaauuaaaaaauucuucaaacugaaugacaauaaugacacaaccuaucaaaaccucugggauacagcaaaggcagugcuaagaggauaguucauaucccugagcaccuacaucaaaaagucugaaagaguacaaacagacaaucuaaggucacaccucaaggaacuagagaaacaagaacaaaccaaacucaaacccagcagaauaaaggaaauaaccaagaucagagcagaacuaaauuaaauugaaacaacaacaacaauacaaaagauaaaugaaacaaaaaauguucuuugaaaagauaaguaaaauugauagaccauuagcaagauuuaucaagggaagaagagagaaaauucaaaaaaccucacuaagaaauaaaacaggagauaccacaacugacaccacugaaauacaaaagauuagucaaggcuacuaugaacaccuuuaugcacuuaaacuagaaaaccuagaagagauggauauauuccuagaaaaauacaauccuccuagcuuaaaucaggaaggaugagauaccaugaacagaccaauaacaagcagcaagauugaaaugauaacuuaaaaauugcuaacaacaacaaaaagaaguccaggaccagacagauuaacagcagaauucuaccagacauucaaagaagaauuggugccaaucauuuugacacuauuccacaagauaaagagggaacccucccuaauucauucuaugaagccagcaucacccuaauaacaaaaccaggaaaggacaaccaaaaaaagaaaaccacauuaagguaugucccuuguaugcugauuuugcugagaguguuaaucauaaagcgaugcuggauuuuguuuaaugauuuuucugcaucuauugagaugaucaugugauuuuuguuuugauuucuuuucaguauuauguugguuguggguuugucauaauacugaacggggaaaaguugaaagcauucccucugagaacuggaacaagacaaggaugcccacucuuaccacuccuuuucaacacaguacuggauguccuagccagaacaaucagacaagagaaagaaauaaagggcauccaaaucaguaaagaggaacucagauugucacuguuugcugaugauaugaucguuuaccuugaaaacccuaaggacuccucuagaaagcuccuagaacugacaaaagaauucaguaagguuucuggauacaagauuaauguacacaaaucaggagcucuucuauacaccaacagugaccaagcagagagucaaaucaagauccccuuuuacaauagcugcaaaaaaauaaaauauuuaggaauauaucuaaccaaggagucaaaagaccucuacaagaaaacuacaaaacacaggccaggugcgguggcucaugccuguaaucccagcacuuugggaggccaaggcaggcagaucacgaggucaggagauccagaccauccuggcuaccacaaagaaauccugucucuacuaaaaauacaaaaaauuagccgggcgugguggcaugcaccuguagucccagcuacucgggaggcugaggcaggagaauggugugaacccaggaggcggagcuugcagugagcagagaucacaccacugcgcuccagccugggcgacagagcuagacuccaucucaaaaaaaaaaaaaaaaagcaaagaaaagaaaacuacaaaacacugcugaaagaaauuggagacaacacaaacaaauggaagcacaucccaugcucauggauggguagaaucaauacugugaaaacgaccauacugccaaaagcaaucuacaaauucagugcaauccccaucauucuucauagaauuagaaaaaaaacaauucuaaaauucauauggacccaaaaaagagccugcauagccaaagcaagacuaagcaaaaagaacaaaucuggaggcaucaaacuaucugauuucaaacuauacuauaaggccauagucaccaaaacagcaugguacucguauaaaaauaggcacauagaccaauggaacaaaauagagaacccagaaauaaacccaaauacuuacagccaacugaucuucaacaaagcaaacaaaaacacaaaguggggaaaggacacccuuuucaacaaauggugcugggauaauuggcuagccacauguaggagaaugaaacugaauccucaucucuuuguacaaaaaucaacucaagauggauuaaggacuuaagccuaagaccugaaacuauaaaaacucuagaagauaacauuggaaaaacccuucuagacauuggcuuaggcaaggauuucaugaccgagaaccgaaaagcaaaugcaauaaaaacaaagauaaauagcugggacagcugggaccuaacuaaacuaaagggcuuuugcauggcaaaaggaacagucagcagaguaaacagacagcccacagagugggagaaaaucuucacuaucuguacaucugacaaaggacuaauauccagaaucuacaacaaacuuaaacaaaucaguaagaaaaaaacaaucccaucaaaauaugggcuaaggacaugaauagauaauucucaaaagaagauacacaaauggccaacaaacauaaagaaaugcucagcaucacuaaugaucaggaaaaugcaaaucaaaaccacauugagauaccaccuuacuccuguaagaauggccauaauaaaaaacucaaaaaacaguagaugcuggcauggauguggugaacagggaacacuucuacacugcuggugggaauguaaacuaguacaaccacuguggaaaacuguggagauugcuuaaagaacuaaaaguagaacugccauuugauccagcaaucccacuggguaucuacccagaggaaaagaagccauuauucaagaaagauacuugcacaugcauguuuauggcaacacauucacaauugcaaaaucguggaaccaacccaaaugcccaucaacgaguggauaaagaaacucugguauauauauacaauugaauacuaugcagccauaaaaaggaauaaguuaacagcauuugcagugaccuggaugagauuggagacuauuuuaagugauguaacucaggaauggaaaacuaaacauuguauguucucacugauaugugggagcuaagcuauaaggaugcaaaggcauaagaaugauacaauggacuuggggacuuggggggaaaagugggaagggggugaagaauaaaagacuacaaauacggugcaguguauaaugcucgggugauggugcaccaaaaucucagaaaucaccacuaaagaaccuacucauguaaccaaauaccuccuguaccccaauaacuuacggaaaaauaaaauaaauuaaaaacagaaauuaagaagauugacccaagagaaaauauaacaaaagucuuuuuauuuauuucauuuuuaaaaauaaaguuaaauucauuuuguuuuugagacagagucucacuuugucacccgggcuggagugcaguggugugauuucaucucacugcauccucugccucccaguucaggcaauucagccuccugccuggcaaauuuuuguauuuuuaguagagaugaggcuucaccauguuggucaggcuggucuugaacuccuaaccucaggugauccacccgccuuggccuuccaaggugcugggauuacaggcgugagccacuaugccuggcccuaaaaaaguauuuucauacacuacauggugggauccagcgagcagaaacugcucagauauuuccucgcccuuuaugagcacauaugcuucucauaucgaucaugugcauuuguauucugaaugaucguuguuggaugacugaaaacgaguaacacagccguuaccugaaauguggaccuucuuucucuuaaaaaaaauuuuaggugccagauuuucucauaagcuuuggcagaccugauaacaaacagcucagcagguggaauguugaagcacucaaagcaagccucccaugcugucaggaguugguguggguggagugggcuagggugggaggggcuaaaugagcagguuccuuucacuacuucccucacccccucaugauagaauggcagguggguucuggcaaagccaagguagaagauagagaaauccugcuuccaggcagagcaaugggcuccugcagguaacaccguuguggcucuaagcccaugaugugcgcuguggaguagacuugacuuagccugcucagagaccaggucuuuguugugcguauccuucuuaacacucccuccaacauccaggggacaagaaaucaaacauacagacucauccuguuuguguuuucucugaaaacuaagaauccugagguguaaguucuuuuguuccucugcuuucucccuuucaucuuguuuguccuugaacucaacagggggcuuuggaggaggucucaaaauuugguccaagaaauaaacaccaagaggauaagacccccuuccaguuggcucacucgaaauuuaaaagccaucauuucccuuauccugccccuccguucuaagugagacuucaaaacaaaacaaaacaaaacccucugugccuggaguagccauugcauacacugcuaaguuauagcuggccucucacugcuugauggugauaagaaaccuacuaaaucuagaaagaacuuuggaucuugagguucugaaaacugcagccauuggucagaagcauguaguucccuuuccaacaggguuugucuauaaguuagacauuggauguugacagaggcuauuucaaacacaugcuucagcuugaauuaugauagccuugacaaagcuuuugauuccaccucuccaguguuuuucuucucuuucuuguuguuaggaauaugauugguucucuuauuacccucauguguccuugggggagagugucugagaguaaagaaagugucugaaacaaucuguggaggucaugaaauuagacauuuguacuacuugugcaagauuuuaguaugaaauccaguuucauggugcugcauugguagaaaaacaaguuagaguaugaauuuguauacacggauucuagagagaaaauuaggagaagcagguuguaaguuccacagggaaaagggugaaaagagugaauggaacaauaaucggagguguguaagugaggaccauuccaaucuccaggucucccuugcugaacugggggagcucuguugagagaaguuacccccuaacuucaacccuuaagaacucugcuccucaauccuuagugguugcaaauucuccuuugauauuugccucgugugguuaccuuagccauugggggccaccucuggggcugcuauggagcagaacuuuuggggugacaaagacauuuugagauaugcaguaagaauguuugauauuugaaccaguuaucuaauggcccagugaccucuuugucaauucuaacaagaagcuucauauuuaaccuaguuuuagcuacucaaguagcuugguguuaaggaucuugucaguucacucucauucucucucucucucucucucucucucucucucucucucucucucucucucucucucucucucucacugucacucucucuuccucccucccucucucucccuauuucucccucuccuucuccccucccuccucuccuccuccuuuccucuuugcucucauuugauagcaaaagaaaacaauacaaggauguaacuggugggaaaagauagcuauuuccagacaagccaaacauuuuaucugggcugacaucaaacugaaagcauuuauuauugcuauuguuuacuccaucacuguaacaauguaaaauguuuuuugugugaaaaucuggcccugcucugauuuauaaauaccucuuggauguguuuucugaaaucguuaccuaaagugguaaaaaaauucuagucaaguucucucugucucucucuuuuucagaaggagggagagaggagagagggagggaggaaaaugugcauaugagugugugcaucuacauguagauggaugaugucuauuuggaugcagaaauacaugcacacauuuguugccgcaucauagagugaagaagaaagaugggcuugagagucagaucugaccugacaucccaaagcccugcuacuuaccagcuagcugugugaucuuaggcaaguuauuuuaaccugucuggguuuaaauuuucucaauaguauaaugaagcuaaucauaauuaccaccucuuaauauacaaaguuaaguauugacacaccaagaaauacagccagaaaaauauauuccaucuguuccagucacuuuggcugugcagagaagcagaguagcccuaaauauagaaaugaauugaguauugaaaaguguaauguauucuaagcaucugaacccugaacuauuucaaaggaauaauuaugcagcaucuguggccgcauuuguguuugcuaccacucagucaggggcauuuuaaucacagcuuuugcuaagagauugcuguguccuuuuguguguguuuuauucaucugcucacuaaaugucaguauuuauugcaauuaauuagccagcuauaucuuuguuauuuuagauagauuacauuagguuacauucuuaaaugaacaauaggcccaauugcaaaauucucaggaaaaaugguuuugcauauuaguuguagauacagauucaucaaucaucuucaucauuaguaccaucaaauaauauaaggcauucagauucacaggacuaaguuaccaaggaaaugagauauuuugguuuggcugcucugauaauuagaucacagcagugguuccaaaucacacuuuugaaaaacauuuuaaauugugaaauacacacaguggaaaagugcauaaaauauaaauauguucucuuaacaaaauauuguagagaagauacuuauguaaccccucucaguucaagaaguaaaauauugccaggacccaagaagcuacccauaugccucuucccaaucaggacuauccucccuaccccaaccacuaucuugacuuuuaucuuguuucucuuuuuagcuuuacuacccgaauauguguaucuaggcgaugcaaucuaguuuugccuauguaaaagcuuuauauaaacugaauuauccagaauuuauuauuucaaucuggcuucuuuuacucaguauuaggauuuauccauguuauugcauauagguaaaguuuguucacuuucauuauuguauaauaucccauuauaugaauccaccacagucuguuuaucaguucucuuauggauggauguuuggauuguaucuaguuaggggauaucauggacaacauugcuauaaacauuguuuacaucugcuggugcuuauaaguguuuguucauuuucuguucgcuuccuucucuuuuucuuacugacuucuagggugucuauguaugcucuagauacaaguucuuugcuagucguauguguugcagauaccuucuccuacucuggcuugccuuuuugcccucuuaaugacauuuuuugaugaacuuaaaagcgcuucuucuuguuuuuuuauuuuuuuuuuauuuugagauggagucucacucuguugcccaggcuggagugcaguggugcaaucucggcucacugcaaccuccaccuccuggguucaagcgauucuccugucucagccuccccaguagcugggauuacaggcaugcaccaccacagucugcuaauuuuuaugggauuuugccauguuggccaggcuggucuugagcuccucaccccagaugauccacccgccucagccucagagugcugggguuacaggugugagccacugcacccagccaaaagcucuucauuuuaauacagucaaaauuaucaaucuuuucauuuauagacagggucagaauucauuuuuuuuaccuucaggucauaaagauauucuccuauuuuaucuuuauuuucuuuuauuugacuaauuaauuuauuugagacauggggugucaaacuccuggucucaagcaauccucuugccucagcacccccgccucaaguagcugggauuagaggugccagccacugugccuggcuauuucaucuuaugaacguuuuauuguucugcuuuucacauuuauuuuuacagcccacauggaauugauuuuugcgaaugauaugagagaugauccaauuucauuucccccuauagauagccaacucuccuaauaccauuuauugagaaugcuauuuauguauugaaaaucuuucccccaucugcuuugaaguggcacauuugucauaaaucaagaauccacgucuggaucuguuucugggcuuucuguucuguuccccgagucuauuuguccuugugcuagucauauacuguuuuaaucacugcagcuuuauauguucuguaaucugguagagugaguccucccacaucguugcucuucagauguaucuuggcucuuggcccuuugcuuuuccuuauaaaguuuagaaaucaacuugucaaguucuacaaaaauaaacaaaugaaauaacccauugagguuuuuuauugggacuuaguuguuuaauuucuuucaaugagguguuuguagcuuuuuccaauagaggucuccuacaacuguuguuagauuucuuccuggacacuugauuuuuaaaaggaguugcaaauguuaucuuuaagaugaugacauuucuaaugucuauugcugguauauagaacuauaauugugugugcacguguguguguauuuaucuaguaacuuuguuaauuccauucuuauucuaauaaucauuuguagauucuuuuagauuuuucuaaguucaccaucauaucauuugugaauaaugacagauuuguuuuuuuccucuccaguucucauuuuuuuucuugccuuagugcacugagaccuccauaguaaauaguuuuucuuuuuuaaauaacuuugcuuuuuggccaauuugauaacuaaaauuuauuaguuuuaauuaauuuguuaaacaaauuaacuacuuuuuaaacagaaucauaaaauucaaaaaguaccaaaaaguugaauacaugaaaagucucucuccuccuccagaccuccauuggcuuguuaaaaauaucccauuucugcuggucuccuugaccugcugaaucuggaacuuuagccaguggagcuucacaauguauggguuuuuuugcuccacacguaacugauauuugaagaccaauacaguaaguuugccuaugcagagauuaaugggauuguguaacacagugauccucaaucuuggcuguacauuaaaaccacugggaggcuuaaaaaaaauuucugaugccuguccuguacacugggccuacugaucugaaucucuguaggugcuguagugggcaucuagaguuuucauaggcuccccaggugacugggggaggcaggaaggagggcuuacaaaggggcaugaggaaacauuugggagggauggguauguuuccuaucuugauuguggcgaugguuucauaaguguguacauaugucagaacuuaucaaauuguacacuuuacgucuguuccauuuauuuuaugucaauuuugcaucaguaaagcuguuuaaagauaaagcuguucaggugauucugaugcacagcaaugguugagaauuauuguuguaauagaaaaggcacaugacugaaguggaaguuggauagacuuucaucugucaacaguuggcugugcgcacuuagacaaguaacuucaaccccuguggaccucagguucauucuaguuaguggguucaguuucuucucaaguacuuuucagcuggcauguugcuucuucuacucagucuggcagugcuggccaggcugcuggugcaccuccuggccacacgagggagccgugcagcuggcagccucugacucuccacugaacacucuugugaggugaaaauaggcuggucaggcaggggucuuucccuucuuccugugcugcuccucuuggugagugcaagccccacuccucaacggucaucuucagcuacccucacucacugaucucgcugcaggugagccuuuuuuuaagcaaagcaaauccauuaauuucugaagguacagaacaaauuuauaaaaggauucccacauugcuuugaaaauauccuguucuccccaagcaauuaaaauaguaccaaauugaaguauauguauguauauauauguauguacacauguaaauguauguauauauguguguauaugcaucaauauagauccauaucuagucuauaucaguaagcacacuaacaauacuauucuccugccccuaugaaaauuaucuauauaaaaggcaguuauguuuguuagagguacaauuuugauauccuucaggcauuaacauugcuuagacgaaaagaggaaucaagguuagcaaacgguuuuuuuccaugguaauaugauguaaagugcuuaaauggguaaauguguaagagagagaaugugugugcguguguguguguuuguguguguguguuuacauauacucaggugaacagguuggcuaaauauuuucggaauggaauuuauccagacacucugugcauuaaucucuauuuuucuuggaccagacagggcaaaaaaucugaauuccccagaagagauagacuagaauugauguuacaaaaugaucuagcuaugcccuaaacuuuaauaaauguauuuuaauccagcucaaaaaugaaaggcaaauguuuaucugaaguauaacaauagcgacuuuuuaaaaagaacuccucccccacccuaaaauauucuaaauaaugcuuuaaaaacuuagcuuugagucacucuuuuauuuuuggucuuauugcaguuuucuuccauuuugauuccuaaauuucagauuauucuaugagccagucacaacaccuugcgggcauacuuuuugcuuaaaaugccuagaaagaugccuagaucacaacgcaaaguguccauugugcaaagacggucuuucacagguaaaucaauauuucuuucuuguuugguuuaaaucaguauuucuuucuuguuuuguuuaguuuauuuggaauugggcacuaagacaguguucaacuggacccccagccacggcacugugguagggcacauuacucccucaaaccaucuauuucuccugucuucuuuuuuuuuuuuuuuuuuuuugacugagucuccacucucccacccaggcuggagugcaguggcgugaucgcgggucacugcaaccuccgccuccuggguuccagcaguucuccugccucagccucccaaguagcugggauuacaggcgcaugccaccacgcucggcuaauuuuuguuuuguuuuguuuuguuuuguuuuguuuuguugagacggagucucgcucugucgcccaggcuggagggcagugacgugaucuccacucacugcaagcuccgccucccggguucaugccauucuccugccucagccuccccgaguagcugggacuacaggcgcccgccaccacgccuggcuaauuuuuuguauuuuuaguagagacgggguuucaccguguuaaccaggaugaucuggaucuccugaccucaugauccacccgccucggccucccaaagugcugggauuacaggcgugagccaccacgcccggccuaauuuuuguauuuuuaguagaaaugggguuucaccauauuggucaggcuggucucgaacuccugaccucaggugauccacccaccucagccucccaaagugcugggauuacaggcaugagccaccacgcccagccuauuucuccugucuuauagccacugucccccucuccauaaaguccuucaggaaaaugaggcaacaugcagcuuuuuaugcaguguaaguagggaaauuaauuuguguuggaaacgaaaguauuaaauagaugauaaacuuggauccugguucuaaugucaucguggcaccugauacacuguaaucuugaguaaaucuuuuguccccucuaggauuggacuagguaagcccugauguucccuuaucaucaguguuuauucuguggcuugaagauaacagcuccaaaggccccagaagaaccucacagaacuucagugugauccuuguccaacccaucaggagccacuguaccuggaagcccuagagcuuuugcagaccgcagcccucuaggacuuccagguucucuaaaacuaaucacacaaacucccaccuuuguuuuucaagugaaccugaaggaauuuccuacagauaaagaagaccugagaaucuaucuuguuuucccucccucagggacuuaucugccacauuuuacaaucgguguuaauguuccuugaccccugucauuccugaggagagguuggagaugcaaggcuaucucuaggugacuacaggucaagagaagucacauguugagcuuuaccaucaccccaguauuuaaauuaagggaauggagugaaaucaucaucacugguagcccugaggguaugcguugggauugggaggagggucaaugucauaccuuucccuggauaaaguuguaggauuugcaggccugauuguaggugagaaguccuugauccuuauacugaaauaauacaucuguguuguuguagcacuggaaaauucagauuaaguggaaagaagaaaaaucuacccauaugcucaguaccuagagaaaaccacuguuaguuaacauuuuaguaugugccuuuucuggcuuuuuguuuuaguaucagcagaggagucaccuacuuuuuagacugacuaccuccucagucaaugcuuaucccccacaacugggacugggaaaugcaguugauuuucccauagccaggcaauggcagugacaguggcagauaaggcauccuggagacagaugcuauagaguucaggacuuggggucuagaagauauucucaucuaucucuguuuauucacauagggucacacuugcaccauuuuacauagaauuaaauauuccaaucauuuucacugcagaauagagacacagcccauacugagaaaggaacaaaauuguuugaagccaacaguuuuauacucaggcgcucccccugcugggacuguagggguaguuuccauagcaagcaauucucugcagauguuuuaacaucaguuguuugauucacaccguuaaauacccacuaccuaaacaucccuggguaugcaucggacagggguguuugggaggagaguaacagugacaauugagccugaguccaguucuugaaaucaugacuuuuaaucucagugauaccuagaugguauauuagaaaggcaaauagacaaaucaauauuuagcuguuuguguuuuuuuaaacuaaaauuaaaagagaaaaaauagguauauuuggcaauauccagaagccaagcauuggguuaggcugggagugggacagggcaggaaagguucagugauugaaaauugcuuuuuaguucccugaaacuuuuggccacuaacuuugagcauaucccagauggagacaauuucugugagcuuguaaauacaaucaucagaaaauggaaagggaagaauuccccccacccuacuuuuuggacaagaacaugaucuugauuucaguguuucagaaaaacugugagaguuuuaaaacuucaaugcagguuuuacccccuuguuaaaaauuuuuuucuaauuauaaagauaaucaauugcauguguguuuuuuuaaaugaaacuaacauccagaaaauacauauauuaugaugguaacagcugcuaauuuguggguccagauuacuccaauaugugggucauuugacuuguucacugauuacaucagaaguguuuugcugauugcuacguauuaccuaauugcauauugucuaauugccuccccccauguagugcuuggcaucaagaaaauacagcaaaaauguaauaauggaggagcucauagcuaaauuccuuccagaagaacugaaggaacgaaggaagcuuuaugaagaggaaauggaagaacuuucuaaguauguauaugcauauuucuguuuuguuucacucauaccagcucaaugagagcugaaugugcacauuacuucccagcuuccgacuuagugaugucaugcuagcugcuugaaauuggcuauggugagaguauuuacaccauggaaauuggcaagugcuacaaaccaggguuuccgcugcacccagagagccaguuguuaaacauaccagcauaccacugaagaagcauaagcgaaaccagugaugaggguacgcccugcccccaguaacaggguauuguuggcaagaguaaauuggaguagcauaaacaggggaacuuaacgaaauguccaaaagauuguuuucagauacauaaggaguugcuaugagguuaagaacuuuggugucaaccagaaccgggcuuaagacccaguucuaccucaaagugagucuacuucacgacccuaggcaggucauuuaaccuuucugggccuuaguuuccuuaucuguagcuugagaauaauuuaauaacuugaguucuuaccucauggacuucuuuuuuugagauugagucucacucugucacccaagcuggagugcagugguacgaucuuggcuuacugcaaccuccgccuuccggguucaagcgauucuccugccucagccacccgaguagcugagauuacaggcaugcaccaccaugcccagcgaauuuuuguauuuuuuaguagagacagggcuucaccauguuugccaggcuggucuugaacuccugaacucaagugauccucccaccugggccucccaaggugcugggauuacaggcgugagccaccaugccuggccaccucauggacuucuuaugaaaaucaaaugaguuugugcauaguaagcacuuaauuaaugguaauaauacuaauacuugucaagcgcuuucucugccgugcacagguaaugugagaggugaaggggaggggcagaggcgucauugaggcucucagcacucugccuggcuguaagaacagcucccuuagcagaaaaagcaggaggcaaucacuaauuucugccucucuugcuucugcccucuccucccuccauccgcaguagaauccuaacagcauuccagaggcaagguuccugacagcaaaaaugguucugguuucaugcccacuguguagagaacauucguaaacucugccaguggcuuguuugaaugcacuccucacuuagacuaaugcuuuucucagaaacuagaaaucguuuuuuuuuucucauuaauuuacauuggaacuacucgggggaucuuuaucuuuauuucugaucuguaaauuagcauugagccucucugagcccucaucucaaaucucauuuaaggucuuauuaacaaauacugagauguauuagggcuuucuauguaaaugaauccugaacuugauccuuuugagauuugggcaguuggucuuauauuucuugauagguuuagguucagauguuccuguguuggauuuacuagacaaauaagacaaggaucccagaagagcuggcucuguuuugguuccccaacggguugugugugugaaucucuggggguacuuauugaaaggcagggccgggcaugguggcucaugcguguaauccuaguauuuugggaggcagaggccgguggauugcuugaggucaggaguucaagaccagccugcccagcauggugaaaccccaucucuaauaaaauuacaaaaauuagccaggcaugguggcaugcaccuguaaucccagcuacucaggaggcugaggcaagagaauugcuugaacccgggaggcggagguugcagugagccaagauugcaccacugcacuccagccugggugacagagugagacuccgcuuaaaaaaaaaaaaaaaaagaaaaagaaagacccuugggucccaauuccagagcuaaugcaucaguaucucugguaaugugguguccaagucaucuugauugaagagccccuguugauucugaugcaaagaagcauuugagcaucacugggcuggauuauucuugccuaucucuugguccuuccuccuuucagcugugccuccuuugcagacucuuugggguccuugcaaauuugagaugcccuagggaccuuacagagaauuucccaccacccuucuggagagcugaguccacuucuaucaucagcaaccuuccccaugcagccugaaaaacaccugaaaagauuguuuugaguggagagcaugaaaguaagaaaaaauaugaauuauagcuaucauccacaauauuaagauacuagagaacuucuucagccaaauuaaaauguguagaaugccaauuuuaauuucuuagaccuuaggcuaaccucugcaucagaucaugggacucagcccacacuaucaauugcauuucaauauuuuucuauuagccaucaaaacuugauguaucuuuggcaagugacacugucaaaaaacaaacuuggugucucugccuucccccagggguaucacaugcuaacauuugaccaauauuuuuguguucuguccgauugcuuugagaucccugucauuuucucuuucugacagccuuaauaagaaugugccuauuuucguguguacuauggccuaucccaccguuccuuguccccugcacaucuuugagccuuguuaccgccugaugauucguagaugcauugagacaggcacgagacaguuuggcaugugccuuggagauccugucaaaggguaagugaggagccaugcgagcaaagggagguuguguaaugagggauuucuguuuuacuuugggguacucccaggagacagggaggccuagcucaugagguuuagccaacugaagaauaugagcauuuguaaggaucauugucccuuuggugguuaguuuaccaugugagaggcugucuauuuaaagaacccuagaauuaauauuugguuaaacaggugguauauguuauaaaacuuguaagaaugugggccuuggagucaaacugccugcuuucauuaucuaguugcagccuuggagcaaguuugaguuugagcaagcuauuuaaccuuucuguaucccaguuuccuuauuuguaaaguggguacaauaauaguaccuaccucauuggguuugcuuggaagauuggugaguuaauaauguacauaaaaugcugagcacaguuccuggcuuccuuaguccauuuugugcuacuauaacagaaugccacagacuaauaauuuaugaacaaucaaaauuuauuucucaugguucuggaggcugggaaguccuaggucaaggugcuggcaucuggcaagggccuucuuccuuuaucauaacauaguggaagggcauagcagaagggcaacagagagagagagaaagaagggggucaaacuugcccuuuuauauuaauaacaacccuacucuacuuucaccauaucagcauuaaugcauucaugaggguggaggccuaaucaccucuuaaaugucccaccucuuaauaauguuacaauagcaauuaaauuucaaaauggguuguagaggaggcaaacauucaaaccauagcacuggcacagcacauaguaugugcucaauaaaugguagcaguuacacgaauacauuacgaauuuuuuuucuucacacaggcacugccuguuguguaauugaagcuguaacccagggacaggaaaauaggcagaagucccuugagccacagcauggggcuacagaaauggcugggugccagcccagggaaacagaacucaucaaggaucuagucucucgacuccauucucaauaaacagguuugcagaauauggcugcauccuagagaucagaaauguucaauucuuugcugauggccgcucagugguugacagcauaggcaagaggcgcuucagggugcuccaucagagccagcgggauggcuacaacacagccgacauugaauacauugaagaccaaaagguaaggguggccagugccaagaaucccaaagccaggcuauccuuguaacuugauacacaaagauaguugugaaaggauuucucagaacccuugagggccuugggauuucacaccaaauugcugcagcaacauugaaugcugcuggauugcuguccaguugcacuauggcagugagggcgccuacuguccuggcucugcuuagcugcugaguugcauucaugcauaggaaauguuauccuagaucaacccuggggcucauucagcuugggaguuaagucucugccaaagauugcaaggaauggaucuggggugggucuauacauauauauuuuaucuaucgauuuauguauauuuuaaacuuuuuucuuuugagacaauuauagauccacacaugcauuuguauuuuaaaguacguaaccuggcuaagagcccuucccaauaauccaucauccccuaaggcagaaagaugacacaucuaguuaauccuugguuuucugagguaauggguggaagaagagguaaauaauccuauauucauuuauauuuacauuuguuacauaguagauuaauaaauaucugaugacugaguaaauguguuugaccaagauaguuacaugcugagacugacauacuccugugucuuuuccagcaaguaaugagaaaacagauguaaaaaugaaaagggcaaaggcauggaccagcauaaccugguuuaaccacaugccuccacucaggccgguuugaaucucugguuuucugcauguuuugcuguuucagcuaaucuacccagcugaaccuuucuccuuccuccauggucagcaguaucuacacacuguccagcacuugacuaaggggcauuucacaucaagcaaaggagaaagcugaaugggugagccuucccauaggaaggcaggauggaugcucaaagcgaaucaggugucaaaagugacucugggaaugauggagaggguacagaauguuucacuuccacuuugauacuuucagguucagggagaggauugugcugagcucaugggauuacauaacugugucuaucagcaagcaucauugugguuucauucgcucaaauuaucccuaaagaaucggauacucaaucacuuuggucccaugccggagaaagacgccgauccucagguauagaaaaaugucuauuuuuaaacggguugucccacuagaagagagugccuaguguuugugauuagauggguauguggcugccauucagcacaucgaaugcagagaggaagauggauuuaauuugguguuguuuggcugcacagugagcgucaugaguaagaccaaaaagaucccaaguuagaaucgggguaacuaaaguaaagcaguaggaacuuggauccaaggcagguuuugagaacuaaguaagauaagagaaugggaacauagauaucaccaacagaagaaccuuccaugggaguccagauucacaccaugguaguguuagggugacaaguuacaugcaaaggccaggacuuaagagaaggguauccugggagcugagaccaaaagcugcugcuuucagguaacuucauaacccucucccucauugcuuugggaacuaggggauagggccagcuacccuuauaagauuacaacugcaagaccacaaaaacuuuucgugccucggucuaucuaugcuucgcccugcaagucuagacccuugcuauuguccucaccagggcugaacagcucuguucaucauuaaauacuguuaguugaguuauacuagacaguaguuuguuagguucuacugaucaguguucuuccugggggauaggccuauuugaaagaucaagcugcagaucagaagcucccuaggagaguggagaugguuaaguuucacuaagcuuugcuugccuggaauaaaucagggaauacugucuuucuaggauaaggcuggagauauccuaaccacauauuuccucacgaccaucucuuccuaugcuccaagcuggcucuccuacauugauucuuuacuuaugcucauccccaacucugucacaaaagaaaaaaucucaauaugcauauucugaccaaaagucugguccugcuuaccucacuagcaguaugaccuugggaagauuccuuucccuuucucaacuuuugucccaucucugacaugaggaggguucuaaagcccccucuuccucuugcauucugagguucuaagacaccagucuguucccuaaaugaaaugucuugcuuuccucagaccacaaagguggcuucuuuccccccccaugcaaaggcaucaugaguuuucaagggagaaaggccaguuagugcuuccugugacccagcuccuggcucugggccacgaugagucaggacugcagcauauaccucugagcaaacucacgaucaagcuuaauguuccccuucaccuuccgggaagcguucucccuuaggcaaaagauacagaucagcaaugguaacgggaaaacacagaugcuacagugugauucauaaaggcuaaugacagagaaaguugaaaucuuggguuucacuuccuuuuuucuuaguucuguuauuauguugcuuuggcagcagcagcaccagcaaaaaagaaaaacccauacccaucccaguuugcuccagucaaugcugcauccccaguggucccacaaauaagcauguucugucaggaggauguuucuuagaaacugccacaaguguuaauaccagcuuaaauaucuuuguuggugauccuuggaaagaaaguucagaacaucagucuaauauucagaacugaucauaggagggagagcauauugccagcuucagggagggacaaaaaagaaugcaaaugaaguuagaggcacaaagaagcaaagaaggcagugagauuuggugacgaucagaggaaccaauuuggagccaaauaauuucagguguaggcacuuugaccagaaugguucucuauaguccuaaaaccaaacuugugaaaguugugggcagaaagcucguuuuaggcuuagaaggaaauaaguacccaaugucuaaaauaugugccagggaagcugcuuuggggaaggauuuauguggaaugggaaagcucuuuauuaaaaggaaaucuaggggcagaauauauuucuuucuuucuuucuuucuuuuuuuuuuuuuuuugagacggagucuugcucugucgcccaggcuggagugcaguggcauaucucagcucacugcaagcuccgccucccagguucacgccacucuccugccucagccuccggaguagcugggacuacagaagcccgccaccgcgcccggcuaauuuuuuguauuuuuaguagagaugggguuucgucguguuagccaggauggucucgaucuccugaccucgugauccacccgcuggccucccaaagugcugggauuacaggcgugagccacugugcccggcccuggggcagaauauauuucuaaugugaauguuuucuaauuggaauuuuugcaaagugagauugugauucuuugggacuguaaaucauagccuuugguuucaggggagaagagagcuauggcccuguauagugacaugguauacauggacuauugccuucagccacaucaaggaaaugaggggacuuaaaagacaugcaaaggucaaggggucaugggaaucgaaggccugaauguuaaaugcaucaguccaaaggaccucaacagaauauuagaaguggaagagacuacauaguagauaccagcuuguaaaaucacauuggcuaggaggcaugguguaucuguuaggauacugguugguuugcuuuaacaagaaacaaaaaugacuggagcuuaaacaagauggaggggcuaagucuuggacaguuagggcagcucuauuccacaagagcauucaggcacccaggcuccuucaucacaaaacucuaccauccuuaaaaugucucccucauccucuugauugagaaaggcugauccucaccacguccauguucuagcuaggggaaagggagagaaagaggaaggcagagggcauaugcuucuuucccagagcaugaccaagagguuacacauaucacuucccuuuacaucucauuagccagaacuuugucucauggccucaccuagcugcaagggaagcugagaaaugcagucuuuuuucuggguggcuauaugcccugcuaaaauaagggggaaaauagauauagggucaauuagcaaucugccacauggaguuguucuaccuggggucuuuaccuugagcauuuggaacucugcagacugauguucuuggaugggaauaggaugacuccauuguguuucucuguugcagaugaacccgaauggcccagccuggugcugguggauguuagcaguucuucccuuggaaagccgagcucagcuccccuuccuagcaaugagguccuuaaaggacagacugaaugguauucgacgaguccuggccuucauaucccgaaaccaaaacuagugaguggauugccgaagaggagcucccaccuuccccacugccgucggggggagucuucuuguaaauauaucuaauugcaauaauaucuuaacagaagggggugucaaacagaggcaucagccugcuguugaucacagagagaaauugaguagaaagaccaaaagaaugugaccuauuugaaacuuucugucuuaagaugcuucuugacaugcugcauaacuacauaaacagcagagguguuuaagagcccagaaaaacauaauuugauuuuaacauuaaaauuuccaaaaguuuaaagugguuuugcuuuaauauucuuucuuucauagaucaaugacugugugguugaaaugugaaaacaaagauacuaauaauguugcuguauaauuucacugacuugaggucucauuccaaaugguucagguuuuauagagcauuguguaaaauaauguucauacuucuuucuguuuuaauaauuuauuuuuugcacuacuguauccuuuuuucuacauguauguuuguaacuauuuaagcguacauugcugaaaaguccauugcuuuauuuauugaugugguuuaccauguaccuagggggaaauaacaauacuagaagugugcaguuuuugcuuuuaucuuuuuuuuacuacaaugacacuaguucuuagaccauuuccguaucuauccaaauggaugcuuaaaagaaguucagaaugaugcuaagaucaucugucuucagaguccacuuuuuuuuuucaguuugaacuaaacaauauaaaauacuuaagggauuuggccuagauuaugguauaugccaagguaaaguaaaauaauucauuuucuguguguaauacagaacaaagcugaaagaauuauuuuuauuauaggcauuuacuucagcaaucuaauuguacguguaucuaauuuuuccccagugcaguuaggaaucggauuuugggcaggaucauaauuaacucuucagaggaaaugguguucaguuuagcacaucacagucaugcccaacuagccuccauaacccaccucuccccgggguucugaggaucaagaccuggacagaaacacuugauaaggacuuuuuauuauuaaaauguaaauaagacaaauagaguagaacccuauaaaaaucuuuuuaaaggaaccagauggccgggcacgguggcucacgccuguaaucccagcacuuugggaggccgaggcaggcggaucacuugaggucaggaguucgagagcagccuaacuaacaugaugaaacccugucucuacuaaaaauggauacaaaauuagccaggcuuggugguguaugccuguaaucccagcuacuugggaggcugaggcaggagaaucacaugaaccugggagauggagguugcagugagccgagauugcaccacugcacuccagccugggcaacgagcaaaccugcgucucaaaaaaaaaaaaaaaaaaaaaaaaagggaaccagauaaucuauuauuuuaccuaaguacugccuuugcuucuaguugcaugggugaaauauuucaauguauggggagaauauagggugaggaguaagaguaagcccugauuuagcuugcuuagugcuaguuugaguccuucaguggcaggacagccuguaaaguaccacaaguaugggaguguuauaauggcagagugaaacgauuagagcagggaggaagugaauugugccauuaguaccuucaugcaaauuauaccaugugauuuuggacagugaaugauuuuugcaucauucauucacagcccaucacucuguuaaggugagaguguaauucuuacuucucccaucaccaccuguagcuagaaacaggaaagggagaaugagaugauccagacaacauaaaaaagaugcauguaagcagaaaccagauggucuuuucugcacucacuuaauggacauuauguugccagaguguuguguuuaucagauuugauguuuggagcuagucugggcaggugaagaacagaaauaggcggaaguauaggcauuauuucugcgcaagcaaacuccacaaagcucagggagcagaaaagacucccccucccaccugguucccagaccauguggucauaacacaauccuaauaguuucugguuaucuaguguaaaugcaacaaagaaaaaggcccuaagcuucucuacuuauuagauauauuauuuuuggcaauugauuuaacuuuugccaacccucaguuuucuaaucuaugaaaugauagugauaaguucugcauauaggguuguuacgaaaauuaaaugagauaauguguaaaucaauuagcacagugucucacaccuagaaugcacucaagaaauaauagcuacuauuagauuagucauaguuauagaauaucaucaagggccuacauuuguauaaaacacugccuuuacacacaauauccacuugaaaccccuuuaaacuuaguugggggaauacauaccacugauuuuuggacccauaauuugaugauuuacagauaauucuuuugggaauuaaaugugugugaaagugaaauaacuggagaacaaaugagggucagagauagggaucaauccuauaccagaaauuuuuuuccugcuucaauaagggcuagaagguagugcccuauguaggucuaggauuucuuucuuccuuccuuccuuccuuucuuuuucuuuuguucccucccucccucccucucucucucuuucccucccuuccuuccuuccuuucuuuuuccuuuccuuuccuuuccuuucuuucuuuugugugugugugugugugugcgagucugagucucacucugucacccaggcuggagugcaguggcucgaucucaguucacugcaaccuccgccucccagguucaagugauucccuugucucagccccccaaguagcugggauuacaggcacgcaccaccacgccuggcuaauuuuuguaguuuuaguagagaugggguuucaccauguuggucaagcuagucucgaacuccugaccucaggugauccaucugccugggccucccaaagugcugggauuacgggcgugggugugagccaccgcacccagccuaggauuucugauagaauggaagccuuaaguucuagcuccauuagaauaaccaacuuuucacucccuguucuccaaaauguauugagaaccuuacccaucccagaugaugagaguuuacaaucugugacuucuguucuuaguugauaguauuucuuuauguugcccaaaguaacagauucaacaaaaaauguacugagauccccauguaccagguacugagccaagugaucucacauaccugagcucauuacaucauuuauuucucauaccaacccugcgagagcaguuauuauccccauauuaugaaugagaaaacugagccuccacuauguuaaauauuuugucuaguugcaaggcaggaugcaaggcuaagcuuuggcuuucuuugggauguaccuuaacgagguaaucaauuggucuugaacauuuuuacacugggaaauugguuuugcugcacagcuugggaaugaaggguauacagaagaaagacauaaggcuaaaucuaggccagaaaaauaagacuucccccacaguagauagugccacuuauuuaguuaguuuuucugucuaucaugacugacccagucuuugccuaguagguuauauuuuguauguauguauguauguauguaugucuuuguguguguauguguguguguguauguguguguguauauauauauauauauauauauauauauauauauauauauacacuagguagcaagcagacaucauaucuuucugcuuuguacuguacuacugcugcuagcaaauaaccagcaaaauguagaaaaugaaaaaccaauuuucuguagacaaccuggagaaaagagugccugccccugacuuagcggggcagagaaugacaauuuuuaaaguuugccuuuucugaagguugcuuuuagcccagugcugccucagcagcaaggggcaagcagagucauugcgcauguggcgcuuccagcucuaccuguggagcuggccugggcucagauaauccccugugacuggccauuggagcggcggagcuccugaggcuaguucacagcacccagaggucucuuacagucaacagauugcauacuguugacagacugcaauccgucuguguuccccacaccaacuccauuuccaagaugggaauuuuauucaggaacucauuuuugaguucccaacauguugacuucgcauccauuucugcucaccaaggcagaaccauagcaguggugugugacaaagaugcaaauggagggcagcccaaacaauggaaaagagaagauuuucagcccauucuuggggcuaagugagguuuugauuuaugguagaagacaguucuaaaaagcagcuggcagcaugggcuucaauuuguggcccuucugaguucaaacagaaggaaggaaaaggagccacauaaaguguacacauucaauucaucuuagaaugauagcucccaccuuauuacacuguacaacuauuuaauaaucuggguuacacacauccagaggugaaauaaagaaauuuucacuuacaaauguguauuuccaaacaugcuaaguuaaccuccagagagaagugccuguaaucucuguuccuggugucacuuuaaagcuuuugcuucaugacuguagcuguuguuuaaaauguuuuugcagcaaacgcgauuuaacagaaguuuacaaagcaacacuguagcuaaugcauaauuuuaaaaguugacuaacauuuaucuauuguuaaagcaacacuaauaauggaauaaaaggaaagcaaauaggccaauguggcaccauaggcuuauuuuagguaaauuaguuccaucaucuuaugcaguuguaaguaaugccaggauuaaaauaucaagcaagccacguaaacaguggcaaauguguguguguuuuccauuuguuugguaagcagccauuuuacucuugcacuguaaugaacugaagggaaauauaagauaaugcuuuuuuccccccauauugcuauucaacuaccucuauaugcuugauuucuuuuuaggauucccauccuccaaaucuguacaaaaacguuucagcucaucuguguuguaauaacaaugugauacagacaguuugugugaaaguuguuuguucauuaaaaaauguuuccuauugc

SEQ ID NO: 18950 - RNA, 13291 nt, Homo sapiens
ccuguagaaacuuaaguagugaagucuucuguuuuaugucacagcuucuccuuaguuucuuuucaccaucagucccgggggauucucaggaacauucucccgauauccugaagcuguuggcaccucacccuagauuaaaggaaaacguagagucaaugacuacugaaguuaccagccauaaucuaccaagguuguuacagguaaaacucaacucacccagcucgcucgugacgcuucguuuggcuguuuugugggcaaacguggggagugagcccucccucuccuauuuugguuccugagaaagaagaaauugagucacuagugguucuguucuuugcaaagaaccucuuaaagaugcaacugugaauuucaggcauggucccagaguuuauucauuacauugaaaaaaaauuaugaaacagggucucuuucuaucacccaggcuggagggcagugauaugaucauggcucacugcagccucagacuccuggucucaagagauccucccaccucagccucccgaguagcugggacuauaggcacgugccaccaugccuggcuaaguuuuuuuuuuuuuuuuuuuuuuuuuuuuguagagacgggguuucaccauuuuugccuaggcuggucucgaacuccuggccucaagugauccucccaccuuggccuuccaaagugcuaggauacauuuuuuuccaguucuugguuagauccagccgagagagauuuuacagagcuagaaaggaauuggcucacugccccugggccauaccauuuggguggguuuauaggcuuuggggaugagucugggaagagggccuaacaaucccuccuuucgagcuuuuguuuguucaagcugcuggccuuugagugccagcacuuauccugugcaaagacaacucugauccucaaauggauguaauuucauauuccugcacuaugccuuauacauaaguaagcuuccaauacguauuuguaacagagaagaggaaagagauguuggaaagaaaguugaguugaaggaccugggaggaagacagguauuuguaccuuucuuugaaaaccaggaaacagaacacaagagagauggguuccaggcccuggcuuucccggcagaggguaaguggucagaaguugaggaucagaagcgcagacuccaaggcagaguuuagcacugaaugccugggcaucuuuagggggcaguuuucccuccauucaugcccgguguucuucuccuguguguaagcccugggcucucauaaaaggacugaaaugcaggugcgcccaacuuuucuuaaaaaauggcagaacuuagaggaucuccugaaaucacagaacccccagugauuucaauaauuaagaucacuauuaaaugauugagaaugcuaauacugaacccaaaugccuggagugacuucuaauugcagcuccaucugaaaagaagaaaaacagcaaccuuggcuuuccaaugucaaccagcuggggaacaaggauuggauuuccacccaaacuuugcuuugcaaagcaguauacuccugaguggccaaugccuuggguucauggaaagucaagguuguaguauugcuguagugcuggagaaaaccccaacucccaaguuagacacagagaaaacccacauuauuuuuguccucaccucauuguuuucucccagcuauaugcuccccuuuuucaccugucugccaguuuuuuuuugguaggguuagagggaaacaacacgaugaguaucuugaccuauggacuauggguuuagauuagagagggguucuccauguaaaucugcauaaacauguuguuauugcacuuauuucuaaauccuuuuucaaauauccaucuccugggaaaauauucuugaaaaggcuagagacauuguugauuuuuuuugccaggugauuuugucuuuuuuuuuuuuuuuaaugcuuuucaccccaaaucuaguaaaaggaauaguuuguaccuuguucauuugaccaguguaacauacagaccuggagcaugagguaacuuggcaggccugugaacagaccugugccaaagcccuaccaaaaguccuuuuggagcuggaguuuggggaucgcagacggccgugaauggcagugagggcgagaggaacuauugagugacaggaucugccgucacugccugccuugguuuugcuaaagugguuacuggggaaggauuuuauaggaaggggaacuggugccuaucccuggcauuuccccuuuuuacaccugcccaaggaggcucuccuccuacauaccuuccuguccuugccuaaggaaguucccuaacuccacccaagcugggaaugccuugguugcagauacugugcagaaaagaaguaggaaauaaugccuuaugacggcccccaaguugagcucuguguccacuaugaguucgggguggggaucaggacucuauaguuucccuuuguuccucuggguaggaauaugagaggacaauauuaguccuaagaagauucugauauguggcccuuucuucauccaggacaaucuggagcucccacauuguucuagucaggaggaagcagcagccaggggagauggcagcagucugauggacccagcuaaagugaagggggauggucagcagcaccacaugaaagaccaggaagaagaggaggagaagugggaugcuaccucuccaaaagcugcuuccagcaagacuggaaaaugccaggaaaagaaaaggaaacauugccagauugaaucccaagaagaaacggggaugccuaauaaagccuccaagcaagguacuggcucuacccagagagaagguagcuuggaggagauccccgggcucaccaauauauacaaguuacuuaccucugucugggggcuccuuaggcucuggguguggggcccagcucuggcauuuacuagcugugugaccucagagauugcuaugaggcuucugugagaucauguacagugccuagcacacuguaaaaaguguucaauacuaauuauuaauauaauggaaagccaaggcaucaggucaagcacaguaucaacuaaugacaucccauacccauggggaugccacuuccuucuaggucagccucuugcuacccccauccccauucuaggaaugcaggaugaggaaagugaggucaggccucacccugcucauucccaguuguguucccauagguaggcaugugagaagcagcagcuguggcuugcuaucuuuccacgagagguuggcagugccaagauucaguuuuagcuuugaaggccuggcucaguccauugaguugcuguagcuucugcuguugacagaggugcauguugcauuugaaugaaguccccagggcuccuggacauuguuugacuugcauuucucuuucuguugggccugcuggaaaccucugagagccuacuucugagugucccauucucaacggcucagguguccacuaaaucaacucucugggaggugguggugagaguggcaaacugaaaaacgcauuggauuauuuugccucagaaguacuaucuaugaaaccgggguggcuccagcgcugacuucuugcuuucuaaaucgcagauccucccacugaucagggggacaaaccugcucucaguuuaccacuugcaucuuucgacgcaucugaccuugaaugcgcucuauguaugagguacguccuguguacuaucauuuacuuccugauguuucuucaucucuggugucuggaccuuucugcuagugaccuacugcuggguugguuagcauguaaaaagcauagcucuaacggaauggaaaucacaacguugauugucacaugggucagcuuguguccccuucccagagacugcauucccugcauuccuggcuccugacuuggaaaaaccuggagagugggaagggaacagucuauucacaggucacaaacugauggcccacugggcugaauaugucugaauaugucuuuuuuuuuuaugucuuuuuuuuggagacagagucuugcucuguugcccaggcuggagugcaguggugcgauuucagcucacugcaaccucugucuccccaguucaagcgauucacgugccucagccucuuaaguagcugggauuacaggccugugccaccacgcuuggcuaaguuuuguauuuuuaguagagacaggguuucacaauguuacccaggcuggucucaaacuccugagcucaagugaucugccugccugggccucccaaaguccugggauuacaggccacugcacccagucugaauaugucuuuuguuuggcccucaugggguuuguuuuucuuaaacgugaaugucuugagacaggacauguacucuccauuugaccacgcccccgccacccaccugccuuauuccaaccugugugucacaauugcauuacauucuuagccccuagagauaauuuaaauuuuggaucccagcacuaaucucaguuacaugggcaagagcucaaaguucaaggacuacugucaccaccacagacuauucuugggaagccaaguggugggccugacuagcuuuuguuuuguguugugccaugaauauuaguggugggccugagauacuuagccaaguaucuccccaccaaacagugccacaucaucucuacuuucucagaucucuggagaggcaaauuauucacaugcucccccaccccaaaagaaagaggcuaugauuaugguguguguaaccauacacaauuuuuuaaaauugcuuacaugucuuugauuucacagcugugacuuacuggcuuagaggagaggcucccugcucugucauuuacuggcuguugaccuggauggagcaagugacauucucugcuacuguuuucuugucaguaaaauagagaacaguguaccuacuccauaggguugucaugauuaauugagaaaaaucuguuuaacaccuggaauagugccuggcauauaauagauacucaguaaauguuaacuauuuuuuuuuccuuguagaccagagguccagaaggaaacuuugggucuauggaccucugaggauguucuauauauggauucuaauagauguauuaaugucucgaaguuguauguuaaaguauguggguuuuccaggacaagguccacauccuuuagcagauucacaaaugugucuguuuuccaaaagagcauuaaaaggaggcugagauauuugcacaaaaauuaagacgguuggcaggcugcuguucguugugcuggcggguccugcggggagggcuguggagcuccagauggacuaaagaacaaaccagcaaucccgagagggcccacagucccucugaaggaagcggguugcuucugcaggacccaggagacaccccaaauacucugggaggcaaauagccucggucgaguucucaagucccucucacucuccuccuggaaacagacuuggagcuguuggggagggcacgguggaagugagacuggcccuucaguuugcaugggagcugggugaggccugugacugcuguauuuccccaacuucccugguaaccugcaugacucagcaaaggcagccauaauccuccuagguacacaacuccagugaccugggaaucucacccccaucccccacagcagcugcagcaagaccugcccaaggagagucugagcucagacauaccuagcccugcccccacccaaugguccuucccuaccaacccugguaguggaagacaaagggcauauaaucuugggaguucuaaggcccugcccaccgcuggucccucuccacacuaccacagcuguuguuuucuggaaagcaccaccuccuggcaggagaccaaccagcacaaaaauagagcauuaaaccaccaaagcuaagaagccucauggaguccauugcacccaccaccaccuccaccagaacaggcacugguaucuaucuacugagagacccauagauggcucacaucacaggacucugcagacaacccccaguaccagccuggagccggguagacuguauggguggcuagacccagaagagagacaacaaucacugcaguucagcucacaggaagccacacccauaggaaaagggggagaguacuacaucaagggaacaccccguggggcaaaagaaucugaacaacagccuuuagcccuagaccuucccucugacagagccuacccaaaugagaaggaaccagaaaaccaaccgugguaauaugacaaaacaagguuauucuaacacccccccccaaaaaccacacuaguucaccagcaauggauccaaaccaagaagaaauccuugauuuaccugaauaagaauugaagagguuaguuauuaagcuaaucagggggauaccagagaaaggcaaagcccaaugcaaggaaauccaaaaacuggcacaagaagugaagggagaaauauucauggaaauagguagcuuaaagaaaaaacaauaaaaaauucaggaaacuuuggacacucuuuuaaaaaugcaaaaugcccuggaaagucucagcaauagaauugaacaaguagaagaaagaaauucagagcuugaagacaaggucuucaaauuaacccaauccaacaaagacaaagaaaaaaagaauaagaaaauaugaacaaagccuccaagaagucugggauuauguuaaaccaccaaaccuaauaauaaucgguguaccuguggaagaagaaaauucuaaaagucuggaaaauguauuugggggaauaaucgaggaaaacuuccccggccuugugagagaccuagauagccaaacacaagaagcacaaagaacaccugggaaauucaucacaagcagauccucaccuaggcacauugucaucagauuauccaaaguuaagaugaaggaaagagucuuaagaacugagacagagcaccagcuaaccuauaaaggaaaaccuaucagauuaaaagcauauuucucagcagaaacccuaaaagcuagaagggacuggggaccuaucuucagccuccucaagcaaaacaauuaccagccaagaauuuuguauccagugaaacuaagcaucacuuaugaaggaaagauagacauuuucagacaaacaaaugcugagagaauuugccauuagcaagcuaccacuacaaaaacugcuaaaaggagcucuaaaucuugaaacaaauccuggaaacacaacaaaacagaaccucuuuaaggcauaaaucacauaggaccuauaaaacaaaaauacaaguuaaaaagcaaaaacaaaaaccaaaguacacacgcaacaaagagcacaaugaaugcuacgguacgguacaccacauuucaauacuaacaauguaaauggccuaaaugccccacuuaaaagauacagaaccgcagaauggauaagaacucaccaaccaucugcugccuucaggacacucaccuaacacauaaagacucacauaaacuugaaguaaaggggugaaaaaaaggcguuucaugcaaauggacacccaaaaugagcagggguagcuauuuuuauaucagacaaaacaaauuuuuuuuuuuuugagacagagucucccucugucacccaggcuggagcgcaauggugugaucucagcucacugcaacauucgccaccggguucaagcgauucuccugccucagccuccugaguagcugagauuacaggcacgugccaccaugcccggcuaauuuuuguauuuuuaguagagacuggguuucaccauguuggucaggcuggucuugaacuccugacaucaugauccacccaccucggccucccaaagugcugggauuacaggcaugagucacugcacccggcccaaaacaaacucuaaagcaacagcaguuaaaagagacaaagagggacaguauauaaugguaaaaggccuuguccaacaggaaaauaucacaauccuaaacauauaugcaccuaacacuggaagucccaaauuuauaaaacaauuacgaauagaccuaagaaaugagauagacagcaacacaauaauagugagggacuucaguacuccacugacagcacuagacaggucaucaagacagaaagucaacaaagaaacaauggauuuaaauuaugccuuggaacaaauggacuuaacagauacauacagaacauuuuauccaacaacugcagaauacacauucuauucaacagugcaugaaacuuucuccaagauagaccauaugauagaccauaaaaugagccucacuaaauuuaagagaacugaaauuauaucaaguacucucugagaccacaguggaauaaaacuggaaaucaacuguaaaaggaaccuucaaaaccaugcaaauaacauggaaauugaacaaccugcuccugaaugagcguugugucaaaaacaagaucaagauggaaauuaaaaaauucuucaaacugaaugacaauaaugacacaaccuaucaaaaccucugggauacagcaaaggcagugcuaagaggauaguucauaucccugagcaccuacaucaaaaagucugaaagaguacaaacagacaaucuaaggucacaccucaaggaacuagagaaacaagaacaaaccaaacucaaacccagcagaauaaaggaaauaaccaagaucagagcagaacuaaauuaaauugaaacaacaacaacaauacaaaagauaaaugaaacaaaaaauguucuuugaaaagauaaguaaaauugauagaccauuagcaagauuuaucaagggaagaagagagaaaauucaaaaaaccucacuaagaaauaaaacaggagauaccacaacugacaccacugaaauacaaaagauuagucaaggcuacuaugaacaccuuuaugcacuuaaacuagaaaaccuagaagagauggauauauuccuagaaaaauacaauccuccuagcuuaaaucaggaaggaugagauaccaugaacagaccaauaacaagcagcaagauugaaaugauaacuuaaaaauugcuaacaacaacaaaaagaaguccaggaccagacagauuaacagcagaauucuaccagacauucaaagaagaauuggugccaaucauuuugacacuauuccacaagauaaagagggaacccucccuaauucauucuaugaagccagcaucacccuaauaacaaaaccaggaaaggacaaccaaaaaaagaaaaccacauuaagguaugucccuuguaugcugauuuugcugagaguguuaaucauaaagcgaugcuggauuuuguuuaaugauuuuucugcaucuauugagaugaucaugugauuuuuguuuugauuucuuuucaguauuauguugguuguggguuugucauaauacugaacggggaaaaguugaaagcauucccucugagaacuggaacaagacaaggaugcccacucuuaccacuccuuuucaacacaguacuggauguccuagccagaacaaucagacaagagaaagaaauaaagggcauccaaaucaguaaagaggaacucagauugucacuguuugcugaugauaugaucguuuaccuugaaaacccuaaggacuccucuagaaagcuccuagaacugacaaaagaauucaguaagguuucuggauacaagauuaauguacacaaaucaggagcucuucuauacaccaacagugaccaagcagagagucaaaucaagauccccuuuuacaauagcugcaaaaaaauaaaauauuuaggaauauaucuaaccaaggagucaaaagaccucuacaagaaaacuacaaaacacaggccaggugcgguggcucaugccuguaaucccagcacuuugggaggccaaggcaggcagaucacgaggucaggagauccagaccauccuggcuaccacaaagaaauccugucucuacuaaaaauacaaaaaauuagccgggcgugguggcaugcaccuguagucccagcuacucgggaggcugaggcaggagaauggugugaacccaggaggcggagcuugcagugagcagagaucacaccacugcgcuccagccugggcgacagagcuagacuccaucucaaaaaaaaaaaaaaaaagcaaagaaaagaaaacuacaaaacacugcugaaagaaauuggagacaacacaaacaaauggaagcacaucccaugcucauggauggguagaaucaauacugugaaaacgaccauacugccaaaagcaaucuacaaauucagugcaauccccaucauucuucauagaauuagaaaaaaaacaauucuaaaauucauauggacccaaaaaagagccugcauagccaaagcaagacuaagcaaaaagaacaaaucuggaggcaucaaacuaucugauuucaaacuauacuauaaggccauagucaccaaaacagcaugguacucguauaaaaauaggcacauagaccaauggaacaaaauagagaacccagaaauaaacccaaauacuuacagccaacugaucuucaacaaagcaaacaaaaacacaaaguggggaaaggacacccuuuucaacaaauggugcugggauaauuggcuagccacauguaggagaaugaaacugaauccucaucucuuuguacaaaaaucaacucaagauggauuaaggacuuaagccuaagaccugaaacuauaaaaacucuagaagauaacauuggaaaaacccuucuagacauuggcuuaggcaaggauuucaugaccgagaaccgaaaagcaaaugcaauaaaaacaaagauaaauagcugggacagcugggaccuaacuaaacuaaagggcuuuugcauggcaaaaggaacagucagcagaguaaacagacagcccacagagugggagaaaaucuucacuaucuguacaucugacaaaggacuaauauccagaaucuacaacaaacuuaaacaaaucaguaagaaaaaaacaaucccaucaaaauaugggcuaaggacaugaauagauaauucucaaaagaagauacacaaauggccaacaaacauaaagaaaugcucagcaucacuaaugaucaggaaaaugcaaaucaaaaccacauugagauaccaccuuacuccuguaagaauggccauaauaaaaaacucaaaaaacaguagaugcuggcauggauguggugaacagggaacacuucuacacugcuggugggaauguaaacuaguacaaccacuguggaaaacuguggagauugcuuaaagaacuaaaaguagaacugccauuugauccagcaaucccacuggguaucuacccagaggaaaagaagccauuauucaagaaagauacuugcacaugcauguuuauggcaacacauucacaauugcaaaaucguggaaccaacccaaaugcccaucaacgaguggauaaagaaacucugguauauauauacaauugaauacuaugcagccauaaaaaggaauaaguuaacagcauuugcagugaccuggaugagauuggagacuauuuuaagugauguaacucaggaauggaaaacuaaacauuguauguucucacugauaugugggagcuaagcuauaaggaugcaaaggcauaagaaugauacaauggacuuggggacuuggggggaaaagugggaagggggugaagaauaaaagacuacaaauacggugcaguguauaaugcucgggugauggugcaccaaaaucucagaaaucaccacuaaagaaccuacucauguaaccaaauaccuccuguaccccaauaacuuacggaaaaauaaaauaaauuaaaaacagaaauuaagaagauugacccaagagaaaauauaacaaaagucuuuuuauuuauuucauuuuuaaaaauaaaguuaaauucauuuuguuuuugagacagagucucacuuugucacccgggcuggagugcaguggugugauuucaucucacugcauccucugccucccaguucaggcaauucagccuccugccuggcaaauuuuuguauuuuuaguagagaugaggcuucaccauguuggucaggcuggucuugaacuccuaaccucaggugauccacccgccuuggccuuccaaggugcugggauuacaggcgugagccacuaugccuggcccuaaaaaaguauuuucauacacuacauggugggauccagcgagcagaaacugcucagauauuuccucgcccuuuaugagcacauaugcuucucauaucgaucaugugcauuuguauucugaaugaucguuguuggaugacugaaaacgaguaacacagccguuaccugaaauguggaccuucuuucucuuaaaaaaaauuuuaggugccagauuuucucauaagcuuuggcagaccugauaacaaacagcucagcagguggaauguugaagcacucaaagcaagccucccaugcugucaggaguugguguggguggagugggcuagggugggaggggcuaaaugagcagguuccuuucacuacuucccucacccccucaugauagaauggcagguggguucuggcaaagccaagguagaagauagagaaauccugcuuccaggcagagcaaugggcuccugcagguaacaccguuguggcucuaagcccaugaugugcgcuguggaguagacuugacuuagccugcucagagaccaggucuuuguugugcguauccuucuuaacacucccuccaacauccaggggacaagaaaucaaacauacagacucauccuguuuguguuuucucugaaaacuaagaauccugagguguaaguucuuuuguuccucugcuuucucccuuucaucuuguuuguccuugaacucaacagggggcuuuggaggaggucucaaaauuugguccaagaaauaaacaccaagaggauaagacccccuuccaguuggcucacucgaaauuuaaaagccaucauuucccuuauccugccccuccguucuaagugagacuucaaaacaaaacaaaacaaaacccucugugccuggaguagccauugcauacacugcuaaguuauagcuggccucucacugcuugauggugauaagaaaccuacuaaaucuagaaagaacuuuggaucuugagguucugaaaacugcagccauuggucagaagcauguaguucccuuuccaacaggguuugucuauaaguuagacauuggauguugacagaggcuauuucaaacacaugcuucagcuugaauuaugauagccuugacaaagcuuuugauuccaccucuccaguguuuuucuucucuuucuuguuguuaggaauaugauugguucucuuauuacccucauguguccuugggggagagugu

SEQ ID NO: 18951 - RNA, 13291 nt, Homo sapiens
acacucucccccaaggacacaugaggguaauaagagaaccaaucauauuccuaacaacaagaaagagaagaaaaacacuggagagguggaaucaaaagcuuugucaaggcuaucauaauucaagcugaagcauguguuugaaauagccucugucaacauccaaugucuaacuuauagacaaacccuguuggaaagggaacuacaugcuucugaccaauggcugcaguuuucagaaccucaagauccaaaguucuuucuagauuuaguagguuucuuaucaccaucaagcagugagaggccagcuauaacuuagcaguguaugcaauggcuacuccaggcacagaggguuuuguuuuguuuuguuuugaagucucacuuagaacggaggggcaggauaagggaaaugauggcuuuuaaauuucgagugagccaacuggaagggggucuuauccucuugguguuuauuucuuggaccaaauuuugagaccuccuccaaagcccccuguugaguucaaggacaaacaagaugaaagggagaaagcagaggaacaaaagaacuuacaccucaggauucuuaguuuucagagaaaacacaaacaggaugagucuguauguuugauuucuuguccccuggauguuggagggaguguuaagaaggauacgcacaacaaagaccuggucucugagcaggcuaagucaagucuacuccacagcgcacaucaugggcuuagagccacaacgguguuaccugcaggagcccauugcucugccuggaagcaggauuucucuaucuucuaccuuggcuuugccagaacccaccugccauucuaucaugagggggugagggaaguagugaaaggaaccugcucauuuagccccucccacccuagcccacuccacccacaccaacuccugacagcaugggaggcuugcuuugagugcuucaacauuccaccugcugagcuguuuguuaucaggucugccaaagcuuaugagaaaaucuggcaccuaaaauuuuuuuuaagagaaagaagguccacauuucagguaacggcuguguuacucguuuucagucauccaacaacgaucauucagaauacaaaugcacaugaucgauaugagaagcauaugugcucauaaagggcgaggaaauaucugagcaguuucugcucgcuggaucccaccauguaguguaugaaaauacuuuuuuagggccaggcauaguggcucacgccuguaaucccagcaccuuggaaggccaaggcggguggaucaccugagguuaggaguucaagaccagccugaccaacauggugaagccucaucucuacuaaaaauacaaaaauuugccaggcaggaggcugaauugccugaacugggaggcagaggaugcagugagaugaaaucacaccacugcacuccagcccgggugacaaagugagacucugucucaaaaacaaaaugaauuuaacuuuauuuuuaaaaaugaaauaaauaaaaagacuuuuguuauauuuucucuugggucaaucuucuuaauuucuguuuuuaauuuauuuuauuuuuccguaaguuauugggguacaggagguauuugguuacaugaguagguucuuuaguggugauuucugagauuuuggugcaccaucacccgagcauuauacacugcaccguauuuguagucuuuuauucuucacccccuucccacuuuuccccccaaguccccaaguccauuguaucauucuuaugccuuugcauccuuauagcuuagcucccacauaucagugagaacauacaauguuuaguuuuccauuccugaguuacaucacuuaaaauagucuccaaucucauccaggucacugcaaaugcuguuaacuuauuccuuuuuauggcugcauaguauucaauuguauauauauaccagaguuucuuuauccacucguugaugggcauuuggguugguuccacgauuuugcaauugugaauguguugccauaaacaugcaugugcaaguaucuuucuugaauaauggcuucuuuuccucuggguagauacccagugggauugcuggaucaaauggcaguucuacuuuuaguucuuuaagcaaucuccacaguuuuccacagugguuguacuaguuuacauucccaccagcaguguagaaguguucccuguucaccacauccaugccagcaucuacuguuuuuugaguuuuuuauuauggccauucuuacaggaguaaggugguaucucaaugugguuuugauuugcauuuuccugaucauuagugaugcugagcauuucuuuauguuuguuggccauuuguguaucuucuuuugagaauuaucuauucauguccuuagcccauauuuugaugggauuguuuuuuucuuacugauuuguuuaaguuuguuguagauucuggauauuaguccuuugucagauguacagauagugaagauuuucucccacucugugggcugucuguuuacucugcugacuguuccuuuugccaugcaaaagcccuuuaguuuaguuaggucccagcugucccagcuauuuaucuuuguuuuuauugcauuugcuuuucgguucucggucaugaaauccuugccuaagccaaugucuagaaggguuuuuccaauguuaucuucuagaguuuuuauaguuucaggucuuaggcuuaaguccuuaauccaucuugaguugauuuuuguacaaagagaugaggauucaguuucauucuccuacauguggcuagccaauuaucccagcaccauuuguugaaaaggguguccuuuccccacuuuguguuuuuguuugcuuuguugaagaucaguuggcuguaaguauuuggguuuauuucuggguucucuauuuuguuccauuggucuaugugccuauuuuuauacgaguaccaugcuguuuuggugacuauggccuuauaguauaguuugaaaucagauaguuugaugccuccagauuuguucuuuuugcuuagucuugcuuuggcuaugcaggcucuuuuuuggguccauaugaauuuuagaauuguuuuuuuucuaauucuaugaagaaugauggggauugcacugaauuuguagauugcuuuuggcaguauggucguuuucacaguauugauucuacccauccaugagcaugggaugugcuuccauuuguuuguguugucuccaauuucuuucagcaguguuuuguaguuuucuuuucuuugcuuuuuuuuuuuuuuuuugagauggagucuagcucugucgcccaggcuggagcgcaguggugugaucucugcucacugcaagcuccgccuccuggguucacaccauucuccugccucagccucccgaguagcugggacuacaggugcaugccaccacgcccggcuaauuuuuuguauuuuuaguagagacaggauuucuuugugguagccaggauggucuggaucuccugaccucgugaucugccugccuuggccucccaaagugcugggauuacaggcaugagccaccgcaccuggccuguguuuuguaguuuucuuguagaggucuuuugacuccuugguuagauauauuccuaaauauuuuauuuuuuugcagcuauuguaaaaggggaucuugauuugacucucugcuuggucacuguugguguauagaagagcuccugauuuguguacauuaaucuuguauccagaaaccuuacugaauucuuuugucaguucuaggagcuuucuagaggaguccuuaggguuuucaagguaaacgaucauaucaucagcaaacagugacaaucugaguuccucuuuacugauuuggaugcccuuuauuucuuucucuugucugauuguucuggcuaggacauccaguacuguguugaaaaggagugguaagagugggcauccuugucuuguuccaguucucagagggaaugcuuucaacuuuuccccguucaguauuaugacaaacccacaaccaacauaauacugaaaagaaaucaaaacaaaaaucacaugaucaucucaauagaugcagaaaaaucauuaaacaaaauccagcaucgcuuuaugauuaacacucucagcaaaaucagcauacaagggacauaccuuaaugugguuuucuuuuuuugguuguccuuuccugguuuuguuauuagggugaugcuggcuucauagaaugaauuagggaggguucccucuuuaucuuguggaauagugucaaaaugauuggcaccaauucuucuuugaaugucugguagaauucugcuguuaaucugucugguccuggacuucuuuuuguuguuguuagcaauuuuuaaguuaucauuucaaucuugcugcuuguuauuggucuguucaugguaucucauccuuccugauuuaagcuaggaggauuguauuuuucuaggaauauauccaucucuucuagguuuucuaguuuaagugcauaaagguguucauaguagccuugacuaaucuuuuguauuucaguggugucaguugugguaucuccuguuuuauuucuuagugagguuuuuugaauuuucucucuucuucccuugauaaaucuugcuaauggucuaucaauuuuacuuaucuuuucaaagaacauuuuuuguuucauuuaucuuuuguauuguuguuguuguuucaauuuaauuuaguucugcucugaucuugguuauuuccuuuauucugcuggguuugaguuugguuuguucuuguuucucuaguuccuugaggugugaccuuagauugucuguuuguacucuuucagacuuuuugauguaggugcucagggauaugaacuauccucuuagcacugccuuugcuguaucccagagguuuugauagguugugucauuauugucauucaguuugaagaauuuuuuaauuuccaucuugaucuuguuuuugacacaacgcucauucaggagcagguuguucaauuuccauguuauuugcaugguuuugaagguuccuuuuacaguugauuuccaguuuuauuccacuguggucucagagaguacuugauauaauuucaguucucuuaaauuuagugaggcucauuuuauggucuaucauauggucuaucuuggagaaaguuucaugcacuguugaauagaauguguauucugcaguuguuggauaaaauguucuguauguaucuguuaaguccauuuguuccaaggcauaauuuaaauccauuguuucuuuguugacuuucugucuugaugaccugucuagugcugucaguggaguacugaagucccucacuauuauuguguugcugucuaucucauuucuuaggucuauucguaauuguuuuauaaauuugggacuuccaguguuaggugcauauauguuuaggauugugauauuuuccuguuggacaaggccuuuuaccauuauauacugucccucuuugucucuuuuaacugcuguugcuuuagaguuuguuuugggccgggugcagugacucaugccuguaaucccagcacuuugggaggccgagguggguggaucaugaugucaggaguucaagaccagccugaccaacauggugaaacccagucucuacuaaaaauacaaaaauuagccgggcaugguggcacgugccuguaaucucagcuacucaggaggcugaggcaggagaaucgcuugaacccgguggcgaauguugcagugagcugagaucacaccauugcgcuccagccugggugacagagggagacucugucucaaaaaaaaaaaaauuuguuuugucugauauaaaaauagcuaccccugcucauuuuggguguccauuugcaugaaacgccuuuuuuucaccccuuuacuucaaguuuaugugagucuuuauguguuaggugaguguccugaaggcagcagaugguuggugaguucuuauccauucugcgguucuguaucuuuuaaguggggcauuuaggccauuuacauuguuaguauugaaaugugguguaccguaccguagcauucauugugcucuuuguugcguguguacuuugguuuuuguuuuugcuuuuuaacuuguauuuuuguuuuauagguccuaugugauuuaugccuuaaagagguucuguuuuguuguguuuccaggauuuguuucaagauuuagagcuccuuuuagcaguuuuuguagugguagcuugcuaauggcaaauucucucagcauuuguuugucugaaaaugucuaucuuuccuucauaagugaugcuuaguuucacuggauacaaaauucuuggcugguaauuguuuugcuugaggaggcugaagauagguccccagucccuucuagcuuuuaggguuucugcugagaaauaugcuuuuaaucugauagguuuuccuuuauagguuagcuggugcucugucucaguucuuaagacucuuuccuucaucuuaacuuuggauaaucugaugacaaugugccuaggugaggaucugcuugugaugaauuucccagguguucuuugugcuucuuguguuuggcuaucuaggucucucacaaggccggggaaguuuuccucgauuauucccccaaauacauuuuccagacuuuuagaauuuucuucuuccacagguacaccgauuauuauuagguuuggugguuuaacauaaucccagacuucuuggaggcuuuguucauauuuucuuauucuuuuuuucuuugucuuuguuggauuggguuaauuugaagaccuugucuucaagcucugaauuucuuucuucuacuuguucaauucuauugcugagacuuuccagggcauuuugcauuuuuaaaagaguguccaaaguuuccugaauuuuuuauuguuuuuucuuuaagcuaccuauuuccaugaauauuucucccuucacuucuugugccaguuuuuggauuuccuugcauugggcuuugccuuucucugguaucccccugauuagcuuaauaacuaaccucuucaauucuuauucagguaaaucaaggauuucuucuugguuuggauccauugcuggugaacuagugugguuuuuggggggggguguuagaauaaccuuguuuugucauauuaccacgguugguuuucugguuccuucucauuuggguaggcucugucagagggaaggucuagggcuaaaggcuguuguucagauucuuuugccccacgggguguucccuugauguaguacucucccccuuuuccuauggguguggcuuccugugagcugaacugcagugauuguugucucucuucugggucuagccacccauacagucuacccggcuccaggcugguacuggggguugucugcagaguccugugaugugagccaucuaugggucucucaguagauagauaccagugccuguucugguggaggugguggugggugcaauggacuccaugaggcuucuuagcuuuggugguuuaaugcucuauuuuugugcugguuggucuccugccaggagguggugcuuuccagaaaacaacagcugugguaguguggagagggaccagcggugggcagggccuuagaacucccaagauuauaugcccuuugucuuccacuaccaggguugguagggaaggaccauugggugggggcagggcuagguaugucugagcucagacucuccuugggcaggucuugcugcagcugcugugggggaugggggugagauucccaggucacuggaguuguguaccuaggaggauuauggcugccuuugcugagucaugcagguuaccagggaaguuggggaaauacagcagucacaggccucacccagcucccaugcaaacugaagggccagucucacuuccaccgugcccuccccaacagcuccaagucuguuuccaggaggagagugagagggacuugagaacucgaccgaggcuauuugccucccagaguauuuggggugucuccuggguccugcagaagcaacccgcuuccuucagagggacugugggcccucucgggauugcugguuuguucuuuaguccaucuggagcuccacagcccuccccgcaggacccgccagcacaacgaacagcagccugccaaccgucuuaauuuuugugcaaauaucucagccuccuuuuaaugcucuuuuggaaaacagacacauuugugaaucugcuaaaggauguggaccuuguccuggaaaacccacauacuuuaacauacaacuucgagacauuaauacaucuauuagaauccauauauagaacauccucagagguccauagacccaaaguuuccuucuggaccucuggucuacaaggaaaaaaaaauaguuaacauuuacugaguaucuauuauaugccaggcacuauuccagguguuaaacagauuuuucucaauuaaucaugacaacccuauggaguagguacacuguucucuauuuuacugacaagaaaacaguagcagagaaugucacuugcuccauccaggucaacagccaguaaaugacagagcagggagccucuccucuaagccaguaagucacagcugugaaaucaaagacauguaagcaauuuuaaaaaauuguguaugguuacacacaccauaaucauagccucuuucuuuuggggugggggagcaugugaauaauuugccucuccagagaucugagaaaguagagaugauguggcacuguuugguggggagauacuuggcuaaguaucucaggcccaccacuaauauucauggcacaacacaaaacaaaagcuagucaggcccaccacuuggcuucccaagaauagucugugguggugacaguaguccuugaacuuugagcucuugcccauguaacugagauuagugcugggauccaaaauuuaaauuaucucuaggggcuaagaauguaaugcaauugugacacacagguuggaauaaggcagguggguggcgggggcguggucaaauggagaguacauguccugucucaagacauucacguuuaagaaaaacaaaccccaugagggccaaacaaaagacauauucagacugggugcaguggccuguaaucccaggacuuugggaggcccaggcaggcagaucacuugagcucaggaguuugagaccagccuggguaacauugugaaacccugucucuacuaaaaauacaaaacuuagccaagcgugguggcacaggccuguaaucccagcuacuuaagaggcugaggcacgugaaucgcuugaacuggggagacagagguugcagugagcugaaaucgcaccacugcacuccagccugggcaacagagcaagacucugucuccaaaaaaaagacauaaaaaaaaaagacauauucagacauauucagcccagugggccaucaguuugugaccugugaauagacuguucccuucccacucuccagguuuuuccaagucaggagccaggaaugcagggaaugcagucucugggaaggggacacaagcugacccaugugacaaucaacguugugauuuccauuccguuagagcuaugcuuuuuacaugcuaaccaacccagcaguaggucacuagcagaaagguccagacaccagagaugaagaaacaucaggaaguaaaugauaguacacaggacguaccucauacauagagcgcauucaaggucagaugcgucgaaagaugcaagugguaaacugagagcagguuugucccccugaucagugggaggaucugcgauuuagaaagcaagaagucagcgcuggagccaccccgguuucauagauaguacuucugaggcaaaauaauccaaugcguuuuucaguuugccacucucaccaccaccucccagagaguugauuuaguggacaccugagccguugagaaugggacacucagaaguaggcucucagagguuuccagcaggcccaacagaaagagaaaugcaagucaaacaauguccaggagcccuggggacuucauucaaaugcaacaugcaccucugucaacagcagaagcuacagcaacucaauggacugagccaggccuucaaagcuaaaacugaaucuuggcacugccaaccucucguggaaagauagcaagccacagcugcugcuucucacaugccuaccuaugggaacacaacugggaaugagcagggugaggccugaccucacuuuccucauccugcauuccuagaauggggauggggguagcaagaggcugaccuagaaggaaguggcauccccauggguaugggaugucauuaguugauacugugcuugaccugaugccuuggcuuuccauuauauuaauaauuaguauugaacacuuuuuacagugugcuaggcacuguacaugaucucacagaagccucauagcaaucucugaggucacacagcuaguaaaugccagagcugggccccacacccagagccuaaggagcccccagacagagguaaguaacuuguauauauuggugagcccggggaucuccuccaagcuaccuucucucuggguagagccaguaccuugcuuggaggcuuuauuaggcauccccguuucuucuugggauucaaucuggcaauguuuccuuuucuuuuccuggcauuuuccagucuugcuggaagcagcuuuuggagagguagcaucccacuucuccuccucuucuuccuggucuuucauguggugcugcugaccaucccccuucacuuuagcuggguccaucagacugcugccaucuccccuggcugcugcuuccuccugacuagaacaaugugggagcuccagauuguccuggaugaagaaagggccacauaucagaaucuucuuaggacuaauauuguccucucauauuccuacccagaggaacaaagggaaacuauagaguccugauccccaccccgaacucauaguggacacagagcucaacuugggggccgucauaaggcauuauuuccuacuucuuuucugcacaguaucugcaaccaaggcauucccagcuuggguggaguuagggaacuuccuuaggcaaggacaggaagguauguaggaggagagccuccuugggcagguguaaaaaggggaaaugccagggauaggcaccaguuccccuuccuauaaaauccuuccccaguaaccacuuuagcaaaaccaaggcaggcagugacggcagauccugucacucaauaguuccucucgcccucacugccauucacggccgucugcgauccccaaacuccagcuccaaaaggacuuuugguagggcuuuggcacaggucuguucacaggccugccaaguuaccucaugcuccaggucuguauguuacacuggucaaaugaacaagguacaaacuauuccuuuuacuagauuuggggugaaaagcauuaaaaaaaaaaaaaaagacaaaaucaccuggcaaaaaaaaucaacaaugucucuagccuuuucaagaauauuuucccaggagauggauauuugaaaaaggauuuagaaauaagugcaauaacaacauguuuaugcagauuuacauggagaaccccucucuaaucuaaacccauaguccauaggucaagauacucaucguguuguuucccucuaacccuaccaaaaaaaaacuggcagacaggugaaaaaggggagcauauagcugggagaaaacaaugaggugaggacaaaaauaauguggguuuucucugugucuaacuugggaguugggguuuucuccagcacuacagcaauacuacaaccuugacuuuccaugaacccaaggcauuggccacucaggaguauacugcuuugcaaagcaaaguuuggguggaaauccaauccuuguuccccagcugguugacauuggaaagccaagguugcuguuuuucuucuuuucagauggagcugcaauuagaagucacuccaggcauuuggguucaguauuagcauucucaaucauuuaauagugaucuuaauuauugaaaucacuggggguucugugauuucaggagauccucuaaguucugccauuuuuuaagaaaaguugggcgcaccugcauuucaguccuuuuaugagagcccagggcuuacacacaggagaagaacaccgggcaugaauggagggaaaacugcccccuaaagaugcccaggcauucagugcuaaacucugccuuggagucugcgcuucugauccucaacuucugaccacuuacccucugccgggaaagccagggccuggaacccaucucucuuguguucuguuuccugguuuucaaagaaagguacaaauaccugucuuccucccagguccuucaacucaacuuucuuuccaacaucucuuuccucuucucuguuacaaauacguauuggaagcuuacuuauguauaaggcauagugcaggaauaugaaauuacauccauuugaggaucagaguugucuuugcacaggauaagugcuggcacucaaaggccagcagcuugaacaaacaaaagcucgaaaggagggauuguuaggcccucuucccagacucauccccaaagccuauaaacccacccaaaugguauggcccaggggcagugagccaauuccuuucuagcucuguaaaaucucucucggcuggaucuaaccaagaacuggaaaaaaauguauccuagcacuuuggaaggccaaggugggaggaucacuugaggccaggaguucgagaccagccuaggcaaaaauggugaaaccccgucucuacaaaaaaaaaaaaaaaaaaaaaaaaaaaacuuagccaggcaugguggcacgugccuauagucccagcuacucgggaggcugaggugggaggaucucuugagaccaggagucugaggcugcagugagccaugaucauaucacugcccuccagccugggugauagaaagagacccuguuucauaauuuuuuuucaauguaaugaauaaacucugggaccaugccugaaauucacaguugcaucuuuaagagguucuuugcaaagaacagaaccacuagugacucaauuucuucuuucucaggaaccaaaauaggagagggagggcucacuccccacguuugcccacaaaacagccaaacgaagcgucacgagcgagcugggugaguugaguuuuaccuguaacaaccuugguagauuauggcugguaacuucaguagucauugacucuacguuuuccuuuaaucuagggugaggugccaacagcuucaggauaucgggagaauguuccugagaaucccccgggacugauggugaaaagaaacuaaggagaagcugugacauaaaacagaagacuucacuacuuaaguuucuacagg

SEQ ID NO: 18952 - RNA, 8252 nt, Homo sapiens
ggaggcuccgccccucaggccccgccuccuccccggcuagucuuuggccgccgccgaaccccgcgcgccacucgcucgcucagagggaggagaaaguggcgaguuccggaucccugccuagcgcggcccaaccuuuacuccagagaucauggcugccgaggaugugguggcgacuggcgccgacccaagcgaucuggagagcggcgggcugcugcaugagauuuucacgucgccgcucaaccugcugcugcuuggccucugcaucuuccugcucuacaagaucgugcgcggggaccagccggcggccagcggcgacagcgacgacgacgagccgcccccucugccccgccucaagcggcgcgacuucacccccgccgagcugcggcgcuucgacggcguccaggacccgcgcauacucauggccaucaacggcaagguguucgaugugaccaaaggccgcaaauucuacgggcccgguacgcggccggcgaggggggcuuggagacaaaagaagggggccccggcacggggcugggcgggagagaggcgaggcgggagcggggcgccccugaguggagggaggaauggcggcgagcuaggguaggcggguaggcgggcaggcggagagccgggaggcucccggggcgggcagggaacaagaggcgcucuagaggggcugcgggccagucagggacgcggauccccggcccgcgcugacagcgcugggaggggguuagagaaagaaggcugaggcgcuuaagccgggggugggugggaccacgaagcucgaaggcguugaggggggacacaucaaagcccaggcuguugggguaguuuucgaagguccugggcuuggggauuccuggaaggaggaggggguagugucggguucuaggaaggaaaugaggguguuccgagggaggcaugggggagggcgagagugagaaaagguccagaccuagagaagacgggaaggccaaugacaccgggaguagguuugaaauaugagggugugggagaaaacgccgagacgggauuagcagcagguaaaagcuuugugcccgguggauagugaugugugugugcacucguggugugugcaugcgcggugugugcguguuuaguguaugugauuuaucagggguguguguguguggugugugcaugcgcgcuugaaaugggucaugcgucagguauguguguggcauguguuuggucugugugcgcuugugcuguguguggcagauggggaaaggcuggaaggugaacaaggaggaagggggcuguuugagggaggaauaaaggcugaauaugguggacaaugguaacguggcaagcuuuuaagguaauaugguauuuagucuauagcaggagagaaaggauuagaagccaagaaaaauuaaaauggagggagggagaagugggaggauaccaagaaacaaaaggaguagagcuaagaagacugcuggguggggggauaucaggaaaagccaaccagagggaaaugaagaauggaugacugcugcacugcugagcuguuggagaaggcaggccugauggguuccuuagaggcgagguuuuugcaaaccugguugcguaucagaaucaccugaugcaucugaggaaaaauacagauucccagucuaaccgccagagcugcaaaugagucucgggugguccgggagucuguauuuuaauaugcuucccaggcgaauuugaaaagcagccaggcuugcaaaguccugcuuuauagaauacuuggagaugaggaagaagagguuuuggcuccuccaauauggacuccucuaaacacagggagcuuagaggauguccacauggacggugcucauuccacacuggccugagagagggaagaguacagaaggcaguacacaaacucaggcauucauuuuagucucccaguccaacugaucaaaaucagauguguuaagguuaaggagcucaguuuuuucuugcagacauuuauuuauuauaaaaaauaaauuuuauuuauuuuuuagagacagggucucccuccuguguugcccaggcuggucucgaacuccugggcgcaagcaguccuuccaccuccauuucccaaagugcugggauuacaggcaugagccacugcaccgggccuguggauauuuuagaauaccugcuuucuauaggcauguaacugucaaaaucauuugaaaaccacauacauuauuugucacuuagaguagcacacauaguugcuuuaucaauaaacauaaucauguaaauaccuguuaauauugagcucaauauuaaaggagugaaaacaugugcaugaggcaucaucaugacuguaguuugcagagucauugagaggaugucagccugugcacagagcacaaaacugggagucaggcaaccugcguucuaguccugauugggucaugacuagcugugugaccuugugcaaagcauuguucucucagagccuuaguuuucccucugaaaagugauaaagauggccuauugugagaucucugucucuaucuugcacugucauucagugagcccaugacuacgugacaucuugguagaaagugaugcuucauguuguaaaggauuccuaaaaauuagucauucuagugccuguuaauucugugcaaggcacuguuguagaugugggaauauagcagugagcaaaacagacacaaaucucugccuauggagcuuacguucuagugaauauauguugcacugaauaauauguauuuuuaaaagacuuuuaauguucccacuagagaacauuuaauuguuuaaauguuuaaauauucuaugagguuuaaauauucuauguuuaaauauucuaugagguuugcuugguaaagacucacucuaccaagccaaugaccauaauuucugaaaugguaagguucaaaccauugcauuugccuauucucaagcacuaggugcugccauuuccacuagggguguacauuuaugaaaaaugugggcuuuuuuuuaccuucuuuagugaauguggcagcauguaaugaugauuaaaaauaagcauuuuucuuuggaauuuuacuugcauuuaaaaguuguaaaauuuguaaaaaauuucugaguguauugagguuucaggugaacaggccauauugaaacuugaucuauucucauacuugguucccuacaaacauuuuaaugucagggcugcuauucaaucugccuugggggaaacaacacauuguuuaaaguacacuggauucucuucauuuaguugugcaauauuuaaauaagucuaaauauccacuuuguguacccacagaaugauucucugcucucuuagacaaaaguucaguauaauaucacaaauaaucacauuuuauagaguuguuuuauagaguuguuuugcaguauugauucagccucuuuuccaugaaaauuuuaguauuuucacagucuucucaagcccaccaaaaaacagauaaugaagacugaucucuguguuaucuauuuauugacagugaagguuauguaauguggauagauuuuuaaaccaccgauacuguuauaaaaugguucuucugcagaugccaugaguuaauguuuaauugagccuuggaaccaaagaucucuauaagauaccuuuguuucauuaaaacauaucagaauauauucauaaggaaauguguuuucauguacacaucagugcuuauuaucuuaagaaaccauaacucucacugguguagccccaagugccuagaacugucaggcucccaguucaauguucuuguaugauucccuacuaccacuaccccaagagaucacuaaccacguaugacuuuuuuacuagcuauuuggaaaccacaggagacugacgcaaauguauagcaguuugauuuacuuuuaguuauuuaaaaguuaaaugacaacaggucuuucugugucuccuacauaauguucagaauaucagcauuacuaugguuuccuaauggaauuugauauucaaaaauggggcuauguugaugaauagggaagccauuuucuguguauaaaucacagagaaauugacugucuaauaaagaauugaucuuugguuuuguuuuugaagaggggccguauggggucuuugcuggaagagaugcauccaggggccuugccacauuuugccuggauaaggaagcacugaaggaugaguacgaugaccuuucugaccucacugcugcccagcaggagacucugagugacugggagucucaguucacuuguaagcauuuuuaaaauugugucugggucaaauuucuaccaguaauggggauucguggcaggacaauaguuauuacuaagcagccugaaacuugggugcauuuugauaggcuccuuaaucuuggacgcaucaaguucauggcuugaaguaauuguagcagugcugagucacuugcuaugauugcauaccaauuuuuagccaguucucuauggaaacuuggguuucugguuuugauuuuaaaauuuuugagagauuugcuagauuccaaaugaggauuuggugcuuggugugucagggaaaggacaguguccaucuuggcuacagaaagggauuuucauaagcccucucuuguagagcuugccguuuaaaagcagcccacaucucuguugaagaaugggagacuuguauucugugaaacagcuucucuuugaaucuaauugaaccuaacuauaggccucaucuacaaaugaugcuuauaaugugcccagcagcaauggugucugcauuuuuaaaaagaaaguaaaaaggagaugcuuguuucuggcuuaugcuaugggcugaggucuuuggggagaaauaggaaugagggguuaaguucagauuuugagaauucaggaauugguuucugucaaaucuaacuguuuaauugucacucuagcaauauuucacugccaagaauuugaauaagagucuuucccagcuuuuaugaaacaguauauaaagaccaugagcauuauuugaagauuuuucauuuaaaauguaguuuucuauguguguucucuauaaucaguuaaauauuacauguucucuuggcuauauccaaccauuuucuuugaaaauaaugcugacuucagagagaguucuggauuaauaauuagccagaugugucucugccuuugaguuuuggucucaagcaggcuacauauaacuuccaagucuagaggcaaguuuuuauacuuuggaaaacauaguucaguuaccuaauagagucccuaauuuuuggcaucauaaggaugccuuuguaauuaguuuucuauaugaaaccagugaauuguagugucuaacuuacaaagcucuauuuucuagggcuugccuucaucagugggagaaaaagugugauuuuuuuuuuccacuuuaaggcuagccccagaugcuguugugacaccucagcuacacuuaaaguugguguggauuccccuuaaggcagguuucccaggagccaccuggcuuuuauuugucucacacaguuccaauuguucccaacgguuauuucacacaaaagcagcuuuaguuaccugguuagacagguugguuacuccucuaauuccuacucauauucaggaagaggagacucuuggcuuuggacauucagaugaucgacccugcauuaguuuggcuacagugaugaggugguuugcugaugccaucucuucucaagucuuuugcauucugguuugcacccuuacaucuguuuucuccaacaccuccagucaucuccuggcuccuuuaccacuuccuuuaaccacccauagguuuuucucugugcugggaaaaacguucugucucuugcucuccucuucaucuaugagacuauuauuccuuccuuucacugucaaacaaacuucuuacaaguuuuuauuccuaaccacuacuucauuuccucucuauaccuucuuccucccuacaauauggcuucuauccccacaauuggauugaacucucuuucugaaagauuuucagggaaaccuuuuuuuuuuuucuugccaauccugacuucacuuguccauuccauguuuuagaucuccugucaugugagccuccagaauggcucccuccacagaguucccauuuugguccaugggagcuccaauuuucacuuaauuaauucaugcuuccaguuuucuuucaaaguacuucucaucugucccuuuccauuccccuggacaccacccugcuccuggcgcugguuccuuugcaucuggaucugcacucugccucuggaucgcccuguucccagucucuccuuacugaaaucugcccuauacaccacauugauaauaucguuguuaaagcacuauuuuacugugucauuccuucgcuuauaaaccuucagugcccuuugccaccuauaaguccaaacucaggcuggcuuuucagaucuuucauaauauuuccccacacuacuuagccaaucuuaucuccuacuaacuucuaaauguuaacucuacuccugccaacuuggucucuucauugcuucccagauacguugucucaccuguaugcauuuguacauggcguuugcauuuucuggaacucccucccuaaauccuucuauacauuuuuccaaaauauauccuccuuccaugaaguauucuguaacccuucugaugaacucaucacuugcccuuguucuucuaaacauuccuuacacacaaacaauucauuuugacguuaccuugcacacucauugccagacguugccaccuguuuuauaugucugucuucugaacaaaacaaauucccuguuggcaaggacggugguauaaaccaccuuuguauccuucaagaagcccaacacauugcugaguauauugcaggccucuaauaaaugcuuuaaauugaaacgugguaaugauguuuuagaaagaaugagaaugaccauuuguguuuucuucucuaccuccagucaaguaucaucacgugggcaaacugcugaaggagggggaggagcccacuguguacucagaugaggaagaaccaaaagaugagagugcccggaaaaaugauuaaagcauucaguggaaguauaucuauuuuuguauuuugcaaaaucauuuguaacaguccacucugucuuuaaaacauagugauuacaauauuuagaaaguuuugagcacuugcuauaaguuuuuuaauuaacaucacuagugacacuaauaaaauuaacuucuuagaaugcaugauguguuugugugucacaaauccagaaagugaacugcagugcuguaauacacauguuaauacuguuuuucuucuaucuguaguuaguacaggaugaauuuaaauguguuuuuccugagagacaaggaagacuuggguauuucccaaaacagguaaaaaucuuaaaugugcaccaagagcaaaggaucaacuuuuagucaugauguucuguaaagacaacaaaucccuuuuuuuuucucaauugacuuaacugcaugauuucuguuuuaucuaccucuaaagcaaaucugcaguguuccaaagacuuugguauggauuaagcgcuguccaguaacaaaaugaaaucucaaaacagagcucagcugcaaaaaagcauauuuucuguguuucuggacugcacuguuguccuugcccucacauagacacucagacacccucacaaacacaguagucuauaguuaggauuaaaauaggaucugaacauucaaaagaaagcuuuggaaaaaaagagcuggcuggccuaaaaaccuaaauauaugaugaagauuguaggacugucuucccaagccccauguucaugguggggcaaugguuauuugguuauuuuacucaauugguuacucucauuugaaaugagggagggacauacagaauaggaacagguguuugcucuccuaagagccuucaugcacaccccugaaccacgaggaaacaguacagucgcuagucaagugguuuuuaaaguaaaguauauucauaagguaacaguuauucuguuguuauaaaacuauacccacugcaaaaguaguagucaagugucuaggucuuugauauugcucuuuugguuaacacuaagcuuaaguagacuauacaguuguaugaauuuguaaaaguauaugaacaccuagugagauuucaaacuuguaauugugguuaaauagucauuguauuuucuugugaacuguguuuuaugauuuuaccucaaaucagaaaacaaaaugaugugcuuuggucaguuaauaaaaaugguuuuacccacuau

SEQ ID NO: 18953 - RNA, 8252 nt, Homo sapiens
auaguggguaaaaccauuuuuauuaacugaccaaagcacaucauuuuguuuucugauuugagguaaaaucauaaaacacaguucacaagaaaauacaaugacuauuuaaccacaauuacaaguuugaaaucucacuagguguucauauacuuuuacaaauucauacaacuguauagucuacuuaagcuuaguguuaaccaaaagagcaauaucaaagaccuagacacuugacuacuacuuuugcaguggguauaguuuuauaacaacagaauaacuguuaccuuaugaauauacuuuacuuuaaaaaccacuugacuagcgacuguacuguuuccucgugguucaggggugugcaugaaggcucuuaggagagcaaacaccuguuccuauucuguaugucccucccucauuucaaaugagaguaaccaauugaguaaaauaaccaaauaaccauugccccaccaugaacauggggcuugggaagacaguccuacaaucuucaucauauauuuagguuuuuaggccagccagcucuuuuuuuccaaagcuuucuuuugaauguucagauccuauuuuaauccuaacuauagacuacuguguuugugagggugucugagugucuaugugagggcaaggacaacagugcaguccagaaacacagaaaauaugcuuuuuugcagcugagcucuguuuugagauuucauuuuguuacuggacagcgcuuaauccauaccaaagucuuuggaacacugcagauuugcuuuagagguagauaaaacagaaaucaugcaguuaagucaauugagaaaaaaaaagggauuuguugucuuuacagaacaucaugacuaaaaguugauccuuugcucuuggugcacauuuaagauuuuuaccuguuuugggaaauacccaagucuuccuugucucucaggaaaaacacauuuaaauucauccuguacuaacuacagauagaagaaaaacaguauuaacauguguauuacagcacugcaguucacuuucuggauuugugacacacaaacacaucaugcauucuaagaaguuaauuuuauuagugucacuagugauguuaauuaaaaaacuuauagcaagugcucaaaacuuucuaaauauuguaaucacuauguuuuaaagacagaguggacuguuacaaaugauuuugcaaaauacaaaaauagauauacuuccacugaaugcuuuaaucauuuuuccgggcacucucaucuuuugguucuuccucaucugaguacacagugggcuccucccccuccuucagcaguuugcccacgugaugauacuugacuggagguagagaagaaaacacaaauggucauucucauucuuucuaaaacaucauuaccacguuucaauuuaaagcauuuauuagaggccugcaauauacucagcaauguguugggcuucuugaaggauacaaaggugguuuauaccaccguccuugccaacagggaauuuguuuuguucagaagacagacauauaaaacagguggcaacgucuggcaaugagugugcaagguaacgucaaaaugaauuguuuguguguaaggaauguuuagaagaacaagggcaagugaugaguucaucagaaggguuacagaauacuucauggaaggaggauauauuuuggaaaaauguauagaaggauuuagggagggaguuccagaaaaugcaaacgccauguacaaaugcauacaggugagacaacguaucugggaagcaaugaagagaccaaguuggcaggaguagaguuaacauuuagaaguuaguaggagauaagauuggcuaaguaguguggggaaauauuaugaaagaucugaaaagccagccugaguuuggacuuauagguggcaaagggcacugaagguuuauaagcgaaggaaugacacaguaaaauagugcuuuaacaacgauauuaucaaugugguguauagggcagauuucaguaaggagagacugggaacagggcgauccagaggcagagugcagauccagaugcaaaggaaccagcgccaggagcagggugguguccaggggaauggaaagggacagaugagaaguacuuugaaagaaaacuggaagcaugaauuaauuaagugaaaauuggagcucccauggaccaaaaugggaacucuguggagggagccauucuggaggcucacaugacaggagaucuaaaacauggaauggacaagugaagucaggauuggcaagaaaaaaaaaaaagguuucccugaaaaucuuucagaaagagaguucaauccaauuguggggauagaagccauauuguagggaggaagaagguauagagaggaaaugaaguagugguuaggaauaaaaacuuguaagaaguuuguuugacagugaaaggaaggaauaauagucucauagaugaagaggagagcaagagacagaacguuuuucccagcacagagaaaaaccuaugggugguuaaaggaagugguaaaggagccaggagaugacuggagguguuggagaaaacagauguaagggugcaaaccagaaugcaaaagacuugagaagagauggcaucagcaaaccaccucaucacuguagccaaacuaaugcagggucgaucaucugaauguccaaagccaagagucuccucuuccugaauaugaguaggaauuagaggaguaaccaaccugucuaaccagguaacuaaagcugcuuuugugugaaauaaccguugggaacaauuggaacugugugagacaaauaaaagccagguggcuccugggaaaccugccuuaaggggaauccacaccaacuuuaaguguagcugaggugucacaacagcaucuggggcuagccuuaaaguggaaaaaaaaaaucacacuuuuucucccacugaugaaggcaagcccuagaaaauagagcuuuguaaguuagacacuacaauucacugguuucauauagaaaacuaauuacaaaggcauccuuaugaugccaaaaauuagggacucuauuagguaacugaacuauguuuuccaaaguauaaaaacuugccucuagacuuggaaguuauauguagccugcuugagaccaaaacucaaaggcagagacacaucuggcuaauuauuaauccagaacucucucugaagucagcauuauuuucaaagaaaaugguuggauauagccaagagaacauguaauauuuaacugauuauagagaacacacauagaaaacuacauuuuaaaugaaaaaucuucaaauaaugcucauggucuuuauauacuguuucauaaaagcugggaaagacucuuauucaaauucuuggcagugaaauauugcuagagugacaauuaaacaguuagauuugacagaaaccaauuccugaauucucaaaaucugaacuuaaccccucauuccuauuucuccccaaagaccucagcccauagcauaagccagaaacaagcaucuccuuuuuacuuucuuuuuaaaaaugcagacaccauugcugcugggcacauuauaagcaucauuuguagaugaggccuauaguuagguucaauuagauucaaagagaagcuguuucacagaauacaagucucccauucuucaacagagaugugggcugcuuuuaaacggcaagcucuacaagagagggcuuaugaaaaucccuuucuguagccaagauggacacuguccuuucccugacacaccaagcaccaaauccucauuuggaaucuagcaaaucucucaaaaauuuuaaaaucaaaaccagaaacccaaguuuccauagagaacuggcuaaaaauugguaugcaaucauagcaagugacucagcacugcuacaauuacuucaagccaugaacuugaugcguccaagauuaaggagccuaucaaaaugcacccaaguuucaggcugcuuaguaauaacuauuguccugccacgaauccccauuacugguagaaauuugacccagacacaauuuuaaaaaugcuuacaagugaacugagacucccagucacucagagucuccugcugggcagcagugaggucagaaaggucaucguacucauccuucagugcuuccuuauccaggcaaaauguggcaaggccccuggaugcaucucuuccagcaaagaccccauacggccccucuucaaaaacaaaaccaaagaucaauucuuuauuagacagucaauuucucugugauuuauacacagaaaauggcuucccuauucaucaacauagccccauuuuugaauaucaaauuccauuaggaaaccauaguaaugcugauauucugaacauuauguaggagacacagaaagaccuguugucauuuaacuuuuaaauaacuaaaaguaaaucaaacugcuauacauuugcgucagucuccugugguuuccaaauagcuaguaaaaaagucauacgugguuagugaucucuugggguagugguaguagggaaucauacaagaacauugaacugggagccugacaguucuaggcacuuggggcuacaccagugagaguuaugguuucuuaagauaauaagcacugauguguacaugaaaacacauuuccuuaugaauauauucugauauguuuuaaugaaacaaagguaucuuauagagaucuuugguuccaaggcucaauuaaacauuaacucauggcaucugcagaagaaccauuuuauaacaguaucggugguuuaaaaaucuauccacauuacauaaccuucacugucaauaaauagauaacacagagaucagucuucauuaucuguuuuuuggugggcuugagaagacugugaaaauacuaaaauuuucauggaaaagaggcugaaucaauacugcaaaacaacucuauaaaacaacucuauaaaaugugauuauuugugauauuauacugaacuuuugucuaagagagcagagaaucauucuguggguacacaaaguggauauuuagacuuauuuaaauauugcacaacuaaaugaagagaauccaguguacuuuaaacaauguguuguuucccccaaggcagauugaauagcagcccugacauuaaaauguuuguagggaaccaaguaugagaauagaucaaguuucaauauggccuguucaccugaaaccucaauacacucagaaauuuuuuacaaauuuuacaacuuuuaaaugcaaguaaaauuccaaagaaaaaugcuuauuuuuaaucaucauuacaugcugccacauucacuaaagaagguaaaaaaaagcccacauuuuucauaaauguacaccccuaguggaaauggcagcaccuagugcuugagaauaggcaaaugcaaugguuugaaccuuaccauuucagaaauuauggucauuggcuugguagagugagucuuuaccaagcaaaccucauagaauauuuaaacauagaauauuuaaaccucauagaauauuuaaacauuuaaacaauuaaauguucucuagugggaacauuaaaagucuuuuaaaaauacauauuauucagugcaacauauauucacuagaacguaagcuccauaggcagagauuugugucuguuuugcucacugcuauauucccacaucuacaacagugccuugcacagaauuaacaggcacuagaaugacuaauuuuuaggaauccuuuacaacaugaagcaucacuuucuaccaagaugucacguagucaugggcucacugaaugacagugcaagauagagacagagaucucacaauaggccaucuuuaucacuuuucagagggaaaacuaaggcucugagagaacaaugcuuugcacaaggucacacagcuagucaugacccaaucaggacuagaacgcagguugccugacucccaguuuugugcucugugcacaggcugacauccucucaaugacucugcaaacuacagucaugaugaugccucaugcacauguuuucacuccuuuaauauugagcucaauauuaacagguauuuacaugauuauguuuauugauaaagcaacuaugugugcuacucuaagugacaaauaauguaugugguuuucaaaugauuuugacaguuacaugccuauagaaagcagguauucuaaaauauccacaggcccggugcaguggcucaugccuguaaucccagcacuuugggaaauggagguggaaggacugcuugcgcccaggaguucgagaccagccugggcaacacaggagggagacccugucucuaaaaaauaaauaaaauuuauuuuuuauaauaaauaaaugucugcaagaaaaaacugagcuccuuaaccuuaacacaucugauuuugaucaguuggacugggagacuaaaaugaaugccugaguuuguguacugccuucuguacucuucccucucucaggccaguguggaaugagcaccguccauguggacauccucuaagcucccuguguuuagaggaguccauauuggaggagccaaaaccucuucuuccucaucuccaaguauucuauaaagcaggacuuugcaagccuggcugcuuuucaaauucgccugggaagcauauuaaaauacagacucccggaccacccgagacucauuugcagcucuggcgguuagacugggaaucuguauuuuuccucagaugcaucaggugauucugauacgcaaccagguuugcaaaaaccucgccucuaaggaacccaucaggccugccuucuccaacagcucagcagugcagcagucauccauucuucauuucccucugguuggcuuuuccugauauccccccacccagcagucuucuuagcucuacuccuuuuguuucuugguauccucccacuucucccucccuccauuuuaauuuuucuuggcuucuaauccuuucucuccugcuauagacuaaauaccauauuaccuuaaaagcuugccacguuaccauuguccaccauauucagccuuuauuccucccucaaacagcccccuuccuccuuguucaccuuccagccuuuccccaucugccacacacagcacaagcgcacacagaccaaacacaugccacacacauaccugacgcaugacccauuucaagcgcgcaugcacacaccacacacacacaccccugauaaaucacauacacuaaacacgcacacaccgcgcaugcacacaccacgagugcacacacacaucacuauccaccgggcacaaagcuuuuaccugcugcuaaucccgucucggcguuuucucccacacccucauauuucaaaccuacucccggugucauuggccuucccgucuucucuaggucuggaccuuuucucacucucgcccucccccaugccucccucggaacacccucauuuccuuccuagaacccgacacuacccccuccuccuuccaggaauccccaagcccaggaccuucgaaaacuaccccaacagccugggcuuugauguguccccccucaacgccuucgagcuucguggucccacccacccccggcuuaagcgccucagccuucuuucucuaacccccucccagcgcugucagcgcgggccggggauccgcgucccugacuggcccgcagccccucuagagcgccucuuguucccugcccgccccgggagccucccggcucuccgccugcccgccuacccgccuacccuagcucgccgccauuccucccuccacucaggggcgccccgcucccgccucgccucucucccgcccagccccgugccggggcccccuucuuuugucuccaagccccccucgccggccgcguaccgggcccguagaauuugcggccuuuggucacaucgaacaccuugccguugauggccaugaguaugcgcggguccuggacgccgucgaagcgccgcagcucggcgggggugaagucgcgccgcuugaggcggggcagagggggcggcucgucgucgucgcugucgccgcuggccgccggcugguccccgcgcacgaucuuguagagcaggaagaugcagaggccaagcagcagcagguugagcggcgacgugaaaaucucaugcagcagcccgccgcucuccagaucgcuugggucggcgccagucgccaccacauccucggcagccaugaucucuggaguaaagguugggccgcgcuaggcagggauccggaacucgccacuuucuccucccucugagcgagcgaguggcgcgcgggguucggcggcggccaaagacuagccggggaggaggcggggccugaggggcggagccucc

SEQ ID NO: 18954 - RNA, 842 nt, Homo sapiens
uuuuuuuuuccggcuggaaccauggaggguguagaagagaagaagaaggagguuccugcugugccagaaacccuuaagaaaaagcgaaggaauuucgcagagcugaagaugaagcgccugagaaagaaguuugcccaaaagaugcuucgaaaggcaaggaggaagcuuaucuaugaaaaagcaaagcacuaucacaaggaauauaggcagauguacaggacugaaauucgaauggcgaggauggcaagaaaagcuggcaacuucuauguaccugcagaacccaaauuggcguuugucaucagaaucagagguaucaauggagugagcccaaagguucgaaagguguugcagcuucuucgccuucgucaaaucuucaauggaaccuuugugaagcucaacaaggcuucgauuaacaugcugaggauuguagagccauauauugcauggggguaccccaaucugaagucaguaaaugaacuaaucuacaagcgugguuauggcaaaaucaauaagaagcgaauugcuuugacagauaacgcuuugauugcucgaucucuugguaaauacggcaucaucugcguggaggauuugauucaugagaucuauacuguuggaaaacgcuucaaagaggcaaauaacuuccuguggcccuucaaauugucuucuccacgagguggaaugaagaaaaagaccacccauuuuguagaagguggagaugcuggcaacagggaggaccagaucaacaggcuuauuagaagaaugaacuaaggugucuaccaugauuauuuuucuaagcugguugguuaauaaacaguaccugcucucaaauuggaaaaaaaaaa

SEQ ID NO: 18955 - RNA, 2932 nt, Homo sapiens
aauuuauuuuagauauuuuuauuucuccaaauuuguuauuuaucaggagugacugaaauaaaaaauacaauugagucccaucaucaucaucauggaaauggcuuuaagagaaaacuggucagaugaauauuauugcuucccauuuucaaccaguaaauaguugccacugagaaacugacagccaggagucugucaagaaugcucaagauauguuauauaauacaacaugccuguucacagggggaaaaauccuaggaaauaacuuauguguacuucuugauuucaucauacaagacaagcacaaaagcaccacccaugccucugagaacauuggaccaugcacccuugaaaaaagcuuugccuccuucaucacgagcaaucuuccgccagcagucaagcgugccuguguacaugaugucagcugcaaagaauaaagacauggaguuagugacugaaggccgaugaaaaauccuaagauucacuaggcuaaauaaagcagagccccaccucuaagaacgucagcuuuaaauccaacauucacacauuagcaugggcaacacugaaauauuaaugcuaugaccacaggaauacagacuacccauuggucuuaaccucuaacaccauuuaagcacccucauucauaggcaucugaagggccagcucaaaggcaguuguggaacagacacagaugcuaucaaccccaucccuugacuuggacagacagccauuuuaaagguauguaucaccaguuuguggcagcagauugccccacgacuacaacuuuaucuucugcucaaguggaacuuacuuccuuugcgcccugacugcaucaucaugcggcggcgaacagugucaaauggauaggaagucaacccggcaacagcagugacagucugugcgaucauccagcugaugacgaugugaguguucuugggauccggaagcauuccugggaauaggaaagagaugcuuuuaccaaaaagcagaguuuuacugacuuccuuuccccacauccccuaaacacgucaucuguacacaaggguugcauuggaugaucuuggcuuccuuuagcaauuaaaaaaacaacucuuuagcucuuggacuguuagguugguacaaugcucuuuuaaacugucuccuaagaacacaacguuaaagcccacagcaaacuuacccuuugcagugucauagauaccgaaguaggcggcucgguagaugauaauacccugcacagacacguuaaagccuugguacaggcccuuaaucccaucagauuuguagaucuuaaccaggcagucaccgaggccucggaauucccuuucagcuccagcuuuacccacaucagcugcuagacggguacgggcaaaaucaagaggguacacaaaacacagggauguggccccugcggcaccacccgaugccagauucccugcaaaguagagccaaaacuggguucucuuguccacaccacccaggaagaucugcuuguauuuaucuuugaaggcgaaguuaagagccuggguggggaaguaucugaugacauuggccagguuaccgcgccagaaggacagaacucccugcuccuugggaauacggaccacgcagucuauaaugccuuuguauugcuuaucugcagugaucugcuugcuggcaugcugcaccuaacagacaggaaggaagccaacagggacaguuauaaccauggggaagggaaagagaagagcuuaugccaucucgaucaaugcccuuuaagguaggcuccccucucucaaaucuagucuucguauaucauacuggcuggacccucccaacccucugaggcugucacaggggaagaggugaucugcaccaguagcauuaagccuccaccccucugaguggagagggggcauccuccagcggacccgugaccuucagaccuaggagaaaggucauuaccucaaacccagguucagaggcauuagggcgagucccacauagggcgcggucaccuuggggaccgcagccuacgccucaagucuccugagcugcuuccgucucgcuccgcccccacuccgcucccagaggugacccgagcgccgccgccgccagcccuacacgcuagcccaggagcgcccucuagagccggcacuggagagcgcgcggcgcagggaggcaggcggagacgcggcggcagcggccgcggcugcgcgggggcggacguaaaaggcacacgcgcuucccggcgccggcuuccggcccggcgagguuugagcgcguccgcgggcugggaggccgcuggacccgggcgcauggccucccccgggcaguuaucuccuugccgcgaccuugaggucuucgguaagaacuggcguuccucuuucuaacgccggcuuucggccuucgcccuugacgcccaggcccggggaggccgucacucagaaacugcuccauccgaguccgccgccucggagaugccgagagccugguccugcccucugcccccggccccuuccuagacucacuacuucaggucacuaaaggcgccucccaccaguuugacuucuguucugccucugcgccccgcucuggccucuccuaagccgcuucccuggccaugucuuuagaguucgcuccccgccaccccucgggcgcccgccuucugugcgacccuuccccccacuuccugguugggcuccuggaucccaggacguaccugcagcagcagcuugacccgcucgaugggcgcuaccgccgucuuggagauggcugcggccacuccaccugccaggaaguccuuggcgaaggacacagcggcaucugucauguugaaagaggaggcagacugcugcaggacgggacugggccgggaaccggcuuugacuccggcgcugcggggcggagcgaagcaaauggccgauuuauauagggggagccggagcuggagcggcag

SEQ ID NO: 18956 - RNA, 5398 nt, Homo sapiens
cacuuacgaagcagggugccccuagcacacugccgggccccugggggaacgcacuuagggaagcgaagcaaagcuaacugcauuuggcagaaaccagcgcgcuuucccacggcgccacgggagcgcaccgcuagacagagaaggcacuagaagaggcggucggugcauagcgucaccuccuaaacuccgcccaucggaagcgccuucuaagcucguucuuccgccagcuucccuccucuuccuuucuccgccaucgugguguguucuugacuccgcugcucgccaugguaaguccaucggcccccaucggccccgggguggcuucccaaaacccgaggccgcugccaggaaaugccugggccgcgcggagcguugaggggcgggagccuuuuaaaggcuuuuucaagaaaauauccaguucggccacuguugucuuucguggccuggagggaagcuagugagccagcgagcaaccuggagagggacgggcugcgcugcggccgcggauucaagggggcucuuucuuugcccggccgcugccgagucgggcagggauuccgguuucccuucgcuuguagcgaacucguucuggaggcggggggugggagguggcagccacccccgaaaucguggccugacugugggcugcccguggcaugcgcaacguggaggguaaucaggaggguauugugggcuacugguuuucgaaaaggguuuagcuuggcguggagaagcgaaccgcauuuuuagaucccaggacuuuuguuuagaggacguuuauucagagacuugagcgucaccccguggaagcgccuagaacaagggguguuuugcgaaccugugugucauucuggccuucuuaguaaauggcagcagcgaaccagucacucuuuacugggaaauguaaaauguugauuucuagauauggaggcgauaaguacugguauuuuauuacuugucaaguaauuuauuacuugacaaaauuuacaacugcuacuguggaugggggacgggguguaaucuuugccuucuuuguauuggcucccauuauuaugcaaggguauguucguccagguuggccaggcauuaaaccugcauccgugccaauuuugcaagauuauucuguagauuugggggaguauugggguuggccuuagaugaaagccaaaagaugcaacuagaaauugagacagucauccuuggaaaagugacauuucauuuauuuuuaaauuuaaaaguuuauuuuuuuagccagugaaauuuagcaguagagauagaguuaggauuaauaccgaaauggugaguagguuagaucuucugaaugucagggacuuucccuaagucuuaauuacccucccaauaacacuugaaaaguacguaccccuguuuuacaaaguagagcacugagauucguugacuugcaaaugguagguaggugguucuguuugacucaaagcuguguucuucccaggaagccagauucccuagccauucccaguguggucgucugaguccuugggggaccacaggguaaauugaaagguagccucuggcuguggagcagaaaggaccuggguuugaauccugguucugcacauugaugcucugauuuugugcauguuucuuaaccggauuccacuuauuuuaucugaacgauggaaacugugguaucugcccccagagaaguugugagggucagagacuugcuuggcuugauggcuuagcauugagaagauuuuggggcugggguauguguuaagcacucaaauguugguuugaaggaguucuugacuuugaaucauucgggcaggcucuaauauugucuaaauugauugcauuuucuucccagucuucucacaagacuuucaggauuaagcgauuccuggccaagaaacaaaagcaaaaucgucccauuccccaguggauucggaugaaaacuggaaauaaaaucagguaagaccuccaucauacugcuuguauuuugcuaaauguaagagccacugugucuggccaggguuacuuuuugaguauaaauacaugauuaaaauugcaugcaauccaauccacccuuugacagcauucucaaauucguuuuuaaaaacguacuuccuuuguuucugcacugcauccagcccacaucugggcuuaugggcagauaauucuccaauacuuauuaauuuccuggucaucuucagucugagcuaggucauaagguggaaggcugucuuauacacauccugguggggaagacccagucaguauuuuuaggcuuuuuguuuuuguuuuuguuuuuguuuuuguuuugagacggagucucgcucuguuacccgggcuggagugcaguggcacaaucucggcucacugcaaccucugccucccagguucaagugauucuuuugccuccgccuucagaguagcugggacuacaggcgugcgucaccacgcccagcuaaguuuuauauuuuuaguagagaugguauuucacuauauuggccaggcuggucucaaacuccugagcucaagugaucugccccucucggcuucccaaagugcugggauuacaggcauaagccauugugcccggccuuuguuuuuguuuuuugagacaggaucuuguucuguuuuacaugcugcguugacacuaucucccugcaaccucucccuaccuaccagacucaagugacccucccaccucaucucucugaguagcugggacuacaggcacacgccaccacaccuggcuaauuuuuaaauuuuuuguagagauggggucucucuguguugcccaagcuggucuugaacuccugagcucaagcaauccuccugucucacccuaccaaagugcagagauuacaggcgugagccaucacaccuagcccagucuuuuagauguuucucuuuucuaaaaagagacuagaaaagauuggaaaacuguccucuacugcagaaguaguugaucucaaaggaaaaacauuacuagaauugcuaugaaggaccuccaaggucaucuagacuaacuccagggaaagcuaggccugaaacagucuccugcauggcuuuuucagcccaucgcucuuugguccugaugggccuugagacagguuuugaagggagcaucaagaaucagcaagaguugcccaagguucagcagucgcucucucacccaggcugagugcagugguguaacccucccaccucagccuccuccugaguagcugggacuacaggcguucaccaccaugccuggcuaauuuguguaccuguuguagagaugggguuucgccauguugcccaggcuagucaaagcacuuucucuuuuuuuuuuuuuugagauggaguuuugcucucauugcccaggcuggagugcaauggugugaucuuggcuuaccgcaaccucugccucccaaguucaagcgauucucuugcucagccucccaaguagcugggauuacaggugccugccaccacaccuggcuaauuuuuguauuuuuaguagagacgggguuucaccaucuuggccaggcuggucuugaacuccugaccucgugauucacgcgccucugccucccaacaugcugggauuacaggcaugagccaccgcgcccagccagaacuugauucgacuuguauggcaaagcuagugggauugguuugcuaagaagacuuaaagggguggcuucuuagggcuaaaguugagggccuauuuccuugguucauuuagcuaguuagaugugaaaauugccacccauuguaauguuaugggcuaguuaauugcuuaccauuuguuuacuggauacuagacacuguccuuuauuauuugauacaucuacuugaacguggguuucucuguguccugccugauggugggaccugcuugugaagagugaaagaaguauauauaaaccaggcacagugcuucauacuuauaaucccagcacuuugggagaggccaacgcaggaggauugcuugaggccaggaauuugagaccagccugggcaacauagggagaccacccccguccaucucuaccaaaaauauaaauuagcuggacuugguggcacgugcuuguaguccuaacuauuuagcaggcugaagugggaggaucacuugagcccaggaauucacaggcugcagugagcugugauccggccgcugcauuguagccugggcaacagugugacccugucucaaaaaaagaaaaauguauguaaaacucaacgccuaguucaauaaauaaccugcuauuaaacucuguggucuccuagaauugggaagguauuuuguacguaagauuauauacccuugacccagauaauugacccaauggaaugauuuucauuguuuuagcuaucuuccagcguuaaaaauguuuuugaaagcagguugcaauuacagugcuucauuuuguggaaguacugccauuauccugcugaaagaaaagccguguuaaucauuuuugauuuugccuuuaugaggguaaaaucaugacagauugacauggacaauucugggauugcuguuucccugcacuagacgugaauggaggaguugaucgauuguaaagaucaugcgaggccaggugcaguggcucaugccuguaaucucaacucuuugggaggacgaggcggguggaucucgaaguccagccaguucgagaccagccuggccaacauggugaaacccugccucuacuaaaaauacaaaaauacaaaaauuagcugggugguguugggggggcgggcgacucugucucaaaaaaaauaucaugcgggagcuuuuauauguuugugacccauuaugaggggguucagaguaugucuguguaccuccagguccauugaaucaaaaguggguacaaguacacuuggagagagugggcuucgccacuacucugauccuaguuaagagccuagccuucaaauuauuuugagaggauaaaacuugacuuggcuaguuuuuaaacacauagggaauuauuuuuuuuacucuccagaaagaacuccaaacuuguuagaggagagaaaagcaguacccuuuguauuuugugguaccuaaaagguuaugugaaugggaacagcuacauugcugucagacugccuuuguaacuugacauuuuuuucuguguagguacaacuccaaaaggagacauuggagaagaaccaagcugggucuauaaggaauugcacaugagauggcacacauauuuaugcugucugaaggucacgaucauguuaccauaucaagcugaaaaugucaccacuaucuggagauuucgacguguuuuccucucugaaucuguuaugaacacguugguuggcuggauucaguaauaaauauguaaggccuuucuuuuuaauugcuguuguauugugguuugucaauuacugaauucucccu

SEQ ID NO: 18957 - RNA, 6141 nt, Homo sapiens
acuuccaaaagaacaaaacguuuauuuuuuaaauuuaagaauuaugggaaaccuaaguaaugggaauugcauccucaucggggucuucuggcaagucggaagcaccacccucuccuguagcucgaugcuucucuaguuuagcaaucaauucuuucgcuggauugaagacgccauuggucugcuggucacagacauagcagcgcgggguggugcggaaaugcugcagugcacagcucucgcagaaauaaugccugcacuuggugacaacuggguuuuggaagcucuggcgacagaugaaacacuugaaugguauuuccucaucaucgcuucccacuucauaguuuucauccucauagacaccauagcgacccucaucaagcucacguucgaucugccacccaugcuuguaaucugaacggucauggaggaauuugcagcugucuccgaagccgcagaagccagucucuuuguaguccuuacagaugucgggcugguaaucccagcgcacgguggcacguagaugcucgggcgcucggauggggcccuuccucaccaucccggaagaggcauugcccauagacguauccuugggcuucauguauuucugauaauuguugauuccccgauagaucuugucauccuccuugccccucagcuccuccuggaucuucuggcugcgcucaaagauggcuugugcaucgcgcucuuucucuguguccagcucauagacagcugucgcucccauauccucuggucccacggguuucgccgaacggguggauuuauaaaccacgccgagacucucgggcucauuuuccucuuccucuucgcugcucaagucgccguaagccgccuucuguuuaccacugucacgggucuucuguaucauuggauugugggucacccgcuucuuuuccggucgaaccacagugcagccuucgucgcuacugcugccgcuuucuccgggcucugggucgcaggccgggcgcuuucugcguccagcagccccuuuccgcccaggcuuuuugaaaaggaaggugcacaccugauccaccgccuuuccuggagaaagcugcucugccauuuuagaguccugagcuccgaaacagccguggcugccuggguugcacuuggccccugcacgucacuccacguugcgcgcuccgccgggagucgaagcaaaagacacugacggaagaggacugcgagagcccgagcgcccgucucucuugugcccuagcagauuccgucgcuucuuccggagccguacguggcaccgccccgcucgcgggcggccgcggggcuugcugggaagagaggcgaagccaggucaccuuucaaggacccagaaguaggguuuuggccuagguaacggggcagagaugugguucgagauucuccccggacucuccgucaugggcgugugcuuguugauuccaggacuggcuacugcguacauccacagguucacuaacgggggcaagguaagccggcuucggcccgggggccgacuccacgggcugauuuccgaaaaggguggugggcagggagaccgucagccugcgaacccucucuccgaggucggcccucuacuugcuuccgguugccuagaagccgaggcuugcgaaacgaagcccgauagaaacuacauccugcucuagugaaaaacagcguuucuggguguaucagagugggccuuagggcagaguagcgacgcgggggccgggaagguagauuagaaaagguggcucaagccugagaaucgcucacugcaaccuccgccuucuggguucaagagauucuccugguugggcgcgguggaucacgccuguaaucccagcacuuugggagaccgaggcgagcggaucaccugaggucgggaguucgauaccagccugaccaacauggagaaaccccgucucuccuaaaaauacaaaauuagcugggcgugguggcgcaugccuguaaucccagcuacucgggaggcugaggcaggagaaucacuugaacccaggaggcggagguugcgaugagccgagaucgcgccacugcacuccagccugggcaacaagagcgaaacuccgucucaaaaaaaaauaaauaaagaaagaaauuuuccugcuucagccucccgaguagccgggaccacgccuggcuuuuuuuuuuuuuuuguagaggcgggguuucaucauguuggcgaggcuggucucgaacuucugaccucgguugauccacccgccuugaucucccaaagugcugggauuacaggcgugagccgccgcgaccggccacccuugacuuuuuuauuccccacuuucucuugcaagccuuuaggaauuuacugcgagaucuuguuuuuuuacaucaggauucauuuuccccucuuccuaguccuucacaucaucucaagaguacaggauauaaauuuauuuacuuuuugauuuuguuauuguucuucacgugugaucuacagcuguuguuucuuagugucccaaaagacaacaacuagauauuucuuuuuuuuuuuuuuuaaaaaaaaaggaaaaaaaauucauguugguuaaaauaguguaaaaagucacagguaccaacuuaauccuaaaguuuaguggucugauuuuauuuaggagauucuguucuuuguacuacuaauuugcauuuuuauuuaaacgaugauuccauuucucuggaaugucccuuuuaaaaauuguaguaucuaucaauugggucacucacuuuuauaaacugcaacaauaauugucucuuauuugaaggaaaaaaggguugcucauuuuggguaucacuggagucugauggaaagagauaggcgcaucucuggaguugaucguuacuaugugucaaagguaagaugccacucugaugccagccuuuugccaggguugagguggguucugguaaugccuugccaagggucauacagugcuaauauauaacuagcauuuucuuaucuacuagugagguuggcaucuuuuuacauauuuaaucuuuuauauuucuuuuuuuuuuuuaguuuuucuucugucauauauuucuuauucuguggauuguugccuauauccuuugccuguuccauugucuuuuucuuuuugagcuaugguucuuuauauauucuagacuuuaauuuuuuugucuauuuuauauaugacauuuuucccagucugcuguuugucuuuuuuacuuuaugauguuuuucaucagguaguucuaaauuuugauauucaauguaucauguuuuguuguucuggauucuagguuuuuaugucucccguacaaaggccuuuucuaucuaagauuauaaaaauacuuucaaaaaauaaaauagagacagucuugcuguguugcccaggcuggcccucaaacucauaggcucaagugaucuucuugccucagccuucggaggagcugggacugcaggugugccacuauaccuggcucauaaaaauacuuuuaaaaaauaauuucuccuaauauuguuaguuucuuuaaaaaauuaguuauuugguuacaucuacaggucauuuuggaguauaaugugaaaggaggauuaacuuuacuuuuuuccaacagguagcuaguuaucgcaauuacccauuuauagaagaguuuaguaguccuagcuacucagaaggcugaggcaggaggacagcuugagcccagggguuugaggcuccagugaacuaggaucguaccacugcacuccagcccgggcgagagaaugagagccugucucaaaaaaaaaaaaaaaaaaaaccaccaagcacccaauuuauuuuuauuuguaauaccacucugguaaacuaaauuuccauguacacaugggccuguuucacggaugugcuuuucuauacucuaggucugccuauuccugcaacaauacuucauuuaaagaauuacuauaauuuuauauuuugauucaauuaugacauugccauuuuuguaggucaaaaacgaccaagcaguagcauuucauaaggcucaacuuaauaguauauuuuuuguuuuucugucuuuuuuuuuguuuuuugagacaaggucucacgcugucacucagucuggagugcaguggugcaaucuuggcucacugcaacccccgccucccggguucaagcgauucuugugccucagccuccugaguagcugggauuacaggcaccugccaccaugcccagcuaaauuuuuuuuuguacuuuuugguagagauggaguuucaccauguuggccaggcugguuuccuaacuccugaccucaagugauccgcccaccucaaccucccaaaguguuaggauuacaggcgugagccccuacuccuggcccuaauaguauguuuuuauauuuuguaggaguaguucauucucauacuucuuuuaaaaauguuuacuuuuuaauauuuucuccuuccucauuuauuccucacaacaaaccuaaguaaauaguauuuccauuuuauagacaagggucagagugauuaaguaauauuauaaggacucaaccugggugauacaccucucaguagagagguaguugagaaucuaauccaaugaacaugauaauagauaucuacuuaucuggagccauauuucucaaaguaugguccaagaauaaccaucagaaucaccuagcaugugagacagaauuaggauuucuaagagauggcuccaaggaagauacaguuuuaacuucucuuaaggcaguucuuccuguaauaguaaaccaaauaccuggacuauguuauuuaauaccuagaagaagugucaucacugaugagucuuuuuuuuuuuuuuuuuuuuuuuuugagacggagucuugcucugucgccuaggccggagugcaguggaaugaucuuggcucacugcaagcuccacccaccagguucaagcaauucuccugccucagccucacgaguagcugggauuacaggugcgcuguaauuuuuguacuuuuaguagagacaggguuucaccaucuuggccaggcugaucuugaacuccugaccucaugauccacccaccucggccucccaaagugcugggauuacaggcgugagccaccacgccagguguaaucuuuuaauuuauagcuucugaaguauuugguugucaacuuaguaagauccaguagguauuuugaauagauaguguagugcuugucagagaaggguucgggaguuggggucccugaauucuggcucugcuaauuccuuauggacuuaagcaggugacuuuuaaccucucugagccuccauuuccucauuuguaaaaaaaauggaaugagaauaauaguaucuaccucauguuggcuguuauuuuuuaaaacagauuuuaccuucuuguccucugacucacugaggugcuuuguaaaaggauccagguggaggccaggcauaguggcucacaccuguaauccuagcacuuugggaggccgaggcagguggauccccugaggucgggaguucuagaccagcuuggccaacauggcgaaaccccuucucuacuaaaaauacaaaaaucagcugggcaugguggcacaugccuuuaauccuagcuacuugggaggcugaggaaggagaauugcuugaaccugggagaugcagguugcagugaggcaagaucgcaucacugcacuccagccugcaugacgggagugagacuccaucucaaaaaaaaaaaaaaaggauccaggugguaaagaguugcuugacuuuaguucugauugggggucggggaagguuuguuucauauaaagcaauaugcugcugucagaaaaugaaaacuagaaaucauuacagguuauucuuuagugauuauaaaauuuaauccaauguauuguugcaguuagagaaaugugggauguggaagcacucuuuuuaauaacaaugccauuuaaugacacuggaaauaaaaguacauggcauaucuuugaugggaacagacuugucacauucuccuuuuuaaacuguuuuucaggguuuggagaacauugauuaaggaagcauuuuccugauugaugaaaaaaauaacucaguuauggccaucuaccccugcuagaagguuacaguguauuauguagcaugcaauguguuauguagugcuuaauaaaaauaaaaugaaaaaaaugcauuuc

SEQ ID NO: 18958 - RNA, 1240 nt, Homo sapiens
cuagggcacaagagagacgggcgcucgggcucucgcaguccucuuccgucagugucuuuugcuucgacucccggcggagcgcgcaacguggagugacgugcaggggccaagugcaacccaggcagccacggcuguuucggagcucaggacucuaaaauggcagagcagcuuucuccaggaaaggcgguggaucaggugugcaccuuccuuuucaaaaagccugggcggaaaggggcugcuggacgcagaaagcgcccggccugcgacccagagcccggagaaagcggcagcaguagcgacgaaggcugcacugugguucgaccggaaaagaagcgggugacccacaauccaaugauacagaagacccgugacagugguaaacagaaggcggcuuacggcgacuugagcagcgaagaggaagaggaaaaugagcccgagagucucggcgugguuuauaaauccacccguucggcgaaacccgugggaccagaggauaugggagcgacagcugucuaugagcuggacacagagaaagagcgcgaugcacaagccaucuuugagcgcagccagaagauccaggaggagcugaggggcaaggaggaugacaagaucuaucggggaaucaacaauuaucagaaauacaugaagcccaaggauacgucuaugggcaaugccucuuccgggauggugaggaagggccccauccgagcgcccgagcaucuacgugccaccgugcgcugggauuaccagcccgacaucuguaaggacuacaaagagacuggcuucugcggcuucggagacagcugcaaauuccuccaugaccguucagauuacaagcauggguggcagaucgaacgugagcuugaugagggucgcuauggugucuaugaggaugaaaacuaugaagugggaagcgaugaugaggaaauaccauucaaguguuucaucugucgccagagcuuccaaaacccaguugucaccaagugcaggcauuauuucugcgagagcugugcacugcagcauuuccgcaccaccccgcgcugcuaugucugugaccagcagaccaauggcgucuucaauccagcgaaagaauugauugcuaaacuagagaagcaucgagcuacaggagaggguggugcuuccgacuugccagaagaccccgaugaggaugcaauucccauuacuuagguuucccauaauucuuaaauuuaaaaaauaaacguuuuguucuuuuggaagu

SEQ ID NO: 18959 - RNA, 457 nt, Homo sapiens
uuuuuuuuuuuaauuuugacaaaucuuauuuaauucagauagcagucugaucacacaugguccaacaacauucaaauaauaaaucaaauauaaucagauguuaaauacuggucuucaaacaucauagccaaugaugccacgcuugccuaugaucucuccgacauaaaaccacauaacaccucaguggccaccaaaccauucagcacagcuuccuuaacugugaguuguuugaagcuaccagucugagcacuauugacuauuuuuuucagacucugaauagcucuagggaucucagcaggggugggaggaaccagcucaaacuuggcguaguaccaaaauguggccaaucaaggcuuugaguaagucacagcagcguucaccagcaccagggucuuuuccacaagguuacggaaaaauugggccaaugguucugggauggaaagucugucgcccugaa

SEQ ID NO: 18960 - RNA, 7610 nt, Homo sapiens
auaauaaucugauggcugaguggguucuaaaaaucuaguucagcaucacaacugcuggccagaugagcaaugcuuaucuuguggcacguuuccaguuuucaaaacagugacauaagucuaaaugguuuauuaaaauucucuaucucaaguacccagggacccaaacacugcggaaggcugcaggguccucugccuaggaaaaccagagaccuuuguucacuuguuuaucugcugaccuucccuccacuauuguccugugacccugccaaaucccccucugcgagaaacacccaagaaugaucaauaaaaaaaaaaagaaaauaaaaauaaaguaaaauaaaauaaaauaaaauaaaauaaaauucucuauaaaauaaagugguguuguucuaugaugcaaucccuauacuaaccacauggugaugcugcagacagaucuagagauuugaggaaaagguguuuaagaauauuuuuuauguuuguaaauuauaguacagcuacacaaagauuaugcaggcuuuuaaaagaaugagguaaagcuacagauuuguaagaauaaucuucaaaauaugccacuaagugagaaaaguaagucacuaaacaauaucauauuugucuauuuuuuuaaaaaagcauguaaauauauaugcugguacauauaugauuuuucucugcaguguaaaaaaaaaaagaccaauagcaguuguuacuuugggcaaugggacugggguccaaaagaggggaaaugguggcuuuuuggauaacuuuuuuuugggaggcggggcgguucaaugauucuccugccucagccucccaaguagcugggauuacagacaggcaugugccaccacgcuuggcuaauuuuuguauuauuauuuauuauuauuauuauuauuguauuauuaguagagacgggguugcaccauguuggucaggcuggucucaaacuccugaccucaggugaucugccggacucagccuccuaaagugcugggauuacaggcauaagccaccgcaccuggcucauaacauuuuaaaugauuugauuuuuaauaauuuacauuaauuuaaaacucauuauuacaaaaaaaauccauucguuguacaacuuuacugcagaaauuaauaaaaaucucuucuccuucaucuuuuguuuuuguuuuuguuuuuuuuuugagacgcagucuugcucugucucccaggcuggagugcaauggcacaaucucggcucacugcaaccucugccucccggguucaagcaauucuccugccucagccuccugaguagcugggauuacaggcaccugccaccacgccaggcuaauuuuuguauuuuuuuuuuuuuuuuaguagagacaggguuucgccauguuggccaggcuggucuugaacuccugaccucaggugauccacccuccuuggccucccaaagugcuaggauuacaggcauaagccaccaugcccagcccuccuucaucucuuaaccccauuccccagaggacagagagccccugcugagaguuugagaucucauuacucagaauguggucuccagaccagcagcaucagaucacuagggaaguugcuagaaaugcagauucuuguguccuaucccggagcuguugaacuucacaguggggccuaguaaucuguguuuuaauaagcccuccagugguugugaugcauaaaccauuuuguuuuagcagauuggaucagaucuuuuggcaggggagguugagaauacuacuggccaggagaacaaacaacucaaaauggcauguuuccauuuauccagagaacucuggcugaagaguuggcagccccuugagcccacugugaccucgcugugggguugagcgaugaccauacugucauccagacaguagauauuaaagguauuauccagaaaaaagggacaugccagaaggagaaaggaaaaagagggaggguaggagaaacuaaaaaaaggaugaguagggaaaggaaaaauggggcagauaaaaagauaaugcaaauuuaaaaaguaaagauuuuugguggcaaauagaugacaccaauaccucaggggcacucauuuauuuauuuuuauuauuuauuauuauuauuuuuugagacagggucccacuuugucaccgaggcuggagggcaguggcgcgaucuuggcucacugcaaacuucgccucccugguucaagcaauuuuugaaccucagccucccgaguagcuggguuuaaaggcaugugccaccacacccagcuaauuuuuguacuuuuugcuagagaugggguuucgccauguuggccaggcuggucuugaacuccugaucucaagugauccaucccucuuggccucccaaagugcugggauuacaggcaugagccaccgugcccagcccauuuauuuaauaacuauuuauuauucuuccauucuaaacuucugcaccuuuaaguucauuuccucugcucauccccacauuucauugucuaucauuuaccaaaucugauagggucaucauuucuuacaccauucaguauguugacauguagggaaauguuugccaaugauuuccugcucuuuggccaaaaagucaugcacucucaaaggugcugaaaagagucuuaaucuaccuaugaugguaggggacaguguggggggacugcugaggaguuugugcacuggggugguaugagguauauucaggagcgcacauaaaagcacccuagauacagcgguaccaacaaucaagucaaccuuugugaagcuuagaucggaggggaucucacagauuuccucaaacacuaaccccagucucacguauacaucugcaucuaccaccgaaagccaaggaaaagcuccuucaaucuggggcaggguaaugggagacuguauaagaaaagggaucuuucucacaguguuuuuuggagaaaacauuaaacauuucugaguauggaagcucagugcaaacaaagacuugagaauuuuuagccuauuuaugcugacaaaauacccagcauguaucuacaacuuucaaaacauuguugugucucacgacgaugccugucccagucaaggagccagcauuuguauuugccugaggaaaagguugugaugggggugaggguggauuucgcuuguaaggcugcucauauuucacuguguuuauuuuuuuaauuugaugacaccuucaagagauaaagggcgacaauuuauuacaccagauauuugacaaauugggacaguauuuuauuuuauuuuaauuguuagagacagggucucacucauuugcauaggcuggagugcaguggcgccaucaaagagcacugcagccucaaccuccugggcucaagcgacccucccaucucagccucccugguaucugggacuacaggugugcaccaccauggcuggcuauccuuauauauaaauauauacauauauuuucagagacagggucuugcucugucacccaggcuggagugcaguggugcaaacauggcucacugcagccuccaccuccuggacuugaacaauccucuugccucagcccccaaguagcugggacuacaggugcacgccaccacccccagcuaauuuuuaauuuuuuguagagaugggguuucaccauguuggucagacuggucucaaacuccugagcucaggcaaucugccugcuuuggcuucccaaaguguugggauuacagguuugagccacugcaccuggccaauuuuaaauaaaugagcauuuacucacauagaauccuugaauuauaaaccugaugccaacuuagagaucaucugaggcccaccaauauuguuuuggggaguuuugagaaaaacaccaugcccaggccugacuucagauaaacugaaucagaaucucaagggaugggaccaaggggaauuuuccacuuuuaaagcuccacaagugauuccaacaugcagccaggaucaagaaacagcucuagucucauuauuucauuuuaccaauaaagauauagaaguucaaacagaugaagugaccugccuaagaucacacugccaguaaguggugucucacaaccaacuccucugacugcuaacccaauguucuuuccacuauguucuuuuuuuguuucuucuuauagaaagagcuuaggguuuuacugaacauuaaaguuaugcgauuuacaauugaaagagaagagcuagaguccaggaaguauugguggggcaucuucagagggcucaacucaguuguggguucucugaagacuacuaugcccaggacauagcuccugccaagucucauugauggcagucaaaagacauuuugcuaaaggcaaugacuaacacuguaugcaguguucauuagucuuguguugggucacuuguucacaaauuaguuucaccuaugguaguaaacauucauugacaaauguucucacuuucaggaauuaauuacauuaaagcaaacaauaguggggcagaucggugcuucuuaauauuugaauuaggguagggguuagggcaaggagucacaggucccauuggagaacuagugaaaacuacaaacuuccccacaaaaauacacauacauaaauguugcauguaauuucugaggauucaccgacaccucucccauccugucuaaacucauacauaaacuccagauuaaaaucuccuggacuagaugauuuugaagcucucuuucaguguuuuucucaaagugugguccauggaccacagaaucagaaucacuugggguguuuguuaaagaagugauuaauaagacugccacagaccuacuguuucagaaucucuggggaaugagguacaggaaucuguauguuaaaaaaaaaaaacccaaaaccagaugguucuuuuggaaacuaacacuugagaaucagugcuuuauuccaacucaagauuuuuaaaugcuuucaucuguugaauauuuuagguuuugucuguucaucuaucaaguauagcaaacaguaugcuuaguaugaacucauuacagaauauuuguguguauguacauaggaaaaauaucuggaaguauagauguggguguguguauauauguguguaaauauauauaauaauguuaauaguaggaauacagaugaucucuauuuuuccgcuuuauccuucuguuuuauuucucucauuuuuuucuuccuguguuuaaaaaagaugcuucuuguuucugagcucaauucccccaccugagaacagggugcuguaacuaggugaauuucaagaucaugucuuguuccgaugguccgugacuccauacuacccccuagguucccucguccaucucacagcaugaacugcauagguaacaacaguguuuggagaauaagcauguauuauuuuuguauguauuacguuugagaugccuagcaaccguuuuugugcccgcaaaauuuuucucuucuuugucaaggagccaaaacggaaauagucuacuaucuacggcccucaaaaguuccuccucucuccuuagccuuagaaaauaccguccgccauaggcaugggcaaagaccucauggcuaaaacaccaaaagcaaucgcaacaaaagucaaaauugacaaaugggaucuaauuaaaagaacuucugcacagcaaaagaaauuagcauuagcgugaacaggcaaccugcagaaugggagaaaauuuuugcaaucuacccaucugacaaaggucuaauauccagaaucuacaaggaccuuaaacaaauuuacaagaaaaaaacaaccccaucaaaaagugggcaaaggauaugaccagacacuucucaaaaaaagacauuuaugcagcaacaaacaugaaaaaaagcucauuaucacugaucauuagagaaaggcaaaucaaaaccacaaugagauaccaucucacgccagucagaauggugauuauuaaaaaaucaggaaacaauagaugcuggcgaggcugaggaaaaauaggaaugcuuuuacacuguuggugggaguguaaauuaguucaacuauuguggcagacaguguggcgauuccucaaaaaucuagaaccagaaauaccauuugacgcaugcacacguauguuuauugcagcacuauuuacaauagcaaagacuuggaaccaacccaaaugcccaucaaugauagacuagauaaagaaaacguggcacauauaugccauggaauacuaugcagccauaaaaaaaugagaucauguccuuugcagggacauggaugaagcuggaagccaucauccuuagcaaacuaacacaggaacagaaaacaaaacacugcauguucucacucauaagugggaguugaacaaugagaacacauggacacagggaggggaacaacacacacgggggccugucaaggggugggggccaaggggagggagagcauuaggagaaauaccuaaugcauguggggcuuaaaaccuagaugacggguugauaggugcaguaaaccaccauggcacauguauaccuauguaacaaagcugcacauucugcacauguaucccagaacuuaaaguaaaauuaaaaaaaaaaaaaaaaaagaaagaaaaagaaaaagaaaaugccguccgcgcauaucucucaggagcauaggaagggcugugaaccaaaaagccagggcguggucgccccgcccaccggccgcuacaucaccaccccucucgccgcuuucaagcgcggagauuggcuguaagcaagaaagagccccgccccuagucuuaugacucgcacugaagcgccgauuccuggcuuuugcaaggcuguggucgguggucaucagugcucuugacccagguccagcgagccuuuucccugguguugcagcuguuguuguaccgccgccgucgccgccgucgccgccugcucugcggggucauggugugcuuccgccucuucccgguuccgggcucagggcucguucuggucugccuaguccugggugaguugucgggcccucccgauuagucuguccgccugggcccggggcaccaguucaaagcuacaaccugaaagacugguccgagggggaggggguugagaggcucagcagcuaacacugggcggcggcgguuggcccggggaggcaagcggugaccuagagaaggccugaccgacggauggcggggaagaagggcccaggagaguaagaaggggccgguaacgggggguggacgccgagggaguaggcugggaggagugaagcguggagagggucagcguggaaagaguaacuuggggaaaacacugaggagugagcguaggagggugguacaugcagauuuugggcgccagagacaauuaggagagucuugguuugcugagaucagggaagaguuuugaagaugguggaaaaacuauggggugagauaggaaauuaagagagaagaccaugccugccuggaguagcuugggagaagugugugggugggggacagaugggacagauaggacaguagagccugaggggcaggggcagugacaggguugggcauuuugaagguuggaauuugagacugugaagaaaggaugauucaagagauuaggagugaugcuggguuugaguuugguagucauaguuuuaagggcgaaggaaccuaagguagcu

SEQ ID NO: 18961 - RNA, 476 nt, Homo sapiens
gaaauuucaucaugcuguguagggacuaacaauggacacccagaaggacauucaaaccccaaagcagcagccaauggcauauaacuguagagaaugucacacagaaaaugacaugaaguccagggauccagucaaauguggagaaugugguuacagaauaauauauaagaaaaggacugaaauauugguggguuuugaugcccagugaaaccugggaauucagagaacauuuucguuuguacuuggauuugccauuaauguuucucauuguguagcuuucaauuuaacauucuuaucuuuaugauuauaacaauauacacaugaauucauuuuauuuuauuuuaaaaaccauauuauauuuaggccucuauuaacacuuuguauaaaaaaauuuuucuucuauuacaugauuuacaacuuaauauuacuguauauauaaccugacacacaaugaggguuaaaauuacuucccaaaa

SEQ ID NO: 18962 - RNA, 2942 nt, Homo sapiens
aaagagauguacaaaguaaugucugcauagcuaaugcuucagauucagcuucuguccuggaaaguuuugacuuugauaaauacguucucagaaagacaaaugaaaaaagaaagcauauauuuaaguauuaagaacuuaagucugccacuuaauugcuaagaugaugaacacauuuuauuuauuuuucugcaacacaucacauacuggauccagaauuauccauguauacaguaauaaaaaaucaacaccuacucugagcacaacugccacaacuggcuuuucacuguaaauagcuaccugaauuuaaagagauguguaccccauauacccccaaaaauaccucccugauugcacuaccacauauauagaccagaauugaguaguucugaaaaucuguagcauagaaaagcaggccauaauacagcggcuuuaaauaagaacacggagggccugaggauaguaaaguuuuacugaauaaccaaaaauguugauuaauaguaugaacaacauuguaagauuucuaacuaacagaacauauuuuuaaagcauuuuacacaucaacacuauacaaacaacagacauugaguuuccaacauccaaaugaaucacgcccuagaauggugugugccacacucuagaaugguggcaaucuagaaccugaacugcauuuuguaauuagaguaaggcuauaaaugauggguaguuccucaaaacaaccccaaagaugcuuuguagcucacauuuccccaaaacaccacacaucuaacauguguaaaagaucugaacacuauugcaauauugauaaaacuaacguacugaauaguagugaagacuaugacuacaucaaccuaaagaaggaggguaugugaaucacugaaagacagaacacaauuaagguuuagccaaaacucuuugaaugagaaggcaaaaauauacugcuguugggaaacgugaaugagaguuuuaaagccaaaguuuugacugccgaaaggaccacuugugcucucucgcucccgcucucucucuuucuuucucugccuaauacauuaagcacacguaaguuggacugguuccaccuggaagacaaaagccacacaaaguuaaaagcacaaaugcagcaugaagaaggaaagucaggcggaacugaaagguaaaccugugcacuuugagaacaaggcguccauccuuaacuccagaggccugcguaguucccauggaggccugaagggagaggccccccagccacaaagagcuucaucuccggccaguuguagcaguggguguagagcgcauuggggaacucucccaugccaccaaaguaguucacccagacgucaucuugguugagccagccucugccgcaggcaagcuugagcuuccucccugcgggccccggcauggaguccaggcuggaagaggcccucuccuccaggaacuucugggcgcggaugucauagaagagcagggaaccauggccggugcccacagugaugaugugcugguagaagcucagcgaccgcacgccugugccacccucucgagagcacaggggccggauguucugcuggcgcuggcgcggauccaggaaggagacgugggacugagagcccacagcguacagggacaacucaucacaguaggucaggcacacauucucucggcaguagggcagccugauggacaggagccuggauagugugcuccgggcuuuccacagguggaaguagccguccaaggacaccgcucccagcuccugguucuugccgcugaaggccagggcccguaccuugcgguugcugggguuggugcuggcccuggggauggccuccacaucccucggacggaugugggcauauacugggagacccaccucgcugugccaggcaaugcugccauuaaacaugucuggguccauccgccacagagccacggugccgucgcgggagccgcucacagcuacggugucacucagccaggcgacugcgaagauccaguccuuguggccauggcggucgcccaggcacaggggguccagggugggcagcugguagauggccaggcuguugggguuuucgccgccgguggccagaagcgucuuggagggauucagcucgauggcauggaugccgcagcccuggugggccugggccagcccggccuccuugucccgcaugagggggaugcgcgugauguggccugacugcacguccaccacaaacagcguauuacacuuggugccgcacaccaccugccuggcguucagccacugugacgcgaacaccuuguugagggugcccagguccagcuggcgcuccgucagcagcucgggcagccucuggacggcguagccccgcagcucgcccucgaagcccuggagcccggcugggccccgcgcuccuaccucccggcccuucagauagugcaccagccugcgacgcgucgccggccgcuucugcuucuuggguagcagaggccccucuccguccgccgccgcuaaacccugcgacgacgagcucccggcucccgccucgaccgcgggcgcuuuccguuuccugcuaccuguuugcugcugggccauggugggcggcgggcgaucugcagcagcggcggcggcggcggcggcggcggcggcggcccggcggcgguggcggcgcguggcacccguguuggccguggcggcggugguggggauggcugcgcuuccgcgucagccgagagcucaggaucucuaagaccaagaagcuggugcgaucgcgggcgcccagacuucagucugaggcucggcggcggcggcggcggcagcggucguccuggccagagaugcgcggccugacguagcagagccggggcgaagcgcggcggcaagggcggcaguggcggugcagaccuaggcgagagcgggaagagugucugucuggauggcugcgggagcgaagucagug

SEQ ID NO: 18963 - RNA, 785 nt, Homo sapiens
cguggcacccguguuggccguggcggcggugguggggauggcugcgcuuccgcgucagccgagagcucaggaucucuaagaccaagaagcuggugcgaucgcgggcgcccagacuucagucugaggcucggcggcggcggcggcggcagcggucguccuggccagagaugcgcggccugacguagcagagccggggcgaagcgcggcggcaagggcggcaguggcggugcagaccuaggcgagagcgggaagagugucugucuggauggcugcgggagcgaagucaguguggggggaggacgacgcuggggcccgagugugaagggcggaggcagugggaggagcugcugggcuggcguggggugccugccggguagcggaggccgcgcgggguggaggcuggaagggggcggaggggagaaggggguagcggagcugcaggggcagagucgcggagggccagcacccuagguccccaguaucagacaugcguuguuucgcuacccucaggacaacagcuaacuacccuucuuaaaauccguacuucaguaaaaucugaaaccuaagauauaaucaagcacggggcuagaaggaggccgagccacggucugccuggagaaaccagugugcgcuugguguaaucuugggacacccuucgcuuagauuauacauugaauuuggcaagggaucgggugcgggggugggggggugugggguucagcagcgucagggagaccucuacccucgugucagaccugcagcuucuccaguuucagcuccugggu

SEQ ID NO: 18964 - RNA, 3507 nt, Homo sapiens
ccccgcgucgaucucgccgcacgcugacuuugcucucacugcccggccagacgcacuucccgccuucgccuaggucugcaccgccaccgccgcccucucccgcgcgucccucacccgguccgccacugccgcgccucagaauccgaaggcucgguuccagcgcagccauccacgccgccgccacgaccgacuccggagccacgcgcugcaaccgccaccaacgccuugccgccgccgcucgcccgccgcccaccauggcccagcagcaaacagguagcaggaaacggaaagcgcccgcggucgaggcggacgccgagagcucgccgucgcagggcuuggcggcagcggacggugaggggccgcugcuacucaagaggcagaggcggccggcgacguaucgcucgauggcgcacuaucugaagguucgggagguaggcggguggggccccgccaggcuccagggcuucgauggcgagcugcggggcuacgcgguacagaggcugcccgagcugcugacggagcgccaacuggagcugggcacggucaacaagguguucgcgucacaguggcugaacuccaggcagguggugugcggcaccaaguguaacacgcuuuucgugguggacguggagucaggccacaucgcgcgcauuccccucuugcgggacagugaggccaggcuggcccaggaccaacagggcugcggcauccaugccaucgagcugaaucccuccaagacgcuucuggccaccggcggcgaaaaccccaacagccuggccaucuaccagcugcccucccuggauccccugugccugggcgaccgccauggccacaaggacuggaucuucgccgucgccuggcugagugacaccguagccgugagcggcucccgcgacggcacuguggcgcuguggcggauggacccggacaaguucgaugacacuguugccuggcauagcgaggugggucuccccguauaugcccacauccguccgagggauguggaggccauccccagggccaucaucaaccccaguaaccgcaaggugcgggcccuggccugcggcggcaagaaccaggaacugggagcgguguccuuggacggcuacuuccaccuguggaaagccgggagcgcacuauccaggcugcuguccaucaggcugcccuacuuccgggauaaugugugccugaccuacugugaugauaugucuguguacgccgugggcucccauucccacgucucuuuccuggaucugcgccaggaccagcagaacauccggccccuguguucucgagaggguggcacaggcgugcggucgcugagcuucuaccgccacaucaucacugugggcaccggucagggcucccugcucuucuaugacguccgggcccagaaauuccuggaggaaagagccuccgccacccuggaguccucuucgggaccugcaaggaggaagcucaggcuugccuguggcagaggcuggcucaaccacaaugauuucugggugaauuacuuugguggcauggaaguguuucccaaugcgcucuacacccacugcuacaacuggccugagaugaagcucuuuguggcuggggggccucucccugcaggccuccaugggaacuaugcaggccucuggagcuaaggaugaccgccuuguacuccagguacacagauuuaccuuucaguuccgcccgacugcccuucaugcugcauuuuuuugcuuuuaacucugugcgucuuuuguuuuccagguggaaccagcccagcuuaauuuguacuccuccaagcagagagagugagugguccuuuggucaaugaaaacuuggcuuuaagacuuuuugacuccuuuccaacaccaucuuuuggaauuuucauacaaagaaauuugguuaaucguuaaucuuuaguugcauucucucuuugagugauucauacauucuguuucuuuaagaagaugcagucauggucuuucaguuauguauauuuguuuuccuuguuuuuccucguuaccaauauuacaacagcauuguuuucaguuauuuuucauugcagauacgaagagaaaauuuucuaguaagcaagguguuccuacaucuuuucuggagagcuuaccauaguuuuauagcauuguucaauuggaaaaguacauuccaaguucuagauuaccuacguuuggaaacacuuaauuuacaaauugugaucuuaguguauauaguuuuuacguuguuggugcuaaagugcuuuuuugaaguuuauucucuuucaaaauaaguuaucauagaaucuugugcuuguaucaaacuccuaauuggucggaacacuuuaggagugcagggguucugcuucauugcauuuucagaauuaaccugaaaguugaaacaaccauuuuuuuuuauuucaaaacuuauuuaaguuguuaucaccuguccuuaaauagauaaaagaauguguauuuuuucacuuguugccuuaguacuaucaagacuugugaauauauuugaauguauguuguuugaaaaacuugcacagggcauuggagccaucaugaaaagcaggaaauguaaacguggaauguauggcaggcugggcagaauguauacugauccaggguauagacuagauauuuuugcuguugcuguuuuuauuauaaaauguuauauuugaggauauuuaacauuuuccaauucugcuuaagagguaauucacaauaaaaaaaacaaagaccaaaaauagcacauucugaaaaaaagauucuuaauaagauuuuauuuugugaaguucaaagauucuuuccuaaaguauaacguguuguuaaaaaguagugguguuauaacucucaauguaauaguaugcaauaucaagaacacaggaaguucguuucaagauaggugagauuuaaaauaaauaggaugagguugaagaaaaguauauuggagcgcagauaaauauaaauuguggacugcuaugaaaacagguuguacuucuccauaugugagacuacuggaagugagaagcaauauuugucauuucuaaaacuggccaggcugugcugacccaggauuaguaauuuguuaugucuguuuucccuuagauguuugggcacucagaugcuaucuuggugcacacacacaacauugcuguucagucacaaauccgaacaacuuaauauaauaaauuguacuaaaagucauuuaagaaauaccaaaaaguaagcuuuuguuucuaaccauuguuauaaaggcuaauauaauuguuguuauauagcaguaagauauauuugugugcaugcgucuccaagucaguuguaaaugucuugagaacagagaauacaauugucaucuuuauauugccucauuucuccacuaauacuuagcaaauaaaaggcaauaaguaaauauguacugguugaaugccucuggagaccuagaguuuaaaguuuuaagucaauaaauaaauaaauauuuacucuuaaauaauauagaauccuguuguguuuucccccc

SEQ ID NO: 18965 - RNA, 508 nt, Homo sapiens
gcaguuuuuacauuuauuuaaacagaaaacgugcacacgagcugucuacucauuuucuucgcugcgcagccuggcauugggguuggugacucugauggccaguugggcagcuguuuccacgauggcuuugcgguucuuggaggaaacauugugagcgaucucggcacaguaagauuuguugcacaucagcagcacuuccagcuccuugauguuguggaccaggaacuuccggaagccacugggcagcaugugcuuuguuuuuuuguugcucccauaaccaauguugggcaucaagaucuggcccuugaaucuucuacgaacccuguugucagugccucuggguuuccgccaguuacgcuuaauuuugacauauuggucugacuggugcuggaugaacuucuugguucucuuuuugacgaucuugggcuucacaaggggucugagggcggccaugaugccgaggaggagauggcugccaccuccguaggcagcgccgaggaagagagcc

SEQ ID NO: 18966 - RNA, 52307 nt, Homo sapiens
uuugcuuuuucacacaacauauauuuauucagaaaaaaauuugcaauaaauuauaauaaaaaagaugacacgaaauauagaaucccacuagcagcuuugcuuagugaucaagacguuuuugggaaauauaacaaacaauuacagaauaagaaaacagugaaagggagacuaaugcaaugucaccacauggauuugaaccauuucuucccuaagacagcaggugcagagucuuucccuaccagcugaauccgaaauccuuacuucagagcagcuacaaauuaguaccuuagaggacuuggcaauuacagguuggggugcuggaauagccaugguagggaagcagauuucuucugucugggucuacaucuugucuccucuaccuagagauugucuaaaacucucaacucuguauauguuccaggaugagcugaaaaaaggucgaggcaguacaccaacuuaguguuuugaucugauguagaaagagauaggauacugcauacgugcagcacagagccuccacuaaccacacccuugaucacccaaagaucccaggucagugauaugcuagaaaacaagcccaggaaagguauuucccugugguaugacccuaccccagugucuaucaucugccucuuuuugugaucacuuucuggccuugcggagaugacaaaccuguucugcucucagucuuccauuaacuaaguucaacaccuagccccugaccuaucauaccuccagaucuguggcaccaguaacuugacuccuauugcuuuaacucucaaucaggaaaggguuuagccauauugcagaauacguaccuucccccccacccccaccaagaaacaggagaaaucacugguggugccuuggauaugcuagaaaugucacagagucaaugcccaggauuguacauacagccuguacguuaugcuccuugcaauuaauguaaacaggcaagggugguuguaacaaaagaaaaccaggaggaacccaacugcaucaggcaguuuugcagucagugguugguggcuuguuugucaaccaauauagauuaauuuauuuuaaaaaaaggcuguaccacagagcuugaauaaaugaaaagcucagagggucaucuuguaugggagagguaaggugcuugguugguccuguuggccagucucuuuacacaacacuggauauggugacugggagccaaggggagucucuaaacccuuuaugugaaggagcugguuguagagcccagagucaguccugcugaggaaggaggugacaucugcccuugguauuucagaagaccagagaauggauucuaagggucauccacaauaccuuugcugugggaaggagcaauagcucuagaugggccugccugagguacaagacuuccucuuuuacuguggggccaguguugcucuggagguggaugucuaggcaggagaugggucucagagacacccaggauuaguccuuguguaaaauuugaauaauaacaggaaaaggauagugggaagcaggaccugucaaacaugaaugcucucacucuucagauacucaaagugcuuccauucugauugugauucucucucaucgaugagaugccaucucuaauagucccuacaguuaugcuacuaaaugugaucuaagagaauaugguuccacccaguguggagccaugaaaaggccaauguuacagagacauaaagaugccauuguaguagaaaugcacaaaugcauguaauaacugcacgcagacagugaauucacuguugaggacacccaaggagucacuagccucacucagacuucguucaaagugacagaacgaggggaguggagugcaaaggagugauccaggaaggggugggucaaaagugcaaaacaaaggacucuagacaagucucagcuacagcaaguagugcuuguaggccuagaaugggaagaucucagaaucuaggccuaggguacuaaggacaaucaugacaauuggguaggagggcaacaaacacaucccuaggugaaggaguguaaauacagaucuuuuugccuuauaaagagaaaacacaaaaacaccaaaauaugguaacuuuggcuuggcaauauaagucuaaaaguauuuuucuguguaggauaugguaaaggagggauuaggaaacgcucuuccuuuuuacuauaaacagaacuugaaauucugcaauagacccuuccuguggcaugacuuuuuaaaucauucugaaauacuuggagcccgagaucgucugcuucuagaauaucagagaacaguaaaagccuuagucuucuucgcucccaagcagaaagcccagaaggaacugaauagcacgcuggcggucacuuggagucugucuugccauaagguuggguggaggccucaggagaagacuagugaagagaguagcuacaagacgagagaaagacaagcggaaacuucugucagacauaaccuaagcaaaaccucagggcuggagggccuggggacaaggacuauugacugccaugugccugcauaugcaguaagguauauacuggauacaaugcacuaagaguauucucaacaaacgccccguguugcaugaagcacucuuaccgaucauguuggcauugacgcuauuguauucagagaauuuuaagaguucucgaaggaaugccaucaaguaacggaaaacauuucuauggcaucucggaagcugggagaucaccuguuuuuaaaaauaggggcaggcagugagaaaaacagguggaagaugaaaguaagaggaacuuacagcugcuguaauaguagucuauaauccaacccuugcaggacccauuucaucugucuaacuucuauuaucuccucauggccaacacaauaccuuccaaauuauaacuucaaaguaagaguggccgugcuguuuggucccuguccacucaaugaccaggccacguggucaucacacauucauacgcacacccugccucacaauaggucaguguucaucuguucuuuucccauuuccguaggcauguagccacggcaccuaccaagcugaaugguuuucuguucuuuuuuguuugaaugguuuucuuuacaaugucacuuagcauggauggggacuccucucaauacucacuaguccaauucacagguacugucagcuacugugcauuaaaaucauuucaggauuaaaaacacacaccaagaagagaaaaagaagaaaggcucccaagugucacccauccuuccugguaaugucagccagaauuccacguacaaucagcuucaccaauuuaccccagaguagagggauccaccccacuauguuuucuguaaacagaaauaggccaaugggaaaaagguggcaaauaucguaggaaacaacacaaccuaaaauuuaaggguagcaacucucaauguugguguccugccauuaauaacagaugcagacccauccuaccagacagcuggcugccuaucuggcucuguaaaacugacgacuucucuauggggcaaucugcgucaaacacauccccaggucaguagaacccaccugucggcagauccggggaucauaagcagagucaagacaucgcugauacagcucguaacagaugacuggcucuggcagggcuuccaagaaaaugagcagugcuucagccacagagugguugcugccagcugaaucaacuuaagucaagggaaaggagcuccaggagaaaggccacacagagccccgacgagcuccuuuccucaagcuccuacagggacuguuucccuccucuuauucagggcacauugauccuaauggggguuugauauuuuauugauucaagugcccugcaggugaguuguuacagaauuggucaaagacucuuggcagcuuuggcccagcuucagggucaggggaauauagccugcagagugacaguugacacuggagcaguccuauaaaccaggugcccauguuucccauccuucucccugcccugucaacaguacgugugguggcaggagugacugaucaccugaaggagaauaguaccagugcuguggcuucuaugucccaugcuuuuaagucauuguuaucuaccccuugcuuccuuuuaguaagagcuggauauggaaagaggucaaaaguuccugaaaggaaaugagaaacaaguggauagucagugguuaucuuauaauaaaagauauuacaaagaaaauaaauauagaaccacaaaaaucaaauauaggugcgaagaagaguuugaucaaguacucauccagcuucuuaagcuuuggucgcaaaggauacggauugucucaggaaugcugguauccagacaaucaaugaucugcuggagcucuuccugcauuccaggggucuggaacagguccuccuaccaaagaagucagaaugaagggacaggcaagauaaucacuccugagguuaugaugauuacccaaggaucagaagagcagcaggaagcaaaagggaagggugguauguguguuaauaauuacaaauggaggugugaaaauaacacauuuuuccuuuagcauuucucuaauccaugugaaauguuauuucaaauaggaaaaugaucuuuucaaagguuuuagccuguaccuaauaaggcaggggacuagauggcuagagcaggaaaccagguguucuaauucuagccuccuuuaaaauuuuuuuuuauagagaugggguuucaccguguugcccaggcuggucucaaacuccugagcucaagcaaugcgcccgucucugccucccaaaaugcugggauuacaggcaugagccaccaugccuggccuacuuguagccucuugacaagcagcagaaggcagaguccaaacagaauaaccacauucaaaugcuaguacuacugaacgcuggggaaggaggaaaucgcaugcucauacuaaaccuugcuuucaaguuacauuauucgucaguagguaagagaacauuaccuuucaauuuagucccaagaaauaucucuuuugggggcgaaugaggugggguggcauuuuaguuaggauuuaaaagaaaaauuaggaccaaguuaaaaaauggguuuaaaaucugcuuuggauuuuacaaucucuaaugccuacaugacucauagccaaaguaggcauuauagacucaggugugcagcuguccagggaaaaugagaggguagccaggagacaggugcucuuaauuugguccuggcucugccacaacuacacuuaggccuuugucuuaguaaauaacuuaccuuuacaugcuucagcugugacaucugugacuaggacacuuccacccacccagucgaucugacagugccacugugugcagguagcuugggaaaguuaaaagcgcuaugcugacgugagguguugugauuuccuauaguaguuacacaccuuccaaaguuguagggaaggucuacucucacuuaccuggugacaggcguauuugaauaggugaucuacuagaagccagaucuccuugggaaccugaaggggucucucacuggcaccuucauccaaaggaaccauuugcagaagggauuucuccuaauagauggaaaaguaugagaaucaaaggggucucagaauaaagacuuugguguauaacuuaaaguccuucaaauucuggucaugcagguaaaaugugaucuucaucucuuaagauuuuccauuucuucucacuggggacacuccuggucagaaggcacuugauagcgagucccauaguuaaaggauguccuuuccuaaaugcuucacuuaauuguucugcauuucauuugcguuuaugauguuuauuacguggaugccuuguguuuaaauccuuucaaaggugacacugagaaccagugcuccggugauacagucacaguggaguccauacagcacuggugacuuggggacuauuaaauuacaauugucaauacaguaguuugagagaucaaggucuacacuuagguuuuuguuuauuucuaacuuacucuuccuucaggucuuaccacagauacuguuguuuguuuucaauguugauuuaaauuagcuucuuuaguuuucaggaauuaaagacaacucuccacaacauuagacccacauauguaaauacuucaggcuugauggaaguucuaaucuuaaggugcuaaaacucguaagccuuaagguccaaaaauaguaaacugaauacagcuaaccaagaggcagaaauaccacgaaaaguuuaaggucugaguccagaaguuacaguuucuaggaauagcucagccaagauuucuaggggcuuuuacuccuuucaucuaucuuucuacuaucuguuauauucuucugaaagaauuuuguaagagaaaaacccagaagugacauaaaucaaaucaaucacuauaugugaauuggaaauggcuaggaaauaaacucaguuaucuuagguucauguaaucaaauauaaauuacaugaaaaaauguuugaaauaguaaaggcaccugaaggcacccuucauaaaaaucccaguggagagaaccaugaccaauuuuuuugcauccuccucccucccccgccucuagcuugaggucauauauauucuguauguuuaacuaagaaauucuugccuaacauugugcaacuugugaauuccauccacaacccccagucacguagcuuuaaaagaaaaaaaaaggagcaugucacuacuuugacagagaccacauacacuacagccgagcugaggucucuucuuaacauuguguucuuuaacaagcacugaugaccuuuaaaagcugcugugccuuuccaagggaauaagaaagagaagggagugugacaguugguuaccauuuaaaaucuuucuuuuuuuuccccacauucaguuugcuuccuuucuuucccugggauucuaucacuugauauucauguuccuaauaguugccagaaugucuaucaauggcucauccauuuacuucuuuccaguuacaaauaucaaauccaagcauccacaugguauuugagacaaaacacuguccaucaugcacucugcuaacucucuggaccaaaugcagcacguguacugauucuuuagcagaugccuccaaacuugccauauagaaauuaugcagcacugauucauguacuuuuuaaaaagucugacauccaacuggagcuuuuccuguacuaaggcauuaaggcaacacaaggcacugccuaagauaaaaagacagaacauggacugcucuuaacagggaagagcuaggaagcacagcugucucaaaccuuggugguuuaaaaagguuaauaaagugucaguagauuauauacaccauccacuauucauuuucaaauuccuguaugauaauauggaaugccacaguugugucuccaaagucuagagaaagaucauacacagaaaauacuugaauaauuucacaaauuauccugaacucuaauuuucaaaggaaaaccaagguacuuugucuucuuucaacaagacacauucagcgccugauaagcccacacucuguaaccuuacuuaguguuaauaacuaaagcaugaaaacaguauaccauccccaucaucaaaaggcauuaaauuccaccaaguggguacagugcaugacuucagcaaguuuuucaaccuuucugggccuugguugucucaucuauuagaauggagaaaauacccugucugaagguagaggccugaaccagaugaucuuuuaugaucuuguucagguccacgguucuauucuaugcucuauuucuugaucauaucuguguauuuuuuucugaaauuaauugcuaugaucauuaaccucaaaucauuuuuaaugcaacagaaagcuacuucuucagguuuuauugucauuggaaauggaggacagcuaacugguaccccccuccaauucaugagcauucagauacaucaagacggcucuguaguuacuucucauuucaaaaauacaaaucuagaaccuugaguccuacuguuuuuauguacugagucucaaugacuugacugcuacaguaaauaucuuuccuguacuucaaacacacuuaaggacagccggcaggacuuuaggggagucucaccaagucagaggucucugauaugggaaagccuagggacaaauuccagggaccacaguuaaguguuaaucaagcacagggaaacucucauaaccaccaauggauugcauuaccuuuucuaggaagcugucuucuuccugagagcggagcaggaaaagaaagucauugacagacagaauaugauuagaauuaauuuacagaauuagaaacagaucaguauuagaacucacuaucuuaccagauauacaugcuuuaaacagcuuugaauucuucaaauaaauuaugauuguugaaaaugaaauacauuuuucauacacaaaguuuacuauacauuuuaaauuuuugugcaguuugagaauaucacucaagaaauaugugcaguucuagacuucagugcccuuuggcaucugccaacugacccagccaaaugccccugaugucucuuccugucugcugcuuggaggcaggugcauugagguauauaccucaaugaaagaauauggcugugggcccaacaguggccaucuggaaggagaugguaaaccacucuacuuuccauuuucauucuucucaccccagccagucuccuaagcagcaucccagauuccuuucuaucuccucguacccaauccccuccucaaaggcccccagagugcccagauuugaagguccuucugaacuauaaaugaauuucauuucagaccuuugcggaucagaagauccaucauuaucccauuuuuauuuuccuauugggcauaagagaaaaaaagagaggcaggggauagguaagaagguaucuuuuuaaucuuccuaucuuuuaugcuguuauuacaauccaauaauaauagcagccaugauaacuaccaccaccacuuagggagcaucugucauguaucaggaacugugcaaagugcuuauauacagucauuuaaucuguacacaugugcaaaguagauauuauucccauuuuacagaugaagaaacugaggcucugaaagcuuaaauuauuugcccaaggccacacucacuauuagguaguaaguggcugaaucaggauuggaucccaggucugaccaacuccacagucauuaucacuauguuccguuagacaauucaaaaaggacaaugugacugcuuccuggacagagagguagaggaaaacugugagaauguauucuccauaacaggcuaaggacagugagaaaccccacuuaaaagacagcgugguuaauggaaagaguauaggcacugguguuggacaggcuuggguacaaaucuucguuccaccucuuggcaauuuuguauagcccucacacaaguuaccaaacuucauagagccucaguuucuucaucucuaaaauagggauaguaauauuuaccuugaagcagccuaaaaccaaugggugauggggcaguaugccagcagaaggucuggguuccucaaaguuccucauaccuccccagugacucccaaccuggauuguuucgaaucugacuauggaccacuaagcacucaagucuaaauuacaugucuuaguucugcuagguaaaaggagaaaucccaaucuuacugucugagaugcacaggagcugggaguggagagggaggaggaaaaguaugugcucccuggcauuccuagugguaauacugaaugcauuccucccacacuacuguuauccauggggauuaggcguuuuaauauugguagauacuucacgaauuaaacaugcuuuuguggguuuaucuagacucuuaaauaucacaugaaauaaagcaauuagaauagucuuuauaagguacauauuuauaguacuauaauuacgauaccuuuuaaugucaaguugauuuugagugcccaacaucugauacaauuuuagacuagaaccucuuguaaaauuuaggacuuguuaucaaaugaagaaucuaucugacacauuuuauauuuuuccucccaugaauaucuaauacaugauaugaauaaaacuagacagagauuuuguauacuaaccugucgaaccaggcucucaaaaaaguuuucuuuaagcagcagccauccuccaguacaaggcauugugcuaaaaugccuuugcaggggaaggcaaugagaaaugaggauaaaggagaaagaccugguuugucccugacucugauuugcaacugaguuggggugaggaguuccagaguuuacagacugguauuguuauaauucaugaauacgaguucucaauaaaucauugcuagcccuuuaaaagacucacagaauuuuaaaggguagagauggggagagaauauuacaaguggaagaggcagaaauaaacaaaaggcacagagacaguaaaucacaaauugauauuaggaagaaguuagucaucuguuuguggggggcauggagaaugccaagaaaaauagugugaaauaaaucugaaaagguauguugaagucagacuuaggaggaccuugcaugacagauuaaggcauuuggauuguauucagcaggcauggggaagccacugacuaccuuuaagcaaggaagugauaggccccaaagcaguaguacagaaagaucaaucugacagcccugaauaggaaaaaaugaagggcagagacagagacagagagagagagagagagagagagagagagagagaaagacaaagggaucauucaaaggcuaccgagguaggucaagcagaagaagguaaacaucuuaauaauggaaaauuuuauacacacacacacacacacacacacacagguguguguauauauauauauauaauuucuaaguauauauauuaaaggauauauauauauaauaaaagguauauacauacacuuacaaaugaaugaauacaagagaaaauucugaaagaagaaucaaaaggacuuugauuaaauacugauggagggacaagagauuuacuucucuagguacaggcacaaagaaacaacauagaaauuacauugaauucaaccuuggucucaauuuugaaaacagaagcaucacuuaaccuuuauuaguaaacagcuuacuccuauaauaauccuaagguuucuacuaugaaucacuuaguucaaccaauuuuaaagagcagagaugcccauucucugcaaaaggcuauauauggauuacauuuaaaaagagaacuuaguucaggauuuccccagugggacaacacuggcacauagcaaaugcaaugcaaaucauucuuuaccccaacauucacccucagaagacuguuccccgugguaaaugcagcuaaaauaaaagagucaauuagagguggaagaugcaaauuuaaaaauaaaaagcauagccgggcacgguggcucacgccuguaaucccagcaccuugggaagcugaggcggguggaucaccugaggucagguguucaagaccagccuggccaacacaguaaaaccccaucucuacuaaaaaggcaaaaauuagccaggcgugguggcgcgcgccuguagucccaguuacucgggaggcugaggcaggagagucacuugaacugggagauggagguugcagugagccaagauugugccacugcacuacagccuggccgacaggguaagacuccaucucaaaaauaaauaaauaaauagccgaaaacugaauggaaaaugaaguucuaaaaaggauuaguucauaugaaauagagaagaaauacaagccauauacuuaacagaguaagaaauggaugguuagauuaguaagacaaaguaaaaacauagugaaaaaaacacuacggacaaauuaacaaguuauuccuguuauuucaaacuuuugauauuguucucccaacagauauguccccaagcaaauauaguuucucuacccaucccucaacuuuuuucaucuccguauuuacaacuuagccacaucuggcaaguucaagucuugucuccuuucaauuaguccauucuacaaguaacaccagaauguucuuccaacuauaucaauuugcaaccucauacuaaucagcaaacccuucugaugguucuagauacccucuggcucaugcauaaacuuaucuauugacuucaagacucucuaccaccugccccauucucccuaaccagcuucauacauucuuauccuugaucuucacuugucccagggaaaucuuacaguuuuucauacauggucuuuucacuuucaccuucuacccuuuauucaagauguccucuaagccuggaagagccugcucacccacuauauuaauaaguguuucuuaaguacuuggacuugacugaaaauacuucuauaacuaacuccaaaucaccuuccuaguucacuuuauucuuaugugcuaaacuuauuucucagucauguuaauguuacauguaucaaauauucauuaaaaugaaaacaggcugauucugauuucuauagggauuagcuggucagucaauaagcuuuuauagcauauaagggcuugaauaaacaacauaggaaaggaaccuauuguuaauacaaacuacaaccuucauagcagucacuuuaaacgacuuuccaaaauacugacuuaccaagcacaccagacauuagccaguaaaggugguuaauguucagauuaucuuuaaccaaacucccuauuaaccaugacuuaaaguuuagccauauuuuaugugcaaauauacuuucaucaccacuaaauuaugggaacucacauaaacuccauaauacuuuguauccaguguguaaugaaucaauauugaggauuauuugcuacuuaauauucuaguuaauauaacagaaaaaucuaucuuaauucugaaaaacaauaaagaugauuacaaaugguagauuuucauccguuucccacuugugcuaaucucaacuauucuaggaguggcaaagucacuauuaugaaaagggcuggaaggaugaaaaauaauuaugucaguuauuucauucugcauuuggugggaagaugguguggcauaaggaucuuucuaaaacagugcauaaggaucuuucuaaaacaguacauagagagacaacacauacauugaacucguuucuggcuuuaccaaaauuuuagagcaaauaauacaacagagggcagguaccauuauuaacagcaucaucucaugagauuugaaauacgauauugggucuuggggaaaaaaaacaugaauacuauaccugaggaaucauuucagaaggucaaaaucaagucacaacagagugagaagguauuaaagaugggauacuaauuguuuuuagauuucuuguuuacugcuccacaguaaugcagguugaguauucccaauccagaaauccaaaaugcuccaaaacucgaaacuuuuugaguacugucaugaugaucaaaggaaaugcucauugaagcauuucagauuuccgauuuccagauuagggaagcugaacugguaaguauauaaugcauauauuugaaaaucugaaaaagauugaaaucugaaacacuuuuggucccaagcauuuuggauaauggauaaucaaccuguauagauaauuuccucaucaaugagauacaggaauuuaauaacacugaaaugcaacagacugugaaaagaacccuaaauccuacaaaauaaaagcuuuaaaagaaaaaugauguccacacacauacaauuuaauaaaaacucagaaauucuguaauuaaaaaugaucaggguucuauuauuuuaacccucaaucacuugugcacaaaaagaaggaaaaaggcuucccaaagagccauucauuccucuaaugauuuugguuccuuucuguucaugggcaaacaugguaaaauuaccugauaguauacuuuacauaaaauaaaaacuuuaugaggguugagccucuucuggccaaucccagaauaugaaaaacugcaaaguuuuucauauuaauggcuuugcaguuuuucauauuaauggcaaagauauucuaauaucuucacugacucugacuaaaaauaaggguagguuccuguuuacaugaagguggaaggagagaguauaaaugggauaaguuuaaaaaaaaaaaaaacaagaaggaaacaaccagaaaaauuuaggaaaugguugacccuugacuggacauuuguacuggacucuuaaaaaagucaaugucacuaaagaaaguaggaacuguacuacuccaauagagacuucagagaccucaccaaauacuauaugaacccagauuggauuuugguuuaaaaaaagguauaacagaaauucuugggacaacugaagaaaucugaauauggaccgaauguuaaaugauacuauggauuacuguuaguuuucuuauacauaauaaugguauugugcuuaagugugcccuuuuuguuaagagaugcaggcugaaguguucaguggugaagugacauauuaccacuaaauuuuacaugacacagcaaaaaacaucuguguguauauauguacagaaggcauguggggguguguuguacuguucuuuccauuuuucugcacauuugacauuuuucauaauaaaaagcugaaacaaagaaagcugggaaauaaugucugagaugaaggaaaggggguaggagaaauaagaaaaacaacuucaucauccaaaauguauucuaaaaggugaaauacuaaaaucuaaaagacagaaauauaauguuaggagaaaaacaauuaucaugaaaaacagcagaacgguaggauaugaauuucugaagaaaaugguucucucucaaacagagguaauauacucagucaugagggcucuggggaaauaaguauaauuccaagaaagaaugccggggcuggacucaguguuuuaaucugcuaucugagucacagcuaaaacaauuccauggcaacagaacagaucggacucagacaagccagcagccugccugcuggucuagaccucccugcuagauacaaucacucgcucuggcuaggccuaaaggauccaugugaauacuaaugguaaggauaacguaugcugucaccucaccuaauuuucuuugguaaaaaaaccaagaauauacuuuuguagcccaaagagauucugcauacaauccaacaauauuuucauuuagaaggaaauuucuuaauacaaugaacuuuauuacuaaaucaacuuauguuacugaagauaguaaguacuuccuucauaaaaacauuaauauuauagcuuggcuugagggagaggugggaaaaucaaccuccuuuucuuucuuaagcacaucacauuaaguaaguaucaaauuucaauguacauuauaagcaucuggaaugcggauaaaaugcagaucuguaggcuccauauccugagauucugauuccauugccagaagugaggguaccuguaauaagcacccccagggauucugauucagguacuccaggguuccaggauaguucuaugcuuccauaaauagcaaaguuuuacucugauuagauauaaugugguauuagugaggaauacuaaacugggagccaggaaaucugggugcuagauuuguuacuaacugaugguauuugacucugggcacgucaaugucucugugccucaguuuucucauaugcucaaaugaggauaauucugccugccccacuuagcauaccucacguacaugcuaauuuauacaaaagugacuugagaguaugaagagcuuaacaaacaagcauuauaucuuugagaggggagucuuuaaucuuauuuggugagcuuaguauuauguauuguacucacaacaagagccaacugcagauuaguccccccucuuuccccuuaggcuuaaucuaaucaaaacagugcuaaaguaacauucuucuuuaucauuugacaucccccguggccaaaagaagacagaaagcacaaagauaaugaggacgucacuuaaguauugugaaaauuaaauguaaaagagguuuaugucuugggacaguucuuaccaagucuaugaguuugguaacaggaacuucucggauuggucuuuucauacggcacagagccucuaaggaugugccaaaacaacuugggagguaauuuccacugauagucaagaaguaaucuuugccucgauccaggugaaggacgagaauaucuucaaucuuaucuucucccgaguucaggaugguuacagagucuuugcugacauacacaucaagagaaauguccacugucucaucugaaauguaagagaugauacaugguaauaggaaaaccuccagugggaaagcaaaaaagaguauaagaaccaacagaaaaguguccucuaaaaaaaucauuaagcaaugagggggaagagacaggacacacaccagagguaucaccaauaugacaguaaagguaagagacaugugguuagaaaacagaaaguuaaaccaaggggaugggagucaugacaucaccagcagagacaaugguaaagggaaaacucacuuggcuccaaguagcccucaaaagguucagcccgaagccauggcuugcaguacuggcugucauuaaguuuagggaugaaagaaaaauggcagggaaccuguccauuguugcugaucuggaacuucuccuuuuguaguugccgaaacuucacauuuucaaacacaaacuggggaauaacagacagacacaaacaugcaucacuaguaggggaaguaagucaguuggauuauuccauagaggauaugaggaguaagguaauuguuaagcaggugugcaaaugccauagacauucaccaacugaaccaacuucacaacauccacuugcauguauuauuauacucacaccagcagagaaggaguuagguggcucuugcuacuucuccaggcuacucugaucauuccuaggauccuaagaggguaacccaaccuugguucagaguauucauccugugaccaaguccugguuucugagauauaaauuaacuagcaacucugaaauauuaaauaagagcaucuaacagcggagggcuuacuaugugccgggugcuguucugagagcuuugcauguauuaacucauguaauccuuacaacuaccccuuaauccaggaaaggaaacugcggcucugagcggguaagauacuugccugaggucauacaucuacuaaacagccgugcuacaacuggaauggaggcagucugacuccagcgacaugggcuuaaccacguugcuauguagccuuuucuaaguagcaguuucuucugugcuaaccacagugagcaguagacagggagaucauguauuuuugcucaccucccuccugcugaguucuaaggaaggaaggaagucauuuuccauucuguccaugaugcguacacuaucuucaaagacuuuccgguaccuucguucauccacaaccuucaccugaaagaaaauguauccucuuuucagucuuauauccuucuagcucaucucccuuggagauuaucuaacaauuuaaaacuggucauuacaguaacuauuuaaaauaaacuguggugcaaacaacauccucaaacacucucuauaucuugcuucauccacagcuugcaccugaaagaaaacagauccuugcuuuaguuuuauguguucucaacuuuuauaccuccaagagucucuaacaauuuuuaaggucacuaaagcaaacauaaauugaacaaagcauuauagaagcacacgcuuuaagguaaagguaagauuaauuggcuaacguccuguaaaaguuaaaccccuacguuaagaagcuugguaauaauaaauauuugggaagaauauuuucuugcuucauuguuaaguuauuugguaguggaaaaaaugugauaauugugguaaaaaugauugcuugcacuguacaaaaugacagugucaaaacacagcaauuacuguuucuaacaaucauaacuuggugagguggcagcaaauauuauuaaaaagcuuuuaacucuauuagauucuauguacaauaccaagaaguauaauaucacugcucagauuacauaauagcagagauauauuaauaaauggaaccuacagccauuuuagaaaauggcugaaacaaaauguccuagacuagaguaaaaccaugacaacguauaaacacaucuccacugauaaaaaaauuuuccaccugacacagcacuuucagcuuccugauauagcuguguuuuuuuaaauauuaaaacuucauacaaaccaaugccaaaauuaacauaacuaacagauuuuaacuugagauaucgguuucuuuuuuagacuaggaaauuucacaaaaauucaugucaaaaaaaauugauacaugcagcaaagguucuaaaaagauguggaaacagaugcuggugaggcuguggagaaguaggaacgcuuuuacacuguugguaggaguguaaauuaguucaaccauugugcaagacaguguggcgauuccucaaggaucuagaaccagaaauaccauuugacccagcaaucccauuacuggguauauacccaaaagaauauaaaucauucuacuauaaagacacaugcacacauauguuuacugcagcacuacuuacaauagcaaagacauggaaccaacccaaaugcccauuaauaauaagacuugauaaagaaaaugugguaaauauacaccauggaauacuauacagccauaaaaaggaaugagaucaggcugggcacaguggcucacaccuguaauccuagcacugcgggaggccgaggcaggaggaucacuagaggucaggaguucgaaaccaccccagccaacacggugaaacucugucucuacuaaaaguacaaaaaaaaaauuagccaggcaugguggugggugccuguaaucccagucacuugggaggcugaggcaggagaaucccuugagcccgggaggcggagguugaagugagccaagauugcaccacugcacuccagccugggcaacagagcaagacuccaccucaaaaaauaaaaaaagucauguccuuugcagggacauggaugaagcuggaagccaucauccuuagcaaacuaacacaggaacagaaaaccaagcaccgcauauucucacuuauaggugggaguugaagaaugagaacacauggacacagggaggggaacaacacacaccaggccacucgggguaguggggcgaggggaaggagagcauuaagguuaaauagcuaaugcacguggggcuuaaaaccuagaugauggguugauaggugcagcaaaccaacauggcacacauaccuauguaacaagccuauacguucugcacuuguaucccacaacuugaagugaaauaaaaauuuuuuaaaauguugaaaauaagaacaucaaagcugagucaaguaucucagacuggggaaguuuuucacauauuugaacuguaacucuuagagaaccgaggaucaaacaaucacuuuaccaucaccaggguccauaguauagcauuaguuuaagaugaauuuuauacuuuuacaaaacuuugcaacuuuuaauuuccaaaaguauuuugcacaugucuuuuuauuuucacaaccuggaaggcuaccaaagcaaggaauauuuuuguuccgauaguugagaacauuaagauacaaaacaaucaacaaacuugcucacugcuacagugaauaccaaaggugacaucuggacuaguuuaagacucuuuccaauauacuagauaugugacagaaucaacuugaguaugucuuaaaagcacagcugccugggucuacuaaucacagccucuaggggugaggacacaugcauccacacuuuuuuuaaagcucucuaagcaauucuuacauccacugaagucugagaaccaaugcaacagaucacaguaccaagugcaggguuggaacccuauccuagcucuaucucagccagcccacagaaagucuucugaaauuaauuggccacggugcacuuggcuccuuuguuaacagucauuggugccaaugguggugaaaauauagugugguuuuuaaagccucuaaucauagcaugcccaagaauccaaaacauggggugauuacucaauaaaaucaaacuuuuucucagcggguuaucaugaucacagcacuuaauggcaaaucaaagauaaugaggagggggggaaccccaaagaauuucacaaccugacacauccauuuuaguaaaggaaauuacugacaaaauuaggaauuugaaaaaaaguacaaugagcuaggucuuuauguaauaagaugggagguucuccaagacacacugcugaguuaaaaaaaaaaaucaaguugcagaccaacacauacauauaagaccguuuaugauauagagacacacacaaaucaguauuuugucuaugagugaacaaaaaagcauauacaaaggucuagaacugcacuguccaguacaauagugacuagccacauagggaauuugaauuuaaauuacuuuaaauuaaauuaaauuagaaguucaguucucaguugcacuagccacacuucaaguacucaauagcccccugcugcuagaagccacuggacuggacagcacagauacaggacauuuccaucaucacagaaagcucuauuggacagcacuggucuagaaagauauaaacuccuaaggguaguggccuggcuggggaauggggguuuaggcaaaguugggaguaggagacagaacagggauugaagaacuucugccuuaucugucaauucugcuuaaauuuccuuuuaauuuuuuuaaaagcacuugucauugcuguauaauuuaaaaaucauuaaaaacucaaaaggcauaucuuuauuaaagauauacauaaauacacaggaagccugaaaaaaaauguaaauaucccacuagaagcucugcauuaauguguauggaguauuaaaaacaucccaagguuggcugcgagcgguggcucaugccuguaaucucagcacuuugggaggcugaggcggguggaccacaaggucaggagaucgagaucauccuggcuaacauggugaaaccccgucucuacuaaaaauacaaaaaauuagcugggcgggaggcugaggcaagagaauggcgugaacccaggaggcggagcuugcagugagccaagaucgugccacugcacuccaaccugggugacagagcgagacucugucucaaaaaaaaaaaaaaaaaaaccaaaaaacaaaaaacaaaaacaaacaaaaaaaucugaagguuuugaaaagaaauguaaacaaaaaagccaggcauaccugaucuaaccaaagagguuaguguuugaggaaagauacccucucaaaauggauuaagagaauucaaaugaagaaaaaggggcagccugcaaguacaaacuagaaauuagaugggcuaaaagaaguuaucuaaagguauauuucaucaaguucuauagaauuauagagguauugugggguaguagaaagagcacagaguugggaguuaagccaacuuaagauuggaaucucagcucuccuccuaguugaaugcucuuaaauaaguuauuucaacuugcuguucuccaucugcucaucuguuaaaugggaaauacaguugucccuugagaucugugggggauugauucuggcauggccuguguauaaucaaauucacgcauacucaagucccacaguuggcccuccuuauacguggguuucacauccugugaauacuguauuuuccaucugcauuugguugaaaauaucuggauauaaguggaucuguguaguucaaacccauguuguugaaggaucaacuguauuuaacucaaagcguuguugugaggaguaaaugagaugugugcaaauugccucacauagucccugccacacagccacuagcugcuaucugaggaacaguuacuauuauuaaugauuauuauuuuaaaauuucaaaauggacaaaaguaaagucaugauugucuugauaaaauuuaaaaucuauucuaagaccaauaaauaauucugaucuuaaaugaaaagccccaaagucuuucuuccuuaaaacaggagcaggauaaaacagguuggugauaucuaucucagaagcccccuaaaucaacacacacacagaggaaagaaaccuaucccauuaugcucuucacauguccgaacucauuaaucuucaugaguauguaccaauauuacccacgcuuaauagaggaggaaacugaggcauaaauauguuacauaaauuguccaugguuacacaguuagaaagugguugaacucggaugcaaaucccagaagucuacuacaaaguccauucuacuaagcacugcacuauauacauucugacagauuauagggcuguagaucugaaaaauccacaagaaauaaccuaaauguacuggcuguaacaaauuaaaucagcaugauuacaagauaugaccuacauaccaauaacacacaguuuaaaaauacaaugggaaaaaaacuuuacucacaauacagacagaaaauuaaauaacuggccauuaaugcagcccaggauagaacagaguuaaaaaaaaauucgcugggcacgguggcucacgccuguaaucccagcacucugggaggcugaggcaggggcaucgcuugaacccgggaagaggagguugcagugagccaagaucacaccacugcacuccagcccggaggauagggcaagacuccgucucaaaaaaaaaaaaaaaaaaaaagaaaaaauaaguguagggaugacacuauaucccuuaagacaauauacagaguuggcuguauucugaucagucugugccuuugcuccugcugucucuacccuuccacccagaaucucccuccugguguuucccuucuuuacuaucugauaaaacuuagcuuuuaacucuucauuaugcauaccuacuuuaggaagcucaaguuaccaccuaaccacuauguagcaugagaaacaucugugucacuaaaaggccuggagcauuaagagcuauacggacagcauuugggaggguugggggcacuaaccucucaaugcugcaaaugguuauuugguuauggaacauuuauggcuugcugaauuacugaucuguucugagucuaaauaauccucuaguaauugauacuuaacacacaaauaaaugaauguacaaacaaguguuuaccccaauauggaagagggcgcuaacaggcuuguggucgcugguuuucaguuccaugugacuccgauaauuaagcugauuaacauuuguuccucuccaaagaauucggucacaccaggcuggaacccggcauuucccacuguaaguaaagaaacgaguuauaaagagaacauaucacacaagaacauaauaccuaccacacugguuuagaucaggguuaggcucucuuguuacaugcucccaaagaaccguguacuucuccuucccuaacaaccccugucauccucccuacuauuuugcaagcucugugaagggacuguauuugcuuguuugccacugaacuccuagaaccuagcaugguaucuggugcaaaguaggugcucaacgaauaguuaucuaaugaaugaaugguucuguuaagauugggaguacaucuucaacaaugucaccacaggagaaaauagcacguucuuaaaauauccucagaagauuuggauuauauuuugaacacuuccuuuuccuuuacucuaugagcaucaacaacacuucacaacagauagauaacuaaucaagucuaaaacuccaaucuucucuuccuagacugggcuuaauuuuuggagaggaauaacaguauugauuucuccuuuaaaccagacauuuauggacaagucuagcuucuucuaauagagacgaaauaaaaucaaaccaugcaagucugagcaaaugucaguccacagaauaccaaggguagggaaaaagaaccuauucaucauucuauuaaaagaagcaacaccuuguacccugauccagaaggugacacagauauuucucaucaguagcucugcagcugacucuaaagucaggugagugaaacaaacauggcaaaguguacaagaucuaacagugucacuucauuugcuggccaguuaccuaggagcauaggaauaucgacuccccacccaugccaguacucucagaguucaaaacagcugaacaugcguggggauucuuucucuuucaaguuucugugcucagccagcuaggagaaacagaaagaaaaagaagaaaagaaaaagaaaaaaggaaaggaaaagaaaagaaagagauaguagguagaggacaaauacucacuaagaacuuacugggggcacuuuacuaggaugauuaggaaaucaaaagggucuacuggccgggcgcgguggcucacgccuguaaucccagcacuuugggaggccgaggcggguggaucaugaggucaggagaucgagaccauccuggcuaacaaggugaaaccccgucucuacuaaaaaaaauacaaaaaauuagccgggcgugguggcgggcgccuguagucccagcuacucgggaggcugaggcaggagaauggcgugaacccgggaagcggagcuugcagugcgccgagauugcgccacugcaguccgcaguccggccugggcgacagagcgagacuccgucucaaaaaaaaaaaaaaaaaaaaaagggucuacuaaacagugguucucaguguucuccagcuguggcagauauuagguccaagcaucaguauuuuuugaaguucucuaagggauucuaaagucuuuuaaggauugagagcuacuggugcuagaagaacccuucauggcuucguuuuugccuucugguauccugaauuaaauagcuggguaguuugggaaaaaaaauagccagaacagguaauagguaagaaacaaaggcaaaaucaggaaggcaaaaauuuaagcaaguuugcugaggugagagaaauaaggcacuguagguagcccauaaaacuucaacaaucuugacauauaaguaauaacuucccuaagauaggcucaccuuugaguauagauaaaugaaacacucuuauuguucuauaauagcacugaggcacugagccauuagguuuauauaucugcuuauggcauggccuaaaaaauuccuagccccuuaccaauauggagggucagaaauaagaucaagccuuaaccuucucugugagaagguucuuauuacuuuaccuggaaucccaccggucuguuuuagagucauacuuauaaguggggaugaacuugauuuccccuucauugaagucaacaaaagcuuuuuucugugugcgcugaauauuuagcuacagauagaaagaagcaucaaauaagcaggauaacacuaucuuaauauaagagauaaucagguugauaagccacuguuccuauuucaaaguaucuaguuccacaaccuuuacaacuguagugagaguacauaaaugaaauuucuauaccuuaugaauuaaaucucagcauucccacagcaucuaaacucacccucagauaggaugcuuguuauuagcacaucacuauucuuuuauugcuaauaguggcagaggguaaaauggaaaaaugaaaucugaauaauuguaaguuccuuggagcugggcagaaaccacccagcacaauuuuaauuuaaagaaaaagcacacaaauguugaaugaauaauucugcaaaccaaauucagcgaauaguuucaaauuguuuugaaagauccucacugaaauauuuuaccagaguuauauaagacucagaauuuauccuaaauguaccccuuuuggaggcagaauaaagaaaaagcaaagaaauuugucagccaaccacaacgugaagguagacauagacaagaauggcucacuacaaaaaccauucugcugcaaaucaccugaauguuggcuacgucugaagguugaaaaggcucucauaacgauuuaaagauuauucgaaugaagucaaaacauuuuccucccucaauaagaagcauucacuuuuagcagccaguauccauauguugaaguaaaaauucaagucacaugccagguucugaggcaaauuuacugcuucaaauauauggaaaccagguucuugaauaucagguuuuauguaaauguuaccaacucaaugcuuuuccugcagguuuuaaauaccagcuagcuucaacuuaucaucuaguucccaugagcccauagccuaugcuguugaucccagacaaacuucuuuucuguacuucccaguuccccucacagggccucccucuuuuaccuccaagcuguuccucagcuugccaaguaaucauagaacaguuuucacuguuccaucugccaaaccacaucaacauagcugaaggcccacuuccuccaggaaguguuccccaauuaaccccacccauucaccaacucauuuagacaaaucucugaaaucucuuaaugauaaagacguuuugaauaaauguuguauuuacuuuuuaucacuaauguuaucuucccuccucccauccaagcacuuaauaaaaguacuacaaaucuuguauguagucaaugcaucacuagucacacuguuuucacaagacaguaagacguuuccaucacucccuagaguaagauauaccucccauaacucuaacaaucucaucucccaucuaggaaaguuccuauaaaaugaaacuuuacuuaccuggucgaauuucaagagucucugaaggucuuucuuauuaauaagacuuuucaccucauuggcaucaggcaugcaaagucuauaauucaaaucucccaaccaaaugacaacccuaaggaucaaaaaaauguaugaacagaaguagcgauuagcauaaaaaaaacagagaaggauggagagaagaaaaauggguagauuauugauaagggcucacucaccacuaucucacaagggguuuaaaguuguaacuaauccuuugagggcaacuacuaucaacaccugagagagacaauggauuacaaaauagguaggagaagaggacucuguacaugaagaaugaaacugggaaauauuacguaugggauuuagaagccaaggaguuaauggacugagaagcaugcaguuuauuugcuggacaagcuucaaaauuuugccuggcugcuagccaggucuuuaggggaagagaaucugaacguuuucugccucucagaguccugaaguccugcagguucuccacugaagucugcauggucugagugacagcucuccgaggcaggacccacuaagaaaaguagguccagggcucucuagugaagccugauuggucuaccauugcccaaguuacaggcaggaaggagacuggcauuccaugggauccucagcucccaauaacagcaacaggcccuuagaugugcugagagccccacaaagggagacaaugcaauuaacacaucaaaauggacucuccuguugagugagcucaaguucccaaugggucauucugacaaucucaaaugcaacaugaaauuuauggaaucugggaaaauaaauuuuuggaauuucauggcaacuucaugaccauacauuuuaaggccuucacuuuaccacugugaaauagaauucuacaugauccuaauuauugagacauuauggaaaauaguugaauaucccuacucuuuccuccucuuuccccaaugacucuacucucuauauuaauuuuuuaaauuuuauuuuauuauuauaaguuuuaggguacaugugcacaaugugcagguuaguuacauauguauacaugugccaugcuggugugcugcacccauuaacucgucauuuagcauuagguauaucuccuaaagcuaucccuccccgcuccccccaccccacaacaguccccagagugugauguuccccuuccuguguccauguguucucauuguucaauucccaccuaugagugagaacaugcaguguuugguuuuuuguucuugcgauaguuuacugugaaugaugauuuccaauuucauccaugucccuacaaaggacaugagcucaucauuuuuuauggcugcauaguauuccaugguguauaugugccacauuuucuuaauccagucuaucauuguuggacauuuggcuugguuccaagucuuugcuauugugaauagugccgcgauaaacauacgugugcauaugucuuuauagcagcaugauuuauaguccuuuggguauauacccaguaaugggauggcugggucaaaugguauuucuaguucuagaucccugaggaaucgccacacugacuuccacaaggguugaacuaguuuacagucccaccaacaguguaaaaguguuccuauuucuccacauccucuccagcaccuguugucuccugacuuuuuaaugauugccauucuaacuggugugagaugguaucucauugugguuuugauuugcguuucucugauggccagugauggugagcauuuuuucauguguuuuuuggcugcauaaaugucuucuuuugagaagugucuguucauguccuuugcccacuuuuugaugggguuguuuuuuucuuguaaauuuguuugaguucauuguagauucuggauauuagcccuuugucagaugaguagguugcgaaaauuuucucccauuuuguagguugccuguucacucugaugguaguuucuuuugcugugcagaagcucuuuaguugaauuagaucccauuugucaauuuuggcuuuuguugccauugcuuuugguguuuuagacaugaaguccuugcccaugccuauguccugaaugguaaugccuagguuuucuucuaggguuuucaugguuuuagguauauuaauuucuuuaaaacuaaucauuuucuaccaccacaucuacuccucaacacaucucugcuucuaugcuuauuaaaucccauucuucacugaccucucucugcugccccuguuuuuaauaagcacagccauuaaaaagaauaauguagaucuauauauacuggcuuggaaaggaauccacaauaaauagaauaauacagucuuauacaccaaguaccuauguguguguuuguauaugaauagacaaaaggcuagaauagugcuauuuaauagaauuauaaugcaccucacaauauaauuuuaaguuuucuaguagcugcauuuaaaaagaaaaaaaacaagugaguaucaauaaauuucauuuuacucaauauauccaaauuauuucaacaugugaucaauauuuuagaaaucaagauaucguacaucuucuuccuaagucuuuaaaauccaauauauagcuuaugcauacagcauaucuuaauuuggaccagucacuuucagguaccuaacagccauauauggcuacugguugucauauuggacaguacagaucuaaaaggcuacacacccaacuguuaagaaugguuuccuuuggagagagggacuggcuagguagagaauaagaaaugaggaaauuuaacuucuaauuuuaucuuuuauuacauuugcaaugaauauuucuauuuuaucauaaaaacaauaaaaacugacuccaacuacagacccuccagcauuauucuaggugccccacuaauagaacuaucuuuuccucugauaucaagucuaauuucucugccucaaugauucuguuauuacucaaaaacccucuccuuugugaccccaaucccucacugguaaucuuucacucuucacagcucuacaguaucucacauuuaaucucuacacuauccaaacuccuguagccacuacucaaaggcuacaggugaguuaaccacuuacucauguuucaugauguucaacugcgggagggucugauuugggaccacaaaacucauucucgcacaaauguccuuauaaucuugauuccuucucucaaaguccuccacgugugcagccagaugggaauugacaaugcaaaaggugguguugugaaauacaaaucucacagcuaccccaccuuuguuucccuguuagcaagaguaauuauucaauuaguacacagaacaagcaacugaacuuuacaugaacaugaauaauaaucaagcucauuuccaaaguaacucaccauuuuccccaugauuccaguuccaacuguuucuguagcaauaucacgaauguaucgacacugauccuuucuggcaaauauaagaagcaucaucccaacaaggcgcaccaguugaaccuaugaguuccggggaguuacaaaagguuaauguuaauaccaaucuuugccacauuucuaaugucccacgacuaauuuuccaucaagaugauauacuagugcccaaaucugacuucauauccucuaauuucucaguggaccccgucaaguggaaacuaauauucucuggggaggcucuaaucuggcacugaccaauaagaguuaaaagcugggagggacaaugaguacuuucagcucuagaucuauucuuuuaaucacuucuuagccuaccaggaguaagcagcauuaaaaguucaaauaauaaagccacuaucccagcuuguuccuuccaccuuuccuuccuaguuucugaugucuaauuuucuaagaaauugaaaucaaccaaacagcaaucuuuuuuacuuauuuuuaacuugugaacuacagcuagaaauaugucugagauauacauuagucagggaccuauaugagaggaauaacauccccaggaguuuuauuaccuauauaaacuguuagaagauguagagaaaaauuacucacauuacuucuuuuagagaccuuaguaugauagcccuguaauuaacucuucugguagcuaaaugccuuuaccacauaccuucuaaagacaaacaaauuggcccaucuugcuaaagucaacucuccucuuaacuuaaaaccaaguuuagaacucguucaaauuccacaccacuucuauucuugcucugauugcaacacaugcaccaugcgcccacguuucauauugcuuuucuguaaagcauucaauucugaccaugucagugaguaaucuaaaucuuauauguaauuauuucaaacuaaguauugauauaagcauaauaaaauucuuuuuuccccuaaaagcuaucuaagcaaugaaaauauaguaucagaaagcuuagggauuuuuuuuucuaggaaauaaggaugaaugaucaaucugcccuaucccaguauuacacacagagaagaauucaauuaaacuauucuuuuggaacaaguuguagauaauggaauaacucccggugagcccuauuuagucauacacuuaaaaagauaauuaaaugcggcuuacuuucuuauacuuggcuuuggaaugcaaaccucucucuacagccauggaccauucuuguuccuucacagauucaaaguagaagaaggcuucugugcucaaguccaguucuuggaaucugaggaaaaaagggauaugagaucuauacauaucccauaauuaucucuggcuaccuccugucccauauguugaaacauuagaugaaaaaaagaugggagagagauaaauuuuauagaacugcucuguucacccagguuaucaguaagaacaaguagcuuucuuuucuaaagaauucccacaaguacauucauaagcuaugcaaaaaauaaaucaaaauaccucccacagaggauaacagcagagcuuugcucuuauauccuaggaacugucacuguuagaacugaccccaagucuuaguuucuaugcagaauauauagauuccuacggguuucaagaaaauuagaugcuuccuuacaccauuuuagguaucuguucauuucuguucucacaaauuugacccgcaaguuaacucucguguauagucuacaguagguuuuaccaacagucuuuuuuaaaaaaggcaaaacaucauguaaaugaacaccaaacauauagccaaaaggaaauuccagaaguguucuuuacccaaugcaguagauaucaggaggauugggaucacaguucagccaagguucuaacccgcuaucuggagacuggccauucacauuccaaguuccaacaaaaaaucuaauacauaauacgaaaagauaauuugaaaacaaagaucaaguauaaaccaacagaaguucuuucuuuucgcuuccauacaaagguauguucacaauaugcuaacauaauuccucaaaauguuuugccacauauguaagaaagaucuuuugcaucuagaacacaaaggcagugggcuuauuuucucuaaauuuuacauuaaguaaaacuacagaaggaaaccaagucuuuauuuuuaaaaaaugcaaagguaauugcuauaccacauuuccuuucaauuaagcuccauccaaacucauacuugauaggagagcuuauggaugggaaagagguaucuucaugcuguaagcuagucaaauauggauaaauguucuauaaggggcuauaguugacuccaggaacucacuuccugaaggauuacaaggacaucuguguaggaaauucugaugaggcagacauaguauuaagggggaaagcagaagggaaaacucaugacugucuuaacuguuuacacacaaauauaagcauagugggggauaugaggaacugcaaguuuuagcauagggauauaguuaugacugaauuagaauaaaugagguaugacaggauagcagaugggacuagaaucuuggacuagaaggguacauucugcucaugaauaacaaagaaaugugguguugcuucaugcauuggcgauacaugccacaugguaccucacaugcagcauacacacacaaguccagaaaaaagaugaaauaaaaaauaauacagauaaaagaacccaagauagaccucccaaucaagaggacugggugaaacuuucuuuauuuaccaaaguaaguaaguuaagagcuagugguaaugauggacuuuaauuuucuaauauuggcugaaaaaaaaaaacuuaacaggccagauauauaaacacgcuugcuuauggaaugugcuaggggaaaauucucuaguacaugugaccuugauuugguucucuaggacucaguagagacauuaguagacauggcauuauuaguaguuagaaaauccaagggaaggccaagcacgguggcucaagccuguaauccuaacacuuugugaggccaaggcggguggauugccugagcucaggaauuugagaccagccugggcaaccuggugaaacccagucucuauaaaaaacacaaauauuagcuggaugugguggugugcaccuguaguuccaccuacuugcagggcuggcgugggaggauugcuuacgacugagagguugaggcuacaguaagccaugaucuaucugcucuccagccugggugacaaagagagacccugacccacacacacaaaaaaagaaaauccaagggaaacuguagcaucugcauuauuucugauaugcauguuauuggccagcauagagacaggagcuugaaacaggcaaccauuccuuuuuaucauauuuugauucuuaauuaggcuaaugucuuaaauaucaacaggccacugucuguuauauauacuaacuuuuuagacucaggaagcaaaagagacacuaaccugaaagucugaauguugacauauucuuucucucgcuuugccaggauauguuugaugagacccucccgcugcccagauuggguauuugguacaaagagcuuccgcaugguguuggucacuuugggcugcuccuuguuagaagcuucuuuuucacguggaagccuagcaaauaaaugagagauucaaaaguaaaauuguuuaaacuauaauucuccuacaaggcaaauauguuuucacaugggacuuacauuuuauucacugaaaaggguggagguggggguucccgaugaaucccaguaggcugauuuugugaauuuauuuucuuguccaaauucauagaagaaaaauugucuucaaauccaagaagcccugaaagacacagaccccaaagucaaacggggaaaaaaucuaacauccaacauauccaggguaacagggcuuugauuugaucacaauuugaucagugguauuacuaaacagaaaacuaucauaaggguagaaauuacuuggauuggaguucgaagaagcauaccuaucccugaagcacugauauacuaacuagaacaauagaaguuuauaagaacuuggaacagacuaguaauagcuaacauuuauugaagacugagcacaaugccugguugagaguaagggacuauaucaugaucucacuuaaucaucacaaaaacuccaagaaguaaguacuauuaaaaaucuucccauauuacagaaaggaaaagggaaguucagaguuguugaguaacuugaugaagguuguacaacuaguaaguucuugacuugggauucaaauccaggcugucuggcucucgagcuuguacuuucuaccacccugcuaagcuggcuccugaacagcuaccaugcuacaggaaggauaaggagugaacacuggucagugggccuggacuugauaaaacuacucugcaggagaaugugucugacaucagcuuuaaucuacaucaccauauuuggccugacaaaaucuacugacucugcaaugaccauagcaacaaggaaaccaggaacuuuuuaguaccugaaaaaacagaagguuuguccuuagugucuaauuucugguaccagcuagaugaguccuuuugcucuggaacaagaagcugugacugagcuagagagauaagguucauggucagaaacugggaagucuuucacugaguagaauuuacuauagccaaaagccauucuuucaacauuccuuauaugcaggggccagcaccauuuuuggauacaguggaagaaacuaaggaaaugagggcagcucuggggucaucuaggggcagaaggagaauuauagucuaugguaagcugugcuugccaugacacugaauauucugaaaacuugccuaguguccuuaaagcugggcagauuuuuucccuaaccuaucccuguguucacuccugaagaaaaaaaaaucagcuaucagggcuuaaagggugagguauuuugccaauggccacuuuccucuguaucagcaugucagaauuccacucccguugaaauagaagaaagaaaaucgcugagucuuuaguuaccuuucugagcagcaaggacagcugagaggaacuucaaacaguguuccucaucagggauuucaaagcggcgcucucugauccagucccccugaacccgaauuuugcagccaccuaaaaagaauugaaauccauacauauacugcuaugggauaaaauguuuuacugggaucauauucucaacuuaucagguuaacagaagaagguccagaucacaaauauuccagaucucuaauauaggaagcacacauacaagaucaagagagucaguaugacggugguggaaggggugaugcagagagggaacccuaagggaagugagaacuccuaaggcugaugaaccguguccaugagcagcccgaucuaaggauaugacacauacuaaaauuauacuuuccugcguucugaucuaucucucagacaucaaagcagggaccuucaaauuccagcaaaagguaaauuccucaaucacccucccucccauuccuuagcuggaaauuccuaccauuucaaguccagaucacauugucagaguaucugaagcaugaagggaauaaaauaaguaggaugguuuguccguaagcacagauuaaauuuacaaaauaacuuaaaaauagugauacugguuugaaguauucugaaaagaagcaucuacaacucauuaccucaaguuuaaaauguaugucuugaauaaacauacaaaaacaauauaaugaccuaugcucagaagugguuugguucaaguacagccaauuggaaacuaggagaauuagaagcaaaguuagcuagggcuuuaauuuauuauguguauaacauauugucuccccuuuuuugaugcccuauaguuaucaucuauaucaacuguuuggauguggugauccaggaaaccuauguacuuguuucuauucuuauuguaacugauuuauuacauacguuguuuucucaugccucuggaaacuacaagcuccuuaagggcaagaggcaggguacgcaugcagggugcacauacagcgaacccagcacuuucaggagucuagggugaccaacugucccagcacuguaugguacucagaggcuuccuaggacucaggacuuccaaugcuaagacugggaaagucccaggcaaauaaggcuugcuggucacucuacuggugacaguaacaucagacuucacagacagaagguauuuaaugacugaugaacuggacucuuuaccacguguaaauaacaaauacaugagaaaaugaaaugaaaauccuaguuuuuaugguggaaauccacuucugaaccuuuagcuuuuuguccucugcauuucuucuucuuucugucuuuguaaaaugaguuacaaaaaggaaaauaaaauaauuaauuagaagaaaauagauaaaaauggagaaaaaugugaaagaaggcacccaaauagacuacggauaagaaaauuaaugagggugccacuguagaggggaaaaaagagagggaaggaaaaaagugucaauuauagcagccaugaagauauagggaaaacuccuucagggccuaacaaguccuuucuuucucagauuauuuauacuaaaugugguuuuaaaagaguaguuucuaucugacauaaauuuagaacaaaaacccuuauuaucucucacacacacacaaacacacaauucuugaaagacauauuuuagcaaauauauaacugaccuauuuaaugggccagaagauuccagaaauugcucacaaaauaacacuggaugcucccucaccauguugcuugagaaagaaaacaaauuaccucaagacucaaccuucuacucuucuuguccauccuaaaaccuucuggaccucugugaucugcaaacacuccuacauccucaacuucaucugaauauucucugcaucucucaguaguucucaacuaugcaugcauuaaaauuaccagaggcacuuuauuuuuguuuuuauuuauuuuuugagacggagucuugcucuguugcccaggcuggaacacaguggcgugaucucggcucacugcaaccucguccccuggguucaagcaauucuccugcaucaaccuccugaguagcugggauuacaggugcccgccaccauguccggcuacuuuuuguauauuuaguagagaucggguuucaccauguuggucaggcuggucucgaacuccugaccucgugaucugcccaccuuggccucccaaagugcugggauuacaggcaugagccacugugcuuggccaccagaggcacuuuaaaaacaauauugaacccaggccccacuccaggacaauuaaaacagaaccucuggaggugaagcccaggcacucguaguuuccgagugaucugaccauaugugcacauuaaaauucagagucaacugcaaaacuggcuggucccuaggaggagcacuucuccuacaacccucuuauuuuuauuuauuuauuuauuuauuuauuuauuuauuuauuuauuuauuuauuuauuuugagaaggagucucuacugcccaggcuggaaugcaaugccgcgaucucggcucacugcaaccuccaccucccggguucaagugauucuccugccucagcuuccugaguagcugggauuacaggcacgcacgaccacacccagcuaauuuuuguauuuuuaguagagacgcgguuucaccauguuggccaggcuagucucaaacuacuggccucgugauccgcccgccucggccucccaaagugcugggauuacaggcguaagccaccgggccuggccuaacccucuuaauggagucuguuuauauucucucacaccugaaguaauuuugaguuggugucuguauuuguccuaauaacaccaccagacuacucuuucuccuucucccucaggcaaaauccuuucuccuuugaggcucauccauugggaucuaccguuuccucccuuuccucuacaagaucaugcaccauccucccagaaacuucagaauccaagauacaauaccuggcucauaagacuuucucuccacucgaucuccugccauuaauuuugggucccuuuaaaauuagcacagaaaacccagucaacaccuucagcuuccucauccaaugacauucccccuccaccucagccaccacuuccucaguugcuacugggacccucucaguuauacccuggauuuugucaucauagaaacaccaccacuucauaaaccucuaauucaaauaucccacccugacauguuauuccuuccaacuuacuugcucauuauccccauuguaacuguuuuuuuuuuuuaaucugaugggaaccuccagcccauugauuucucuguuuucuuacuauccgucagccccuuccugcucucacuuccccuuuuaucaaacagaugccaucauuacacucuugcaaaaacccagaacugccuugccucucuguucuuccguggcaccuaccuggcuaaauaccaacccucagaaauccaacuaauugccuuucuguacuuauaccugaacaagcagaggggguaaauaugcacacccacaaccagauggcuaucauuauacauuccugauugccaaucucaaccggguccucuaucauaggaagcaaccuaagguccuacagucaaucagucuccuacuacuaucugaaacaacuguuucacaccuacucauuuauccucaaaauuuggaucccccaucuucuugagcccucuuauucuaagcagaaugcuucagcucauacuucagagaaaaaauaaagcuaucacauggaaacuuaucuguauuuguacucaucucauccuuucccuacugauacaaggaagaagaucacuccuaucaaaccuccuucacuuugaauuacaaccccucugauucucucaguaaucuuacaacuaaucccuagacacacccccauauccuuaacgcuuucccuuucacuagcuccuccacauuagcauauaaucguguucuaaguccuucucaucugaaaaacaaaaaucuuccuggaucucagauuucccuccaauuccaguccaucucuauauuccccuccagucacguuucuuuaaaagacacacagucacagacuucccauuucucacuugaauccauuccaauaugacuuccacacccacuacuuaucugaaauugcuuuaaguucaccaauaaccuccaucccauggauauucuucagucaucuuauuagaccuauuagcagaaaucaacaguuaaucagggcuugauauaaucccuuccaaaagcuucuaugauaccauacucaucuaguuucucucucaucacuaauuuugagugcccuuugaaguaucucuuccucuaucuaacauuuaaaaaauggaguuccucaaguucaaacauaaaucuuuuuucucauucuauaccaguauuguccaaugggacuuucugugacuaugggcaugcucuaaaccgugcuguccaauaugguagcuaacaauuugauaugugacuacugcaacugagggacugaauuucucauuuuauuucuaauuauuuuaaauaggcacauguagccaguggcuacuguauuggauagcacaguccacacacaaucacaucaucucuuaugauuuugaauaucaucuacgugcuagugacccagaugacuuucuucugagauucagaugcauacauucacuugccaauuuaucaucuacacucaggugucucaaaaaaaaucucagccgggugagguggcucaugccuguuaaucccagcacuuuggaaggccgaggugggcagaucaccugaggucaggaguuccagaccagccuggccaauaaggcaaaaccccaucucuacugaaaguacaaaaaucagcugggcgugguggcgggugccuguaaucccagcuacucaggaggcugaggcaggggaauagcuucaacccgggaggcagagguugcagugagcugagaucgcgccacugcccuccagccugggcgauaagaccgaggcuccaucucaaaaaacaaaaaaaaaaucucaaacuaaacaugacuaaaacuaaauuaaugacccuucccccuugaggaaaacucauucuuugugcaguguucuuauuucugcaaaugguaccaucauccacagucaugucagaaacccgagauucauccuugacacuuccucucaccccuuacacccaaaacaauuccuauggauuuuaccuccaaaaacaucuaucaagucugacugcuucucuucauuacuaaugccaccacacucucuagcuuacacuauggaaacagccuccuaacuggucucucugcuuccaugcaaaugaugacaccccagcauaaaauccuucauacgauucucauuuuugaaaucucaaaauucagauuuaagacaaggcuuacaagauccugccagaucugcccccuagccuguuuuucuuaccuuggugcccaagaccuguuuuaggcacccuggucuucuaucacuucaaagaaaagugucaagcuacuucccagccuggagccuugugauucccuuuaccugguaaauucuucucucucccaucuuaaccugccucuuacuuagccccucuggucucaauuuaaaugucaauucuucaaagaggucuucccugaccacccuccuaauauacuuacucuucucauaaacucuuaguacuuuuccucaagagcauuuauuaaaacuacaauuaucugggccaggcacgguggcucacgccuguaaucccagcacuuugggaggccaaggcgggcagaucacgaggucaagagauugagaccauccuggcuaacauggugaaauccugucuucacuaaaaacacaaaaaauuagccaggcaugguggcaggugccuguagucccagcuacucgggaggcugagacaggagaauggugugaaccuggaaggcggagcuugcagugagccaagauggcaccgcugcacuccagccuggaugacagagcaagacuccaucucaaaaaaacaaacaaaaaaaacuacaauuaucuauaucuuaucaguuuaaagucuguuuccuauauuaaaauccuuaaaguaucaugacuguacugcuuucugcuauaucccuagagccuaguguaguuccuggcacauaaaaaauagucauauuuuuauagaaugaaugauugaauuauagguaucugugugacacuaguacugaauugcacagaagcaagaaccaaaguaggagcagcaacuuuaucuuugucguucuguacugauucugcacuuacaaaagugccugagaaauagaaggcacucaacaaauauuuguugaauaauggauaaacaagggacaguuuaauuuuaggaaauuaguacaauacaguguaccaauuggucaaauaaggaagaauaaaaucaucuccauaaauaccaaaaagacauuugcuaaaauucaguauacauucauaauuuuaaaaaacacaaacuugaaauaaaugcaguuucuuaauuaaaaaaaaaaaaaacccugucaaaucaacaagcaauaaugucauuaacagugaaauaccacuugaggcauucucacugaaaucaggagccaaacaagaaacaucaucauuuaccacuggucccaaaauucucacugguauaguguacaacgauaguagcuacuagaaaagagacaaaauuauuauuuauagauauuaagguuagcuaccaaaaugaaaaaacaaaaugaaaagcaaaaaagauuaaaaauaaauuucaaugaagcaacuggauaaaagauaaauauccacaacucaacagcuauucuguauacuaguaauaaacaauuagaaggacauagaaaaaaccuccacucgcaauagcagcaaauaaaauccaccacgaaauacuuaaccuaaaaacuauauauauuaagaaacuauaaaauuuuauugaaagauauaaaagaggaccugaaaaaaacagauauaucauguuccuugacaaugacuuaauuuuauaaagaaguuaauuuaauaaaauuuggcacagaccuauggugaaauauuugguuuuuaaaaagcauauuauaaaguaauuguaaaugacauaagaaaaugggacaauauaauguuaaaugaagacgcaggauaaaaacugcauaugaggauuccaauuauguaaaaauauaaagacuggaaggaaauacauaaaaauguuaaccacaguggugaucucuagauugcaggaaaauaaucuuaauuugauacuuuaagcuuuucugaauuaguaaauuguauauaaugaagauguauuacuucugugagaaaaaauuauuuacaaagcauuuaacaccaauauccagacaaugggaaaaugcauauuuacauuaaaaucaggccugccuaacaaacccaagaucuccuuccugcaacacaccguguaccauaaagguuuauguaugaagcccaaggaucaagauaaaauaugguuucagugcaaauacuacuaaauggguagaaauaacaaaggauuuuauucaaguggucacuuaccuauuuucccccuaugagccaguaacuagaacucuggacauagcaacacauggcuaauguagaagcggccacaacaaaacuaaugccgaaaauuaggugcuuauaagagaaaaggcacagcucaguuuaacuuuucagcuuugaaucaaauacuucuccacaucaaauacaggacauuuccaucucuuauuucagcagcagugucaguuguuauggaauugcuuuuguucuaguuuugcuuuuuuaaguguuguuuuugccuucuccuuucuaagcacaauaagaaauagacauuaaguuauuuucucucuuggauacuugcagcugggguuuaccuggccuuucaggcacagccuuuaagacuucuaaaauucacgaccaaagggaaaaaaaaaaaaacucaagccagaaaaaaagccuacuuaaaguguucaauacaaauuaauagugccaagggcagggacugucuaaacaaaguuauguaaaccccuagucccaagcucagugccaguucccacucauccaaggacucaaccaagagauaaggcaacccauuugauuuagauucauguggucagauacucuuuuccauagcaaccucacaguagcaucgagugcccauuuucuccacuccauaaaauaguacaauuagaugauaaacaaagaacaguuugcacagaaagucaaagaugauuugcuucaaacagauaaaaaugagagaauggaaacauugaaaagaagaucauguucccucuaauaaagagaugccuugaggggauggggcuuaaauaaaagacuaaacuuuuuuuuuuaaaggaaugccuggacaagcaauuuaagggacucuucagccuuccaaaaaaauacaacaaauaaaggaaaauauuaugacuuaacacacaaaauuuaaaaagaggguagggaaaaaacuuaaaauguaauagcaguuaaaaaaugaccaaaaaaacuccaccaauaaaccuuaugugcuuuaaacaucagcccuuccuacaauuaucaauucuacagcaaugauucaacugacagcaacaauacugguagcucacggaaguucagcauuagaaagguagaucauuauuuuuuauuuuuauaaagauucuuaccagccaccugcuuuuucuuaggcuuagccuacauguuuuugggaaacagugcuaauuuguauggcugcuacaggagacuacaggaaaagaugguaaaauaaaaaaugugccccaaaaggugucuuaaauguagugaguguucaaguaaauauuuguugaguaaaaaucaagcacauucagaaagauacucacuguuagaagcuaugucaaucaaaagaguuucuucugcuucugagaggggaaaaaaaagagaguaggauuagggaagagaaaaccacucacuacaaccaaaagaauacaugccuaacuaaauaacugcuucucucagucacuacuccuaggucuuagaacauauuuuuuuaaaucccuuuucguuuaauauuuuuuaaagggauuuuuuauagcacuggguucuaaagacuaugagcaaaucaacuaaaauaaaaaugaacugaagaaguaaccaaauggaacuccucaaagcaaaucaacgaaugagaaauuaauaguacagaacauaacaacauguuaauucagcgaaagcaaguuuaauuccccuuaacuguaacauaaugauuuaacucuggguccuuuagauacuucuuuagauaacagaaggcaaaggaagugacccugaaagcccagaggugaauuacuuucuuaacucagaucuauucucugaaaauuucccagugaucucaucaccucugccccugccccacacaugggggcagaguauaccuucagguuacaacuacuaccugugggcccaaggcccuccguaccaaacagggugcaaagcagucugcaaguuuggauuucucuuaucucucaaugguucuccuggacuucuuccuuuacaacaagugucuagacccaaccuaucucuuccccucugauuucucuggauuugaccaagugcaccugccagacccuccuggcuaauugaacucuggguacugacuccuugggauuagccuggaucuaccuuggucaaauggaguagucucaccuuuuucaccucccucccaagacugaauuguuuauuuggcuccauuacucagguacaacagaagcaacuggcaaggaacuaacuccuuuaacacuaaaaaguagucucgauauuauuauuaggaugauuaaacaaggggaauuagggcaucaagacauagauauuguaugcuuacuacuguucuucauuaacuuuuaguucuguaaaaccugaguguuuacagaugguuuucuuuuucuuuuuuuuuuuuuuuuuuugagacggagucuugcucugucacccaggcuggagugcaguggcacgaucucggcucacugcaagcuccgccucccagguucacaccauucuccugccucagccucccgaguaguugggacuacaggcacccgccaccaugcccggcuaauuuuuuguauuuuuaguagagacgggguuucaucguguuagccaggauggucucaaucuccugaccuugugaucugcccaccuuggccucccaaagugcugggauuacaggccugagccaccgcgcccagccgguuuucuuuuucuuuagagauggccucacucucucacccagguuagcaugcaguggcacaaucacagcucacugcagccucgaacugcugggcucaagcaacccuccugcuucagccucccaaguagcugggacuacauguaucugccaccacgucuggcaaauguuguuuuuuuaauuuuauuuuuguacagauggggucucgcaauguugcccaggcuggucuugaaccccugggcucaagcaauccuccugccucagcuucccaaaauguugggauuacaggugcaagccaucgcgccuggccacaguuuacaaaauagaugcaggggucaggaaauagaaaggagaugaaaaucaaaaguaagucuuccuuuagucauggggaacuacguuacaugugugcacauauuuucccagguucuaagaagcagcacuacgaucuaacaaucagcaauugauuucuuauuaaaaauacuaagagaaacaggguaaaagagauccuagagguagaguaaaaagguacaaagcuaauaggauauuaauuuaaagucauguucuuuggcucuuccccucugugaaggccuacaccuugaaaagugagguggccacagcaacuuacuauggaacguggcuaccuuguuuaguaugucucucucacauagggcaggcuaaauagcuaucacuucauucuuccauacaaauauggacacuauucauugaaguuauuuuuaauucuuaacacaugcauucuuaaaaagucauauccacuagcuuaguauuuucacuuauaggaauacauccugaggaaauaagagaugugcagguauauuuaggugcagagauguucaucauauuacuauugauacuagugaaaaauaacccaaaugucaacauaggggaauaauuacauuauggaccauucauaaacugguaugguauauagccauuaauggcauggaaaagugcucauaauacaauagcauguagaagagacaaaaaauuguauaagaugaguaucacucacccugcaauguauguguagaaaaaaggaaaaugcuagguguuuaucucugaaaggaugggaauuuaagugaccuauuuucuuuacacuuuucuguucuuuccaaauguauuacauuauguacaugucacuuagugauuaaaaaaaaaguucaauguaguuuaagaaauaauccaugcaagguaagauuuaaguuuuccaagaaaggccaggcaugcuggcucacaccuguaaucccagcacuuuuggaggccgagacaggcagauugcuugaacucaggaguuugagaccagccugggcaacauggcgaaaccccgucacuacaaaaauuacaaaaaaaauuagcugggggguggugcaccugcagucccagcuacuugggaggcugaagugggaggaucacuugagccugggaaaugaccuugucuugaaaaaacaaguuuuccaagaagcuacaauugauacagaaugcuucugcuagauaaagccacugguccuagugaaaacagaaugcauuuguucucuaguaucaauuuccuuucuagagcaaugugagaugacagaagcaacaccuccuacacaaaccucccaauuuuuaaguuucauuguagcagaugaaacaacagauuuucuaugcuccguccccaaauuugagggcaggaggccaaauauuuccuccccagagucaauuuucuuaugauucaccaaugucaagguuugagaaucagcacaauugaguguaagauauuacagucuggcaaggcauguugccaaaugucuuaauuucaaauagcauguggagaaagugcugaaugugugugaauccaagugaccuugguaccuuaugagcacuguguccguuaagcccaagaauguuauuuaaauccacauauaggucagucagcauaaaaaacuaccuacacagguaacaaucuacauacaucucuaacccaagccaaggaaacaggugagacuauagacacacauauacaaauauauuucgauauaacccuucagcauucuuagagaaaguaucaucuccucaauguuaucuuuuuaugcaaagaguaauacauuucauuuuacaugcacugacaaauuuaaauauguaugguauuacauaaugcaguaaugaccgagaaaaaacauuauaaaacuagcuaaggaauuaaagcuaguaccuugaacacaucugaaguggcuauuuauaggaaugauaucuugaacaugcuguuccuucucaugcaacuggauuauuaaccuaggaaacagaagaacgcaucaaagaacagccacugaaaaacucauuuagcaaaaaaauacuucacuguccuguuauacaaaucuagucuguauuuacuagacuugcugcaucuaguucccuggaucugagcaucaugacagcuagauauugcucuaggccuaaaaggaugcuaguggugaugaacaucugauuacccacacuguucucuaggccauauauccuaaaaacaguguacaagcuuaagagcaugaauuacagaguauauagcuucagaguaugcauaccagagugaagaacugacagcuagaugugaaguccaugagugcagggaccacagcuaucuuuacaccacggaauuucuaguaccuagcacaaagccuggcacacaggaguugcucguguguguggaaucaaugaauuagaaaauucauaaauuaaccuuccaauuauauucccauggcuuuuuaccaaagaauggaucugucucuucaaacaagcauucagguucauggaggaguaagagggggugcucagccagcuggauuggucaaaauaucagugaccaacaagguggcagauaucacaacuggauugccuucaaaucccuuguuucuucucugguuuccaaguuuacgcugguauuucuacauaaacaugaguaaaccugacuccccagaugaaauccauacuucuaaauccauacguacuccugaaauauuaauuuuucauuuauuauuuauccuuagugguccagaaucaagguacgaccuacugguaaacagccauucugaacgucaacuagcauucucaaagucaagcacucuucaaguauuguuuuuaguuuuuugucaggaacacucuguuucuuuccgaguuucaucucaaauaucaccuccuccaugaaacuguccucaguacccccaagcagaaccagcagccuuaucgccuuuguuugccccucuaauagaacacuuacacacuccauuaugguuauauuuauuuccccucacugauuucagcuccuugaaagcaaagaccagaucauauucaguuuugucugcagccuaauagaugcucaacaaauacuggcugaauaaauuaacuagcuuaauuaagcuauaagcagcggugaauuuuucaaugaaacuguccaacuucugacauuaaaaugucauuguuuugaaggguuugauuucuauuuuguugucuuuugggggugcuuguugcuuuugcuuuuugcauuuucaaauguguuaacuuugaagaggauaaccugggauaggauaaguaauuacuuagauagaacuaagggaaauaaaaguauuaaugcuguuuuucugcugugauccuucuugccuaauuugcagggguuuguacucuaaggugauuacaggaauauggggcaggccccuuuccaucuggaaaguucaugaguugaguggagaguccuauaaacccagauggaaaccagaaaccagauaaaaggcugagaaaucaaggguuaaggaggaagagcuuacuuugaggaagauaaacacaaaccacuaaaaucucaaaauacauaaacaagaaaugguguugaacauuagcauuaaagcuucaucuggacaguacuguuaaaaacuauuacaaaacaaauaaacugagaauuuaagugaauuucaccaacauuuauugaguauuuacuacguguuacccacuaaauuacaauaaaagaguagggcuaagaauaagcauaaaaauucugaguguaauuauucauuucagaauauaaagauuagaaauaauugguauacagcaaaacaauggaauucagaauuugguaguugucaaacagaaaagagugacaaauccugaaugccaacucugccuuaucccuaggaaacacuuugauuuguucaaggaagguuaaaggucaaacagguuuugucauaaucuauuauccuugaaaaauaugaaucuuaaguguuugauucccuguuuccaaaaaaacccugauuuuuaauuguaauuuuggucaagcaaauuuccuaugguugacaguaggaaccacagaccuaaagauuuaagucaggcuucaaguucuaggauaaaaaagccaaaaguaaaaaguucuggacacucgagucagaaaagacaccagagagacaagaauaugaggauuacagaugguauuaugguauuaggugucuccagcaaaugcuuucaagagaaacuucucaguguaauucugagacauguuacauaggaucagaucucagguauucuacucccuaauugcaaacaagugacuuaaccugucugugcuucaauuucuguaucuauaaaagggggaugaugauauuacuaucuuauaguaacccucacauguggauuaaaugaacuaacuaaugaaaagggcuuagaacaguaccuggcacauaagcagccauugaauguuaguuauauagcaacaacuauauuaguuguuaguuauauguuaguuuauauauaaacuauaguuuauauguauuuaaaacuauaguuuauauauauuuaaaacuauuuacauaguuuauauauaaacugcuaauauagcaacaacuauauuaguuguuaguuauauaguuguuauauaguguuaccuauauauuaauguuaguuauauagcagccccauacccccacauauacccccaacuauacccccauaacuuacacagaauuggaacacacgacuuccuuauuagcucaacagaguuccaaaucuacuaauccgagggacuagauucugggcuguggucaucucaacaauguagcuacucuauucaaucuucaugauuuuguuuuuacauuagaggaaaccaaggcacacaaguuuuacugguuugcccaagggucaccucucuguaacccacucuagccuuuggaaauguuagugguguuccacuuuucugcugaauuuuguuuuauuaaauucugaauuuaguuuaguuucauuaaacuagucuuccaggguuugaugaaauccggguuugaugaacuucccaguagagcugacuaagcaggaccuaugaaagagcuacuucacagaauuagcugacauccaguuagaguggcaccaauagucucagagaagagcagguugggccagugggaauuucuuccguguaaaucugacagcauagauacagaggaucuaaaaguggggacugagaaaauugguuuuaggcagaagccaauguugggagauggcaagauuuaagugaacaauuuuuaaacugggaaggaauaugaugucaagaagccaaugaauauccaagugaggugucuugggcacacagggauaggggccuaugauacguaauggucaccauggauauuuuugagauaagauauuagugacaauagagugagguuagcagcuauggugauagcuuaucaaaauaaucuuuugaucaaucagucaacaguauuuacggagcuccuauggcagagaggaaggugacacacugauaaaauacugucauuucuaucucuacacauuucauuaccuuuucuuucuaacaguaaagucaguaagugaggcaguuucuggccuacacuaaaccauuacugaauuaaugaauaugccuucaacccagugggauaaggggacggggagacuggagaaaccagcugaauaggguuaagacaagucuguaacguuaacaaugaagcauuuccauagcacuuuuacuuuuuggaagccacucucgcauuuauuuuucccccaguuauaauuccaaaggcuguaagguaaggcaguuaaugguuuuauuaaacugaagaguuaacuuuggcccagaaagcuuuauugacuugcccaacguuacacaacacaugucaguugcaggggcaggaacuaagaacccaggcuuccugcuuccccgcccauucaguccuuccacugagccacacugccaagcacaauccagaggcuuggaaguuggggacaaagccccgagguuagagagcacuggcacuucacaccuggaccugaaccuguugcccgcguggcuucaguaggaggacagugggugacccgucgcgguuugggguugggagguaauggcaggcuccccuccucugugggaaucaggugguuacuuacucauauugcccguuccucugggcuagggucagggcgcagggcucccggagaggacccuucaucuccauacccucgacaguaugcgggcgcuagucaagggucuccuucggaagcgcgguggggaggaguggugcacugcggggcgaagggggucuuccaccccccccccaccgccgcccucccccgccccgccccgcccugcuucgucucccgcgccggcccccucccccucucugcucggccucugggccacccgguugccccgccccaccguguuccgcagggcccccgacccccacccccggcccugcgcggccuccccucucccuucucuccggcggauacggcaagcggcugggcuccgaccgggagcggcggcuccauccaggcggccuccgggcucagcaggacagcggacugcgggccgauccgacgacacuggcucccgcguccccacacccacccaccucggcugcgugucguuugaggaacagcuccgcgccgggcgccgggcgccgggagccgggagcggggagcugggagcugagaaucugacccaagagagagcg

SEQ ID NO: 18967 - RNA, 1135 nt, Homo sapiens
aguccaaguggagcaagugagcgagcagagugguugugugguugcgucucggaaaccaguagcacuugcagcauggcugaccaacugacugaggagcagauuguagaauucaaagaaguuuuuucacuauuugacaaagauggugauggaacuauaacaacaaagaaacuaggaacuguaaugaggucucaggcagaaucccacagaagcagaguuacaggacaugauuaaugaaguagaugcugaugguaauggcacaauugacuucccugaauuucugacaaugauggcaagaaaaaugaaagacacagacagugaagaagaaauuagagaaacauucuguguguuugauaaggauggcaauggcuauauuagugguguagaacuucaccaugugaugacaaaccuuggagugaaguuaacagaugaagaaguugauuaaaugaucagggaagcagauccugauggugauggucaaguaaacuaugaguuuguacaaaugaugacagcauaaugaagaccuuguacagaauguguuaaauuucuugcacaaaacuguuuauuugccuuuuguuuguaacuuaucuguaaaaggcuucucccuacugucaaaaaaaaauaugcauguaugguaaucaggacuucauuccuccauguguucuucccuuacugucauugcccugaaaccuuauuuuagaaaacugaugaaguaacauguugccuguggcuuacuccggauauaucuaagcccuucugcacaucuaaacuuagguggaguuggucaaauaagggaacauccggguuaugccuuuuuuuaaaguaguuuucuuuaggaacugucagcaugguguugaaguauggaguuguaacucuguguggacuacggacagccaacaauauguacuuaaaaguugcacuacugcagaauggguguauuauccagguacucccagguaccucacacacuguuuuuucuguacugcugguccuguaccagaaacauuuucuuuuacuguuacuugcuuuuuaaacuuuguuuagccacuuaaagaaaaugugcuuauggcacaauuugccucaaauccauuccaaguuguguauuuguuuuccaauuaaaaaaauuacaauuaaaaaa

SEQ ID NO: 18968 - RNA, 1135 nt, Homo sapiens
uuuuuuaauuguaauuuuuuuaauuggaaaacaaauacacaacuuggaauggauuugaggcaaauugugccauaagcacauuuucuuuaaguggcuaaacaaaguuuaaaaagcaaguaacaguaaaagaaaauguuucugguacaggaccagcaguacagaaaaaacagugugugagguaccugggaguaccuggauaauacacccauucugcaguagugcaacuuuuaaguacauauuguuggcuguccguaguccacacagaguuacaacuccauacuucaacaccaugcugacaguuccuaaagaaaacuacuuuaaaaaaaggcauaacccggauguucccuuauuugaccaacuccaccuaaguuuagaugugcagaagggcuuagauauauccggaguaagccacaggcaacauguuacuucaucaguuuucuaaaauaagguuucagggcaaugacaguaagggaagaacacauggaggaaugaaguccugauuaccauacaugcauauuuuuuuuugacaguagggagaagccuuuuacagauaaguuacaaacaaaaggcaaauaaacaguuuugugcaagaaauuuaacacauucuguacaaggucuucauuaugcugucaucauuuguacaaacucauaguuuacuugaccaucaccaucaggaucugcuucccugaucauuuaaucaacuucuucaucuguuaacuucacuccaagguuugucaucacauggugaaguucuacaccacuaauauagccauugccauccuuaucaaacacacagaauguuucucuaauuucuucuucacugucugugucuuucauuuuucuugccaucauugucagaaauucagggaagucaauugugccauuaccaucagcaucuacuucauuaaucauguccuguaacucugcuucugugggauucugccugagaccucauuacaguuccuaguuucuuuguuguuauaguuccaucaccaucuuugucaaauagugaaaaaacuucuuugaauucuacaaucugcuccucagucaguuggucagccaugcugcaagugcuacugguuuccgagacgcaaccacacaaccacucugcucgcucacuugcuccacuuggacu

SEQ ID NO: 18969 - RNA, 9702 nt, Homo sapiens
gggagcauucucucuggcagccggggucacgggcaguugcagccgcggccgagcagccagccgcuaagaaagagcucgccgcugccgcucccggagccgccgaggccagcuucgcggcgcugccccgcggcgggagaggaggcugcagaagagcggaggcggccagcgggagcggcggggcucagcgcgcacacucagcggccggggagccucccgagcucugcgcccgcacgcgccagccgcggcucgcgccuuucuuggccuccgggcgcccgaccucuccucccccgcgccggcucgccggggccgcggcggcccaaggagcagcaugaaucugcggcucugcgugcaggcgcuccugcugcucuggcucuccuugaccgcgguguguggaggugagugcgcgcccucccgcucgcccgggcugcagccggcgugcuccuuucccuccgcccuauucgcacucuccccgccucccggggagcccggcgcgagccgugcaguagcagccacgcgccggccagcgccaggcagcagauugacagagcgccccgagccauggggcggcuggccacaaggacugcuucuuuugcggggcucaacucggccuuuggcaucaccugcccgucaccuugucccuccuaaccgucgcucgcagucccaggagcucaggaccacaggugugcgccgcgugucccacgcccugcaccccgcgugguagagguggaggcgggggacaugcccgcucccucguggaucgauggaaggaacugaccagagucgagugggcugggcucccauguugaacgucuucuggucccugaaggcugggagccucccgccaguccaggggcgcgggaaaccggggaugaugugccaacaugcagacgugacacuuguugcauaggcaggagugcgcggaggggguggcggcauggagcccagcuguugcuccuuucggccugcaugugugagcagaggcagccucccccaggcagggccgggcccagccgggcugggcuggucuucuccucccuaaccccaagguccuggcuggucuccuccccugcacaggaugcccuccccauagccuccaucccacccccagagacuugguucucuuacauccuggcuccagccuuccuuucugucccaggcacggacaugcuucacuuuagucucccugccgcuaggcaccaaaggaggaagcacagcaccugacccgaccccucccugcagcucaggaaaggggaguccuuuugcccucaccugccaauacuuggcacuagugcccauguccgccccuagccugguccccaaccacgccccagcagccccaucccaggcugccuguccucugugucaaugucuccuggggcugccagcucccaccuccagcugccacaguccuaugaucuggcugucauugcugccugccuggcaccacacaaggggaaggccaagaccagguggacuaacgccaggaccauggcuggagucacagggaggugggagcagaaagaaggagaaggcagggcagugaguuuccuggggcaagggcacagggcccuaagugguuccaaacccuccagaacaggaggauggcaugcagcccaggagccuccgaggggcccagccagcucugccugccucucaucgcaggccaccuccuuucucugcucuugcuuuuuggcccugcuguggcucugggaacacugccuggcuucucagaaaggugcagugguuggggcuggcaccuccugccuccagguagcuggccggugauuucucuauucaagaccugaacacgaagugagccaccaccacaguaagaaguggguaggcuuuuuccacagaaacuccugucaggcagguaacagagggagcaaaagauacgaauguaagauacgaaugauacaccauaccagccuauccucagggagccuaccaucuggugucauuggcaaggcaugacacuugcacaauaccaccacaggcaaauaguccaggguggugccuucagggaagaagaagacugggugcagagaguguuccagaggaagguagggcuccuggaucugcacacuuggugcuccccccagaggcuguggggagaccccuggccaauagacaaccacucagacccuccugggucccagccauugggacaguacuagcaaaggggagagagcugguuucaagggaagggaagucagccaggaugcccgaacaccauguggcugguccagagccugccacuucgugcuuuaauucccccgucuucauuaggucaucuguccacugugauuuggauaaauucguugcccucacauuuugcucaagccucgugcuggaaacuuucagggcucucacugacuucucuacucccugacuucuccuggagccaaggaagggcaugucccuggaaguggccaccagccaaggguccagguacacauguccugcucccgcuggcuccuguccuggguuagaagcaggaaucccagaaccacuuuguccuuggcccggacuggcaugcuguccccagccagaguccccagucaaaguuccagccugaaaaccacacuuccuccucuccacagucuguccugacuugaaauguccacccccgaccccucuccacgcugccucucaucaccccgcuaccaccacguacacuccuccacugccuccugaccugggauacacuuugcucuugugagucugagaacuccugguccagggccaagugucccucggucucugagcaccccucuuuuuccccuucuccucccccuccgcaggcccagcucaaagccugcagucacagugggagugugaggagagccuacuguaccccuccugcucagggaagggcaucucuacuccauccccaguccucagcacuaagcacccguguaaccugagccaggccucuccucgcaaagaacuaaggcaagggaagcagagggccaccagacagagcaugauguaucccagggcagcaaagcuggcacuggagacagcacagggcccuggagaaggcgacugggauggggggcugggcagacaaagagacacaugcaggaccacagagcaguggaggggcauugccagcaggguccccaccggagcauacguuugggcuuuuaaagucaucacaagacaggccagacugagagaggaaaaacaggugcgucauuccugaugagacuggcauguuccugaaaagucgcaaguaccucuuugugcauuggcaggguuggaguucagauagcaugaaagucaaauccuguccucccccugacugugguucucagcguggagauguuguagcuucguggcugauggcacuucagcaggcaauggcuccaaucucucuaggcucgagauuguuuggaggauugcuccagccuccuuuuacguagcaaaugagcuggaagaaaauauuuaagugcauuagggcuggccuccauuucuaaaggggaauucuuuuuuacagucaagacuucugcagugaugagaaucaacagccucuaauuuguuccuuuggacagcauaaagccaggguuucagaugucagcuuaucugauggugagccagacucagaaucaaaaguaggaaacaggugggugacgggcucagagugcgggaggagccagcagaucucggugaugcugaggacaaugaguccccaacgcaaugggagggaugcaagaagccuggggcugcucuccagggcccggcuggggguucagucagcucagagugguucuucucugcagaccuagagucuagacaucuuccuggccagagccaccaacccugcuccccauccugacauauggccucuagcccucccuuucugacugccagacacucacaaucugagcaccuggagaugaugcccucccccuccuggcaccaugcuucucuucuccaugucugccaccacccugagcuacaauggccugcaccacugccccaucccuucugcacccccagcagucgaaggugcagaggugagagccaaguguugacuugguucacuucacaaggccccuagguccuuccccugcuccuuaucagcaucauucagauccgcccucagugaucagggugagccuuguggggaccccagaacucaaggcagaggcugaagcagcugcaguggggagcuuagugaaggucuuuccuuccuuucccucuccagccccagcccccucacagauggcgccaagaggguagcucuaugacagucagacagaagcagcccccuuguuccauccauacuuacugcuccaaagugcuaagauaauucuucuuuuaauucucauagguuaugaauuuaagggauaaguuggcacggaaguguggcuaguuaaccaaaugacccaagucaacagcgggguccucaugggccuggcaauuuuucuuggggaaagagggaaggagggugcaggcuuggagaauauguguuuauguguguguguguggaggggguggguaugucugggugugaguggggagaacugcaggcucagaagccugggggaagagggcccuaaggccaaacccacccacuuuuggcccaagaggaggcugaacacuuggaaauugugugcaagcagaggaggacucacaaaaaccaaggagccaaggaaggaacagagcguggggauguuggaggcagaggcagaggggaagggggagcugccagggguaugauuggggugugagcagccaaugggaggcucuauggaaacugugagcaaguggugggaauuccuggguagauggcaauggggcucgagggacagggaucuagaugcaggcaaaucagauggugugcagggggagagagacuguuauucauuaucucuggccucagaugcuguaucugcacaggccuguacuggacauugcacaaguacccugccuggcugccucuuccccagcaccaucucaucuccacacacugccugccaccaccagccaggcuugucuuggggguggcagcucagcuucccugcauggacugcaggcuucacgagagucggccugcaugccuuuucccucacugcacccaaggauacccugcaccacuuggauuccauugucagggcucagucuggugucaggaggccucuacucuaagccuccugacagauguggacagauguaaagaggagccccagagugcagaauagaagccagcugggauugaaauggaaggaauuuacaugagacacaggaugcagggugugaucugggaauuucaggagguagggcauugguggggagguaccaacugcaacagcccaccccccuccuggugcacagacaugcugcugaaggugaccauuguuucauuuauucauucucaaauauucaugcaauauuuauuggucucuaaaucuggucucaggucucuaaaucuggucacagcaugaggcaggcugagucagagaccucucccccuuaacccgccuggcccagccccauccacugggaggacuuggcgcccuagagaugccuaaccaccgaugagacacccaggggcgagauaugagcucccuaguacucacaagugggucauccugcauaucaaaggauguaggaguacaaugacgugauguucgggauuugcuuuaaaauacugcagucaaggaaaauagaaaagggauaacuaaagcauaugugacuccaucuggauaacuguugaaucugggugauggguccauggcggugggagggucauuguaaugucauaugucugaaauguuugaaguguaccaguugcaggggugccguggugauuacugccuccugccccccagccaaguacaggcgugacaacccaaagugcacaccccccaaugacguuccaaagaaagaacccacuugugccugucagaaacaugauauaacugucaaaaggacagaaagucagcuacaucaauggcaagaugugaguaguagguuccguuugucccaggacagugcagaaauggcaaauuuucccucaauaugaaaaaaagaaacaaagaaaaucuaugagaagugccaccacauggacagaccaccccucccgcgggccuguggucugcagccccugcccguuuccaacaaccuuccucacuaacaggcuuucuccuuccugcagggucccugaugccgcuucccgaugggaaugggcuggaagacggcaauguccgccaccuggugcagcccagagggucaaggaaugggccagggcccuggcagggaggucggaggaaauuccgccgccagcggccccgccucucccauaagggacccaugccuuucugaagcagguacuugagccucuguucaguggacagugcuaaagcggagggagaaggacagccuagaagccgggugauccugccgcucaucacuggccagacacauccaucaaacaguccuggcgccacacucacagaggcuuagagcuggcaagagagcuuauggggcagcugucuagccccuuuauuuuacagacgaucuccucgucugaggccuagagaggggcuugauacuuggggccagucucccuuccacccugcugccugggguuggggaggcuggccugcuuagagauuucuagacauccugguggaccuuaauggcuggggaggggugcccagggcaaaccuacagauguccaguguagauugucgccagaguuggggaaggaggcagagagcucuaggggcucucaggcagagaacaagaggacaguuguggcugugguugcccggagcugugagaaggagggaagaaccaagguggcagcagagagaggagagcugaagccugccccuucccuggucugcuggcugucccacugcaguggggacaggcaggcaccaacucaggggccuugggauugagguuugggcugaguggaguuugggggaaagagaaggcggucuccucucuccucuccuuuccuggggaguuccuuuggccuaggauauguccaugacuucucucuugucauuuuugucuccuuaggacugaaggggcccccaagugcccacccccggcgguuaugucuccuccauagauuggucugcuucucuggaggccucacguccauucagcucucaccucgcaccugcuguagccaccagugggcccagcucuucucaccugccugcuucccccaguggcgugcuccuggcuguaguuuggaugauucccguucucucacaagaauccguccaguccaucuuccuggccccucccuggacugacuuuggagaccuagccccagaaagccucccuucuucuccagguccccuccgcccuagucccugccugucucaucuaacgccccaaaccuucauuugggccuuccuuccucaugucugcccugagcgcgggguggaagugcucccuucugugggcuccagcagaucccuuguuuuccugucaguuggaccccucaccuggccuccagggaagaaugcagagaaaagcaaggagagacucuaguuaagaggugcuggcugcggggauccagacagggcacauugggggcauggaagugccagggugguuuucaggagcucuggugaaguggguggagcaucagcguuugcucaguuaagggagagguagagaggggcccgugaaguccuuugucacuucucuugccuuagugugccucccaauacucccuucuuccugcccccacaccccauccccagcuagcccaagcuccaggucaggaggggagggugcugggccugacauggcuauauacccucccaggaguaaaagccaagcaagagguuguuuuugccaagaaucacagaauguuagagcugacaggacccuugaaggucacuuagccuucuuaggcaaacgccugcaaaacagaagccuggagaggggagugaccugcucagagucauugcagagccgggauggggaccaggucucccaucuccuacuuuaugacgcccucuucccucuugaugaugucuuuucaaagcaaaugaagugccuuuucccgaggcuggggcuggggguggcugggaggggaagggaagggagaggcaagcuggcugugaacuguccuguuguggggcuggagcugcucccaccucccugaccuaccccugcugcaccauucccccagcugggcuggaagguuccauaacuggccagcugcccccauaacuggcagcauucccagacccaggguacucuaauaggggcggcucaggcacugagacuaccgcucaaccccagggugguuuucaggaguccgagguagccuucaaucacuggacuccauggccuucccuucguguugaccggaccuuccuuccagggcuuuuccuuugggggaggcggagaggggagaagaaggaagggaagggcagaaggaaggagggaagaaaagaaagcaaaggaacagaaggaaggaaagaaagaugggaggaagugcagcaggaauagcacccucuccccgggaggcccuagcuuccgugaggggccaucaccagccauuccuuggagggggcuuucuccccuuuugcuugagcaggguucccaggagggagaaagagaagacaagagccugaugcccaacuuuguguguguggggacgggggagucagggccccccaagucccacaauagccccaauguuugccuauccaccucccccaagccccuuuaccuaugcugcugcuaacgcugcugcugcugcugcugcugcuuaaaggcucaugcuuggaguggggacuggucggugcccagaaagucucuucugccacugacgcccccaucagggauugggccuucuuucccccuuccuuucugugucuccugccucaucggccugccaugaccugcagccaagcccagccccguggggaaggggagaaagugggggauggcuaagaaagcugggagauagggaacagaagaggguagugggugggcuaggggggcugccuuauuuaaagugguuguuuaugauucuuauacuaauuuauacaaagauauuaaggcccuguucauuaagaaauuguucccuuccccuguguucaauguuuguaaagauuguucuguguaaauaugucuuuauaauaaacaguuaaaagcugacaguucgcccuuacucuuggaggucauguucaggaggggcauuccuuuccccugggggucauggguguccccaugcccacauauugcacgugcagggagguaagugccugcaucccaaaucgguucuaggucaacuggccucaaacugauuugccaugagcucacaaaaugaaucccuaugcuuaaugaccaggucacauaaaauccagcccacuuacagguuuucuggcaucuguuuggguguccuaauuuuuuuggcagugucauuugaagaauuuuuuuaaagcaguuuauuuaagaacauacugauuaaaugcaggaucgcuacuaaaaauuguuuuguauccuuggugggugucuucugcuauuuuaucuacuuuugaacacuuucaggacuuuuuagccaguuugccuuucuugaaaaauguuauguuuucagcaauaaauacauuugauaaugacuuuguuuguaucauuuuauguuucacaaaguagaguugcuugaugaaugagauagccugaaaaauaaaaugcaaagaguucaauauaauu

SEQ ID NO: 18970 - RNA, 1586 nt, Homo sapiens
ggguuggaagggguugcuuguuacuccccaaacuuccauuaaccagggcacccuuggguuggagagguaguuccaaacucuccauugaucuauacuacauucugggcugaagguuuucuuauucuggacuaugaagaaaggacuuucaaggagauauagugugaacaggaucaggaagguagagggauuauauuuacuuaagagaacaagcucuauauuaggauauuguuuugaagcagauggaugccguuaauugcuaauaagucuuaguuauuaacgcaggcucaucagggcccccccuuggaaauauuugaucaguggucuuuuacaagugaugguauauauuucuuucuaggugguguauaaucaagacucccuaucaauucccaucucauacuucccaguuaauuggaauuaaugaaauuuggcugcucccagaccuuuuuccaugucuuccuuuuuccuuuuaacaggauuuaaguugagcauucuugagagagagagagagagagagauuggaagagagauggggagagacugacucagaucccucuccugucugcuucuuuuucugguucucucaguuuuuuuucuugaaguuauaaagccaaaccuggagaauuuguaaguuguuagguuuccccagguaacuuggcacucauaugaaccccauuuuaauaaguacucagcccaucuccucuccugggcucagauggcucucucuccucccucaccuuaccucaaguguucuccugaggacccuuaggucagacagagaagcuuucucuuucugaugggaagggucaaaguggaaaucucuuaucucuagugugaaaugauuuucugcuuuuucauacucccugcccucuuucuuuuccuuaauaaaucuuccauguuuaagauguuggccugaagaucugucccauucauaccaugcaccagcugggacugucccuaucugaucagaggggagauuaaagaaucaauguucccaggggaaaagggccuuaaauuguuuggucuuuucaauggcugacacugucuccaacucuccccuuccuccuucuuccucaagcuuccuaugcacccuacuuucccaggccaggaugguuggcacugaucccaaaccucugggggcagguggaaauuggcuguggugagccauuucuucauguccauucagcucugaggccuuccuggcccuagcugagaucaucaucuccuccuuugcuuuuaccccaggagugagguuggguuagagguggauucugauuccguagcagcuaaauuccauucucccuguccugaccauccugccuuuacccauaaagcacccguuccuacugaccaaaucucuuuacuuuguuggagaaaaaaaguauuuuguuuuuaaaucuauuuucuaauuuaaaugcaauuuaauauguaaaucucugcacuuuugugugagccuacaaauguguauguguuggggguuuuucacucucugguauuucuuaauaaagaaaucuuucuuuuggggggaagccaauuaaugaaggagccuugaaugguuuuagaaauacagggcugucuguuucuuugug

SEQ ID NO: 18971 - RNA, 39167 nt, Homo sapiens
uggcgcucagaccccaaagagaggcuggcaguggcuuggcaggugggcaugcagcagggagauggguggaggagugggcggaggcaucgucgaguggcguuaggcaaaaccaauggcaguucgggauaggggcggccggggcggaggcgccgaggccgaucggccaauagagggcgagcaacuacuggagcgaccuggugacgugaggagcguuccauuuggccaguggugggcgguugccacagcugguuuagggccccgaccacuggggccccuugucaggaggagacagccucccggcccggggaggacaagucgcugccaccuuuggcugccgacgugauucccugggacgguccguuuccugccgucagcugccggccgaguugggucuccgugguucagguaacgaggggugggggcgggggucuccugggcucggcugcagggugggcugccuccccuuccgcggcgccuggaggcggggacgucggcaccgcccuucucaacucggcagccgccgagccccuggcccggggugacuacacguggcggggcgugugugaguguguacgagcguguggcugcgugugcguguggauguggcgcgcgucccaaccugccuggggcggugguccgcggcguggcggagucagggcgggccucgagaggccgcgcccgcggcucggccccggacuccggccuccggccuccggccccccgcuggggagccggucgcugcuucccgacggauuuugaucuuuguucuuccaggccggcucccccuuccuggucucccuucucccgcugggccgguuuaucgggaggagauugucuuccagguuaguuuuacacaaaggacggguucucugcaccucugggccccccuccccuuccccgaaccuucuaccuucucguuucccugcuccgcuccuaggcuguuuuuggaccuuugcccucuccagcccgcgaguuggcuguuucucccuccguccgucgggcugcaggcuuccgccucaguccugccagcguggggcauguggugucgguaaauagaggccacaacaccacaccugagcggaggagaaggguagcagaggcugagaaacucugggccugggaauucaggaugcugaguagagaugguacuuaggacaugucccagaaagcgcccuugugacuuuucuuagcugcugccauuccccaccccccaaccagccaucagcagucaccaaccauuccagaaucucuccugcuuaagucagccuuucaccuacaggucucugaugugguuucauuaagauucucacaaauguuaggcuagaccagccagauuguuucauuucccggacucaggaaguugcagaggguuugaugaggggaaaucuguuuuguguaaauacaaugcacguaugugcacagagcguccagaaccuccuggcccugccagagggugacuuguucccugcugugauucauauucgaguggcuaauugaagaaagaaggugaaguggaggaagggagggagguuuuauaaggacagaaacucuacuauuauuuuuagaguccuuuuaaugauguugaaagaacacuguggcauaguggaacaugcccuugacuggaaguuagcaguaucagcauugcugcugugugguccuggauaaguuauuuccucucucugguccucaguuuacucauuuacaaaacaaaguauuaauaauuggcacgaucaccuauaaaauccucucuaguuccaagguucugugaugaucagaucaucagcauuagauuggaagcauagaggcuuauuuaagaagaaauacuagccccuuuccuuuuuugagaaccuuuuaucauaccuucuuuuagagaacaaacacgaauuggaaauaaacuuuucccacuuccccguccccaccccuucagucaguuuucaacuuucugucucugggaaaggaggguugaacuguauuuucuuauuauugccucauuuuuuuuucuuuuucugcuuuuucuuagggcuagcaauuggacuuuugaugauguuugacccagcggcaggaauagcaggcaacgugauuucaaagcugggcucagccucuguuucuucucucguguaaucgcaaaacccauuuuggagcaggaauuccaaucaugucugugaugguggugagaaagaaggugacacggaaaugggagaaacucccaggcaggaacaccuuuugcugugauggccgcgucaugauggcccggcaaaagggcauuuucuaccugacccuuuuccucauccuggggacauguacacucuucuucgccuuugagugaguuucgguugaguagaguuaccugauuaugguuacuuuggguccaggggaagaaccugcuuucuggggaguuuggggcugguccuuggaugacuuuaacguccucuugagcgaugucuguagagaugccagcugaauucauugcuucguggucaucacagaguauguacuuccuaaaaagaccaauaccuuugauaccaauuuuguaguacugauuuggggcuguccuugauagacuugggaaauaagaaaguuugucuuaauuacucaccucucccuuuuaguggucuccuuagaagcuaaaugacagauggccuccccugcacacaaaccugagggcaccccucauuguuacauuacucagcaauccucaccuauuuuguuauucuggguccuguuuccuuaaggcucagcucucagcuagcugguacagugaaaagccaacugaguugggaaccuacagauuaguuccagccucagcuggaccacauacuaguugugugcguggcacauacgugcuuauuagaagugaguugcucuuucccucaaaaucacucaacguaaacagcucuauauucuguguaugucugguaccagccuuggagugauuuuuuuucugugguguaauaccucguacucgagccacuguuugaagucuguguaggucucgucucuaggggagguggccggcuggauucuagggcacuguggcgugucuccugggugugcugagaaugcucuacacucuagggaugggagcauugcuaauuguuuugggauuacugugaggaggccuuugagagccaagagguguguguguggacuguaagccacaccugaggugagcgugcuaugguguauguacaugggugaccuggaaauggagggcuuaugcugggguguguccaugggagguaggagggggcaccuuggccagccuaguggggaaguaaaaugagcucuggucccuuggggcucauuuuuguccuucugugagggcuucaggcuuucccagugcacccagagugauuuuugggcugcuuugccagacuuuugggugguugcagcuggcuugaguaacagcagggggagggagauccaguuuauaacggggcugggaaaguaaggucagaggaacucuuuguuaaagguccuuuugcugcugccgccgcuacugcugacuuugugaaguguuuagugaagucaggcagguugcugaaggcuucuuauuugcuuuccaguuugaguuuccugaaugagugugugugugugcauaugugcacgcacgugcuugugugugguaccagugagcauguguagucaggcaggcauaagccccuagcauuaaaaauuguuuuuccuucuccucacccuucucuccaaguauuccuugccucauuccuguccugcuucuucuuggaagugcaaagcugacaucuguucuuuaucauucuuccucucuuuuucucuuuuuguccccacccccaccuccagguuaaauuuuuauuacaacuauuccaaacagagaugagccuuguucccaggcuuugaguuaguugguaguucugggcccaggaaaccucugguuugacuggccagggguacuugaaauuuggagguauugccauuuguccccuuuuguaucugggagccagcagaagaaucugacuggaaucuguuccacugaggccccugcaggccucugaagaaaaccgcuggugggaugaagcuucuaauuagccaaguuaccauuugacagaggcagguugaguuuucuaccaugaugacuuccccccgccccagguuauuucuugcauuuugaagggugagguuauuuguaaaacuuacuugaguaccagcugucugugugaaagacuaaauauuuuugaagauagggcuggaggagggaguagugggaagaagaggggagaaggaaguaaauguguuagcagaggaguggaggggggagguggaaaugugaccacagaggagaggacccuggugaugaauacuuuguacauguguggaugugcgugcuuguguaugugugugugugucugucauauacagacacauagacacuuuaggugguggcugccuugugccuagccagugacagguuguacaagguacaccagcaugccucugaggaaugaaaucuccuucuggucggccuuuuucuuuggcaucuauaauuuccuguccaccacauagugggggcaggguuuggggagcagaaugugggcugcuuuguuaguauuaggacuuagcgcaguggcucaugccuguaaucccagcacuuggggaggccgaggcaggcagaucacuugaggucaggaguucgagaccagccuggccaacaugguaaaacccccgucucuacuaaaaauacaaaaauuagccccguguggcuguugugcgccuguagucccagcuacucggaaggcugaggcaggagaaucccuugcaccugggaggcggagguugcagugagcugagaucuuagccuggaugacagagugagacucugucuuaaaaaaaaaaaaaaaaaagaacuuagugaggccucaggaaaucaguugaucuagcccccugccuucaggcaggugagggugucugaauagacaaauggugaucuauuuucauucuuacauugucuaggaguagagacuccacauccucuggcugcuguauuuuuaccuugugggaagauaguccaaaucuugaggcacaucuggagcugcauuuuaguagcaggguccugcuugcagcaggugcuuaggaacaagugugaguugauuuauagcugccugcagcacagcucugggccagccagauggcuugagaagucuggucaggcaugugggugccccuuaaugaaaaacgcauaauguuagcagugcuggcagauguccuuuuauuuuuggauuaugccuuuacauaucuucuagaagacuuuucaaaugagugaccuguaauuuucaguggacacauaguagauugaauacauaaaacaaaaaaaguuguccauccuggggccaguuagcucuguauuguuagaguguuucuuuuuuuuuuuaauuauuuuuuauuuuuuauuuauuuuuugagacagggccuugccccaucacccaggcuggagugcaguggcaugaucucugcuuuugcaaccucugccucccggguucaagcacuucuccugccucagccucccgaguagcugggauuacagacaccugccaaauacaaauaauuuuuguauuuucaguagagacaggguuucaccauguuggccaggcuugucucgaacuccugaccucaaguuauccaccugccucagccuccccaagugcugggauuacaggcaugagccacugcgcccggccuguuagagguguuucugaagaagccggggggucucucucgggccgcugucaccgaguagaaauuuggccaaauauucacuaagccucuugcaacuccaagaaccugaaauucuguauaacucugugucugucuggaagacucaaauacacacaaaaggagauuauagauuaccaguagguugcuauauuuaaauauaauuguauucaugguaaacguauuuaaguuuaaaagcagagugaaaaaugguauaaugcuuaaagaaaaaggauuuucuaauuaauucuuagggugagguauuuaagaaaugugaguguguauugcuaguuucagcuuugagcacaugaacaauuuucaguucuuucugcuuaagcucuauccagcuugugcgaugaacacauagcuaccagcuuggccugaaguguuaggacacuguagcagaaugccacugacaaccuaggagacauccagcuacugaaaggcuaucgugguauucagucaaauucaacuuccugauaaagugugauccuggagaaaggaacaagugcacugucuccuggaauuggcuuccagcuuucucuuuuagcuuucugaccuggccacuagugggaucaagguccucagacuucucuuguggcaagaaugacuaugagacucuugaccccugaagcagaagcaguuugcugcuauaaucagugcuuauggucucacuguguccucuguauaugaaggaaaucuuaucaaggcacugucagaccagguucugucagguugguccccauuagagcuuuugauguauauauuggcagaagagucauugaauuggaugaacugaaaacagcuuuguaacacugcuuaguaaucaauaguaaucaauacaaacaauacuuuucuagccuauccaaauucuaccccucuuucaaauucuuucuugagucuuucuucaugaaaacuuuccaguaauuucugcauucauugggcuaauuguacacaccgcucauucaacagauaaucacaugacauuucuuauaguuuggagcuauauggugauuacacuucucacuguuguugucccccgcagcuagucucuuucaaggucagagacuauguucaauggcuguguagcccccacagugcucucuaccaugccuuacauagaguagauggccaauaaguguugcugaauuaaaacauucuagauguacuuaaaauuuaacaaucuugacccacagaaucauaggaugguagaucuggaaagggcuuuggagacuaucucccuccuuguguggggugaggaaaccaggcccacagaagugaguuuccuuuaucaagaugaguugaccagccaacgucucuauacugacucagggcuuuuucuucuaauuucgacauuuuaucucauuguucauuguuacccuuuggcuauggaauccugaagauauucaaacacacaugcuuuaguaaaguguacauaguaccaaauacuaggccagcauauuccagauucuugcgagcuaguguguguguuacccaguggcaucuaggcucuuugggucucccaagcuuaugcuccuagaaaaugaaggcaucuuugcagagaacugaugguauugcagcauggcauuucugguagccuugcaggaacagggaagccuaucaggagcuuugugaguuaacaagggaucaucacugcuguggccacuccuggucccugcugccaagaugaggauggcuuggagaaaaaucaagcaaugugugcucuguacauuguuacuuagugacuuauccugaugaaaggggcagugugggcugggcgcaguggcucaugccuguaaucccagcacuuugggaugcugaggcagguggaucacuugaggucaggaguucgagaccagccgggccaacauggugaaacccugucucuacuaaaaguacaaaaagucagcugggcuugguggugcacaccuguauucccagcuacuugggaggcugaggcaggagaaucacuugaacuugggaggcggagguugcagugagccgagauugugccauugcacuccagccugggcaacaaaacaagaacaaaacuccaucuaaauaaauaaauaaauaaauaaaauagaaaaaagaaagaggaggugugucuggcagacaggugaaauagaaaaagcagaccugauaauaugaacuuacuagguuugaggagacacaagacuauguagaccaaagccaaacuuugacauaccagaauguuagugcccacagugacaagguccagguuccugaagagcauccuuaugugagauugggaagaggaaaaagugacuauauugugcucuguaaccaagagugcauucucuggggaaugacucuauggaggucagucuuggcuuuaucuagcuucggauucugucugugacuugacuaaccaaaugaguuuuagaaaggcauaguugccucuuugguaucaaucuguuacaguacuuagcuaaacuuaacuuccugaugaaguauguuccuugagagagaguucuucccaagaguuccuuggguuguaucuccugaacaguuugcuuucuuuuucuuuucuuuuucuuuuuuuuucuuugagacggaguuucauucuuguugcccaggcuggagugcaauggcacaaucucggcucacugcaaccuccgccucccggguucaagcgauucuccugccucagccuccugaguagcugggauuacaggcaugcgccaccacgccuugcuaauuuuguauuuuuuaguagagacagaguuucuccguguuggccaggcuggucucgaacuccugacuucaggugauccgcccgccucugccucccaaagugcugggauuacaggcgugagcuacugcaccuggcggcaguuugcuuucuuuuaauaauucuuuuuuuuccucuuuuuuuuuuuuuuuuugagauagggucucccucucuugccuaggcuggagugcaguggugugaucuuggcucacugcauccucugccuccugggcuuaaacaguccucccaccucagccucccaaguaucugggacuacaggagugagccacuaugccugacuaaguuuuguauuuuuuguagagacaggaucucaccaucuugcccaggcuggucuugaacuccugagcucaagugauccaacagccuuggccucccaaagugcugggauuacagguguaagccaccaugccuggcuccuuuaauaauucuuuaugguucugucauucagaauuucucuacauuuucagccucuauuuccuuuugugguaaugaguuucacauuuucagucuccacugaaugccucucccaucuuuugaggaugagucuuaauuaaauauagugauccucuguuuugggaaaagcaagcccagagaacagggauguuccccaacaugcugacaucaguugagauguuauugagggaaagaagagacuccuaaaucuuucuccucagagaugcuggugcugguauugugcuuaagaacaaaggagguaccuuaggcuauuugcaguagcaagaagcuagcuaauucaggguaauuaauuagugggauguuucuggaauggaguggggaagacagggccccuaugaugaugauuagauaaggccaguuaauggagagccuuggaauacugaccuguggaguuuggggcauaauauaauaggcagcagugaaugguucuaaguucucgagcagggguauauuguaacugaaauuugaacuuuguuauuauaacugaaauuuggaaacuacugagcggguuuaccuggauagagauuuugaugagaggauggcuucucacuucagaauugaaagugucccuguuugguuaauuuucuuuauugcuacuggagcaaaagaggguugugcauuuuucucugaccuucacauagaaguaaaucuggaggcugauuguaaauuauguuuuuaguguuaagggaaacuuccccucucagcagacucugagggucaucagaagaaucuugaaacagucuuaaugggugguucuacauguuuauugucuucuagagguagugucuuagucuguucuggcugcuguaagaaacuaccaucgacuggguggcuuauaaacaacagaaauuugugucucauaguucuggaggcuggcaaguacaagaucaagaugccugcagguuuggugacugaugaaggccugcuuucugguucauagauggcugucuucucucccuugccaaaggggcaagggagcuugccaggauuucuuuuauaaggaugcuaaucccauucaugaggguggagccuuaggugaccuaaucaccccccaaaggccccaccuccaaaauccaucacauuggauguuaagauuucaacauaugaauuuugcagggauacagacauucaguaaguagcagguagguaguaagaggacagauggccauccauaucagggagguauuauagcaaaggcuuauuucucccaugugugaccaaagaguaucauggggcucugauccuugggccuucuuccuuaaagccauacuuaccagcugcuacuggagcaguuucaagcagccagcagcuccccuacagagcucuucccugaccacuuacagcccuuagaggcugagucaccauucuaacacuugauuaucggucaucuuauucuuuagcuguuucauauuucaguuauguuuuccccaacaaaauuaacuccuauuucccuuguucuucauuuguuaguccaacaaguacuuguuggcugacugauuacauugauaaaagaacaaacaaaccaaaaaacauagcaagaaagcuguuagggagacuuagaagcaguguauuguacagaacaccaauccaagcugccaauccguaaggcauagcucucugucuagauucuuacccauucuacucaugaaucucuucugaguguuuucaugugaauugaagucugugucauuaucaucaucccuccagugaacuagcaugcuagggaugggggaugggacacgacacaugagcccagccuggcacugaugguuacugcuggucaguaccaccgugccgccugaggggacaugugggaguccaguugucuaguccagcuaugguagccugaggacagucaagaagucaguagaggaugguuuaaaaugaugaugucucuucagguggcagaaaugaagacuuaguugggacaugguugcauuuauaaaauucacaagggagaaaaggaacucuaauccccaggaaggagaaaggccucuugguacuuugaauacaggagaguucuguuuuaagaaguauauggauauuauuauuccauggagugauauagggaguuucagaaacaauuagcuuauauucguggaugacagaucugaccuagucuuuuuuuuuuuuuuuuuuuugagguggagucuugcucugucaccaggcuggagugcaguggugcaaucucagcucacugcaaccuccgccucauggguucaagugauucuccugucucagcuucccgaguaagcugggauuacaggugcaugccaccacguccggcuuauguauuuauuuauuuauuuauuuauuuauuuuugagacggagucuugcacugucacccaggcuggagugcaguggcacgaucuccgcucacugcaagcuccaccucccggguucacaccauucuccugccucagccucccaaguagcugggacuacaggcacccaccaccacgccuggcuaauuuuuuguauuuuuaguagagacgggguuucacuguguuagccaggguggucuugaucuccugaccuugugauccacccaccucagccucccaaagugcugggauuacaggcgugagccacugcacccggccuuauuuuuguguuuuuaguagagaugggguuuugccauguuggccaggauggucuugaacuccugaccucagaugauccaccugccuugaccucccaaagugcugggauuacaggugugagcgacugugccuggcugaucuaaucuuuaucuaagacaaauuagugauguuugaggauacuccugacuuuggaggucuauauugggaauuaccaccaaacuuucacguagcuuauucuugucagagacagacuuccagcuuauagcaauuaugggauuagucuagggugauauuuuugaaguauuuuuuaaauugacaaauauuuuauauauauauauaaagauauauauacaaagauauauauguauacaauaugauguuuugauacaucuauacauuuggaauaguuaaaucaagcuaauuaacauauguauuaccuuacauacuuauuuuuuuaauggugagaacgcuuaaaaucuacucuccuagcaauuuucugguauacaauauaguguuauuaaccauaguccgcauguugggcaauagaucucaugaacuuauucuuccuuacugaaauuuuauguccuuugacaaacaucuucccaauccucccuucccaauacccccgguggggguauuuuuuaucauaacuuuugaagacaaacacuauggguuguaguucacaauagucuuaguggcuggcgcucgaaguuuccccuuacucagaguagaaaggccugcuagucccacaucuggcuucccagccacacccacucacuagagacgacuggcugccaauagccucaucucuggaggagaacaauacaauaggccuguuguguacuuguugacauacagaguggauuguuuuagcaggugcagaagaugcucuguguggagauuacagagaccuuuauccuugauggcauagcguaauucaaaucuaaguuguccuuugucuggccuacaagcagguguuggaacuggacuuaguuaagcucggguccuucugugcagcggggcagcauuaauuuagaauuuuuugcuguugcucuacucacucuguauguuuucccuuuaauaaaaaaauuaagcucucuuugguggccaaucagauacaucugauuuuuaaggcuuuugauuggagacuauacauccagggcaguuugcguccuggagacauuacuucuuuguuuucaagaaugaucuuagugaugggcaguggccaggaagauuccuauuugcuguuagugugguaauuucacuuggcuuguucaugaaaugaagccucaugcuuuuccugcauccuuuggguuccugauaaguggaggugauuuuugcuucugaauucccuuuuugguuaaucuguaccagugaaaaggaguaguggaaaauaggguaauccacaagcuagugauauguaagaaccuuaauuacccugaacucagcugccagauccuucaguucuccaguuuucccccaacccuuggcuuuuaggagaaggaaguaaaucauuaaaaaagcaacuuaagaugaaggauuuuguuaaaaauaagcaagcaagcaaacacaaaagucacgaaaaucauccuucagguucaguacauaugugcaccuucaucaaaaacugcuuagucuaauauaaaacuuggcuuguguccccccaugaaguuguguguguggcagggagcuaggggaagaccucauggggguuguuccgaaacugcagagaauauauaaccaggaguuaaacguuugcuuugaauggccaguagcuugcuuacuucccaugcugaugagguaagcguuuuucuuagcuuacuuucucugcucucucucugcuccuugcucauccacuuauagucugccuccaagugaaaacucuguuuucaaggagaaaugugccucaggaggaggaggauaaaaauaggucagcgauaacucuccuuacauauuccuauuuauuuuguuugaaauucaguucagaucaacaaguauuuauugauagcuucuuuguucccuuacuuguauuaaagcucugggagauacagaaucaugguguuaauguuaauagcuaacauuuuacuuaguguuuaguauuuacugugugucaagugcaguucuaagcacuuuauuuauacuagugcguuugauccacacaaugaccucaucaagcacuguuauuauccucauuuuaucgauaaggagacugaaguuaacuaagucacccaacuaggagcugguagagccagaauucaaaccggagcauucccaguccaauaagacuagguccuugcucuuaggaaguccaguugagggagaugccaucaacauacugagaaauagcuaggaaauaaugcaaggcucuggaagugaggaccacagggaguagagaagagagagauuagugcagcuuagcauaagccuuuuggaggagguaagaauucucuaagucucagauucuucaucuaucaaauggguauaguaggaucuauuucauagauuuagugugagaauuggaugggauaauguagaugaagagcuuagugcagugccugucuuauggagagcccucaauaaauuauaguugcaaugaugacaaugauauugaugucucuggcaccugaaagaugaguagaguugggauauucagagaggaagagaaauagcuugccagaugcauuaugaggaaagaggggagugaacaugauguugggaagggguacuaaggauaaacgauuuucuuauuuucuugcugauggucauuagucacuuauuagcugagcuaauugaggagaccagaggaauggauguugcagagucagucaacagcccugaagguuuucacuggucuugaagcaugcugagauacucucugucugacacugugaaccugcuuucugguugguccucaucuuuucucccucuucaucaagcucagcuugaaugccagaucagugguuaugagaagcccuggacauucccagagugagaucaaccuguguugcuuagaaauccagguucaguugcuucccuauucuuagcaggugugaaccuuuccugagguagaggaaauguagcucccaguggguugauaggauagauuggacuuggggguaagagaguguccucaagcgugucuucuguauguuauagguggcagcagucaauuauuuguugagcuccuacuauggguaaagccauauguuagggguuugggguaauucaagagaagaaacauggucccugcccuugaggugcugcugauucuguugugggggccagauugacauacugguaacaauuggagaucaauauaggguagguaucauuaaaugcugaauugccugcuuucuucaggugccgcuaccuggcuguucagcugucuccugccaucccuguauuugcugccaugcucuuccuuuucuccauggcuacacuguugaggaccagcuucagugacccuggagugauuccucgggcgcuaccagaugaagcagcuuucauagaaauggagauaggugagucuuccaaccagcuggcaagcugcuguguaguggguggcccuaaucaguaagagaauggaaucauaauaguaguugcagauuaauaaucacuucuagccuuuucucucugagauccugaaucugagaucaugacuaccccgugaauuuaguaaugcaggucuagcaacagucuaaagucauagacuuuguccuucacugcauuuggucacauuucaggaaggauuuguuaccaagguccugcuguauuguucccaggaggaugguuuuuuacuuuuuugggggagguggucaccaacacauuuuuuucugaagcaaugaaagcacagauuuauuauuuauuuauuuauuuauuuagagacagagccuggcucuguuaccaggcugaagugcaguggcgugaucuuggcucacugcaaccucugacucccagguuuaagugauucuccugccucagccucccgaguagcugggauuacagucacaugccaccacacccagcuaauuuuuguauuuuuaguagagacggggauuucacuguguuggccaggauggucucgaucuccugaccuugugauccgcccgccuugaucucccaaauugcugggauuacaggcgugagccaccacaccuggccagcacaaauuuauugaaacaaaaguacacuccacagagugggagggggcuugagcaaguggcucaagagccacuuuuugguuuuuugaugaaagcuguaaaccuucuccccauaaaaaugcucuuauaugcauguacauguacacaauuuuguauguaauuucagggauucauagaucuucugaaguucauucaugucccccccaaccaagaauuccugcuuuaggccgggcgcuguggcucacgccuguaaucccagcacuuggggaggcugaggcgggcagaucacuugaggucaggaguucaagacuagccuggccaacauggugaagcccugucucuacuuaaaauacaaaaauuagccgggcaugguggcaugugccuguaaucccagcuacucgggaggcugaggcacgagaaucgcuugaaccugggaggcggagguugcagugagccuagauugcgccacugcacuccagccugggcaacagagcgagaguccaucucaaaaaaccaaaccaaaacaaacaaacaaaaaacgcugcuuuaggggaacaugcaaugugaaagggggcagcuguggugccaggaaccacugagaauucuaggagggguaaaagaagcaauugcaggcucaguagagugcauacugcagcucaggauaaggaucuuugguacagagaugaagugcuacauuaucuaggagccaggguggcuucaugauuugaagcagaaccaucccagggccagaggaggagauauccugggaucucacagugagaaagaagacuaugaugcaaguacuaggagggagugggagcccaccagaucaacagcagugccuaccuaaaugguucucagguuugguacccagguagcuugagucagcauccaagcuagacagaguaagaaaaagggacccaggacuuguaagacuaagaagcugugccaguagagcaccaaucuguggcuagccuuuaguucuuugacggugcuuugaaggcuuccauguauuucuuuuuucuuuuucuuucccucccucccucccuccuucccucccucccucccucccuuccuuccuuccuuccuuuuuccuuccuuuccuuccuuucuucuuuuuuauuuuuccuuccuuucuucuuuuuuauuuuucacaguuucacucugucccccacgcuggagugcaguggcgugaucucagcucacugcaacccccaccucccagguucaagugauucucgugccucagccuccagaguagcugggauuaugggcacccgccaccacucccagcuaauuuuuguauuuuuaguagagacgguguuucaccauauuggccaggcuagucuugaacucccgaccucaaguuauccucucaccuuggccuuccaaaguucugggauuacaggcguaagccacugcgcccggcccauguauuucuuuuguuuauuuuagcuguguuuucccuuaggcuucuuaauggauuucauuuugaaaaauuccagccuguuuuaguugagcuaaggagaaauggguuugugcacaugugagcuauaacuauuuggggguggggugaggguggggauagugggaagagagcagaggcgacgugugcuggcacagcuggaguucuggggagacccgauagaacuaggaguaguuaggagcaagauggugaggaagaguugugagugcuguuuuuucuccaucuggauuauucuuuuccaguucccuucccauucacauauggagaaacugagggucaaggcaguaccuugacuugucuccugccucucacagcagguuguuaacaaaguuagcucuuuucugccugaucacugggccuggggcucagacucaagcagucacauuguggccucugcauuuagcauguuucucucacuagaagaguacauuuuucaguucauauguauguuuauguuagcaaguuuuugucaucuuauauucaguccuguacuggguaugcugugggugggggauggggagagaggaagucaugugaugcccuugccugauacggccuccugagaaaggugaaccaugaacccugucucccaggugcccucauggaaagcauaugcauagaauauuaagguggcaugcugguacuuauccucuaaugaauagcuguccucauccuuuuaagacuugugacacauuguuauuguuugauuucacagcaucuaccccacuccacaaaaaaaggaaaaauguuccauauggcagauauuuuuaaaaucaaagugaauugaaaaauauucuguuuuuagaauuauacugcauggugagagugcaaugagacaggcacucucauaugcugcggaugggcaggcaugcaaauucauacggucugucugggaagcaguuuggcaacaaguaauauggacuuuaaagggucauacccuuugacccaguaguucuacuucucugaggguuuagcuaaaggagauaaacagauuuuuacaaauuacuguagaaggauuuuuggugcaucauuuuuucuuuucuuuuaaauaugaguagcuauuuuaaugccggcaacuucauguauuacugcuuauacuucaccauucuuuucuuuauucuuucuguuuuagaaauuaauuuuaacacaugaguauguucuuggaagggaggaggggacuaggauugagguggugaucgaaggagauuuaagcuuuucucuguaauguuuuaaauuuuuacaugaaacaucaccuaaauaguaaaaaaucccaacaauauggaauauuuaaauaaaucauaguacacguauaugauggaauauugccaguaguuauguuuuagaaaaaaaauuaacaaugagaaaauguucacagcauauaauauuaaguaaauacuucaugguacaaaucugcauuuauaauaugaucucaauuuuuuaaaaauuaugaauguuuaccuguuaauagaagauuagaaggaaauacgccaaaaaauauaaauaucucugagcugagagacugacugucagugauuuuuauguuuucuuauuuauacuuuguuuuuuuccaaaaaaaauuuuuuuuuugaguuggagucuugcucgcucugucacccaggcugccucccagguucaagcgauucuccugccucagccuccagaguagcugggauuacagaugcgugccaccaugcuuggcuaauuuuuguauuuuuaguagacacgggguuuugccauguuggccagacuggucucaaacuccugaucucaggugccccgccugccucagccucccaaagugcugggauuacaggcgugagccaccaugccuggcccuauucuguuuuuuuccaaaauuuuuacaauaagcaagcauuacuuuuauuucaguaacuguuucuguguuaccagucuuuucuuuucacaugcauauauuuuguuugcaagauaguauuguuuuaugcguauugcuuuuuaacauacauuuucauuuugccauauauuguauuuuccuguuuucaccauucuuucgucuaugucauuuuuaacggcugcauaauauuccauucuaugcacauaacauaauuuacuuaaccacccuucuauugugacauugaaguuauuuuuaguuuuucacuauuaaaaggaacucugugacaaauauccuuauauaaacaucuuucguauaucucauuauaauuuugauaaguuucuagaaguagacuugaucaguaaaugaauauacacguuuaaaacuuugguagcuggcugggcacgguggcucacaccuguaaucccagcacuuugggaggcugaggcgggcggaucacuugaggucuggagucugagaccagccugacaaacaugauaaaaccccaucucuauuaaaaauacaaaaaucagccaggcaugguggugggccccuguaaucccagcuacucaggaggcugagacaggagaaucacuugaacccaggaggcagaaauugcagugagccaagacugagaucccaccacugcacuccagccugggcgacagagcgagacuucaucuuaaaagaaaaaaaaaguuuaguagcagcugccauauugcucacugauaagaucuaagaaugaccuuuccccacccuugcuaacaugggguauuuuuauuguuuguaauguuuuuuaauaugauagguaaaaaugguaucuuugugcuuuaauuuuuauuucucugauuauuagugaaauuggauguuuucauuuaauguauuuuuagcuauuuuuuuaaaugaauguuuuucuuuguaaucagaaaaaaaagccucgaagaaacacuuuuucuuauguauacaacagaacugcaugcacuuaguggaguuuuaugggcauauucugugauguugagugucuagucuauaaaagacagggggcuuggggaaccuuugaaugcccccauugguuuuggagagguggugagacuuuugggcucaagugauggcuagcugugauauuaacugucuuuauugauuuacagaagcuaccaauggugcggugccccagggccagcgaccaccgccucguaucaagaauuuccagauaaacaaccagauugugaaacugaaauacuguuacacaugcaagaucuuccggccuccccgggccucccauugcagcaucugugacaacugugugggugaguaaaacuacagggacauugccuagggaaaaggcugaguugaacuagaaagucaggguggucaccaauuuugggaggagggaagauagauuuagaugagaaaugaacuagauuuagauagggaaauuuagauaggcaacaagcuccugaaaaacugcaaaucagcuguacuuguguagaucaaaucaaaauuuaaauauccucuagccuaaacuuuacaaaaaccucuuuaguaaaugagaaaaauaaacuuuaccuauuuuugaaauuuagauuuuccuguacuggauuuucaugugggacccaccuuacauagugggaggagacaccuaguccacuggagggcagcauugaggaaggaaggucugucuaagacgcaacccaagaagaggaaaguugcuagcauuuauugaguuucuacuacauauugggcacugugcuaagugauuuaccuuucucucauuuaagacuuguaacagccccaugagauugguauuauccccauuuuacggaugaggaaauaggugaagcaccaguauguaaguucacauaauuaguaugagauuaagcuagagcaggucugauuccaaacugcuuauuucuucucuuugcugcugcugcaagagggucagguauaugugugucuaauacaguggucuguacuuccauccacauauauguggcuuuguuguaaucacugccuacugugugcuaaacccuggccaagaugagaaaugggccauaaagauuccuguugauaggccuauaugugaaauugcuuauaucaucacuaggcauacuucuaauguucuuuuuaaaauuacuuuuucuugaguucccaugauuggauaauguuuuuucuguauaccauguggcauccugagggcauugcuuuccucuuacuagccauuucuuuaggcaaagguugggagauauauauugcuuuauaugguaaaagcuauauggugcucucuucggcagcguguauacuaaaaagcuacuauauguauauaagauuuuuauaaaucaaaacccauuuuauuauuauuauuauuuuuuauuuuacuuuaaguucugggauacgugugcagaaugugcagguuuguuacauagguauacaugugccauggugguuugcugcaccuaucaaccugucaucuacguuuuaagcccugcaugcauuagguauuuguccuaaugcccucccuccucaccccaccccccgacagaccccaguauguguuguuccccucccuguguccauguguucucauuguucaacucccacuuaugagugagaacaugcgguguuugguuuucuguuccuguguuaguuugcugagaaugauggcuuccagcuucauccaugucccuacaaaggacaugaacucauccuuuuuuaugggugcauaguauuccaugguguauaugugccacauuuucuuuauccggucuaucauuggugagcauuuggguugguuccaagucuuugguauuguaaauagugcugcaauaaacauaugugugcaugugucuuuaugguagaaugauuuauaaugcuuuggguauauacccaguaaugggauugcugggucaaaugguauuucugguacuggauccuugaggaaucgccacacugucuuccacaaugguugaacuaauuuacacucccaccaacaguguaaaaguguuccuauuucuccacagccucaucagcaucuauugucaaagcccauuuuauuuauuuauuuuuugagauggagucucacugugucacccaggcuggagugcaguggcaugaucucggcucacugcaaccuccaccuccuggguucaagcgauucuccugccucagccuccugaguagcugguauuacaggugcacaccaccacgcccggcuaauuuuuguauuuuuaguagagauggaguuucaccauguuggucaggcuggucuggaacuccugaccuugugauccacccaccuaggccucccaaagugcugagauuacaggcaugagccaccacacccggcugucgaaacccauuuuaagugaagcaggaaacuugauauuuaaagaaggucuggccaggcgcgguggcucacaccuguaaucccagcacuuugggaggccaaagcgggaggaucacgaggucaggagaucaagaccauucuggcuaacauggugaaaccccaucucuacuaaaaauacaaaaaauuaggggacgugguggugggcgccuguagucccagcuacucgggaggcuaaggcaggagaauggcgugaacccgggaggcggagguuguagugagccaagaucgcgccacugcacuccagccugggugacagagcaagacuccaucucaaaaaaaaaaaaaagaagaaggucuauacccaguaaugggauugcugggucaaaugguauuucugguucuagaucuuugaggaauugccacaucuuccacaaugguugaacuaauuuacauucccaacaacaauagcguuccuauuuccccgcaaccuugccagcaucuguuguuuuuugacuuuuuaauaaucgccauucugacuggcaugagaugguaucucagugugguuuuugauuugcauuucucuaaugaucagugauguugagcauuuuuucauauauuuguuggcugcaugaaugucuucuuucgagaacaaugagaacacauggacacagggaggggaacaacacacaccggggccuguugagggguggggaagggagggagagcauuaggaaaaauagcuaaugcaugcugggcuuaauaccuaggugauggcuuuauaggugcagcaaaccaccauggcacacauuuaccuauguaacaaaccugcacauccugcacauguaccccagaacuuaaguaaaauaaaaaggucugaugugagguaguauuuccuuuccuuauuaauacucuuaacuauaaggaacucauacaaaucaauuuuuuuaaaaagcacugauauuccaggagaaauauaaacaguucauaacaauauaauuggcuaguuaucaugacuaauagucaaauaaaugauuucaggaugcuuuuguuuugagauaggaucucacucuuuuucccaggcuggagggcaguggcacgaucacagcucacugcagacucaaccuccuggguucaggugauccucccaccucagccucccaaguugcugagacuacaggcaugcacuaccaugccuggcuauuuuuuuuuuuuuuuuuguauuuuuuguagagauggguuuuccccauguugcccaggcuggucucaaacuccugggcucaagcagcccaccugcugcagcuucccaaaguguugugauuacaggugugagccaauacccccagcccaauaugcuuuuuuaaaucuagaaaauuagcaaggaaaaccugauguuuauucuuccacuaguaagaguguaaauuggaacaaacuuuuuggaaggcaaucuaauaagauuaaucgaaagccuuaaaacaucuauaccuuuuggugccagugguucacuuucuagggagucugucccaugaaaucagagaugugggaaaauauuucgggguggaaauguuuaacucaggauuauuaugacaauuaaaaguugaaaagaaccuaauugucuaccaauagaugaguagccaaauaaauuauagagccgggugugguggcucacuccuguaaucccagcacuuugggaggccgaggugggcagaucacuugaggccagaaguuugagaccggccugagcaacauggugaaaccucgucucuacuaaaacauacaaaaauuagcuggacguggugacaugugccuguaaucccagcugagacccuggcugaggcaugagaauaaaaaacccaugagguggaggcugcauugaaccgagauugugccacugcacuccagccugggcgacagaguaagacucugucucuaaauaaauaaauaaauaaauaauaggacauucguacauuagacugauggaaagaguucauaccagaaagcuaaaugacaaaaugggagauaggcuacauuuacagugugaagucaguuaccuauuuuuaaaaaaucuaaugauguauaaagaaauaugcaaggaaauacaggaaauaugccacaauuuuuauaguuuauuaucuauagguugugggauuaugagugauuuuguuuccuucauuuuuucauaugccauccuccacuacugugauuucuucauuuuuccuuuuauuuuuuucaaguuuucuacaaugagcauguauuacuuguauuaucagaaaaaaugugauuuaaaauacuguaaaaaauauauaucuguauaaccauucuucucuauaccuuucuucccuuuccugaaaagauguagcuuccucagcaggagauagaccauuuuuacagccuuauuuuuucaccaguacacagcucacuuuucuuucaaauugauauauuuuauucuuuuuuuuuuuuuuuuuuuuuuuuugagacggaggcugucucucucucccagucuggagugcaguggcgcgaucucagcucacugcaagcuccgccuccuggguucacgccauucuucugccucagccucccgaguagcugggacuacaggcucccgccaccacgccuggcuaauuuuuuuguauuuuuaguagagacgggauuucaccguguuagccaggauggucucuaucuccugaccuugugauccaccugccucggccucccaaagugcugggauuacuggugugagccaccacgccuggcccaaauugauguauuuuauucuuuuguagucuuuuauucaucaaaauaacacauguucauuguggaaaauaugggaagugcagaaaguauaaauaaaacuuaauccuaaauucacucuccauuuugcuauauuuccuacuaguguuucugcaaaauuggacuguaacaugauaguuuuuaauccugcuuuugucauuuaacauucuauccugagcguuuuucuacaucuuuaauaaauguuucuuuaauauauuauuuuaaugacugcauaauccaucauaugguucuauucaaguuuauucaggcagucuucugucauuagacauuauucauucuucuauuuuauucauuguuguaacacugcaaucauaauuauuaaacuuaaggauguggaacaauuggaaccuucauacauuucuggugagaauguaaaaucaugcagcugcuguggaaaaguuuggugguuccucaaaaaguuaaacauagaauuaccacaugacccagcaauuccacuccuggguguauaccuauauuagucugcuuggguuaccauaacaaaauaccucagacuggcuggcucaaacaaugggaauuuuucucucacaauucuggaggcuggaaguccaagauagaggugcgagaagggaugguuucuggugaggccucucccccuggcuugcagauggcugccuucuugcuguguccucacgugaccuuuucucugugcucacacacuacuggugucucauccucuccuuacaaggacaccagucccaucggauuagggccccauccagaugaccucauuuaacuuuagcuaccuccuuaaagguucugccuccaagugcagcuacauuggggguuagggcuucaacauauggaacuggggaguggggguacaguucauuccauaacaauagccaaaagaauugacaacaaggacucaaaaccuacuuguacgccaguguucguagcaucauuauucacaguagccaaaagguguaaccaacccaagugucuaucaacagaugaaugguuaaacaaaaugugguauguacauacgguggaauauuauccagucauaaaaaggaauacaguacugauacaauguggaugaaccuugaaaacaugcuaugugaaaaaaaaaaagacacaaaaagacaaauauugugugauuccgcuuauaugagauaucuagaaugggcaaauucauagagacagaagauuagagauugcuaggggauggggaagggggaaauggagaguuacugcuuaaugggugcagaguuucuguuuggaguaaugaaaggguuuuggaaauagauaauggugaugguuccacauuaugaauguaauuaaugccacugaauugcacacuuaaaaugguuaaaauggcaaauuguauguuauguauauuuuaccauaauagauuuuuuuuuuaagacagggucucacucugucacccaggcuggagugcaguggcgugaucucagcucacugcaaccuccgccucccgagcucaagugauccccccaccucagccucgugauuggcugggauuacaggugugcaccaccacgacccacggauuuuugcauuuuuugguagagaugggguuucaccauguuggccaggcuggucucaaacuccugaccucaugauuccccugccugggccuuccaaacaauacaaaauuuaauuuaaaaguuugaacuucggccgggcgcaguggcucaugccuguaaucccaguacuuugggaggcugaggcgggcauuucaccugaggucaggaguucgagaccagccuggcuaacauggcaaaaccccgucucugcuaaaaauacaaaaauuagcugggcgugguggcggaugccuguaaucccagcuacucgggcagcugaugaggcuugaaccugggagguggagguugcagugagccgagaucgcaccauugcacuccagccugggugacaagugugaaacugugucucaaaaauaaauaaauaaauaaaaauaaaaauuugaacuuaaaauuucuguguacauuucuauuuucuuaugagaaauugcugaaaauggacuuauucuaccaaagggguacaagcuuuaugaaggcucuugauacguacugccaaauugcuuucugggaagguucuuucauuuuaugcucccacaagcaguauguuagaguguccauuuuacccuauucucacuagcacuggauuuuauuauuuauauucuuauuuugauaggcauaaaauaugcuauuauuuuacuaguauuacaaugaauuauuggugacuaggaaaaauauuaaauauagguuuuaugguauuuauuaguuuuugcccuauuuccuuuuuguuuguuuuuuguuuuuguuuuaugugcagucgacucuugaacaaugcaguuuuguacugcaugggcccacuuaauaaugaggguuuuuuuuuuccaauaaauacaguaucaguguguuccucaucugcaaccaaaugcggauccaaaauacagucgucccuaaguauccuugggggauugguuucagggauugcccuugaauaccaaaccccaugcauucucaaguccugcaguggcccuguggaacccauggauaugaagucagcccucuguauccgucuccaggaguuucauauuuugugaauaccguauuuuugaucuagguuuaguuguggaugcagaaccuguugauacggagggccaacuguauuuauugaaacaaauccauguacaaguggacgcacgcaguucuaaccugaguuguucaagguucaaauguacaguauucacaagaugcaaaaccuguguacaugaggggcaacuuuucuuauccguggguucugcagggcugcugaaugacuugaguauggguggauuuuggugucugccuguaaugcuuaccacaaucaaaugaacauauucaucaccacacauaguuaccauugugugugcauguguguguguggugaggacacuuaagauuacucucuuagcaaauuucaaguaacuuuugacuauuauuuucuugacgaaguauuuguauuuuccuauugauuucuaagaacuuuucauauagucagguacaacuuuacauagauugccauuguuuuuuuuucuuuagucuucuuuaugguaauuuuaacauacacaaaauauuuuuuaaauuuuuaauuuuuuguugguauauaguagguauauauauuuaugguguacaugagaaguuuugauacaggcaugcaauguguaauaaucacaucauugaucaccaaggaaaugcaaaucaaaaccacaaaguacuuuuuuaaaguuuauggagucaaaucuauuuuuccuugucaucuguuuucuuccaguacuuuuaugcuuagaaaguccuucugcauauagaggacaaauaaacauuuauucuuuauaguuauuuuauggauucacuuuguuuuuacauuuaguucuuuaauucaucuggaauuuacuaugacaaguaguaugaagacaaaaaaaucgauccuuauuuugcaccaaauagccaauugucacguaauuguuuauggaauaauacuuccuuuuaccucugauuuuguaaugcugaguuuauuagacaacaaaaucuuauauauucuaagaucuguuucugggcucuuuccauuccauugaacuaugccauaccauuuuaaauauuguaguuuuacauuuuuccuuggcuauuuugaccuguuuauucuucuugaacuuaguaggcccaccgauuaagauuuuauuuggaaaagcagugucucugcuuuuaaugagcugagugaggcaaaucacuuaaccucuccaugccuuuguuucuucaucuguaaaguggggaaaagaguaucuccuuuugcccaaguuccagggaaauugugaggaucaaaugagaugguuaugaaaacauuuugaaaaaguaaaaaaaaaaaaaaacccuauauuuuuuacaacugaaauagacaaugauccuggaggucuuugaauuagguauuauagggauggugggguugauuuuuguucuggaggcuuuuggcuuuggacucucucuuucucccacagagcgcuucgaccaucacugccccuggguggggaauuguguuggaaagaggaacuaccgcuacuucuaccucuucauccuuucucucucccuccucacaaucuaugucuucgccuucaacaucgucuauguggcccucagugaguauacagggcaguguccguuguuggaguggggcugggugggggaagaguuaagggcagcuuagaggguuguuggguuuccuggugguaccauugugaaagguacuuuaggacagguuagaaaugagcacaguuaucugcucuugagcaggguugcaaaccucagugcacaucaaugaguauuaaucaguguguuggccuucucuuuggccaacugcugggcacuggggccauaauuacuggucuguauccagaguacuggggcauuucugagguaaucccaaaggcuggggauguauuuugucucggagcauccucucuucuucugccuuguaaaacuugccuugugcuaagggguagaaaaggguaaggguuuugccugagaaaugucuuuuuguagcucauggucuaguuugggagauagaaagcacacccacauauguacaugugcacaaacauacacacccacacacacgccaaucuaagagcagaugugauguggaguuaagggaguggucuuaagacagcuuucuggaaagagaagaguucugagcuggauuuugaacaagggagggacacguauuggcaaggagagaggauuuuucuuggguauuucugauuucuuuuaucuguuaauaucccccuaacauguccauaguugggggcuagggaaaagggaagggagccugcugcucuucugccugccugucuaguccagggccugguccugcacuggaaaugugaacucuuuagucaugagacuaccagcuaggagaugaggcucuucacccuugcccgagugagagcuuagcucuugccaguguguaacacgggagagggagggaaggaagugaguaggcacuaggauaguguguaguuuugacugaagucacuaauuuuucucucuacucuuccauccaauuucacagaaucuuugaaaauuggcuucuuggagacauugaaagaaacuccuggaacauauccuccgcuggcaguaugucccugugaagccuucuuaagcuacuuuccagcaugcuuuuuccccacaguucucccacuaucuaguuuuucagauaucagagagugccaaggucuaaaauaauuuaaaaaaauauagucuuagugguagcaaccagaauggaagaugaccgggacuaaaagggaggucuuuccuucacccccugcucaggacaguggcugcauuucugcaaaggggguucagaugagauuucuauaaaucacauccucuuuuuuuucccccaccaguucuucauuuaugaauuuucuuuuuuugagacagagucuuguacuguugccccagcucgccuccuggguucaaaugauucuccugccucagccucccgaguagcuuggacuacagaugcccgccaccacgcccagcuaauuuuuuguauuuuuaauagagacggggguuucaccauguuggccaggcuguucucgaacuccugaccuugugauccgcccaccuuggccucccaaagugccgggauuacaugaauuuuguuuuuugacagaauuuccauuggcagugauggccaacauuguuuagcuuuggccccucccaugcauccccuuccaagagccaaugauggguaaauaggcacacccuuaaauacccuagauacgcuagaaauucuuucauaagggaucuauccaguaaguucagaauucaucuauuguuauauauggaaacauggcuuuuugugauauacguuccaggagguaaagauggucugacuggugcucugaauaugggcggaggcaucaagucuccugauguugaguucuucaauacuccuuaaccacaccucacuguucuagaaguccucauuugcuucuuuacacucugguccgucgugggacugacuggauuucauacuuuccucguggcucucaaccagacaaccaaugaagacgugagucaacuuucucuucuccucaccacauauucuucuucccaaagccuauccucuugcuaccugcuagagaacuaccgagucuccagggccugggagguugaggcaggcagaaacgugguaugcgagguuguuaagucagauguguggaagagaaaggagagggcuuuguugaaugcuuguggagcauuaggaagaagagguugaaaaguuggguggguauacagccuuuaacuguucacagguccuuaaaggcuagcuggugccucuguuuggcauggagagggacaguugcacuggaugaauccuugcuauauaaaaaguuaccaauuaggcugggugugguggcucacgccuguaaucccagcacuuugggaggcugaggcgggcggaucaccugaagucaagaguucaagaccagccuggccaacauggcaaaacccugucucuacuaaaaauacaaaaauauagccggauguguuagugugcaccuguagucccagcuacucgggaggcugaggcaggagaaucacuugaacccgggagguggagguugcagcgagcaaagaucacgccacugcacuccagccuggacaacagaaugagacucugucuggaaaaaaaaaaaaaaaguuagcaauuaaucuacauucacuguagaaaaucagaaaauacagaugagcaaaaagaaaaaaguaaguuccucuuacuuuacuucuuagacaucaccuuuguuaguaguaugauuuauauauucuagacuugucuagacuuuuuuccauguuuauuuauguguuuauauuauguacuuuuaaauaaaaauaguauauaucauucaguuaucugcuuuuuucacucuauugugaguauuuuucauggcuguguauguauuucuuuuuuguugugauaaaauauacaugauauaaagugugcuauauuaaaugucuuucaacccuggcgaucaauggggugacaguuguugcagccagaucgcccucauauccuaaauguacaguucaguggcaucacauuguugugcaaccauugccaccauccauuuccagaacuuuuuuauuaucccaugcugcauguguuucuucaacauuauuauuauuauuuuucuuuuuugugucuguuuuuaauuuuauuauuauuauuuguucauuuuaacauuauuuuuaaugucagccuugguuuuuaucuugcagaucaaaggaucauggacagggaagaaucgcguccagaaucccuacagccauggcaauauugugaagaacugcugugaagugcuguguggccccuugccccccaggugcucagggcacucaaaaguccugggacuguugggaugagcagcucaaccugauccuguuaccuugucugauguguuuuucugaguguggccucuuggugucaaauaggucuuuccagggcuugccacuugguaccaugucuacauggaccauagaccaugggcugguuguuuuggagggaugaucuuucauucuuaauuucauuuguuuguucccugguuaaugugacauuuccugguuuguggaagaaaaagugaaugggagauaagaggcaugugcuguguucaggcuagauugccaaaggacagguuuauauuuuccagucuaugcagcaaaauuccguaggccagguggguggaggggugaaugcccaguucuuuguuaacucucuuaucuccuucagugugcuggaucgaagggguauuuugccacuggaggaaaguggaagucgaccucccaguacucaagagaccaguagcagccucuugccacagagcccaguaaguguuccugacuuaaggcugggucgauauagagagggcggaggcuaauuuacagcuuggaaauauaauuaggcaauauuguauucuaaucaccccagcuucccugccucuacaccugcccugauguugccuucagaucuuuguguccuugauguagauuaagauuuagucauuucuuugguguauauugagugacucugugccagccacuguacuagcugccaggguuauaccaaugaaugaggcaaacgaugucccugcucucaaggagcucauugucuagugggggcaagaaacaaguaaacaggccauugcucaacauugugaaaagugccuugaugaggaaagcauaaaaugcuauaggggcaaagacagaggucaggggauuguauuagaguuagugaugugguuacugugguagaagggggcuuccuaacuggaauaugcaaaaguuguggaaacucucccagcuguccuauuuaagauauauaaaguauaucuuuaaaguauauaaaguacuuuccuaaaaaaaaauauuacuugagcuuuuuuuuuugagauggaguuuugcucugucacccaggcuggagugcaguggugugaucucggcucauugcaacuccaccucccagguucaagcaauucucugccucagccuccgaguagcugggauuacaggcgcccgccaccaugccuggcuaauuuuuguauuuucacuagagacaggguuucaccauccuggccaggauggucugcaucuccugaccucgugauccucccgccucagccucccaaaguguugggauuacaggcgugagccaccgugcccagcugagcuuucuuuuuuuaauaagaacuuuauugagauaugauucacauaccauaggucccaauuuuuuuuuuuuuuuuuuuugagacggagucucgcucugucacccaggcuggagugcgguggugcaaucucagcucacugcaaccuccgccucccggguucuccugccucagccuccugaguagcugggauuacaggcaugugccaccacgcccagcuaauuuuguauuuuuuaguagagacgggguuucuccauguuggucaggcuggucucgaacuucugaccucagaugaucugcccaccucagccucccaaaguagaggauuacaggcgugagccacugcgcccaacugaucccuauuuaaaauguaugauucacuggucuagaauauucacagaguuguacaaucauuauaacaaucaauuuuagagcauuuucguuacccuuccacccuaagaaacccuguagccauuagcagucacucucccuuuccccugaacuuccccagccacaccccuaggcaaccacuaaucuacuuccuuuuaguacagauuucucucuucuggguauuucauguaaaugaaaucauacaauauguggucuuuugugacuggcuucuuuuacuuagcauguuuucgagguuuguccauguuguacuauguagcaguacuucguuccuuuauauggccaaaugauauuccauuauauggauauaccacauuucauuuauccauucaucaguugauggacauuuggauuguuuccaccauuugauuauuaugagugaugcugcuaugaacauuuguguaccaauuuuugcauggccauauauuuucauuucucuuggcuauauaccugggaguaaaauagcuaggucacaugguagcucuauguuuaaccuuuaagguacugcugaacuguuuuccaaaguggcugcaccauuuuauacccccacuagcagugccugaggguuccaguuucucuacauccucugcaacacuuauuaucugacauuuugagucuagccaucuuagugaaugugaagugguaucucauugugguuuugauuugcauuucccugaugacuaaugaugucgaauaucuuuucaugugcuuauuggccauuuuuaugugcucauuggagaagugucuguucagagcuuuugucuauuuuuuaauuggauuguuugucuuuuuuauuguugaguuguaagaguucuuuauguaaucuguaugcaagucucuuaccagauauacaauuugcaaauauuuucuccuauuccauggguuaucuuuuaauuuucuugauaguguccuuuggagcacaaaauuuuuaaauuuugauguaguccaguuugucuauuuuuuucuuuuguuguuuguacuuuuuggugucauaucugagaaacuguugccuaauccaaagucaugaagauuuaugcccuuguuuucuuguaagagcuguacaguuuuggcucuuacauuuagguuuuugauccauuuugaguuaauuuuuauauauggugugagguagaggguccacauucuuucuuuugccuguagcuauccaguugucucugcaccauuuguugaaaggacuauucuucucccauagacuugucuuggcacccuuguugaaaaucuauaaaugugagaguucauuucuggacuuucaguucuauuguauugcucaauaugucuguucuuaugcuaguaccacgcugucuugauuacuuuagcauuguaguaaguuuugaaaucaggaaaugugaguccuccaacuuuauacuucuuuuucaugauuguuuuggcucuucugggugccuuaaauuuccguaugaaucuuaggaucaacuugucauuuaugaaaagaagccagcuggaauuuugauggggauuucauugaaucuauagaucaauuuggggaaauauugccauccuaacaagauuaaauauucugagccauuuacauggacuguauuuucacauauuuagguaugauuugauuucuuucaacaacauuuuguaguuuucagaguauaaguuuuacacuuuuguuacauuuauucauaaauauuugauuauuuuucauguuauuguaagugaaauuguuuuacuaauuucauuuuuggauuuuucacuuggaguguauugaaagacaauugauuuuuauauauggaucuuauacccuaaaaccuugccaagcuuguucauuaguucuuuuuuguuuguuuuuguuuuuauuuuaugagauggaguuucgcucuguugcccaggcuggagugcggcagcgccaucuuggcucacugcaaccuccaccuccuggguucaagugauucuucugccucagccucccaaguagcugggauuacaggugcccaccaccacaccggcuaauuuuuguguuuuuaguagagaccggguuuugccauguuggccaggcuggucucaaacuccugaccucaagugaucuacccuccucggccucccaaagugcuggaauuauaggcacgagccaccguacucggcccuuguucauuaguucuaauagauuuuuaguaguuugaacuuuguuuuaaaauagaaucauacuuuuuuuuuuuuuuuuuuuuucugagacggagucucgcucugucgcccaggccggacugcggacugcaguggcgcaaucucggcucacugcaagcuccgcuucccggguucacgccauucuccugccucagccucccgaguagcugggacuacaggcgcccgccaccgcgcccggcuaauguuuuguauuuuuaguagagacgggguuucaccuuguuagccaggauggucucgaucuccugaccucaugauccacccgccucggccucccaaagugcugggauuacaggcgugagccaccgcgcccggccagaaucauacuuuuaagugaauucuuuuuauaagguagauaauaguucucuacuuugccuuuccuaaauuuugaauuuccuuuuaaaguacagcaacccguguuuauauauuauuguugucauuuuuaauauuauuuuuuaaaugagucuggacucaaauuguaacaaucuagguuaguuauucuugguucaaaguggagaagggugguauuuuagaaucacuuggggacauuuucaaaccacauaugaccagcugaaaauuuggacacuuggccuucuuugguucagaaucacuauucuaaugagcuguguguucgggcagaaacacgauugaggaccauugggucaggccuuguuacauaaguauguuaugacauuuguucugaaguggggaggaccuguguaauuauuugugauuccuauuauuaugacuauuaauaauaauagaaaaaucuguccccaaccaacaguuaaggaucaaacucaaauaaacuucaguuguguucugccgagaagacgauagcuugguguugguucugaguuugguguugguggcugcauaucuguagcaucagugugaucagggggcugagaggaagaguucagugucuaagguuuaucugcauuuggauuuugaggaacagcuuuguguugaaucucauaucuuuuccuucucaggcccccacagaacaccugaacucaaaugagaugccggaggacagcagcacucccgaagagaugccaccuccagagcccccagagccaccacaggaggcagcugaagcugagaaguagccuaucuauggaagagacuuuuguuuguguuuaauuagggcuaugagagauuucaggugagaaguuaaaccugagacagagagcaaguaagcugucccuuuuaacuguuuuucuuuggucuuuagucacccaguugcacacuggcauuuucuugcugcaagcuuuuuuaaauuucugaacucaaggcaguggcagaagaugucagucaccucugauaacuggaaaaaugggucucuugggcccuggcacugguucuccauggccucagccacaggguccccuuggacccccucucuucccuccagaucccagcccuccugcuuggggucacuggucucauucuggggcuaaaaguuuuugagacuggcucaaauccucccaagcugcugcacgugcugaguccagaggcagucacagagaccucuggccaggggauccuaacuggguucuuggggucuucaggacugaagaggagggagaguggggucagaagauucuccuggccaccaagugccagcauugcccacaaauccuuuuaggaaugggacagguaccuuccacuuguuguauuuauuaguguagcuucuccuuugucucccauccacucugacaccuaagccccacucuuuucccauuagauauauguaaguaguuguaguagagauaauaauugacauuucucguagacuacccagaaacuuuuuuaauaccugugccauucucaauaagaauuuaugagaugccagcggcauagcccuucacacucucugucucaucucuccuccuuucucauuagccccuuuuaauuuguuuuuccuuuugacuccugcucccauuaggagcaggaauggcaguaauaaaagucugcacuuuggucauuucuuuuccucagaggaagccugagugcucacuuaaacacuauccccucagacucccugugugaggccugcagaggcccugaaugcacaaaugggaaaccaaggcacagagaggcucuccucuccucuccucucccccgauguacccucaaaaaaaaaaaaaugcuaaccaguucuuccauuaagccucggcugagugagggaaagcccagcacugcugcccucucggguaacucacccuaaggccucggcccaccucuggcuaugguaaccacacugggggcuuccuccaagccccgcucuuccagcacuuccaccggcagagucccagagccacuucacccugggggugggcuguggcccccagucagcucugcucaggaccugcucuauuucagggaagaagauuuauguauuauauguggcuauauuuccuagagcaccuguguuuuccucuuucuaagccaggguccugucuggaugacuuaugcggugggggaguguaaaccagaacuuuucaucuauuugaaggcgauuaaacugugucuaaugcaaacu

SEQ ID NO: 18972 - RNA, 8452 nt, Homo sapiens
gcuuccuuuuuuaaaauuuggaacuuggggcaaucuucccaagcaggguuuacugcacgaggaacuuaagccacagucccaguuauacaguggaucauuggcaaagcugggaauaggacccaggacgucugcuuccaauaugcuacuuuuuuuuuuuuuuugagacgucuugcccuguugcccaggcuaguaugcaguggcacagucacagcuuccugcagccuugaccuucuggcuccagcaauccucccagcuuagccucccaaguaggugggacuacagauccacaccgccaugccuggaaauuuuuuguuguuguuggagggguggaggugguagagaugaguucucacuauguuguucaggcuggucucgaacuccugggcucaagcuauccugcccccuuggccucccaaagugcuggcauacaggcgugagccaccauauccaacaucucacaugcuacuuuuuuuuuuuuuuuuuuuuugagacggagucucgcucugucaccuaggcuggagugcaguggcacaaucucggcucacugcaaccucugccucccugguucaagugauucuccugccucagccuccugaguagcuggacuacaggcacaugccaccaugcccagcuaauuuuuuguauuuuuaguagagaugggguuucaccguguuagccaggauggucucgaucuccugaccucaugaucugcccgccucggccucccaaagugcugggauuacaggugugagccaccgcaccuggccacaugcuacuuuuaauuaccaaacuccguugccugcuaugauuaguguacugucuaggagauucaauguacagaaucuucuuuuccccguuuguccuuuuuauaaugucuuaugugguaccuagcacuuggugggugcucaacaaaugcuuaccgaccagacaacguacaaaccucauuuucugacaguuuucauucuuuuuucccccagauucuggcagccaggaggugcugucugaauugagaguacuaucucagaaauugaaggaaaaccaucaguccaggaagcaaaaagcaaguucagaggggacuauuccccagguccagagagaggaaccugccccagaagaagaggagccccuguugcuacagagaccagagagaguacagacgcuggaagagcuagaagagcugggaaaagaagaauguuuucaaaauaaggagcuucccagaccuguguuagaagggcagcagucagagaggaccccaaauaaucgcccugaugccccuaaggagaagaaaaagaaggagcaaaugaucgaccuacagaaccuccuaaccacacaaucucccuccgugaagucuuuggcaguucccacaauagaggagcuggugagcagagccaggguggugggccauuguucagaaagugucguucuugcgcaaggaguaaugaagcuuuguuuugcugggggcacauuucaguaguuuagagguccagaauaguauagggccaggcuagucccagugacguuuuaauagaugcagauauaugggugcugccaagaccccuauuuccgaaagccugauccacaaaaacuccucuggggugacucuaaaacugcucucagagguaagagggaguaacucagaguucugaccagaucccaggcaggacaacuugaaggugagucauugaacuguugcgaaaguuuuauucagugggaucucagauggucuaagacuccccaguuaaucugaaacuuaaagugaagcguccuggcaccugucuuuucagggauauaagcuggaggaagccuacagucuggccacuuagagcuccugcugcuaacacgggccauuccuuccuccacccugcagcuuccuuacugaaaaguuuaaaauugugucauaugauaaugagcuagggauauuuacccuagagggaagaaaauuugagcaugauuggcugugcacugguuuguaucgcaagaccaucauuguucagcacuucccccuagggggcgcuaaaaugucacgacccgaaauucaagcguucucgccaugaaccacagcucauaagccaagcuguagcucucgcuuguuucuucccaggaagaugaagaggagagaaaccauaggcagaugauaaaggaagcuuuugcuggggaugaugucaucagagauuucuugaaagagaagagggaagcuguggaggcgaguaagccaaaggacguggaccugacacuaccuggcuggggcgagugggguggugugggccuaaagcccagugccaagaaaagacgccgguaagaaugccgaagaaagucugucaaaagggcaccggguucuccccucgcccuucgguguccucccuacccuuuugacuaaguccuuaaugcuccuagucagauguccuguuguuuugcuuuccagguuucucauuaaagccccugaggguccuccaagaaaagauaagaauuugccaaaugugauuaucaaugagaagcgcaacauccacgcagcugcucaucaggugagagcuuagagagcucuuuagcugccugcuuguuacugccuggcucucuugcuugagaggaguauucuagugaucuguagucaagagagacgugugaucuugaccgcagaaucaaaucuguuguuuucacugaauggcuguuagauuuaucauuucagauagacuacgcuguuuuaauuacuggccaggaaaaaaguuuagagucaagguaaugcucaaacagaggcuauaagguuuaagcuguagcuuaagaaaaaugaagacaaaccgguacuuguucaggagaaugagaagauuguaaguugugucacaugauaaugagcuagggauguuuacaagagaagaaaauuugagcgugauuacgguguucaaguauaucgaagguuauuguaugaagucacauaaaguagaaguuagaggacauacagaauucaaggcugcucugggaguaugagaauguguaaaggggacucaagaacgagauuggacuagaugaccuuuauguucccuucaauucugagaucuguccccagccaguauauugaaaugaguuacauuuuucccucggaaggaauaaagaauuaauggcuacagaacagagguaagaagauacacauuucaauaacauucuuuuugaucuuauuuugugaaccaaucacugcagaaacugaaucauaacuacugcagucccaauuaaaccuauauaacuagaaaauaggcaguuacacgauaagggaaggggggaaagggugcuucagugggccaggauuccaggugauggguagaguauggagcucaauaaagaccacccuucccuuccaggggucuguuuguuuuuuuaauacagucauggcaaacugacaaauaguuuucuaggaaucuccccugauuuucaucuuuuuaauaaguuacugcagguuccaacaugcaguagaauaaagugcuucaaggugccuaggggggacuucugagacugaauacuuuguccagguguucucuuuuucuguugcccugguugacaagcacagauguagccgucaacccaaauaagacauucccuuaacuuaaagagaaucuguuuccuuugcuacuaccaggaccaccugauaguacuuagcuucucuugaguauuccacugaauguuuccagagacuacugauuuuuguuuguuuguuuuguuuucagauggagucucacucugucacccaggcuggaaugcaguggcacgaucccagcucacugcaaccuccaccucccaaguucaagcuauucucgugucucagccuccugaguagcugggauuacaggcaugcgccaccacacccagcuuauuuuuguauuauuagcagagacaggguuucaccauguuggccaggcuggucuugaacuccugaccucaagugaucugccugccucggucucccaaagugcugggauuacaggugugagccaccguacccugccaaagacuacugauuuuuacauccccauuuucugcuuacguguuuuccuccuuuggccacuggggaaguguugaaagauuauuuaaugucugaagguagcaaugugguggaggaguaccaggcaaggaaacaggagcuuuggguucuguucuccaaugcugcuccucauuuacuuagguccaucacuuccccccucuaagccaaaucuucaggccaagggagaugaccauugucaauaucuagggccuuccagcucuacauucuguggugccaaaagaagaugaagcuaagugggccgggcauggugguucacaccuguaaucccagcacuuugggaggccaaggcggguggaucacaaggucaggagaucgagaccauccuaacacagugaaaccccaucucuacuaaaaaaaaaaauacaaaaaaaaauuagccaggcaugguggcaggccccuguagucccagcuacuagggaggcugaggcaggagaauggugugaaccugggaggcggagcuugcagugagccgagaucacgccacugcacuccagccugggagacagagcgagacuccaucucaaaaaaaaaaaaaaaaaaaaaaaaaagaugaaacuaaguguaacggccugguagaguucaggauucggguuccuuaaaacaucaauccuggccaggcgcgguggcucacgccuguaaucccagcacuuugggaggcugaggcggguggaucacgaggucaggagaucaagacauccuggcuaacacggugaaaccccgucucuacuaaaaauacaaaaaauuagccgggcgugguggugggcaccuguagucccagcuacucgggaggcugaggcaggagaauggcgugaacccaggaggcagagcuugcagugagcggagaucgugccacugcacuccagccugggcgacagagcgagacuccgucucaaaaaacaaaaaaaaaauaucaauccuaagagagggaaggaggagacugaaagcauaaagaggguagaaaagucauaaaauccacagggauacacaauggucuggauucuugcagucacaguguuacauaggaaagcucacucugggacaacagcccuggagcuccuguagcuagauagggacagugucacuuguaaucccagcuacuugguaggcagagguugcagugagcagagaucaccccacugcacuccagccugggccacagagugagacucugucucaaaaaaaagaaaaacaaagaugggcagugucagggugguuuuucagacccugaauuguugaauagaugggggauccagagccaacucaggccccccuacucccaaaugucaucaaacagauugaauuccuaagggcagaugggagcaaugggacgccuugaccucucagucucuucacuugcagucaucauguggaaccguggccuguaccaaaacaguaccugaugaaagcugccauuacaguauacaacugcaccccaggccugccucauaccaaaucauucuccuuccuuuccagguacgagugcuuccauauccauuuacccaccauuggcaauuugaaaggaccauccagacccccauaggauccacauggaacacccagagggcuuuccaaaagcugacuacucccaaggucgucaccaagccaggccauaucauuaaccccauaaaagcagaagacgugggcuaccggucuuccucaaggucggaccugucugucauacagaggaauccaaaacgaaucaccacacgucacaaaaaacagcugaagaaaugcucuguagauugaguugcuggaggagugacagccaggagcccugacuucacuuccuuugguccaguuuuacucugauacaggguggauuccaaaacuggcucaguacauugcauguaguuaagccacauuuuaaaaauaaaggcauuuuuuaaucuauuuaccuggaguauauguugcauugucccccagugggaucauuucguucaagucagacaccuuuggacucuacagcauugcauuucucgaguugcacuugucagggccaccuccuuuucuuaccaaggauuauguaguugguccuaaaucgaaauggagaaaguuaacuguagucuguaaccuuaaauauaucacaucagauaugauccaccauuaauaacugccaacuugaagagacaggguuaauaaugauaaaauauuguauauuuuaaccucugaaccuagaaagaggauguacaaacugcaauuggauucugcccuagacugauccuaagaccaggacggugccgaagcuggguucuguccccacaagucuagccacagccauuuuuuucacaugugugagcuucccagcuuguacaggcugcugucuacaauaucucauauauaaccuucuacuuauuuucucauaagaagaccaggagguuugacccuuauuuuguagauaaagguagaugugauuucagaaguaaaccucuauugccuuuccuuccuaacucagggcccacuccucaccauugauugaaaguguaguuuauucaagcauugcuuugcuauaugacaguucacaugggcuucucagcucugaggaacuuggccuggcuuuggauggcaagaaauauacggaaagagccccugcagcugaguuuccuaacaaggaauuugggaaaccccucugauuccaaaaugacaccacuacugcaccuugccuccuaccuuggagauucaguccuauccccaguauucuuagaccacaguggguucauuuuugugucacaggccccucuaaaaauauguugaacguuaugaaccgucuccagaaaaaugugcacacacacacauuuguauggcauuuuacauacaguuucagggguuuucaagacauuuggaaucccugggccaaaagcuguaccacuccaaguuuucuuuugcaauccccccaacagauacggccuucugagcacaccacucuccaaaucaguuccaaaacguuuagaccucaaugguagcuagucccaguuaucuuuauaagagaaaauuuucagaauagagcgugcaucuaguguuacacauuaaacugaagugaaaagccaaaggauaaauuuauaugaauuccccagugggguccccuguggcccccuacuauugcucauccucuuaagaaacaaccugggacugggaagguaagggaaaugaguauguugagcaguguucagugcccaaaaggcaugcuuaaguauccauuggcuugagauuauccacgauccacucgcugguugacacuuaagucaguagccagugguaggggaugcgggagcccugcccacuccugccuccguuuaagagaccacaacauucucuugcacucuuuugagcacaaagcugcuaccuccgucccacccaccccccaaauugaggcgcccaaucaaguguccccgguaaauggccaauccccgucuacuuuccccggacccucuucagcuccguuugcuccccacuacccaggagugaugcaagccaccccauccuucaaaggagaaggcaggugccagagcgugcuauaaacgacgcccauucccagccuuccaagcccccaaacagauucgauuguuguuucguggggcuuuuuuuucuuuucuuccuccgaaccuccgaaguguucucccuucccauuggccgaagcugccccuugacgccacccuggccuugcucgcugauugguccacucuggaugugcccaagccuuuuucccaggguguggcgcccccccgcccccaacaggguucugaccccuggcuccucccuuccccccaagccccccucucuguuccgaaugguuccgcccuggcucggcucccccacggcccaggccgcugcccuuagggcccccggacggggcggggcacgcuggggacgggcagagggcggugguggcgccuuccugccgaguccgaggccgcccccgccacccuucucuaauccuuguaggucccacuuuccccugggcaguucuccuccugcaucgguagccccgucccgucugugcagcccccaccguggucuuugggucaucucgaagagcugcguuaaaucccugcccucagcgcugcacacacgcccauccgccuccacccucggguccccgcaccacccccuuuucccgugucggcucccccuuccccucccgagaccgcggaagcuccgacccccuucccucgcugacuguccauccccaggacccccgucccuguguguggccagucccagcggccucuccuucgcggccucccuucgccuucguggccagcgugguggagcacucccgccccccuuuucuccguacccccgcgcucccuuauguugucccuucuugucccucucuaagucccucccacacuaugcccccccgcgguacacacacaccccuccccgcgaggcgucccccggcgccccucc

SEQ ID NO: 18973 - RNA, 77795 nt, Homo sapiens
ccugagcccagcagccugaucccagcaccccccgccaccucccuccucccgcuucgcccgcuuccccggcggcguggagaagagcaaaguugcgacagcggccgggggcucugcccagguaaagggggcgccgugaggcggggguggugggggaacggugcggcccugcggcgggggcggggggaggauaaagaaacuugcuucccgcggcccccaccccgcguggguuccgaucuugcguggaacgagcccgcguggcgagucgcggcaacacugccgggaccgaggccggcaccuggacccggacccggaccgcgcgcuugggccggcucggcgggcgcaggcagcgggccaggccagcacccaggcaagggcgggguggguggccguacaccggaccgaaucggggacuccgguggcgugggcgcgggccgaaccccgaccgggccgaguuggguggcgaaguaggacguggauucgggggcggggcgcggcgggagggggaaaccaggccuggccagacuggccugggcgugggggcggggggcgaguucggggcacuugcugggcucuggaccgagcgguagggcggggcggcgcuaggggcugggccggacccgcagggagagggcgaggggagggagagccggggguggaguaggggcguggaguugugagcggggucuggccucggccgggggcgaagguagaucggcggggccgcgagcggagggagggaggcccgcggcggcgcggcggcagcgaaggccagcuuccgcggaguuugugcccgggcuucccgggcucuggccgccucacgcgcacaaauggggcuaggggacugagugguaagcaacuccgaguguuagacggugaucgggcggcgauuccgggaaaagcgaggaaagacacagucugcgauugugccgcaccccccacccaccucuuagcaucuggauucugcucucguagugggggccgcggacccuccccgccacaguccuuuuacucuccagcacucccaccgccuucccccuucuucagccaucugacucuccuagggguauguguuuuuggggguggacggcgacgggggugggggauacuuuccuucccguggcggcaaccuaguucguaucuuauuccuacaagguagcgucgcuucgagucgcauggacauugggguuuagauaauuuaccccccacccaagcgauuuaauggcuuuuaagcaaaaggcgaauaccuggauuuccaugggagggaugagguuugaagauugggauucaccccuagcucacuuccacuaccaaccccucuuucuugugagccacuuccacggguauucaaaucugggggggaggggggacgggaguauuaauaugcuucucuauuucuacacagggucggcguggcgaaggacggcuagccuuggagggaaaguagccaccaguccaacucgggucgcccccaccauuauuucggugagggggcaacgcuaagaaggggauacugguggguaggggcccaguauaagggagggggcuggguagucguccccagaaggacuccgugucuuggcggggagagagagaggcgagccccggcuucaggggagggguuccggggagggagauggggggguggcgacgacggugggggggggagcgggaagaagggggagucacgcccugccugcaaggggagccucccucaggccccugggagaaggggacugaaugcgucuguucuccgcugcccggcagaggagaucuggggucucgagauuugcacacuggaucggcaccaguggccugagaaagucaggucggggcauaagguggagaacguuggaagaaagagagagaacccuuuggccgcggcucacugacccucucccuuccucaaccucccccuucgaggggcgucgagguggggggggacguggggcuccugcagccccgcagauugagcgccuccgccucucccaggagucuagcuuuuugcccggcuugcugcagccacugcugccucccucuccggaauccgcucgguccucucagcgauccccuccuccucuccuccccucccagugucaccggggcugcuuggcucugcccccuucgccgccgcuugcucccugcuuucgucccucccucucuugcucgcucccucccuucgccuccuccuccccauucccccccacccgcguaggccgcauucugggaguuguaguccgguggagcggggguuggcgccgcccgcggacccagccggacuccacuucccgucgagcccugcgaccggcacccacuccaccaggcuucgcucgcacacagacacacacacacaccgcucucccccucacucuuucgcucgccgcggcugcugccaguguguggcucugucucuccuccgcuuugcugagcccucccuucuuccucucaguuccuagaguccgaccgccgccgccgccgagagagaggagaaggaggucgguggcgauaaggggcggaggggggcaucagaucggggcaguauuaggcggguggcgguuaagagggaguaagagggagcccggguggcggccugagccuccccgcggagccgacccgggaacaggugcgucuuuuuucucucucccccaaucccuccaccccuuuugacuccccggcuuuuucguauccccccacccgcuucuuucuaucuuaagccuuucuccaacccuguuccuucuuuucccugcggccgcucggcuugccccccgggggcgccguccucuucguguccccggacguagcgcucccuggagcuggguaugucuucgccccucccuucgggacagcucccuuccacuucccaccuucguaccccauccccugacuugcccuacccccuucucgacccccuucucucuuagccaggugagacucguucgccacgauccaagagagucuucuucccggcugggcgggggucuccauggaaacgggggucgguugauccugggggggaaaccauaggaauuaccccacuccucggaaagggagguggaggcuauggucuuguuaacuaccugacuccaacccccgauccaaggauccgacgauccgaagggaggcuggcuagcagggcagggcgagaaaaggcuuuuuuuugggggggggggguguccgugaugaaguguugaagagaccgggagaaaaugcccuccaaccucagaggggaggugcgacgggugcucuucagggcugcuuucuucccggcgcuggggugcgggaaucguaggguaagggguaccccuagguggcggcggggccuggguucgggagugggagugcugugaugggggcaggggcaauuauccgagucccuggaaaaaaggcgggggaugacuucggagcgcccuggcuccgcugcccucgcucuaggggcgggggccgccgggccgggcgcggcggggagggggcuuaaauugaaggaagaugagaucgggggcaauucauacuagcaccggcaagccagaggggagauccggcgugcaagcccuccacccgcuucgcgccaggccuggaggcaaggggucggcgagcgaagccgagggcuggaaggagggaggcuccgguuacggggccggguuucgggaucaggggcaaucccccggcccuuggagaaggagggagagggauggccgcgaaccccagggcucccccaccccggguccuaaggggcgugagggacggacagcaggcccagcggagcuggauucgagcggaucgcggccggggagugggagggcuuaguggugggcuucggggggagcaguccggcggcggggcgggcgggcggggcguggggcuccggcgggcggcggggcggggccgggggcggcgcugcugccgccgccgcugccgccgccgccgcugcugcuccugcuggggccgccgcagccguugccgccgccgccgccgccgcuucugggcggggaacggaggccaaagagagucccgugccggggcagagggcgcaggcggcgcgcgguggggagggggccguccugggggcgggggcaggcggggggguggagcccccgacggggggcgguacgagccgggacgacgacgacgaggagccccgggggccgggugcauggaggacgaggugcugggagaaggaaggggggugugggucccgcgacuggccucgugggcuuggcuccucgagguucgguuucgggacagagcccugcaggggcgccaagaggccggggaagggauagggaggugaacuggucgguggagggggcccuccucgccggggucccgccgagaggaaggcugggccagagggacguccggggcaaggcugggaggagccggccgcaccucggcuggggauuucgcguuauggaggugcgggagauuguuguagggaaagacguggucgaggggaaaggugggagggaaacacugcaaacccgggaggccaacagcacaggcccgugggggugcccuucuauuccgcucgcaccuccucccucccugaguggaagcacuauguuuuuguuuuauuguuuugaaauuuucaauguuggcugaucgaaacugucgauggggugauauucauucuuggugucuccuggaguagacaguaaagacaggcauccuuuggcgagcaagcaucuagcccaggguuuagaggcucuuuacguuagugugggaagggggcccgguaacuuugugccacagcuugacuacuguuaaggcaguuuggaggucgucccugugguacagagguggaguacaauugcaaaaaucuucaguaagacuucuggagaugaguuguagguuagcguuacagugguuagcccugugguucuuucaacuuagaaggcucuuucucaaaagcacgccguugaguuacaugggaaaauaaauguggauugcauuugggguugggaguggauuagguugauuauaaaauuucaagguuggaagggaguuuuaagguuauuuacuuuucuguugauauguccuguccuugaauguuggaauugagggagcuuuauuuuggggaagaugguagauggcacaguggaggaugucuggugcacaguuuaggguacuuuaauugaauggugaugucaccaugugguacuaaagaugacaguauguaggagagaaauuugggggauuccacuggggauuaaaugggauaaccuaauuuuaagaaucaucccggggcuccaaauagaagcaaaaggcuggggaggagccuguaaaauuucgauggaggcgaaaaguuaguagcaaagauugagguagcugggaagagcaaggggcuuggugagucaaguuaagagaaucugaagguugauaguagaguuuagggauguggccaucuugacuaagucaugaggauguuguuaggcggacaucuuuugacagggcaacuuaggcaacugcccuuggggcagaugugagggaugaaagguacaggccuuggggcacagauccugacuaaaauugaccuuaagagggcugauccugauaccagcuuugcaacaagggugguuagguuucuuuucuuuucuuuuuuuuuuuuagauggagucucagucgcccaggcuggagugcagugcuacaaucucagcucacuguaaccuccgccuccuggguuccggugauucuccugccuuacccuccagaguagcugggacugcaggugcccgccaccacgccuggcuaauuuuuuguauuuuuaguagagacaggguuucgccauguuggccaggcuggucuugaacuccugaccucaggugauccauccggcccaguuuauuuuuguccuggcuguaagucauugaugaggaaggagagggguuucaccucucccuugucugaguucaggaggauuuuuaaaaaauuuuuuuagaauaggccaauaaggaagggacagcaaauuuuuagaaaaggccaauaaggaagggacagcaaaacaaaucguuggcauagggcagagaaaagcuaaggcccuggcaagcucugcugcuggagucugcauagggcagaguggagggaguuccacaagacaugauggcugcaccaaaaacacucaugugggucuggcuauuuugauuugccaggaaagcguagauaaagagggaggaucccuuucucagugacauagacauucuugggaagaaaagagggguccuccacagggcucugcuucauuuaugaugcaguucaugaaauagaaaaaaaugggccgggugcaguggcucacuccuguaaccccagcaguuugggaggccaaggcaggcagaucacuugaggucaggaguucaagaccagccuggccaacauggugaaaccccguuucuacuaaaaucacaaaaauuagccaggugugguggggcgugccuguaauccuagcuacuugggagguggaggcacaagaauugcuugaaccugggagguggagguugcagugugccaagaucgugccacugcacuccagccugggcaacagagcgagaguccaucucaaaaacaaaaacaaaaaaacaaaaaaacaaaaaaagaaaaaagaaaaaaauguucaguacagggaguggaggaucucaggacacuauugguuggauuauggguuguagggaagggcuucuuugagagaaacagaauuaugggaaaaaaggacuuggacacuagagggaaggaaggcaagaaagagaagucaggaagagggcugguugagcaaugaaaggaaaagaaaggugaucaucacuggucccauguaagggccagcuaaggaaaaagucaaaccuugaaaucucuaggacaauguuuuccaaaguaaacuuugaagaacucuuaaagcucuuuacaauuucaugcuggaaucacuaagguuggggcaagagagaaggaauauaugggguaaaaguagggugggggagaaacuggcauuuagagagaaauacaagcauauuuauccauaaggaaauagggaacuuagagauuauauacagguuaaaaugcagaaugugagagaaaaagagaggaauuaagagccaaaggaggaagauauuuacucagauaucuuuuggagccgguguuagggagcggaaaaucuugccuuugauagccacugcccugagagggcccaggaagcagagguuagcugggauccaggccuuacacaucuaaacauuaauuagaaaaucuagacuaaaguaaggauacugaauggggggagggauucacuguccuaaauagaguggccuugaaagaaggaaaaagugggaauccaccaguguuuccagucugcaggugggaaggauccuagguaucaggagaugagugauggaaauuccagggugaaacuggauaaaaaacugagugacaugagagccugugggccagaauuggagggugggguuaggggcauggaagagaggcucuaaucagggcuuggacuggaggccacauggaguaauucauugauucugggcugagcuaagcuugggaugaaauagaacagccaaagagaguagagagcuguucuucagggccaaucagcaucagaaucagagugaagaaauucgaggucaaguuugggugggaaagugaacaccggaguggaacagagagggugcuggagaaagugacacaauuguugggguagaauaggaaaagguagaagccacugaugauuacauaacccagagggaagacccuaggccuuugaguuuucaaagagaagggaaguuucuuaaugcuggaguuugaauuaggugugaguccaugguugccagaguguuuagugucaggauggccaaagagggagguaauaucuacuuuucggccacuaggaugcuaguacaguauuugauauaauuuuacauaugaacuaggcuuuauuaaugcccauuuuugaaugguuauccuuaaaauaauguagaaaugguucuuuuucuaaauuaaaucauucccuuucccacuguucauaacuuaaaagcaaucuuuuaugaugagaacuuucuuuggcgaacugaaguuucauucuggucaagaguaaaauuuaacucuguguuucuauccccguaauucaaauaugcuguucuaguuuucuuuuuuauucuaagcagaagugaccuuuuccccauaaaacauaaaaaaggaucuuuuuuuuaaaaaaaaaaaguaacugaguaacugcaggcugcaugucaaggucauauuuucccuggucaaugaauuaugaugaauuugaauacagcugauauauuauuuguaaaaugugguaauuuucagauuuacucaucacaguaugugaggcaggauaccucuucauuuguauuuuaagaaaaccuuaagcugaagguccgugaggaauccagaguaccaaggagcagggaaagcuuuguguuuugggcuucuuuaccgugggucugcugagaaacaaaauuugguuaccucauuacuaagguaugccuagaaaucauaguguuagugccauuuaaggguacuguugaguuuuguuauaaugcugauguccagggacaaggagaacaagcagauuuuugcuuuuccaaguuuuguggagaagugcaccguauaugacuaugaucgcagaggugaguugaugcacuguauaccugaauccaugagaugauuaucuucugauaaugaggcuuuacucaguuuaacuugguuguaccacaccccaguuaguauaguacagugguucucaaacuugagcuccucagaauugccugggggggcuuuggagaccgacaaccucagguuagagugcuugcuguucuacuucuuagcuauguggcaggaggcaagucacuuaacuuacuuucguucuuuuuuuugacagagucucacucugucacccaggcuggaguguaguggcaugaucucggcucacugcaagcuccgcugcccggguucaagccauucuccugccucagccucgcaaguagcugggacuacaggcgcccgccaccaugcccggcuaauuuuuuuuuuuuuuuuuuuuuuuuuaguagagacgggguuucaccguguuagccaggauggucucaaucuccugagcuugugaucugcccaucuuggccucccaaagugcugggauuacaggcgugagccaccgcacccgucuuuuuuuuuuuuuuuuuuuuuuuuuuuuuuuuuuuuuaaccggagacagucuagcucuguugcccaggcuggaguacaguggugugaucucggcucacugcaaccuccgucuccuggguucaagcuauucucccaccucagccuccugaguagcugggauuaaacgugcccaccaccaugccuggcuaacuucuguauuuuuaguagagacgggguuucaccauguugaccaggcuggucuugaacuccugaccugaagugaucugcccaccucaaccucccaacauguugggauuacaggcaugagccaccgugccaggucuucacuuaacucucuuuguuucuuuuuuuuuuguuuuuagacagagucuugcucugucacccaggcugaagugcaguggugcuaucuuggcucacugcaaccuccaccucccggcuucaagcgauucucgugccucagccucucgaguagcugggauuacaagcgcccagcaccacguccagcuaauuuuuguauuuuuaguagagaugggguuuugccauguuggccaggcuggucucgaacuccugaccucaggugauccuuccaccucagccucccaaagugcugggauuacaggcaugggccaccaugcccggcccacuuaacuuuguugagccucaguuuucucaucuauacaauggagaugauaauaccaauuucacagggcugugaggauuacacaaaaucaucccaggcccauaguaggugcucaauaaaugggaccuauuauuuuauauauauauuuuuuucuuuuucuuuuuugagauggagucucgcucuuuugcccaggcuggagugcaguggcgcuaucucggcucacugcaagcucugccuccuggauucacgccauccuccugccucagccuccugaguagcugggacuacaggcgcccaccaccgugcccggcuaauuuuuuguauuuuuaguagagacgggguuucacuguguuagccaggauggucucaaucuccucaccucgugauccgcccgccuuggccucccaaagugcugggauuacaggcaugagccacugugcccggcccuauuauuauauuauuaucuaauuuuucuuguucaauuguauccuauuauguuauaguaaacaugguggcagcaugaaaacuaucaacagcuucucagugguccccuuauaucuugauucucuguccucuuucuucauauuccuguuguauuaguacacauuuggcauuuacaacaugcuaggaagaaagcuugacucaucacugcaucuaccuuugagguggaaguggcggcuucuuuaacagcuaugcuguaacacugcucaauaguucaggacaggaacugaggaguguauauccaguugaaacucuagggaacauuucgggccaugggugacauuuuuaaaaaccauugcuuucugaaaagggcuguuguguuuauuuaauuaauuaauuuauuuguuuauuuauugauugauuuauuugaaaccgagccucacucuguugcccagguuagagugcaguggcgugaucucggcuuacugcaaccuccgccuccuggguucaagcgauucuucugccucagccucccguguagcugggacuauaggugugagccaccaugccuggcuaauuuuuguauuuauauuauuuauuuauuuuuugagauagaguuucguucuuguugcccaggcuggagugcagugaugcaaucuuggcucacugcaaccuccuucuccuuguuucaagugauucuccugccucagccuucugaguagcugggauuauaggcacccaccaccacgccuggcugauuuuuguauuuuuucuaguagagaugggguuuugccauguuggccuggcuggucucgaacuccugaccucaagugauccggcugccuuggccucccaaaguguugggauuacaggugugagccacugcgccuagucuauuuauuuauuuuugagacagggucuggcucuguugccucagccuccugaguagcugggacaggccaccaugcccggacaauuguuuuuauuuuuauuuuuaguagaggcagggucucccuguguugcccaggcuguucuuaaacuccugagcuccagcauuccuccugucuuaacuucccaaagugcugggauuacaggugugagccacugugcccggcagaaaauauucuuuuuuuuuuuuuuuuuuuuuuuugagacagagucuugcucugcugcccaggcuggagugcaguggugcgaucucggcucacugcaaccuccaucucccggguucaagcaauucuccugccucagccuccugaguagcugggauugcaggcgcccgccaccaugcccagcuaauuuuuuuuuuuuuguauuuuuaguagagacgggguuucaccauguuggucagguuggucucgaaccccugaccucgugauccauccaccucggccucccaaagugcugggauuacaggcgugagccaccgugccuggcgcuuuuuauuuuuauuuuuguuucugagauggagucuugcucuauugcccacgcugaaguagaguggugcaaacucagcucacugcagcuucgaccucccgagcucaagugaucuucccacuucauccucccaaguagcuaggaccacaggcccauaccaccaggcacagcugauuuuuaaaauaauuuuugggccaggcacagucgucacgccuauaaucccaccacuuugggaggccgaggcuagcagaucacuugagccuaggaguucaagaccagccugggcaauguagcgagacccugucucuacaaaauaauacaaaaauuaccugggcuugguggcgccaggugugguggcaugugucuauagucccagcuacuugggaagcugaggugggagggccacuugagcccgggagugccgcuacagugagcugugauugugccagugcacuucagcccaggugacagaguugagacccagucuuaaaauaacaacaacaaacucuuugagcuaauacuguuuaaugaaagcuguauagauacaccuuugaaugaauaauauauauaaaauuaguugaacccauagcugagucuguucuguugugagaaaauagaaagaauaaccugauaauggucucuccaaauauuuguguuauguaguccaggagacuuuuauaaaagcaaaaguugggugaggaagaauugucuuuuuuaaaaccauauauauauauuuagagaccggguuaugagacuggcuaauuuuuguauuuuuuguagagacgggguuucaccauguugccaaggcuggucuggaacuccugggcuuaagugaucugucugccucggccucucaguguugggauuacaggugugagccagugcgcccagcuaggaauugucuuuaggugaaaaauugcguaucaugaauauaguauacugaaauggagacaccagagggccacugucacagucuauggcaggcaggacccagaagcaucucaaaagggauucagaaugucucauauuacaaugauucaaguuuagagugugaaaaacacacuaaauauuuauaugguccugcugaagaccaagauugagggaagccaauuuguguuuuuguucuagcggaaauuagaaguacucaaaaaaugacccuagauauuuagggugacauuuugagguugcuuugccuuuugaaaggacugauuaauuucacaaugaucacuuaaguuuugcgugacaucuagaaguuguauaaaaucuuguagcuagagccgagguuuauuauaaagcuaugaugagguguuuuuguuaaauggaguaaaguaauuuucuuacagcaggaaauggaagugaguacuguuugaauaauaagaaaaaaguaucauagcaauggguagaaagcaaaaagaaucuggcgguaugaaaauguaagugaggccaggcacgcuggcucacgccuauaaucucagcacuuugggaggcaaaggcaggaggacugcuugaggccaggaguuugagaccagccuaggcaacauagggagacccugacuguacugaaaaaaauuuuaaauuagccagguaugguggugcacaccuguggucccagcugcuugagaggcugagguaggaggauugcuugagccugggaggucaagguugcagugagcuaugaucaugcgauuguacuccagccuggguuacagagcaagacccgucucaaagaaagaaauaaaauguaagcaaaagauuaaagcuuuugcauuugacuacuucauucuuggaauagauuacguaugguccuuuuuuuuauuuuuuaauuuuuauuuuauuuauuuauuuuuuugagauagagucuugcuuuuguagcucagguuggugugcaauggcacaaucucagcucugaccccccagguccaagcgauucugcugccucagccucccgaguagcugggauuacagaugcccccccaccaugcccagcuaauuuuuuguguuuuuaguggagacaggguuucaccauguuggccaggcuggucuugaacuccugaccucaggugaucgccugccuuggcuucccaaagugcugggauuacaggcgugagccaccauguccggccagucuaugguccuuuucuaagugcuuucauguuauuccaaauuuuuaguagggacuaguaguuuauucccauuuugcaggugacaugguaaauggacauagagagauagucugagauggcugagaaguggggacugggaguguucuccaaguuuucccaccgcaguguaggcuaugggugcuagaguauaucacuuuucaaggcauuacuugauuagaugguucuguuuaauauugcugcuguuugaguagauuguucugaauggauuuuggauguuccuaaacaucagaucgacccugaaaggauggguuccagcacuaaugaggagagugaaaaggacguaguauuggucuggaugcuaacgcucacagaggaacuccagggagauugcaagcccuggccgcucggcugagaugacuguccagccuccugaggcgacuacuuugggguaacuacauucauuugaaugauaaacgcucauguguuuaacagcaguuaacauuccuuuguauccagucucauaaauguuuauagguaagguuuuagacauggaaguacccaaagagucuaugaagggguccaugcuagaccuauaugccggcaacuaccuagccuucccacuaaauaccagaauuaauguaucugggcaaaagauacaauaugccuuauaagacugaucccuugggguagauaucaguggaaauauuuggauaggaaaaaaaaaauccaggggaaguagaaaguguuagaauagauuuuuagucaggcagaaguuugggaugaacagcagaaagggcuguucuuucuccuuuaaauugccuggcagauuauuucuaguugauuuugugugugcaguaguagaggaaccaacuuggcaugaagagaagcaaaguaaaguguuugggggcaugucuaugggacuucuuuuuuuuuuuuccaagacagagucucgcucuguugcucaggcuagacugcaguggcaugaucuuggcucacugcaacuucugccucccagguucaagcgauucuccugccucggccuccugaguagcugggauuacaggugcccaccacuaggccugacuaauuuuuguauuuuuaguagagaugggguuucaccauguggaccaggauggucucgaacuccugaccucaaguuauccaccuaccuuggccucccaaagugcugggauuacaggcaugagccaccacgucuggccucucuaugggacucuugaguuucagggaauauuugguuaaugguagggaaagaugagggaauauagauauuggggguaaagauugaggagaauuuucgaauacccuuauauguauuagaucauuaaauaaguuuauuuuuauuuuuauuuuuugacacggagucuagcucugucacccaggcuggaguguaguggccucaucuuggcucacugcaaccuuugccucccagguucaagugauuccccugccucagccucccgaguagcugggauuacaggcgcacaccaccaugcccagcuaauuuuguauuuuuaguagagaugggguuucggcauguuggccaggcuggucuugaacuccagaccucuagugauccaccugccucugccucucaaaaugcugggauuacaggccugagccacuacacccggccagaacgguuuaaauugggguaacuuccucauugggggcagggguugugguauguaaugaaguagggaaaacaggaauguuagucuccuaacacauucuguugaauacacauggaagaaggcagaguaaucaggagggcaagcucuguaguaggaguuccacaucuaaagccggguaaaguuguccuugcuggguguguguacauuuuccuauggaaaacaaugagcagauuugccuucacucuaaaagacuucugggcagaagucauggccuuuucccuuuagcccugagaucucagugucaguggucucuuagaucuccucaggggugucuuagaugcuguuuuuucccaaguggaaugaugagguggccucuccuuuugcugcuguaaaguuugccucugucuuaugggagcuuuaccaagagcucugggucucuauuggaggaguaggucccaaaguugguuuuccuuacuuauuagucaucacugacccagcccuccuccuuaaacugucugcuggccacgccuauccucuagaggacagauucagggccaggcuucaagaugaauauuuuccggcucuuucauuuuuuaaagucauaauugcuuccaggucaccaggcaguaugaaccaaaaggagccugggggagcaggacuacauuucguuuaacugagagcuucuuaagcuuggguuucuaguuuacugucuugaugguagaguccaagcaugaauaaauggguagguuucaugcuauguguagaagaccgaguuguguuccauaaguugaguguucugcacuuaaggggucuucagccacaaagggaacuacaugauccugaaguacuugucagcugcaugaacauccugaucauuuucuuuuauuuauuuauuuuuugagacaggaucucucuuugucacccaggcuagaguacgguggcgugaucuuagcucacugugggcuugacauccugggcucgaaggaucccuucugccacagccuccugaguagcugggaccacaggugugcaccaucacacccagcuauuuuuuuauuuuuuauagagacgaggucucacuauguugcccaggcuggucucaaacuccugggcucaagcaguccuccugccucagccuccuaaagugcugggguuauggacaugagcccaugccuggccugguccuuuuuaagguuaaaaaccucguaaacagugccuaccucagucaaaaacauuugucagauagaugcuuucucuguuaccuccuuuaauguccuucucuuccucauaugcaugaugacaaccaugcuuuugcuuguaauuguugugaaaucugcauguuuuggcaucuucauuucaaaacgaaacaaaaaaauccuaucccaccuguaaaaucuccuuugagauuuuggugcugccuauccucuauuacuaacucccccagccccgacauaggcuauaauuugauguuauucuuccccuuuugagaacacauucucucuaaacuuuucuaaaaugucugucuucagugcuuccccacaguguuucaguuuggcccaugauggugaaauauuucagguuccccuauuucauuuuuuuuccuuuugguuauugcaugcgaugggcuuuucuuuuaugccuaucacaccugcccuugucuucuaguguguucuauuuggauuguuuuaaagaucucugcuucauuaugguuucucuuccacuacccgcucgcccucagcuuagcugcuauuuuucaccauuuuaaaguuauugcggccaggcacgguggcucacuccuguaaucccaguacuuuuggaagccaaggugggcggaucggaaggucaggaguucgagacgagccuggccaacauggugaaaccccgucucuacuaaaaauacaaaaauuagccgggcaugguggcccaugccuguaaucccagcuacucaggaggcugagacaggagaaucgcuugaacccaggaggcggagguugcagugagccaacaucgcgccauugcacuccagccuuggugacagagcgagacuccgacucaccaaaaaaaaaaaaaaaaaaaaaaaguuauugcucucucauuaguuccuuuucuuuuugguuuccccuguucuguaguguggugauugucucuggcuaccuacucuuggcugcccaccuguuggauucauuuccugggaucuuggguaggccuuuuacuucucugugcaugugccuccuaaauugaaguuuuacauauauauauauauauauauguauuuuuuuuucccagccacacuuauggcuuuggauuggcagagcacgugcucuccuuuguccucaccaugaguuggauauaucuuuugaguuuuuucccccaaaguagggauagcucacagugguuccucugccuuccaggcagugaccaggguugauucuugggccaugcagcuguucauuucuuuaacaauuacaugguugugacaucugggaaaauccuuugagguauuucauauccuugugccugugcuuccugggucauuugggauuaccagguuucuuccaaguuccuuuuuggaacuuugcuuuugaugugaugauuuccaucagagagagggagaguaggcggggugguggggggaggugggaagggagaacacaugaguaccggugcuucaagcaaaagcaagccagcauacaaguguguaaaccagcagcgcuuacgaaguguggcaugccugcaaggcuuuuccuuuuugcucaccucuccugggauacuaauuugauuggcuauaauauaauaaaacaaaccccuaggccuacugaaucagaaucuccaggacugagaccuaggaaucuguauuuugaacaagcuccucggugauucuggcuggggaaacauugguugacauugaccguccugacuccucccuucugugagcauucacgcagucaggagucuguucucuagggccgcuuuagagguucccuuugcuuucccucuggcuggggaagaccaaucuugccuucuuguauagaccauguagcucagugucaguguucuccugccuguguuuuaucccuccccuccucuccucucaucugcagaggcuacuguuaauuagcaacagugggcuucagauaggaaguggcgcuccugggacaaaaucaugauagaaaauugagaggcaaagauuuaaguggaugcuccaucuugaggaucuugugaaaauggaguuauccagaaucagcguugcucucuacguggucauaacauguguauuauauaguaauuauuuugauauuuuaacucgguuuuauuuuuugugguuuuuuuuuuuuuuuugccugaaagcucuuuaucuaggugauguuguaugauguucuguuuccaaaugccaguguucccccucugauuucugucccagacccuacauacuacuaauccuaauccucucuaaauagagcaauacgaaaccugagagugaaaaaucuagugucacuaauaccugcugccuauagauauuuaguagcaacuaaaacuuguacuuuguguugaaacacaucuuuuuuuuuuuuuuuuuuuuuuuuuuuuugagauagggucucccucuguugcccaggcuggagugcaguggcgccaucucggcucacugcaaccucugccucccgggcucaagcaguucucccaccucagcuucccaaguagcagggaccacagguuugcacagccacacacggcuauuuuuuuguauuuuguagacauggggcuuugccauguugcccaggcugaucuugaacuccugagcucaagugauccaccugccuuggccucccaaggugcugggauuacaggcgugauuacagugggauuacaggccacugcucugggccugaaaugcauuuuauggcaagaacagccccuuccauugcuugaguccucuaauucuuuuuccccccccccagacagagucuuaacugucgccuaggcuggagugcaguggugcgaucuuggcucacugcaaccucugccucccggguucaagcaauuuuccugcaucagccuccgaguagcugagauuacaggugccugccaccacgcucggcuauuuuuuguauuuuuaguagagaugggguuucaccauguuggccaggcuggucucgaacuccugaccucaggugauccacccgucucggccucccaaagugcugggauuacaggugugagccaccaugccuggccgaguccucuaaugcuuaguagagagaaaagaugaaaugaguaccugggguaucagccaauaggcugagcugguuuuguuuuuguuuuuguuuuagacaggauuuugcugucgcccaggcuggaaugcaguggcacaaucucagcucacugcagccuugaccuccuaggcucaggugauccucccaccucagccucccaaguagcugggaauacaggcacccgccaccaugcccggcuaauuuuuuguagagaugggguuucgccauguugcccaggcuggucuugaacuccuggacucaagcaauccucccagcucaaccucccaaaguucugggauuacaggugugagccacugugcccaaccaguguuguugguuaaaauggggauauuccaagauauucugagaaacagucaaaacuugauuaaccaggauguucagggaacgggguccuuguuaaaaauauuucuaaaauuaugcuaacccacauaacugucuucauaauguuaaaagauaauugucagaaaaaagguaaaaaaucaugacucucguacagauacaaaaaugaacacguguuaaagauuuuauuuuacucauuaaucaacaagagaaccagacagauguuauagcugguucaaacaaaaagucaaaaagcacaaauuuauauggaguaaaggaaauaaauugcaaauggaggcaaaaguaguuuuucuacaguggggaggaaagacaauccaaacucaaugggacaagacagacuucgcauauacaucaguuaccugcaauuacagagaugcaaaauagcuugaagacaauaaccugagcuaaaaucagauagcccagaagguuaugcuauagacagugcauaguuuuuucauuggaguacaaagguuuuucuguaguaagcaaacaugguggaugcuuugugugugugugugugugugugugugugugugucgggggguggcuguugauuuugcuucuugugauuucucagggccgucacuucaguucuuauccagaauucaguuccauauaacaugcauuuacugaguaguuacuauacguaaggugucguggaggaaacaaagacaaaaaaggaugcuuuuuuuuucuuuuucuuuuuuuuguuuuugagauggaguuccacccuuguugcccaggcuggagugcaauggugcgaucuuggcucaccucaaccuccgccucccagguucaagcaauucuccugccucagccucccaaguagcugggauuauaggcaugugccaccaugcccggcuaauuugguauuuuaauagagaugggguuuccccauguuggcuaugcugaucucaaacuccugaccucaggugaucugcccaccuuggccucccgaagugcugggauuacaggugugagccaccguggcuggccaaggacgcuauuucuuaccuuagguagcugauuggugggggagacaaacaugccuuguccccaacuaaccaagcuagagaggagaauaagaaccagugcuguggaagagguagggaguaaauacuugaggacaaccagagagggagggguuaacugaacucgggcuggggcuagggggaugacaugaugacauuuaagcugagucuugagagaagacagggagaggaagagggggaagcaggagaggccauuucagggugaggaggcagaagaguccugaaacuggaugguguguuuaggaaggguugggagcuggggguggugagagugguggggaaauggcaggaugugguggaagaggaggcuggagaggagguuugaggccaggucaugagggcccugaaggcagugcugagaauggcuggcugggugcuagaggccggggaaagcuauugaaagcuuuugaggagggaaggagugacaugaucgaacuggcgcuuuagaagaugaauugauuguagaaucaagaaauugaaggcagagggagcaguuaagaggugauuauaauauucugggugagagcugaugagggccugcaccaggguaguggcaagaaggguagaaggcaaggcuggagauggcauuauuaaggccugacuucugaucgaauaugggcggcaggggagagaaggaguugaagaugacaaggcggaaauuuccaggcuaggggacgguagugccguuaaguaagcuaggaaacacgcugcuuacugggcauaggggguggggagcagguuuaugagaacagauaaugaguaugguuugagacacauugaguuugaggggcuugguggucauccaauuaacagcaaguugcuggcagcuggaaauucuggucugggccuaaggagagaggucaaggcuagagauacagauuugggagucaucagugcaucaaggggcgagcugaaacuguggaagcucaugagcugagagagaagguggggcagggcugacaacuggcacagagggagagagaugggugggggaagccagagagagccagcaaaaggcagacuaggaggaaaagagacagagggagaccggggagggaccggaagagggagacugaaggccaaagaguagaggggagggggaggcacaggggagggagaaggggaaggagggggagagggaggagagaaugaaugggagacugagggaaauggggaaggugagauaagcaagaaaaagacagggaaggagagaggugggaacggggagaaaguuggaggagaggggauugugugugugugugagagagaggagaaaggcaagaggugaacagcugggaaaauaauaggggagagaaaggugaggaggaggaagaguaaagagagagagauggguagggggaugagaaagagggaagaagccuugaaagauaggaaggggaggaaaugggagaggguggcagaggugaagagagacagagaucaagggaaaggccaggccccagugaaugcccaagucuuuggggugggcaguggaagagaagggccccggagaagccaucaggcaguggaucaggaaagacaagagaagggagagaauaaagagggcaacguaucccacucugcagagaugaggaggaggaugaagcccaggcaggguggaugccucucuccucucuucuccuaccaccuccacacuggucuccuggcucucccuugaucuuugugggcaaccuccugccuuaggacuuucucaugcacuguucccucagccuggaaugcuuuucucccaaauauccacguggcuacuccuuuaccucauuccgaugguuuaaaugucuccuuuacagcaaggccuauccuguucaccguauuucagauaguagcccuccccaccuagacugugcccuugccccuuagucuguguuguauuaucuccuccuccuccuccuucuucuucuucuucuucuucuuuuuuuuuuuuuuugagacagaguuucacucuuguugcccagguuggagugcaauggcaugguaucagcucgccgcaaccucugccuccuggguucaagcaauucuccugccuuagccuccugaguaucugggauuacaggcaugugcuaccacgguggcuaauuuuguguuuuuaguagagacaggguuucuccauguuggucaggcuggucuuggacucccgaacucaggugauccaccugccucggccucccaaagugcugggauuacaggcaugagccacugcaccuggccuguuguacuaucuucuaacaugccgugacauagaacuauuuaacaugcuaugacauagaaguauucaacauguuuauuguccaugucaucccccugggauguaagcuccacacgggcaggcauuuuguucuguuucguuaauugcugaauccucaguaccuaggauggugcuggcucauaguaggaaugcaauaaauugugauacuguguugaaaguggacaaucucugaaaauugaaaaauggauacaugaaacaaaucccucguacaacuauaucuuauugugauuuacuuuggaaaguggagaacagcauucaauucugaucacuguaggguucuguucaguugaacuucaaugaauaaggauuuuagcuaauaagcuaacucaagagcuuaagggucucaaggcaagcucauuggauaaagguuuuucuuggugccucauuuuuucuagaagguaaauuaacugugcccugcuugucaaagcgagagagggacauuggcuggugaagagagugguggaacauggagacaacagacugacaggaagggacaaggacagaaaugugugguuuuuuuuuuuuuuuuuuuuugagacagagucuugcucuguggcccaggcuggagugcgcuggcaugaucucagcucacugcaaccucugccucuuggguucaagcgauucuugugccucaaccucccgaguagcugggauuacaggugcacaccaccaccccaggcuaauuuuuuuauuuuuaguagaaacgggguuucaccauguuguccaggcuggucucgagcuccugaccucaggugauccacccgccucggccucccaaaauguugggauuacaggcgugagccaccgcgcccugccgaaacacguaguucuggauggaacguuguuuucuguuuguuugcuuguugguggucagcgugcaaggaguacugcaccugauuuggagggagcuugaaaccagguuagauacguguguuauuuccaacucaaagucaauggaguauuuuugaaggacuuacgaaaaaaagcaugugcuuccucugaagaguguaaauuggcuacgucacucaaauacuucaguacccauggauuagagaguagacgagaaaaaggucaccaguaguguuuuagugcaccauucauauauggguaugacucucuaauuguaguugguuaggcuaaauguguguagaaauauauacugucaucucauuugucugaaauagauugaauuuccucuacucaagcauaucugucuuuuaagauaauuuaaaacucacucuaggugauuaacaauguccucaucuccauccugaaaccuauggauuccuagaaagcuggugcucccucuucccgguuuagaccuuaauuuuccauagcaggcuggcugcuuuaacauucugaugcuguaauuaccuuuauugaaacauugcuguguaaaaggugauugaagcagcugucccuguuacgaguuuugauuuucuggaauucuuuuccccagggggaguggccacagcagguccuaucugguggugaguggcugucaugaucucuacagcaccgcucuacagcggcgugcacaacuggaccaguucugaccggauucgcauguguggcaucaacgaggagaggugaggaggccaggaagguggccgcugcuggccuccagugagcaguaccucgucaccagagggauagcugcauacaauagggccuggggagggacccuggggaggagaagacucuuaguuguuucuaauuuuccuguggugggauggggauggggcugugugaguggccugaucugccaugcuaucucuuuucagaugaaggugaggaggccaaaaaaaugaccuuuugccagcuagcacuugucuacucauuaacaacugucagacuguggaguaaggggaagcucaggcaauggcaauuuuuuuuuuguuuuuugagacagagccucgcuuugucaugcaggcuggagggcaguggcacaaucuuggcccacugcaaccuccgccuccugggcucaagugauucucccaccucagccccaccaguagcugggaccacaugcaagcaacaccacgcccggcuaauuuuuuuuuuuuuuuguaguuuuuuagagacggggguuucgccauguggcccgggcuggucuugaaccccugagcucaagugaucugccugccucagccuccccaaaugcugggauuacaggugugagccacugcccaugccuggccagcgauugcaguuuuuauuugcugcaucaaaguuuggugcucaaggauauguguaagguauuuucagucuuugaucuaggucuggaagaaagaugguuuuauuguucagauuucuacugggaacuggcagugggcauucugguggucagcgcuuucucaccucaugaggcuaauucugauuugaagugagauccuuaugaaguaucaaaggaaguugagaccgccuagcauagucuugagaguuggugacaccugccucacguguguauuuucaguuaucuguuccccagaauauuugguugaccaagaugugccauugccugaucaugccccauacccaaagcacucaaaauggccuucagaauuuauauuuggcuuucauaacccuuggucaaagagcugugugugauggcugcagugccucucucauuuucuuuuuuuuuuuuuuugagguggagucucacucugucgcccaggcuggagugcaguggcgcgaucucggcucacugcaagcucugccucccggguucacgccauucuccugccucagccucccgaguagcugggacuacaggugccgccaccaagcccggcuaauuuuuuguauuuuuaguagagacgggguuucaccauguuagccaggauggucucaaucuccugaccucgugauccgcccgccucggccucccaaagugcugggauuacaggugugagccaccuugcccggccguuuuuauuuuuuauuuauugauuuauuuauuuugagacagagucuggggcuacaggcguaugccaccacaccuggccaauuuuuguauuuuuaguagagacggaguuuuacuauguuggccaggcuggucucgaacuccugaccucaugauccacucaccucggccucccaaagugcugggauuacaggugugagccacugcacucggccgccucucucauuuuuagagaaggcacugcuccuucaugcuugcugguguuuuuuuguuguuucaauccauugacuguuuaaauucaaauauacaucagauaaaucaccaagacacagaacaauauggcuuucccugggauucaagaucugacguuucuuggguaaaucuuagaaaugugugugcgcauauaggggaguauugguaauuugaagggaaaaggaauggaagucuuuguguuuaucuacuuuguucuucuguuccuaacuggagaaguauauacuugucugaggucaagguuagcagaauagaccuuuuuauuuucuuaagccauuagugccugauagcuuaauguucucuguacugaggaacaaguuagagaugggcuuaaaaggaauuuaauuuuaggauaaaaagagucaagaccauggaaaaugagaugaaauucuuaggugcucaggaagaaaaguguuuuccuuuacauaugaagcauguccucagaugaucacuaagagaugaucuagggaaaggcagggugaugauaaugauuugcguaaguauucauuggcaggucauguugaccuaguuauaaguaguugagacuuugaugcagaaaucuggacuagagccuucaaaagaccagcggggccgggugcuguggcuuaugccuguaaucccagcacuuugggaggccgaggcggguggaucaccugaggucaggaguucaagaccagccuggccaacauggcgaaaccccgucucuacuaaaaauacaaaaaaauuagccaggcauggugguguaugccuguaaucccagcuacuggggagacugaggcaagacaaucaguugaacccgagagguggagguugcagugagccgagauugcaccacugcacuccaaccggggugacagagcaggacuccgucucaaaaacaauaaaauuaaauaauaauaauaaaagaggccaauagacaaguuaccuuaguucaccaucuacuguaaaucccugccaagaaaggagcaggaaguaggcucaaaaucugauuuucccuccaucuuguuuuuuguuuuugagauggagucuugcucuguugcucaggcuggaguguaguggcacgaucucggcucacugcaaccuccgcugccuggguucaagugauucucgugcaucagccuccugaguaacuaggauuacaggugugcaccaccaugccuggcuaauuuuuguauuuuuaguagagacaggguuucaccaugucacccaggcuggucucaaacuccugaucucagucugucugccuuggccuccaaaagugcugggauuacaggugugagccacugcacccagccagauuuuccuuccuucuaaaccugugccuagugcuuaagaggacauuuuuuuuuuuuuuuugagacagaguuuagcucuuguugcccaggcuggagugcaauggugagaucugagcucaccgcaaccuccgccucccggguucaaacgauucuccugccucagccucccgaguagcugggauuacaggcaugcgccaccacacccggcuaauuuuguauuuuuaguagagacggguuuucuccauguuggucaugcuggucucgaacucccgaccucuggugauccaccugccucagccucccaaaguguugagauuacagaugugagccaccacgcccggccuaagaugaccuuuuaaguguugucacuuuugaucucauccacccuuuauugucaccuucuugcuacagucuaggccgcuacagccuagaccaugcuaucacugguuuccaaaauguaaucucaccuuauuuaaaaaucauuuuccuuggcccuuuacaacuuguagaauuuaggaauuugggguacaaagcugugccugggguucaacucuuaaagugauguuuuagaggccugccagcuuuggcagcugcaauugaggacuguagaacaggaggcaugggcuugcggcuggccccagguggccgucucuaggcaaaccuacagcuaaaugugucugcuugccugcuugcaucccuucuaggauuaauucaugccuucauucaacaaacauuuauucaacauaaugagagcaaaccaguaguucuaguacauugguggugagugcccuagaauugcauguccggguccagugggaguccaaaugcaagauugacaaaccuccuggugggagaauaaggaaaggcuucccagaggcaguggcauuugagcccaggcuugaggaaugaguaggaguuugaggugagagcugguauuucccugagacaauaagagcacaguguggcugggcacggugacucacgccuauaaucccagcacuuugggaggccgaggcagguggaucaccugaggucgggaguucgagaccagccugaccaacacggagaaaccccgucucuacuaaaaacacaaaacuuagcugggcgugguggcgcaugccuguaaucccagcuacucgggaggcucaggcgugagcccgggaggcagagguugcagugagcugagaucgcaccauugcacuccuccagccugggcaacaagagagaaacucugucuaaaagaaagaaaaaaaaaaaaaaaaagcacaguguguuuggggaagguccaaguuggaaugaaggcaaucuugggguacugugggacucgaaccagggaaagucucccaggacuggaagguaaggagccuggugugugcugggugguauauuucucuuacggguagucugggcccagcaggaacugaagaggguccgguuugacaguggugcuagcccuuaauaauuagggaaauggcccagaggggucauggccauuucugguuuaaguuccacaaagccuugaacauaacagcucugccuccucuguggugggaagaaacagcaggauugauuuucaguccugacugaagccugcuaugaccucuguucccuccugccgcccgccuccgccagcugcacccucauaaccuugccugguugacccagcucuucccgggcccccuccccugcaaguuacuccugucccaggcucuucucucaauggagcaaguuaauguuugcuuagcucugcccaccccucuucucagaggauuugaaacacggcugcaugacauuuugcagcgccuucggggcuggacucagguguggguauggcuggaguggccaggacugcuguugcuuggccugguucugugguucucuggcagcugccuucgacggcagggauucugcuuucgaggugucauuucaggcagggugggagcuugcaaggggagaaugaggaugcagcccacucccuuuuguauggccaggaggggaaagaauguaaauaaauagcaccuucccaugugggguugcuugggggaagugcugcuuguuuccccuugaguacucccccuaaaaccgucccuggcaagucuagugggaacacgcuucccccuggcccaaggcugggcauaggucucgcuuuuguggucucuuaggaguugaugugaaaguauguuuucccuuuccuucaggcccucccucccuccccuuccccgagaccacccugacugcaucuaaagcccuugccucuccuuacagucauuucuguuugucaccaacagucacuuccagcaguggagcccucccacuucugccaguccaacugccuuuuaaagggaacaagccuuucccccucgguuagccccuucuggaucccugaaaagauggggagaggcccguggugaucccccuugccuuuuuugcuucucuugccccagguacaauuuuggagucccuguuucagugggagggaggaaguuagcagggcccucccccuucuuguugggguuggcuccagcaaccugacugcccuuuggcuagggugacuggggaggcgagagcuggcuucuucagggcugucuucaggagcuuggggugagccucuaaagaagggaggcaaaaauuagccaggcgugguggagcaugccuauaauucuggcuaugcuggaggcugaggcaggagaauugccugauuccaggaggcggagguugcagugagccgagaucgagaucgugccacugcacuccagccugggugacagagcgagauucaaucuaaaaaaaaaaaaaaaaaaaaaaaaaaaaaaaaagagggaaaaaaggaaagaaagaagggaggucaccucaggcacaguguauuuccccaggggcacacagagcaguccugugccuugcccacccaggaaacgcacugcagcgucuauguugggguuuuauucuuuaaucuaaaccuccuccuuggccacucccacccacagcucccaagggcagggggcaauaguuuuuuuugguuguuguuguuguuguuuugagacagggucucacucugucgcccagguugaagugcaguggugggaucucggcucacugcaaccuccgccucccagacucaagcgauucuccugccucagccucccaaguagcugggauuacaggugccugccaucacgccuggcuaauuuuuguauuuuuuaguagauauggaguuuuaccaugauggccaggcugauauugaacuccugaccucagugaugcacccaccucagcuggccucccaaagugcugggauuacaggugugagccaccaugccuggccuaauaguucuugcuguacuuaaaauaccaggggagggaggcagucugaugccacccucucccuuuuuuuuuuugucaggauguacaauuuucuaugaugcuuaccugaaauuuggagaagacuuuaaacagggggagaugcauuugaguuuuccuccuuugggacccagcucucuggccuugagcccuuuucucugggacauaugaaccugaauuuggggucugaggcuuuucggacaggagagaacaaaguggugcugggagacugaugggggggcagggaggggugcuggcaggagauaggauguaggcaaggauagaaggaggguagaagggaggguguugccuagaacucuagaaaaaagggggcagugucuccuggagggaaaaaaguaguauucuuaaaaugccucucagcacccagugaccugguggccuccaagugguaucaucaccagugcuaauaaacaugucucugcucuaggcaagacaggaggugaauaggugacgauucagauuuagaccugaaaacacaacagggguuuauuuguuuuagaagaggauuacccauaugacacuuucagccagcugcccuuagagacuuaaaauaagauuguauuuaaaagaaaaauggguuuugcaugccuuuugaggcauucagugguucucaugucuccccuuugagcaaugcccuguacauccuggauggucauuuuggcagguaagcuccagggaaaagguaaaagugcuaggguguccacacuccuggcaagagcccuagaaaacaggguaaacaguccaaagaggggggucuagucagacugggcucugguagggacuugcaaagcuagguguggcgccuccgcuuuguaaccaagaacccccaguuccuuguaaucccccucacaaguuacuacaggaagugagguaggaagguuuuauggggacccaggcaggcaggaggcauucuggggaaggugguguuggcucaaauccugggccucaugucccuucucugguuguaucuuccaugcuagaagagcaccucuuucugaugaggagucaacgacaggcgacugccagcacuuuggaucucaggaguuuugugucagcagcaguuuuuccaagguaagaggcuuuauggagccacgugcuguccaccaaaggauggagcugagcugccugggaggugugcccagccugccaucccaggaagugggcaggaagggacagggucucucccaggaguugguauuggugggacacaaauuggcuggcugcccucugcgucuuccgagaccugguuggucgaguugcagagaagaccagcaguugccucucgggccucaggacacuugcaccaucugcagggagcuggcugagaugugcaugcuauccugucguugcagguggagcucacggcaguuggaaguggcagcaaugcccggggggcagacccagauggcagugcuacagaaaaacuugggcacaagucagaagacaagccugacgauccccagccaaaaauggacuacgcugggaacguggcagaggcugagggcuucuuggugccccugagcagcccaggagacgggcucaagcuucccgcaucugacagcgccgaggccagcaacagcagggccgacugcuccuggacuccacucaacacccaaaugagcaaacagguugacugcucacccgccggaguaaaggcuuuggacucucggcaagguguuggagagaagaauacuuucauuuuggcaacucugggaacuggagucccuguggaggggacccugccccugguuaccacuaacuucaguccucugccagccccuaucugucccccugcucccgguucggccucugugccccacucuguuccagaugcauuccagguuccccucuccgucccugccccagucccccauucagggcuuguuccaguccaaguugccacuucgguuccagcuccuuccccucccuuagcaccugucccggcucuggcuccagcgccaccgucagugcccacgcucaucucugacucgaacccccuuucuguuucggccucagucuuggugccugugccagcuucugcucccccuucaggcccgguucccuugucggcuccagcuccugccccgcuuucagucccaguuucagcuccucccuuggcucucauccaggcuccugugcccccuucagcuccgaccuugguucucgcucccguccccacuccgguucuggcucccaugccagcauccacgccuccagcggccccugccccuccgucugugcccaugcccacuccaaccccaucuuccggcccaccuucuacccccacccucauccccgccuuugcuccuacaccggugccugcacccaccccagcccccaucuuuacuccagccccuacacccaugccugcugccacgccagcugccauucccaccucugcacccaucccggccuccuucaguuugaguagagugugcuuuccugcagcucaggcaccagcuaugcaaaaagucccccuguccuuucagccagggacagugcugaccccgagccagccgcugguauauaucccgccuccaagcugugggcagccacucaguguggccacacugccaaccacucuagggguuuccuccacucuuacgcucccuguccugccguccuaccugcaggacaggugucucccaggcgugcuagccucccccgagcuccguucuuacccguaugcauuuucuguggcccggccucugacuucggauuccaagcugguaucucuggaggugaacaggcuccccugcacuuccccauccgguagcaccaccacccagccugcacccgauggggucccugggccuuuggcagauaccucccuuguuacugcuucugccaaggugcuuccaacuccacagccucugcugccagcccccagugggagcucagccccaccgcaccccgccaagaugcccaguggcaccgagcagcaaacagaagggacuuccguuaccuucucuccucuuaagucaccgccacagcuggaacgagagauggccucuccaccugagugcagcgagaugccccuugaucuguccuccaaguccaaccgccagaagcuuccauugccgaaccagcgcaagacaccccccaugccuguguugacccccgugcacaccagcagcaaggcccuccucuccacaguccugucuaggucucagcgcacaacccaggcugccgguggcaaugucaccuccugccugggcuccacuuccucgcccuuugucaucuuucccgagaucgugaggaauggggacccgagcaccugggugaagaacucaacugcacugaucagcaccauuccuggcaccuacgugggaguggccaacccagugccugcaucccugcugcugaacaaagaccccaaccugggccucaaccgugacccccgccaucuccccaagcaggagcccaucuccaucauugaucaaggagagccuaagggcacuggugccacguguggcaaaaagggcagccaggcuggugcugagggacagccaagcacagugaaacgauauacuccagcccgcauugccccugggcugccagggugccaaaccaaggaacucucuuuguggaaacccacggggccggcaaauauuuauccccgguguucagucaaugggaaaccuaccagcacccagguccugccuguuggcugguccccguaccaccaggcgucucugcuuuccauuggcauuuccagugccgggcagcugacccccagucagggggcgcccaucaggcccaccagcguuguuucggaguuuucuggugugccaucucucagcuccagcgaagccgugcacggacuuccugaggggcaaccacggccugggggcuccuucguuccagagcaggacccuguuacaaagaacaaaacuugccggauugcugccaagccuuaugaagaacaagucaauccuguccucuugacccucagcccucagacugggacccuggcacugucuguucagccuagcgguggggacauucgaaugaaucaggggccugaggaaucagagagccaccucugcucugacagcacuccuaagauggaaggcccccagggggcuuguggccugaagcuggcaggagacacgaagccuaagaaccaagugcuggccaccuacaugucccaugagcugguccuggccaccccccagaaccugccuaagaugccugagcugccuuugcuaccucacgacagccaccccaaggaacuuauauuggacgugguuccgagcagcaggaggggcuccagcacagagcgcccacagcuuggaagccagguggaucuggggcgagugaaaauggagaagguggauggugauguggucuucaauuuagccaccugcuuccgggcugauggccucccaguggcuccccagaggggccaagcugaaguucgggcuaaggccgggcaggcucgagugaaacaggaaagcguaggggucuuugcuugcaagaacaaguggcagccagaugaugugacggaaucucugccgcccaagaagaugaagugcggcaaagagaaggacagugaagagcagcagcuccagccacaagccaaggccgugguccggaguucccacagacccaaggugagugcugagcuaagguccaggguggggccgagaugccgcuggucuacuucgugccauggauagcaaccuccugugaccccuacccugugacacagugcuguugggcagcugugugaacugaacggauuggaaggcuuuuguaaaaguaauaaugaccugcuguccccucccuaggucacauuuuccauauacggugucucagcauggggagaggcuggcuuguaguuuguaggaugugggaaaugauucugucccugggguagggaagccauugucccagaugagaucggaaagcggaagaagguauuggugagggaaaucaaugaauaacaggcucuuccuugaauaaccauucuuccuuuuccuuuacugagagaacacuggccuugagaacuuagggauggggagagcaggggccucugacgggguuguuccuuucaccacugguuggggggccugcuuaggauuugcugggagccuuguggggucagagccaauuuggcuucugugcuaaucaguuuccuacccgcucgaaugcuugaggcagcagcuuuggguuuuggcccacuggggauuggaugggcaaggcagguugggugucuggguguuggucuugacaggcuauggaugguggcagaguucuaggcaaaaaggugggccaggagcacuugaugagaauccccuggucccccagaagggaccagaggcuacuggugauccaaggagaaucuugaaacauuugaggauaggguuuauuaaaaaucuagaacaacuugaaguucuguuagcaagcuuucaaguuggauguucauguacacuaagggacaaaauuucuggcuagagcacugugaauuuggcuguggcacaaguuuauggucuuuuuuggaccauagaccauuuugaaaagcuggugagagcuauggacccuguucccagaaaugugaccucagaauuuugccaauaauuuuaggggguucauggaccugaccucugccccaucgcccaaagcucacccagggacugcagguuaagaaccccugggauagguguuuggguggauuuuaacucacaaaccucacaaccacccugguaugucagagacacgugaaguaggaacgugggucaugacgcaguagagcauauaacguuuggcagguaauugccaucugcgcucggugguaauaagaauaauaauucaugucguuagaguuguguuuuuacauuuguuaucuaaucguuacaguaaccauaugaggugaaugcuacaccaaucuacaggugagaaaauaaaugaaacagaggcucagagaggauacauuacccaguuacacagcuacuaacuugcagagcuagaacucagacucuggucucugguuccaaaguccauguucuucuucagcuauaccauauuaucuuccacucucuuuuuguuuuuuuuuuuuugagucagggucuugcucugucacccgggcuggagugcaguggcucgaucacagcucauugcagccuucaccuucugggcucaagcagucucccacuuuagccucccaaguagcugggaccacagguguguaccacuacaccuggcuaauuauuuuuuguagagacgaggucucacuauguuggcuaagcuggucucggacuccugggcugaagcgauccuccugcuucagccucccaaagugcugggauuacaggcgugagccaccucaccuggccaucuucuacucuccgcccauggaacuguuucacugaauguuuugcaaguuuuuguugcauggcuacuguaugccaguccuucccaggcaaugggaauaccucuucaggagggugguaucauagauugaugaggaguaugcucccuggagccagacacggagccuggguuugaauuuuggccccaccucuuccuagcugugugcuauuagucaagcuacuuaaucucuauggccuucaguuucuuaaucuauacacaagacaauaauaguaucuacucauagaguugugaagauuaaaugagaugaugauauaaaauguccacaauaggcaaauccauggagacagaaaguagacuagugguugccuaggguuggggaggauggaagaguuggggagugacuguuuaauggguauuggguuuccauucagggugaugaaaaaguucuggagcuagauaaguagggaugguuacauagcucuaugacuauacuaaaaacaauugaauuuuacacuuaagugaauugcaugguaugucuuaauaaauuguaucucaguaaagcugucauuuuaaaaaagauuaaagaacgugauauacauaaguguguacaguaguaucuggcacauaguagguguucaguuaguguuagugguugcuguuauuguuagcauuacaaacaaaauagauguggccccgccucucaugaagcuuaugucucucagaugacucagugacaggugggcacugcccuauccuauauuagaugaacaguucagugggcccacuaucaaaugcagagggcagaaauuaaaaugacaagaucaggggccuggaagcagcucuuugcaacugccuguaaggauuuaguaaaugucuauuuuuugggagugcaaaucacuucguuccuucuuuuuuuuuacaugccaccuuccugagaaggaaacuguugaucagcaaacuaagaucagggguuuguuugaaauagccccuuucagggcuuggccaagagugaaaauagucuccuguugccaauaccaccugcccaaggccucucaggauccuaaagggccuucugcaucaccagcaaagagagagaguucugcuucauuuggugcuggauguauuuuauuguccucucauuccuuggaaagcucuuuggaaaauauuucaaaacuguuaaccagaauguucaucucucacggucuccccauccucccaacuucaugcauaaguuggagugugcgaaauauuuuuauuccugaccucaggugauccgcuggccuuggcuucccgaggugcugggauuacaggcuugagccaccgcgcccugcuagauguucuguuuuacuuguuuuugucuucggaaguaaaaguuaaugaucugcauuugaaagagccagcuaagaaugauauucagaaauaaauaggacauguucaaauguaugugcauuugacuuuauucccccugacuuaaaauaguuuuucuccagccguaccugaagguuaguuuuuaagcaguaguuccucaucuuccucuuuccaaccaaugcuuuccuccuccuaacacuuugguuuguaggaacuggcagcaagccaagggggaaacugaacuugaauuuuuagcucaggccucugcugaaaauaagaagcaggaagaguucaugggauaggaggaguccuggaauuugauggguaguggugacucccugucccuggagaauuaggaggccccagcccccgaaaauguuccaucaguaagguaugugccauccccuuagcuggagguacaccacgauaaccuucuagcaggcgaggcaugggucagcuuaggggaaaaacagcucaagcaaguuuaacccuuccuuuccuccucggaccugcuuuuauuguuccaacguuuugcuuauucugcacucccugcauacuagaauacuggaaaucccuacauugcccuauuucuuguuuaguggcacagagagaccucaaagcucgugagaauacgugacuguuaggcugagaguguccuugcagugugugagcacagccauugugccucuuagaugugccaggcagugggcgugggagaagcugagcugaagcagccgaggaagugauucagggaagauagguagcgagagcugaugcccagaggcccgggcugggggccagacccccggguccuagucccaauucugggucuuucucacugcaagcacaaaugugcuaacuugcggguuggccugguaaguggcagucccugagccaguggacacaugggauuguguguuacccuggacaagucauucaacccuuugucuuggagccuccguuuucuuaucuguucaguggggauaauauuagcuucuccucccaggguuguggggaggauaaaauccaauaauagagaugagagcauuuggaaaggcugaaagugcuacagaguauaaaguggcauuaugaauaaugcuugggccuuuucacuggguuuuauaaauaugaggauauuugaauugcuccugugucauguuuuucuucuugccuuaguugaaucuauuuucugguauuaauuuacacgugaaaagagacaauuuuucuugaguuggccuguacugagaauuauuuucaguuguuggugcaauaccauucacagugaaguuauuugaacaauguagucucccaacuugcagaagaggcauuuuguuuaaugccggucucuccauugguguuuggguacagagaguauggggccugacuuugcaccuuuuaaaaugacuuuggguguuuauucacuggcuuuugaacgcagacucuguagaccucuuuaaagugaugggauguggacgccuauggggauuagcuggggcccuggacucaguccaaaagagccccugucacccacucuggaaggcagugcacggccccuugccccuggucccccacucugggcagcucaugccucuaggucagaaacgggacacauggcucaaccccuggagagcuuucuuaagaagcaaaacugaccucagaccugacccucuaccucuccacagugccggaagcugcccagugacccccaggaauccaccaagaaaagccccaggggggcuucagauucaggaaaagagcacaauggagucaggggaaagcacaagcaccggaagccgacaaagccggagucccagucuccaggaaaacgagccgacagccacgaggaagguaggccccgcggcccuggcccucugggcugggcugcagagggauccccagggcacaguggugagggcagaggggcucaggcgcugacuccuucacucuggaaaagugagacuucuucacuguggaaagaagauaugauugaccccucugaagucuaaggugagcgagcaaggaucgggggccccuucugcuccuccugggugcuagaauaaggcugaaggaagugguuuuccgacacaaacaccaggcccacaacacaguagccgacccauuuccccgcgaugggucuaggcucaaagaaacaaguuuaaggagaauuuagacaaaaaccacggaauggggguucauuacgcugucuucuuuggguauacuggaaaacugcuauucugaaaggacaaaaauaaauagcuaguuagcuaggagaguuuagagaaaucuuaaacguuuauuaucauuuagggacacacaggauaucugggaugacggggcugguaugugucccuaaccuguccguuuugccacuaauaguuucugggcacccuuaucagggagagaauccccagcauuccugagcauaggaguccagguucauggucuugcccaccugacgugacuaugaccugccucuucuggucuguucuuuuuuuuuuugagacagagucucacuuugcuucccaggcuagagggaguucaguggcacaauaucgguucacugcagccucaaccuccugagcucaagugauccuccuaccucagccucccgaguagcugggaccacaggcaugugccauuacaccuggcuaauguuuguaguuuugaagagaugggguuucaccauguuucccaggcuggucuugaacuccugggcucaagccaucucccugccucagccucccaaaguguugggauuacaggcgucagccacugcguccggccucaucuguucuuagccguuuuuucucuguucacuggcuccuuguuccuaucuucccaccucacucaauccuccaagauucacugagguugcccuccucugggaccugcuccagcucaguuagaacuuuguuuauuuucuuucuuucuuucuuuuuuuuuuuuuuuuuuuuuuuuuuuuugagauggagucucacucugucacccaggcuggagugcaguggcacaaucuuggcucacugcaaacucugcaucccagguucaagugauucuccuuccucagccucccaaguaucugggacuacaggugagugccaccacgcccggcgaauuuuuguauuuuuaguagagucgggguuucaccauguuggccaugcugggcucgaucuccugaccucaggugauccacccaccucggccucccaaagugcugggauuacaggcgugagccaccaugcccagcagaacuuuguugaggugcagcagccucagaguccuaugggcaguggggccuccuacuuuccuacuuucuggcacaccaucacauugauacugugcacugccuuuucugguaucagcaaaagcgaccaaacucucaguuuuuaaaaaccaccuggaaacacucauugucuacaagagacacauaugugauggccacguaaggggagugaauaaauguaacccagauuaaccacaggguaaacacaaacucuuucucaaucuuucccccgagccucacaggugggcuuucuggucuuuaagcuuugauuguaacauuucugccuucuguccccaaaccacacaucacuccagguuccuuggaaaagaaagcaaagagcaguuuccgugacuuuauuccugugguucugagcacccgcacgcgcagucagucuggugagugagacuaaggugauggccccucucagcaucuucuaugaaaagagagaucgaaaucugguugagcaguuuuaccaugggcccaggugucgaguugggaauuugauucacugugccacaaugcccagcuccuugcagagauaagagagcccugggugggggcaggggacaaauaguccucaaauauugcccacuguuugaggauuauuuguucaacuuuucagagcagggauuugacaucucuuguugggagcugaugguggaaagagguaaggccugugccacucgggaaagcugguucaacuccaagcuuuggcaccucgucauuacuggggcuaaucucaggcacagacauuuaacuuucuaccuuggucuuauugcccuaugugacaggcagccucaaaguuggaaaagucauugaaucgucagggcuggcagaaucacauuuggcucccugaauuuguguuggucaaccucuagggacuaaaaaaagcuagcccuuucuagccaccacuaccuucugcuagccuccacacugguauccagggcuggagauaguugucccaguucacccaauuuccaugcaaauuggauagaauggggaagcaagguauaguguaaacucaguuaucugacauucuaguaaccggcaccuuagcacauggcaagcgaggugguaauuggggcucauaaugauggccuggaggccuuacaaaauccugaaguguccucugaauuaucaaagagcaauuacauuacagccagucccauuuuaguguuaaacacauuguacuguauuugauucuuuggaaauuggugaucccuuugugaucucuaugaugauucuguauuaaccagaauauuagauuaaccagaacacuuuguuuugccuagucuauauaauggaaaaugugcuguuauuugcugucuuuuagcagugugacuaacuugaagcuuuggucaagggcuacuuacucuauuugccucgaaccauuucuuucuucugcugacuucgcuugggucuggggacuguugaguuaauagcugggccuugggagaaagaugguggugucucacagcugcuuccgaggaggaaggugucaaaucuccuguagugugaaaccaggccaauuuaggauguacuuucguuguuagcagaguugaaggaaagaguggagagagaaaauggccucuuggcaagguggcugaggaaggcaggaaagguaccaauccauccugggguggugggggaggagggggaagcgcuugcccagcggugaggaacagcuacaaccggguggagggaggugccugggaggaagcuccaccccugaacucuuggcaagucgggaggagguggggucaauuuaagggaagugggcgugccugggugcauuugggcgugacccaaccaggcucugucacagaucacaggaaagggacuccuucuugcuucgcuuuucuugagacucuucucuugugaugauucugcuuggccgggguggcucuguccccaagauugguggugccacaaaaggaguauauccucccuugcccugucugagaccccaauugcccucuccuagccccugauuucccagggacccguggcccucuccugcccuucacaaaauacuuggcacuuuauaagagcuaagcaagaguuuuggguguggauucaggugacacuguaacguggaugaguaaggguguguguuuuuaauacuugauguugucugguauauuggacucuguaaagcacauaugcgugaaaaaucuuauuugagccucaaaacagcccugugaggucaguaaggggagaacaguauccccauuuuauagaugaggagacugcacugaaggaacuuucccgaacgguacagcuaauaacuggcagagccugaacuugaacccagaccuucaaacuccuaguccagggcauucacuucgacaccaugcuuuguccuuugaagaaguaccugaccauccucuguacaucccauccacaggaagcaucuguagcuccuuugcuggcauggcagacagugacaugggaagccaggaagucuuccccacagaagaagaagaggagguaacccccaccccagcuaagcgucgaaaggugagaaagacccaacgggacacccaguaucgcagccaccaugcccaggacaagucucugcugagccagggccgaaggcaccuguggcgagcccgagaaaugcccuggaggacagaggcugcccggcaaaugugggacaccaaugaggaggaggaggaagaagaggaggagggccugcugaagaggaagaaacgaagacggcagaagagccgaaaauaucagacuggggaguaccugacagagcaagaagacgagcagcggcggaaagggagagcagguaaggcuggccaggggcucugcugucgccgcggcccguuuggcuucugggaacccucgggcaucucuacgccagccaaaggcuucgggacccagagaaacccggugcuaugaucuccagcugccagagggggucacucaacuccagcuccgagccuuuggcuuuggguugacauugaaugaguucggauuggccugcaggugagcggaggacaugaaggcccaagcccuccgguuucuuauagaagucugaaccugugggcaaggccacggugacauccuuggcaugggacaacuggauaccagggaguucucugguuggcuugagggagucgagucuuuugggaggacggguucucucuccuagaaucuuggguucaagaagacagagggcaucggcugccuuuccugggauacuugcagccucuaagcuaaaaagaaguacaguggguucuucaaaccaacagaagaacuucaaguagaaacgggcacagcauugcuuuauccguuaaagccacagugauuauucagaggcggagugaagcuuugaggugacccaaaguagcaucauuuuuguuggaccugaguugagaaggcaggcagcccaaagagaaaaccaggcuuucucugaccacaucaaaugcugugauauaccauuccggaggcacagacugucacaagaugcuaauaucaguauguuccacugaguacuguucaggcccauuccuauaguggauuucuaaaugagcaaaaagcacaucuuuggguuuuauaagaacaccucugucucucacucucauucucugaccucuacccuggaagcagcaauugauugccuccuaugauguauucauccugagcugccgguaaacauccgcugucuccuuauuagcuaaaacugaauaaccucauauugaguggguaguagaguccagguuugcuauaaugcaaagacggcuuaaccucauuuccggcucuguuuaaguggagguguauaugauacccaucucuacgcucaagagaguaauugagcuaauuuucaucaacuaugugacagagugggaacaauucucuuucuucugcuagagcaauaauagauuggucaggaaugaguugucaagcuguuggccucagccacuuguguuaggaugaagaggagcuuuuguguaucaccuaaucuucucuaauggcaccugguuuccuagcauggaagcuuccuguggaacauauuggcgcuuggaaccagaaggaccuucgagguugccugguccaguuugccacccaaugcaaagauagagaucuccacagcauucuugacagguagccagccagccuuuucaugaacacaccuccaguaacgcagagaacaccaccaaucaaggcauccuacuugauuugggggcagcuccaguuguuggaaaguaggucauucuuccucuguggaugugucuaaggguuuugcauugaggcagcuggauuuggcacauggucugguuacuuuccuccagaucugaugauggcaucuucgugcaggaauuuggcaaaggccaaaugaggcagguuacccugcuucugucugagccuccugacuuuucuuuucauccugguuuugguuaucucccuucuugaccugcggagcagguaggcagagccacuuccacucacacaccugccaccuccgcucucuaguccuuugugggcuacuauaaagccuucacuucucugcaauugaauaaacacccgagccugcccugcccuggguaaacaagguggggggcuguuucuuugccuguagcauugaacacuguaauaugacuucuucauguuuccugggguccucacaaggcaugguucuguuccuuccucuuuugccucagcccaaaugugucgcaucaaaagcuggaguuuagaacauucugacuggaagugcuauuagagaccauguaguacagcaauuccuggacaggcuauggggccccacuagcgggcugaggcuagcugggagaaagggauggcaugacagcuggccuuccaggaacugugcauaagcugcagccaacuccuugugcugaaaugauggcuuccacaucuggaucugccuuugucaaugucacaugugagagcccgugucaggguugagagaggcgaguugagaacucuucaaucucagucccuucauuucacuaauugcuaggcaugguguucauuccuuuggggaggaaaacacacgggcauggcuccaccucaagagcuugugcuuaaauaacacaauaaugaugucuuacuuguuauaacacuuuuugaaagggguuuugcauguauuaucuuauuuaauucucauaccacucuugugauguagauuauauucuccccauuuuacagauauggcaacugaggcucagagcaauuaggacuugagcccagccaaucacacaauugauggccaagccaagcagcacuaaucuugagagaugagguuaaacacacagucgccccuacacacgggguuaggacagacccugugggaugaagcucuugauaauggaguucccggcaggccuuuuugaaauuagaaugugcuuuguucagcaagcuguggcuaaauuagagauguugcugguguguucuagugacaccagugacuugauuuucacccagaaaaggcagcagguuucugcccuugacugccagcuagguaggcucaugaugccuucuaguuucagggaguuccuguagcuuugaucuuuguguccucggagagugacaaauggggcagucaggugaguagagcugaggccaugaaggcagccuucuaccuuuuccucccuguuccccauguacuugauacuuaaugucagcaggaccaccagauuugcuuucauacgggacuggagaaacagacaaagggaaugggaaaaaagcaaaaagaaauucugauuugcucugggcucugggaaaaauccuguuaaaauuacccuuaucuuagggcuagccagaugggccgcccccugcuggcagggcugggagcugucuccugcuuguagaugagggacuucgauguugaaguaugguguguucauucaagaaguauuuaguggaauagucagcacagcacuagauaucgauagcugauaguuauacaacuuugcacugcaguucuaauccccaaaguccucugauucaucuuagaggaaggcguugcuuuucuguguuccauuucucugacauccguucuuuuccuguuucuugccuucagauuuaaaggcccguaagcagaagacuuccuccucccaaaguuuggagcaccgccucaggaacaggaaccuucucuugcccaacaaaguccaggggaucucggauucaccaaacgguuuccucccaaauaaccuggaagagccagccugccuugaaaauucagaaaagccaucaggaaaacgaaagugcaagaccaagcacauggcaaccgucucagaagaggcaaagguguguagcuaucaagggguauuguagaagguguguguggcggggggucagaggaggcaggaggggggugggggauggggaggaucaaauuaacccauauuuaguaaggcauucucaaacuaguucucgaaggguuggggguggauuugaagaaugggaacuaaaguuauaguuaauuuuaaggucuggcccaugauggcuuuuccucuacaaucuuuagauuuucuuugaguuaaggaagaguuaaagaauauggcaggauguuagcuugaguagcucguuaacauccaaucaagaagcuuuugucuggguuuaacuuacuggaaaccaaucuuggaacuuucugagucaaucaagguagaaaacaacuuguaggaggaaggauuuuaagguccagacaaagguugauugagggugaggcugaaggaauuccacuggggcccagguucuagcuacuccuccccuacccugcuucccaguucuuuagcuucucauggaagcguagaugcuagugagugggcagucaccaaucaacagccaggcaagcauuccuaaaacccucaucccaaaucaacaucucuuuugggucugauguucaugccauugguguuagguugcauguuguauccuuagaaaaaaucagucuucaaccuggguuaacuuuacauuugagagaagugaggguccggguucaaauguauaccuauaauauguauuugucauugacagccaaaaacaaaagcccaucuucagcuuguuuugguggucgugauucuuauuuuuuuuuuucucucucucucucucucuuuuugagagucacacgcuuucgcccaggcuggagugcaguggcacgaucucggcucacuguaaccuccgccuccuggguucaagcgauucucgugccucagccuugugaguaacugggauuacaggcgcccaccaccacgcccggcuaauuuuuguauuuuuaguacaaaaauacaaaaaaucaccauguuggccgggcugaucucgaacuccugagcucaagugauccgcccgccuuggccucccaaagugcuggaauuacaggcggaagccaucacgccuagcgcuuugguggucaugauucuuacuggaauccccgaauggcacuggcaagaggugggagccccaagugcucgucuccccuccuuuccccuucccccucccagaaccucuuuccagcucagacaagacucaagcuuauuucuucaucuugaagaauggagcugcugcuucaugcccuuucugucucacaagggugcuugggggaacaaaggaagcaaugucugugacaggcuuugauaaccauaaagugcucuccgaggguugcugugcaucauugugcuucgggcggaagcaagaaugagggaacagaggcauagcguggcaggguagcagcguucguucccuugacccccuagagugggaggacaggggcccagggaaagagcagggaacucuggucugugccaagcaguucauucacguuaucgcucuuaauucccgcaguggcacuugggagguaggcaccuuuauuauccucauuuuguagugaggaaacugaggcucaaggagguuaagggacuugugcgagguuauugggugguccugagugaugcaguugggacgugaaaaaggccugucugccucuggagccauggcucguuccauaugucucucaggcucugaauggggggcuucuguuuguauuugggaggcacugggggaagggggcaguugggcagaaaaugcugccuccacaagcagcgcugggaaaaggugggcgucucaggcuccugcucccccuccccuucccccuguuccucccccagacacucagauggauggccccagcccacacaaagguaaccagcgcucgagauucagcagcacacucacaugcuucugucuggcuauucugccuggcaguggguccgcugcaguguucuccuggagagguuuuugucccucccucugaccuuccuuucccccucccaccuuccuuucucucccagucaccaccaccugcucugguugcccccauggcauggggcuuuguagcaggaagcaaggggugggggagggcggggaacgcuccugcaacacugaaagcggggcacuggccaagggcuucuucccacaggggcucagagccagggggaaggagagagggggagggguccccccacuuguucuugcuccucccccucccaggcaacuugccucgcugcugcucucuggcagcuuuggcccccagaaaggagagucacccuuugguuccuggcuuggcuuagugaaacccugguacuuuacccagcauccuccaguccugccauuguacauucuauccuccuggcgauaaagcagcauuguacccucauagcuagugccuuccugcuagggcuuguaccucucugcccuuucaggauggggacugaucauggcuucucgcugucuugggauugaccagaggaaacaaaugccccgagcccucaucuucuguucucuacugcuccuuuccugacuugaugucuuuuuaggcaacuuuucuggccauccagggcucugcacacagcuggcuugaaacaggucaacaaauauuuguuguaauaauguggccaggcgcgguggcucacgccuauaaucccagcacuuugggaggcugaaacagguggaucacaugagaucaggaguuugagaccagccugggcaacauggugaaaccccgucuguacuaaaaguacaaaaauuagcugggcgugguggcaccugccuuuaguuccagcuacuugggaggcugaggcaggagaauugcuugaaccugggaggcagagguugcagugagccaagaucgugucacugcacuccagccugggugccagagcgagacucugucucaaaaacaaacaaacaacaacaacuaauaauaauaaugugcccagcccugaguuaagugcuguaaggaacagaaaaaugaugacaauaugaacccuguccccaaggagcuuaaaaucuagcaggagaggugagacuuacgcgugaaacucuggguggaaagaagaaagugaggcaucagauuacgugguucagacuugguacucuggcuacacagaggaagagggcccagaguguuguggaauaugguagaagacagaggauugaacugagaccuugauguucugagggguuuggauaagucggaaauacuaguuaucuauugggguauaacaaauuacuauacaacuuagcagcuuuacacaacaauaagcauauguuaucucacacaguuucuuggggucaggaauucaggggcuuagcuaggccuggcuuggggucucucgugagguugcagucaggugucagccagggcagcauuccucugagggugugacuggaggaucugcuucugggguagcuugcucgcauggcuggcacauugaugcugguuguuggcaggaggccuccucucccugccccauggaucucuccagugggcugcucaaggguccucaggacacggcagcuggcuuuccccacgagugauccaaaagagagcaaggcagaaaccacagugucuuuuaggcccuagccucagaagacaccuacugucauuucugcagucuccuguugguuacauaggucagcccuacucacuguaggaggaaggugcauaagagcaugaagaucaggggaucacuggggccaucuuagaggcugacucccacagucugcccucuggccucccccagugauuccugucccucccacaugcaaaguaugccaccucucccagugccccccaaagcuucauccaauuauagcaucaccuccaggucgagaaucucuucuauuuauuuauuuauuuauuuauuuauuuauuuauuuauuuauuuguaauggaguuucacucuuguugcccaagcuggagugcaguggcucuaucugggcucacugcaaccucugccucccagguucaaguaauucuccugccucagccuuucgaauagcugggauuacagguaccuggcaccacucccggcuaauuuuuuguacuuuuaguagagaugggguuucaccauauuggccaggcuaaucucgaacuccugacaucuggugauccacccgcuucagccuuccaaagugcugggauuacaggugugagccaccaugcccggcaauuuuuuuucuuuucuucucucuuuuuuuuuuuuuuuguaacagagucucacuccaucacccaggcuggagcgcagugccgcaaucuuggcauacugcaaccucccccucccgggcucaagugauucucaugccucagccuccugaguagcuggaacuauaggcguguaccaccacgcccagcugauuuuuuguauuuuuaguagaggcuggguuucacuguguuggccaggcuggucuugaacuccuguccucaacugaucugccugccuuagccucccaaacugcugggauuauaggcgugagccaccgcucccggccucuccuaguguuuugugagcaccuacccugcucacaguucuggagccuuuguaguucauuaucucaaagacccugcaaggaagaaaguggggcucagagagggagggccuugccccaggucuucuagcuaggggauggcagaggcaagguucaagcccaggucugccuuagaucuuucuaccaccccaggggagucugaguaugauauggggacacagugugauggaagaugggaacauucugugaggacuggauguggaaggaagguuuuugcuacaagugugaagcuuuagcagcugugacuagucaaagauagccggccgggcaugguggcucaugccuguaaucccagcacuuugggaggccgaggcaggcggaucacuugagaucaggaguucgagaccagacuggccaauguggcgaaaccccucucuacuaaaaaugcaaaaauuagcugggcaugguggcgcauaccuguaaucccagcuacucaggaggcugagggaggagaaucccuugaaccugggaggcagagguugcagugagcagagaucacaccacugcacuccagccucagugacaaagugagacucggucucaaaaaaagaaaaaaaaaagauagcugucucauuucucuuuacucucagaguuugcuucugccuauuuacagauaggacuuauaaaaaccucaauaaauggugauugaggcagguaaagaaggcaugcagagucuugagagaagcuaggauauccccucaaucucugauuuacaaucccuguggcauuccuugguuuaugggguugagcauuugaaccucuucauaucuccccaccggcuacaaacucaugggaaccuguguugauccuggagagacuucacaugguuagcgccuggcccagcgucuggccucaaaccugacaguagucucggccauuuaggguaguguaagcaaaguacagcauggacacagauaaggugagauggccuuggccacugagggcagugaugacccugguggauggauaagcugccuggccugaccugaccuaggacugcaucucugcuuuccagggcaaaggucguuggagccagcagaagacacgaucucccaaaucucccaccccagugaaacccacagaaccauguacacccucuaagucccgaagugccagcucagaggaggccucagagucaccuacagcccggcagauccccccagaggcacgucggcucauagugaacaaaaaugcuggugagacccuccugcagagggcggcgcgucuuggcuauaagguaagggaguuuucgacugaccacagggcgccguuggucugagcaucuaugaagaagcuuuucuccaugggcucuucuggugcuugaacccaggcuggccucccucuacaccccagauugcccuggggcugccuugccccucaucacuuggaugucagcgugugagaaugcaaacuugcuugaaugucaauuugggaugaaugcaauugaaaugguaucaugcaguauauuccuagaccaggaacgcaauuuuuggauauccacguugucuuaaauuucucuguauggugguuucccaacucagaaaggaacaaggggugauuuauugcucacucuucaucuccuccuccagcuuccccucauuuucgccucucgcagaggggccaggaucauguuugaggggcgaggcugagcuaaccccaccuuauacuacuacccuauagauuagaaagaaggcaagaaaggaagcuggcauuuauugagcacuucuuuugucaugugaagagccugauuacuuuguaucauuuaaucucacaguaagccgauggaguagauuuauuauccccauuuuauaggugagaaaaucgaggcuuugcaguguuacugauaugucuaagaucacucaacuacuacgcauaugagucugaauucaaaccaaggucuuuugauucccaagugccaggguagguggaagacugacucauucaccauaauucaguuacaccuuggacguuuccauuguuccccacuuuuuauugaguguguaucuuugccuaccauauggauuauuuccucaggguaugcuccuagcaguggaguugcuggguuaguuacagagugugccuuugguuuuaaggcuuuccaucccuauaccugaguuguuucacaccagccacacucccagccagacuggucagcucuggggagcugacgugacagugucucacuggcaagcagcccaucuuucaugagcaccuagugugcgugccuggauagcugccgagggagaccuaaaacaaaaaucaagaccaaucccugccgucaagguuaauuuaauugucuuguacccugggcaaaaccagccaacaggaaaccauuggaggggccaaugggacagggcuggagcacuaaggcagccugucagggaggguggaaggagcccuuuugggccugggggaagaggcagacaucugcacuggugaggagggugggaagccucgggcuuucucccggguaaaggagcuugacaguuucuauauacagccagcagcaccccugacacaggcugcacacacagccgcucuagccagcuagccugugagcugucagacagaaagguggaguggcccaucuccccagugccccagagaggacuggcaauggugcagcuaugggauccauuguuuggaaagccaggcagccauuaaugcugccagccucuccccuccucaccucauucacccagcuucagcccaugcuagcuagggugcuucaagucccuggugucccaccuguaguccuagcaucaucucaauccaaggaaggcagucauuaaaguguggaugaauggcaguauuggauuauccuuuuuuuuuuuuuuuggagauggagucuugcucugucaccuaggcuggagugcaacggugcaaucucggcucacugcagccuccaccuccuggguucaagggauucuccugccucagccuccugaguggcugggauuacaggcaccugccaucacacugggcuaauuuuuguauuuuuaguagagaggggguuuugccauguuggcuaggcuggucucaaacuccugaccucaggugaucugcccgccucagccucccaaagugcugggauuacaggcgugagccacugcacccagccuauuggauuauccugauuugaggggagggcuagaacugacuguccuggcuugaacauugguccugccgagacgugcauccagggauaguccuuaaaacaauugucuuccuuauucuugaauugccaccagaggcugugcucuccaccacaucucauuucucuggucuggggcuggcuugccaagcucagggagucgaggucugagugcuugagcucugggcgggcaggucagccucucugaggaccucaccucaaauaccaccacccagaugaguguccuuggccauaaaaaaagucucuccaggccaggugcgguggcucacgccuguaacccuaacacuuugggaagccaaggugggcagaucaccugaguucaggagcuggagaccagccuggccaacauagugaaaucucaucucuauuaaaaauacgaaaauuagccaggcgugguggcgugcgccuguagcuccagcuacuugggaggcuaaggcaggagaaucgcuugaaccugggaggcagaggcugcagugagcugagauugcgccacugcacuccagccugggcaacagagugagacugucucaaaaaaaaaagucucuccacugccaaggaaacggcccagagcugggguccuggcaauuguggcucaggacugauguuguuaaugaaagauuuugaagugugucccugcuauaaagggcaggcucugagacuccucagauauuuggggagcuuugagucucaggguuauauaaguucaagaauuagaccucucuuugcucauggaguugucccuguccccacaggauguuguucucuacugccuccagaaagacagugaagaugugaaucaccgugacaaugcuggcuacacagcccugcaugaggcuuguucccggggcuggaccgacauccugaacauccugcuggagcacggggccaacgugaacugcagugcgcaggacggcacgaggcaagagggcugcaucuccccccagucccgcccucacucccagcucagccucucacucaaaagaccuugccugccgcuggcaggcaugguggcucacgccuguaaucccagcacuuugggaggccaaggcgggcggaucaugaggucaggaguucgagaccagccuggccaacauagugaaaccccaucuuuacuaaaaauacaaaaauuagccgggugugguggcaugugccuguagucccagcuacuaaggaggcugaggcaggagaauugcuugaacccaggagguggagguugcagugagccgcgaccaugccauugcacuccagccugggugauggagacuccgucucaaaaaaacauaaaaaauaaaaaaauaaagaccuuaccucaaccugaaccuucguagcacaccagacugcgaguugcagagaggccuugacaggaggaguuuuggaaagacuucuauaggcucaagagggaaccaguuuagggcaggagccaaugaguuaguucccagauggccaggccgcaucaguuacuaaggggaggcugugguugucuagggaucaucccaucauguguagcugucaccaggaagaccacucggucuucccucaacucauccuggugggggacgugucucagacagaauagaaacugagagguugaccugaggguaauauccagauuugauuuuuaaaauuugaucucuagacacuguaagaaaaauacaccugcugugucuuagagaaauuguacccauucuccucuguucuaccagagagccuacuuccugggcaaauuagagacaggagcugcagauccaggagggggcuccgcuuggguucugccuggcguguggagcccuucugcucaucucugcucucagggagucacccagggccuucaguucccugaacugaaguaucccucuacaguugcccccaccuuuuuuuuuuuuuugagauggagucucacucugucgcccaggcugguaugcaguggcacaaucuuggcucgcugcaaccucugccucccgguuucaagcaauucuccugccucagccuucugaguagcugggacuaugggugcccgccaugacgcccagcuaauuuuuggauuuuuaguagagauggggcuucaccauguuggccaggcuggucucaaacucuuggccucaagugauccaccugcuucggccucccaaagugcugggauuacaggcgugagccaccgcgcccggcuucccugcagcugccuuaacuuuauuguaggucagggacccauccucuagugaacuccacaacuaccaauagagcuacauugugccaugggaacugucccaagaugucaggggaacguaagagagagagaguaaugggagggaggaaaaggggguacagagagaggaggaguuggggagaugguaguggagaguugcaaggcuacaggugguucccuuguccuaagucuuaaaccauauuacaccaagguuaccugggggucagcucaguuuuuuccccugaugcaguagccuuaaguguagacaccccaguucccacuugggcccuguuauccucacccuguaucaccuccacaggccaguucaugaugcgguggucaaugacaaccuggagaccaucuggcuccugcuguccuauggggccgaucccacacuggcuaccuacucgggucagacagccaugaagcuggccagcagcgacaccaugaagcgcuuucucagugguaagcaugguccagacuugacacuguuguccuuggggccagccucugauuccugaacuugugaggacauccucuucaucuccuuccaccuugaacagcucccaugagggccaucugcccucuucaccugcuuucauucaaagagcucaagaaucucaguuugcuugaaaaaguccaaaggccacuuccucuuauccccuuacugcaagugugugcguccucuucagggcccugggagcccacagggaccuauuucguagcuagggaucuagggugggccucugugugggggcggcagccccacuaguagaccuagcugggggcagaauguguugaccugugcuuugaaugggaugucaguugcaacaaagugauacuuagcauuuugcuuauguguuugcaauuucuucuuguuugugaucaaguggaucacaguggaaccccugggaugcuucccgaagcuucauucuuuacagcccuugccugugggaacugugauguucccucugcaucccagggucccccuuccuuccguuccuuuuccucccucaccugccccuucuguaaagugucugguguugaggcccauggcaagggccacaagccaacaugcauuuauuuucucauuaguggauagcagcuguuugucugcaguuagauagcucuacugaguugggcagggggaggagggaaggaggggagucuagcuugggcaugcucaguaggaaucuccucagacuugaccucugaauaaaggaacccugccucuuagugacaucacaguuuggcccuugcucuagcagugacuucuucagacugccugagcggcggagcagcugggaguuguaucucugaaccuucuuggaggcugcaguguuuguauugugguuagaaccccucucuggccaggagccaacaggacuaaggauuggcccaaagcugcucccucuucucacccagacuuuggcccuaguuagccccgaaccucuauaccuccagauauaugguuccaggcucccaaccaggggcucauuuguuuauccaacaaagguuaacuaaguagcugaugauggaggaagaaacaaaggggaccuaacuaaaggcucuuauggaaggggaggacuagguaggcggugagugggggguaauaggaggcugucgcgggagaucuugacuccugcucagccagccuccacccaggucucagcugagcugacuaaaccuuggagcacaggccuuaggccuguacagccugacuagcaucucccaggcugggggcaggauggcugccuuuucuguuuucccucccuccagcucuggguucccaagccccuguccuugaggcgcagagcagccuuggaauguucauucagucauuuguccugggccaguggugacuguuguuccccuuagcugaaccaucccuaggggugcagggcuuggggcaagccaccguugguagcugccucccacguacuguguacacaugcacucucucuuagacacauacacguguuaucugcacuccacuggauucccaggaaaaucugagaccaacaagcauccagagcaucuugauaugacaaaggcaccacacgcagcucugucuuugagaaaccggucuagucccgaggccuccuuaggcuagaaacugccaucccgagggucucaggggcuccuagaucuaaauaacacugugaccaccuuaguaaacagaugaacucuuugcuuccccaaucccuucuccaaaaccccuaaggaguaggaauguggaaaccauuuuaaguaguuaaaaaaugggaaauaggccaggcgcaguggcuuaugccugugaucccagcacuuugggaggcucagguaggagaauugcuuccggccaggaguuugagaccagccugggcaacauacggagaccuugucucuacaaaaaaauuuaaaaauuagccagguauggugacugcacuccagccugggcaacagagugagacagugucucaaaaaaaaaaaaaaaaaaaaaagagacagagaggagagaaauaaacacguuucucuuaucuuucugucuccucaucccaacuacuagcuaucuuuugguuuuguuuuguuuuuggcgcgaucuuggcucacugcaaccucugccucccggguucaagcgauucucauuccucagccuccugaguagcugggauuacaggcauucgccacuaugcccggcuaauuuuugaauuuuuaguagagacaggguuuugccauguuggccaggcuggucucgaacuucugcuagccagcuuuuugacaccuccugaaacuaaauugaaugccagucuauguugcagaauucagagaagacuuuuauuuuuuuuaggcggagucuugcucugucgccaaggcucgagugcaguggcgugaucucagcucacugcaaccuccaccucucggguucacaccauucuccugccucagccucccaaggagcugggacuacaggcacccgccaccaagcucggcuaauuuuuguguauuuuuaauagagacgggguuucaccauguuagccaggauggucucgaucuccugaccucgugauccgcccgccucggccucccaaagugcuggaauuacaggcgugagccaccgcgcccggccccagagaagacuuuucuuaacucuaguacuucacauauuugugguguguguguguauguacguauauguguuuauauauauuugagacagagucuugcuguguugcccaggcuagagacuccagcacuuccuaacuuguccuggcugagcaccuuuauuuagauuuguuaaaaauuacuagagacagugucuugcucugucaccgaggcuggagugcagugguacaaucauagcucagugcaguuucaaacuccugggcucaagcaauccuccugccucagccucccaaguagcuaggaccacgggugugugccaccggucccagcuaauuuuguauuuuaucuuuuuguugagauacgggguuugcuauguugcccaggcuggucuggaacuccugggcucaagcuaucuucccgccuuggccucccaaagugcuggaauuacaagugugagccaccaugcccagucuucauuuagaccuuuugcucaauuuaugggcaugaaucaggcuuaauaaugggagucaggagccaauggguugcuauaaagugcaccagcucuuuuccaugcaaaggcagccugggaccuuggccuaccaccacaggaaggcaggcacuggcaggagucagcaggcucucaagaagcagggggcccuuaggcccaaaggcuguuuguagggugugugagaggacagcacucagggacuuuuuuaaaaauugagguaaaauuuaccuaacauaaucauuuuaaagugaacaauucgggccaggcgugguggcucaccccuguaaucccagcacuuugggaggccaagguggguggaucacuugaggucaggaacuggagaccagccugaccaacauggugaaacccccucucuacuaaaaauacaaaaguuagcuggaccgugguggugcaugccuguaaucccagcuacucgggaggcugaggcaggagaauugcuugaacccaggagguggaguuugcagugagcugagaucacaccacugcacuccagccugggcgacagagcgagacuccgucucaaaaaauuaauuaauuaaaaaaaauaaagugaacaauucagugggauuuaguacauucucuuuuuuuuuuuuuuuuuccugagacaaaucucacuguuacccaggcuggaaugcaguugcaugaucucagcucacugcaaccucugccucccagguucaagugauucuccugccucagcuucccgaguagcuaugacuauaggugugcaccacugugccuggcuaauuuuauauuuuuaauagagguagguuucaccauguuggccaggcuggucuccaacuccugaccucaagugauccgccucccuuggccucccaaagugcugggauuacaggcaugagcuaccgcuccuggcccauuuaguacauuccuaauguugugcagccaaccucaggggcuguuuggaugccuugaacugaguguuuggcucucauuuuucaugccugugugccucccugccaaaucuccaggaaccacuggguagguugguaggguggcugcaggaagcacccgaguguggagacuggaggcuggggaagcuuuucccuccacugcucugccuccucagccccuacaccuagauacauuuacauggacuucugauuuauuuauuuauuuuugagacggagucucgcucugucgccaggcuggagugcaauggcgcaaucuuggcucaccgcaaccuccgccucccagguucaagugauucuuuugucucagccuccccacuagcugggacuacaggcgcccgccaccaugcccagcuaauuuguuauauauauauauauauauauauauauauauauauauauuuuuuuuuuuuuuuuuuuuugagacggaggcuggaaugcaguggcaggaucucggcucacugcaagcucugccucccugguucacgccauucuccugccucagccuccggaguagcugggacuacagucgcccgccaccaugcccggcuaauuuuuuuuguauuuuuaguagagacaggguuucaccguguuagccaggauggucucgaucuccuggccucgugauccgcucgccucggccucccaaagugcugggauuacaggcgugagccaccacgccuggacauuuguuguauuuuuaguagagacgggguucaccauguuggccaggauggucuugaucucuugacucucgugaucuacccgccucagccucccaaagugcugggauuacaggugugagccaccgcgcccagccugauuuuaauuuuuuuacuuugcugucuggcugagguauuuaaaaugcuuuuggcuuuuuguccccaagcauuugcuugacuagacccucuguugauuaauugucuucaucuuccccuaguggaguccagcugggcagaaaaugaaggagaaucccuuuagggugcacagggcuccauuuuuggcgggaggaaaaggugagcauuagcgucaggguuaugccucauguagcgcuucccuggcugugugcaaaggccccuguuguggaaaguugucgggggaaucaaauccuuuucucuuuuuucuuuaauuuuuuuuuuuuuuaagauggagucucgaucuugucgcccaggcuggagugcaauggcacgaucuuggcucacugcaacuucugccuccuggguucaagcgauucuccugccucagccucccaaguagcugggauuacaaacgcccaccaccaugcauggcuaauuuuguuuuuucaguagagaugggguuucacaguguuggucaggcuggucucuaacuccugaccucaggugauccgccugccucggccucccaaagugcugggauuacaggcgugagccaccgcgcccagcaguaaauccuuuucuaaguacaaagaaaugucacuguuuuccgguauccugaagugaguccuuuuguaaagcagaagauagauaauucaucuggguuguaaauguagauuuucuuauauuggguugacuuaaggugaggcccauuucuccugagaucaugaaggauggaguggcacuccuuuauucauucguucauccguccauuuagugagcaccuauuagauuucaggugcuguccuggguacaggaggccagacggugaacccuuucuaccucaugcuugggcuuggagcgccaagccauccaaacucccugagaggccucuggaaggccucccccuucagccaaauuacaggcagguaugugacugauuuaccuuugucccuuugaagaagagagcaauauccaagcuggcugaaggaaaacagacuuguuuuuccucgucuguuggaaagaauguagggcuuacccagaguugaugcaguuugguucgggacaucagaggaaguaucaggacacucugccuuccaccuaugaaaggguuaguaguuuaccgcuugaagucacugaaucacagguuauuguuuuuccugcuagauaccucugccauaugaccccauguugaagaccacuaguuuuuuguuuuucucaucuuucaagucccucagcuggugagugaguuagaggagauggggagggguaugaucggacccugaggaguagacaaacugcugggguagccucuugaauugaggugagaggcucuauucuuaccaugaggccugagggugcuuuuuauuuuuauuuauuuauuuacuuauuuauuuauagacaaggucucacuuuguuaccuaggcugaagugcaguggcgcagucugggcucacugaagccucgaccucccggguucaagcaauccuccugccucagccucccgaguagcugggauuacaggcacacauuaccacaccaaaauaauuauugcauuuuuuguagagacuggguuuuaccauguuacccaggcuggucuugaacuccugagcucaggugaucugccugcccuggccucccaaagcacuaggauuacaagugugagccauugcacugagcuucugcgggugcuuuuuuaaaaaagaauuuaucgagaugaaauucaugcaacaugaaauuaacaauuuaaaaggaaauaauuaggcuggucacauuggcucacaccuauaaucccagcacuuugggaggcugaggcagguggaucacuugagcccaggaguucaagaccaucaugggcaacagagugauuccucaucuuuacaacaauaacaguaacaaaaauuagcuggguauguuggcacauaccuuugguccccauuacuuaggaggcugaggcaagaggaucacuugagcccaggagguugagguucagugggucguguucaugccacugcacuccagccugggugacagagcaagacccugucucaaaaaaauaaaaacaaagcaaacaauucagugacauuuaguauauucacuaucuugugcaaccaccucuaucuaguuccaaaacauuuucuuuuuuuuuuucuuuuugagacagagucucacucugugacccaggcuggaguggugcaguggcgugaucuuggcucacugacgccuccgccuccgccucccagguuuaagugauuaucgugccucagccuccugaguagcugggauuacagacaugcaccaccaugcucagcuaauuuuuuuuuuuuugagacggagucucgcucugucacccaggcuggacugcaguggcgcgaucugggcucacugcagccuccaccuccuggguucacaccauucuccugccucagcuucccaaguagcugggacuacaggugcccaccaccacacccggcuaauuuuuuguauuuuuaguagagaugagguuucaccguguuagccaggauggucuugaucuccugaccucgugauccgcccgccucggccucccaaagugcugggauuacaggugugagccaccgcgcccagccucccaaacauuuucaucaccccaaaauaaaaccccacacccauuaaacagcuacuccccauucccccuuccucccugccccccgcccaaccacuaaucuuucugucucuauggauuucccuauucuagacacuucauaucaauggaaucauacagcauggggccuuuugugucuggcuucuuucauguagaauacuguuuucaaggucuagccguguguuagcagguuucaauucuucauuccuuuuuauggcugacuaauauucucuuauguggauauauacgccauugauggacauuugggcuguguuccccuuuuggcuguucugaauggggcugcugugagcacgcauguacaaauacuuguuugaguauccauuuucguucuuuggggcauauaccuaggaguggaauugcuggacuuaggguacuuuuucaaggaaaggauaagagaaaagggcuggaagcguggcugggguggagggaaucaagggaaaggaaggucccucuucaucuggacuguaugugaacguccgugaggaaaugguaauggaagccacaccaccgaccaaaucuuggagcuccuccugugugccacucaugggccuguuugagcuuuagcuucuuugcucacgccaguuaacuuuuggcugucucaaaaaggcaaauucaccugcaaaugacaaagauugguagucagugaagagaauuagaggaaugugccagaggcuuugaaggaaguucccagagaggagccccaggaauguggugaguuagggcugcuccgauggaauccuuguguguccucuuguggggaagggggacagcagucauuugaaugcauguguuucggcauguugguuaagcaagcacuuucuagucucgccuuguaggaauuccucccuccuuuccucuccauauauuuauuaagcucuuacuaugugccaggcacuggguuuagguacggcagagacaauggugaacaggacaggcauggucccugucuuuuuagaacuuaugcucucacuccauaaucucccaugacaccuaacacagggcuaggcacagaagacacacccaccuaacugacaaauguuucuggaagaaacuacuuccaacccucaagugacaugggguacaaaggagcaccugagccgacagcgggacugcaguuguuuuucagggagugcacagaagaucuaaugugcaugacuagagguuucccacucugguugcucagccaugacucugaaagcuucucucuggcugccuuuuccuacugggggaaacccgccaucaccuggaagguugcuaaagaaaugagucauuucaguagcucacaaugcuaauagguguucuugucgauaggaugaucccaaagggauauugggucaugguggugcuucgcacugggggaaacuagcucugcuccuuuaaguuggcugccaacuuccuccugggauuugcuuucuggggggcacccucaccucaccugugcccuuuggacugucuccuguccgguugccuagcugucaccugagggcugguggcaaucauacacaacuaagucagcuugccaguuguacaggguggcauauugguugagccauguguacccuuagaugguacaguuggauuugucgugaaagccaauggaccuacuuuuuguucagguaggaauaagaggugaaacaauuccacuagguagugccuagcuaaugaggaggcuaagcgguggccuuagccuccucauuugucuugucuugucuguagagcaaguaaacaaaagauuguuaaaacuuuuauuguggucaaauacauagaacccaaaguuuacuauuuuaaccauuuuaaaguguacaauuaagugacaguaaguacauucacaauguugugcaacuaccaccacuaucuaguuuugaaacuuugucauaauuuuaaaggaaaauccuguccccauuaagcauacccucccgcucucccccaggcccuggcaaccaccaaucugcuuucugucucuaugggcuugccucuucuggacauuucaucuuaauggaaucauacaauaugggaccuuuggugucuggcuucugucacguagcauccauauggguagcaugugucagaaucuccucuuaaaggcugaauaauauuccacuguauggauauaccacauuuuugucuguuuauccauucauccauugauggauguuugggcuauguccaccuuuuggcugccaugaauagaacugcuaugaacgugcacacagagagguacuugucugacaaccuguuuuuaguucuuuuggguauauagcaggaguggaauugcuaggucauaugguaaugcuguguuuuaccuuuugaggaacgaccaaacuuuuccacagcagcugaaccauugaguauuuccaucacaaauuucaucaguuggugggcauuuggauuguuuccaccuuuuggcuuuugugaguggaguugcugugaacauucauguauaaguuuguuuguuuguuuguuuguuuguuuugagacagagucuugcucugucacccaggcuggaguacaauggcauuaucuuggcucacugcaaccucugccucccagguucaagggauucuccugucucagccuccugaguagcugggacuacaggcgugugccaccaugccuggcuaauuuuuauauuuuuaguagagacuggauuucgccauuuuggccauggcugguuucaaccuccugaccucaggugauccaccugccucggccucccaagguguugggauuacaggcgugcgccacugugcccggccucauguguaaguuuuuguuugaacaccuguuuucaguucuuugggauauauaccuaggaauggaagcaaaaggauuuuaugaagauaaaccuggccauuuccccauguucuucaaaaaugaaccagaaggacuuaugcuuauuuauauuacuauacauuggagagauuaugauucgauaaaugaacauugugaccagcagggaauuaaaauccugggauaggucuaagauucugcuugcaggguuaaagcucuacaccguauaaaguggaggucccaaaccuaaaugccuucaggcuuaaaagggagaagcaggcuggguggggaguggcgaauuggagcccagcccgcgugugucccuguucccuccagccagcuguugacaugcaggaauuuggacacaauguugccagaucagauuuuuuuuuucacagaaauauugggaaaucuggauuuuuaagugaaauugcccaauuuaaaaaugucggaaguggggccaggcaggguggcuuaugccuguaaucccagcacuuugggaggccgaggugggaggaucgcuugagcucagggguuugugaucagccugggcaacauggugaaaccccauccuuuacaaaaaugaaaaaaaaaguauuagccagguguggugguaugcaccugcaaucucaguuacucgggaggcugaggugggaggaucacuugagcccaggaguucaaggugccgugagcuaugaucaugccacugcacucuggguggcagagcaagacccugacucuuaaaaaaaaaaauuaaaauguuggaagcaaauugggauuuuuuuuuucuuuuaaagcacugggucaaacacuaggcagucaguggguuagauuggucuccuguccccuuguuggcagucucugacugagaacaggaagugugugucucucuggucacuccuggacucucuugugguccuuccuucccuucucccauucccuuagccccguaugcauggacuucacuuggacauuccuuccccagccuaaccuccuugucucacugccugcucuucuuucaucagaucaccucucggaucuucagggccgggcagagggugaucccgguguauccugggauuuuuacagcaguucuguguuggguaaguuuuaagugagauucuucccacccuucuucucaaggacaggaguagcccuguggugguaucccuucuucaccuuuuaguggcuuacagacccuuucagaccaaaccugaaccugaacccauccuucccugcagacucagaagucauuugucgaaacugggaaaugcagcacugguuuggacacagccaucccucacuagcccucuaccacuccccacccugggcauuuaaaaaauucucuuucuuccgaggucccuuucuucucccuggcuuugucuuaacccugccagaagccucuaugagcacugucaccuauuccaguauugcucacacucaagagggaccccaccccucaccugagaccuaccauucccucccuacccugcccccacgaugcacacgcaguuuuuggaauagcuacugucuucggagcccuuagccuucuggccgcagcuuuccucuccuggaagaccagcaggccuuuauccaugguggucaucuagcauucgcccuuugggcuagggacugaagaugaaaggaaacacccacuccuacccuugggggaagcuggaggggagaaagucaggauggaaugcaacuggccacacccagaaugugggcuggggaaaggaacccgcucagcccccucugggcuucgugggagcccugcaggcagugagguggcuugggaaagcugcagcuagagaaggacagguguuuuuaccuugcccuugucugcugauaguaucuucaggcuuccaucucccaacagcugagcagcucauccuugacgucaccuugcuuuugccaguuggaggggggagugauauaauaaaucucuggccacacaaugauuucuuucaguacuagaacuuucaugugcccucugaaggaugugagccauggaaccggcaaaccgcaucccugacuaggggccuguggccuugucauuuaccucccaaccaccaccccuccaugccccuuuaucugcuuagcgcauuucuuuucuucgguuuuguacauguaucugaguccuaauccccuauaugcuccccuuacagaggaaaaagacggguuugccugugaccuccuacauaauccuccugggagcucagaucaagaaggagacgauccgauggaggaggaugauuucauguuugaacucucagacaagccucuucucccuugcuacaaccuccaagugucagugucccgcggguaaguguccgagagauccacggugacugagugucaggauccuggcacucaguaggaagguggaguucuccacgaggaagugaagaccuggcaacgagugccaucacacaugacaaaggcuagccugcccuuuuagcccagaguagucauguucaaacuagaggcugcaggcuccauggacauugacuaucugcauuuccugaaccuuaaaucuagauucucucucggaaggcuuuuuuugcacuauuacuggguauaaaagauaaucugagagauacuugggccuaugaacugcuagaaucucuggaacauuuuuguaguuucuggggguaaacagauagaacauuagaaauugagauugcuggaaaagccaggacauaugguugccauagccauggggccacuaggguccuucaguaauccacagccuaguuucucagugcuguaauguuaguagcguggugcugccaacauugucagccuagaugacugugcauauuauauuggggaucacccauuuauuuaaggagacuagaauauagaauauaccugacacguaacauuagauugaacccaauuuaauacuuauuugaugguucuggagggaguucgacagccggcagggccauggcccuuguuggguuuccccacaugucagcguguggaagugcugguugagagaaggagaaugcgggcugaacugcccuuuuauucuuagccuccaugauuuuuucccucugauuggugucuucauguauuucaaauacuuuuccgaacaauuguaaggauaauuuuucuuugauaucuauuuuuaaaaugucaacucuauguuaaaauccugugaaccaguggcuggucgcagcaguuguaauuucagcacuuugggaggccgaggcagguggauugcuugaggccaggaguuccagaccagccuggccaacauggugaaaccucgucuacuaaacauacagaaauuaggcgggcaugguggcgggugccuguaaucccaguuacgagggaagcugaggcaggagaaucgccugaaccugugaggcggagguugcagugagcugauauugccugcuacacuccagccugggcgacagagugagacuccgucucaaaauaaaauaaaauaauaaaauaagucagugaaccagcaugaugugcacaggauggggagcuagguagacgauggaugaggaggucuuuaagugagagccucuguuuagggcucuaaccauuagaccacaguuucuuugcauccccugcccucccccccaccaccccacacgcauagccugaucagaauaaaaauagcauguaugauggcacuaguagggaucaaguuucaggggcuuuugguccuuauucuucugggcauaagcugaucccugaggacagggcggggccucugggauauaguauugcacgguuaauuaauuccuccgauguauucagcaccucccucucugaaacaggaucuugggcuucaggcaguaaaaggaccaggguagucugcauuaggugcagacagaacacgggccacggagggcugcgugccccucagcgagcugaguggcaggcacgugguuagcccagagcccgguaccagcaaagcugguuuuccugacgugacauccucuagcgcucgcucuagagcugccuuuccccacagcugcagcacacugugaaaaugucuguucuucaagaaguugggggugggggugcuagcguagagugaugccucugaggcccuauggggugcagaagggccuucugaaucaccaaagcaagacugaauucucaucacuagugugaauguucucagggcuuuuuuccauucuuuggaagugaugguccaaguguaugauaucuguaguccccuuuucuuaacccagagcccuccauuuccuacucaugugagauaagagcuugcugucauuugggagaaauguuccauuuuagggauaaggaucgugggucugguuagauguuuaaggugcuggaacagaacauuugauucuauaaacaugucuuaaacagcugcaccaggucaaacccuggggaccuucaaagaauccaccaucuagugcaguagacagacaaguauauaauuaacucuaauaaaagacaaaauguccuaagcagauuuauuauaaaaaacuccaacaguuucagaagggugucaaaugcaaaaaguuccaguccacccugagcccccauugcuaugcugcagagugaaccacaguuuaagguucuuuugcaacccuuucagaaauggguuuuguuaguaguauuacaauagggaugugaaucaaaugccacgagaccaugggagauggaagaacaaugaguuacaccgggggaagguuucacaggugauacaguaucuaccugagcugggccuggaaggagagaaggauggagcaaggcacugaaacauacaaguucagaaaguagggggaguccuuuaucauguggcuggugcuugguagggugggggauacaauguggggugugugugugugugagagagagacagagaaagagagagacuggguggacauugggcugaagagguuagaaggucucauauaauaucaugcuaguggccgggcaugguggcucacaccuguaaucccagcgcuuugggaggcugaggcggguggaucauuugacgucaggaguuugagaccaaccuggccaacauggugaaaccccaucucuacuaaaauacaaaaauuagccaggcguggucgugggugccuguaaucccagcuacucaggaggcugagacaggagaauugcuugaaccugggagguggagguugcagugagccgagauugcgccacugcacuccagccuagagacuccgucuuggaaaaagaaaaaaaagaaaagaaaacuguaaugguaacagaagauccagugagggugggugggggugcagaagagugacucuuggcaaagggaaaccgguuaggaggcugacaagacagagcccaggccagaaguggcaaaggcuggagcugggguaguggaauagugaggagggaaaacccugugaacugggaccacuaauguggggaggcagcguuucuucccgcauuagucaauguaagcguuuggcccgggaucggccucuccagcaccccucccagcuguccccaggcugccacccagucgggugugcucagcaaagucagacuccacuuucuguaaugugagcucuggcccugcagaaacgauggugcugcugcuggagaaaaaacuugucuaaugcauuccagagccaaagagaaaugccuuuuggauuacccgcaguuuaggccuuucuccacggcucccccucugcuggggaagaucuuggagagcaaggaggccagggaagcaagaguaagaacaggagaagggaaggcagccaggguuggcaggggcgggagucggaggaaagacuggucccagcagauggcaaaugccaggucacaggggcgcaggcuaaguccccaagaagccugcuaagaguuuuagguucuagaaugccccuuugccuccuguuuguguuauuuuggaagagguggucacugauugcgugcucaccauuuagcugaaagccgggccaggcauugcaggggacaggagaagacauuugccucagcuauacccaaggagccugugguuuagcaggggacgggggagccagacuggcagugaguuauaaugggagacauugauggucgugcagccuuugugggcuuugcagaguguucugggucggugcccccaccgcuuccuccagccuccuucaauaacucccauccuugccuuugcaggcccugcaacugguuccucuuuuccgaugucuugaagaggcugaagcuuuccucgaggaucuuucaggcccgguucccgcacuuugaaaucaccaccaugcccaaggccgaguucuacaggcagguggccuccagucagcugcugaccccugccgagaggccuggaggcuuggacgacagaucccccccaggcuccucugagacuguggagcuggugcgguacgagccagaccuacuucggcuccuaggguccgagguggaauuccagucuugcaacaguugaccgggaaaacagccccuccucuucuuucuccuuccgaguucgcccuucccccaccuccuugucuuuccccgaccgagcaccagacugcagaaugaggcaauaauacggaccaacaagaagccgccuuaucaaugccagcauuagcgacuggacuguuuuuguuuuuuugguuacaauuaguucucaucucccugucgucgucauuguuaucgugguugcugauggggguggaaaguugaacuccaugucugaggacaagaggucccggggguggugggagguggcgccggggucccuuggacuggccuccuuguucaugaccaagaccaaaccugggcccuggauggccuuggccugucccgaggagaaaugagaaaaucccagaucucugagcgccccccaacuccauuccccuguguucuucugucuucuguaguauuuauuuuauuaguauuuaauuuguauuguuucauugguuucugauaagucuguaucacugugacgauuugagacaacuuguuguauugagggacuuucuguaccuccuuuucuuuuucuuuguugaugagcucugacaaagcuauucccugguguuuuuuucccccacuggggagggggugagguggaauggggugggggaacauggacuugugacuaacgaagcugguugcugcuggcccagggcugggggcuuggggguaaauccugaggcuuuggugcucccccacccacccauucccgcccuuugcagcagccccgcuaucuugagauuaguguugacagggaggggaggauugugaggugagggguuaauaaguuacucuaauaaaggagcguggagaagggaucugaggggugaggguggccccccuccucacgccuucuucacugccccccucagagugcacaauacgaguuuguuccugccuccacucucccaccccguucuggccucccugucucaagauacugagccucucaccucccagcccucagccacccccaucccugccccuucugagacucacagcaccccuuuccuuccucuccucccaccuccucccucagccccucauucuccuugggaaucugcagagggcucugggacucacugccggaugugaaauccaggcgucagcuguuuccuaggcaagggcaggaaaguggucuccagcccuugcuccacucaugccugggggccuggggcugagugguaucccuaccuggccucccccuggccucugggccuccagcgcuggguuugucgagugagagagagagaggagcuuggguugcuucccuguccccgcccccucuguggcauugucccucccacucuuauuuuucuaccaauugcuauuuuuccgaacaauccuuguagaguauguaccauccaaaggcaggagggccucgccguggccggcucugguuggagaugguacaguuuuauuguacaggugcuaaaacaacaacaacaaaaaagaaaauggaaaaaaaaaagauuaaaaaaaaaaggaaaaaaaaaaagccaguuugaggaugggacaaucuguucucuagaggcuccugagccaugcgggagcauuggugguuauuuucuuuguauuguguuuguucuuuguuccugggggggaaguucucggcccccuucuguaggacugcuccccacccccaccauacugcccaguugguuuugaacaguuguuuucccuuuuuaagaaaaaaaaauacauauauauauacauauauauauauaaaguugagggguuuuggacuuuaauuuguugguuuuguugggguuccugguauuguguaguuuauuucauguucuguuugccuuuccuuuuuucgcauuuggguguauauucuggcugcccuuuauguuucauuuuaagcaacuggcuguggagucaaaaacacuugcauacug

SEQ ID NO: 18974 - RNA, 677 nt, Homo sapiens
ucccgccaccuccauuucccuuucuuccucuauaucuagguaaagacaugcuaaauguuuaaugaacuaccacagccccagaguaacgaaucagaccagggaauuggaaaacacacuggccaggcgcgguggcucacgccuguaaucccagcacuucgggaggcugaggcggguggaucacuugaggucaggauuucaagaccagccuggcuaacauggugaaaccccaucucuauuaaaaauaaaaaaaauagccgggcgugguggcacacaccuauaaucccagcuacucaggaggcugaggcacacccuggaggcggagguugcagugagccgagaucgcgccacugcacuccagcccgggugacagagugagacuccgucucaaaaaauaaaaaaagaaaaacacguuucgggcuaacagagagcuuuugccuacauuagcucauuggccuuuugcaacaaccccuugagcuaaauaggagaucccuguuuuacaaaagaggaaagugaccugccucaaccccaaggcagagcuggggcuucuagcuggaaagccgaugaucuuaggaucugcaggggcuucugggggcucuccuaggcuggagcuggcagaccguuauacugggguuuaguggcugccccacacuuggguuucucccuuuuccugcaguggg

SEQ ID NO: 18975 - RNA, 40922 nt, Homo sapiens
aaaacaauucagugcaucagugauauaccugaaagcaaauuggaaugugacuacucaaggacguccaaguuacucagaauggcaucuuccaguuaauaaguuuauuagcugagcuagcagauauauuuacagcuaacccuuuuaucauauaugugggucgcccauuucuaaaacccuacauuauacuacucagcauuaaaacuacccagauaaggauuuccucuuaguuggcuaauccaaaaucauccuuaugaauaccaauuuucauuguauuauguaucaaucaucauuguacaguauuuuugguuuugauuagucugaugccuaguuugcuggaucguuccccucuguauuggaaguuaaugccccugaugaucuuuaucuacagaauagcuuuaagguggagagggguaacuauuaauuagguacauccuguacacaaaguagaaaggggcuuugcccuuugccaauucacagcuagaauuaaugcuaacuuccugagagauauuaaaaaaacauauguacauaauaagauuauuucaauguaagcuucuagcaaaaacuugucacugagucuacuuuuguaaggaagaaacuuugauuucugaaaauaugauaucucaaaaugggcuucuugcccuaauaaaaggugucuguuacuucuguggggugagacuuugggggauuuccacuuauauuuuuuggaauuaauucaaugaguauauauugcuuuugaaaaaagauaaaaauauaauuuuuaauuaaaaggacaggaaaacuaccuuauuguaccuauuguaaaaaaauuaaauguacuguacaaugcccuuuguguuaauugugcauuauuaaauuacuuucaaauacaugcaguuguuuucauagguaccugauuaucaugauuuugacaguguuuuccagucucuuuugccaucagauauaauuaacuuuguauuuaaucaauccaugauuauugguuuuuacaaauaucaauaaaaaucaaugcaaggcuguuaaaauguuaaguaaauauaaauaauuuuuaccuuacuuuggaauugauacuuuuuuuuuuuuuuuuugagauggagucucgcucugucacccgggcuggagugcagugacacaaucucggcucacugcaagcuccgccucccagguucacgccauucuccugccucagccucccaaguagcugggacuacaggcgcccgccaccacgccuggcuaauuuuuuuguauuuuuaguagagacgggguuucacuguguuagccaggcuggucucgaucuccggaccucgugauccgcccgccuuggccucccaaagugcugagauuacaggcaugagccaccgugcccggccuggaauugauacuuucaauauuuauccccuggccuaaagugauccacccuccucggccucccaaagugcugggauuacaggcaugagccacagagccugaccauauuuucaauauuuauccaaaggagcucuagauaaaaugucacccauugccugcacuucugaacacugaucuacucugcuuaauggguaagggagcccuggaucaucuucaccacauaaugacuacuuccuaggccuggcacaguggcucacacguguaaucccaacacuuugagaggcugaggcagcaggauugcuugagcccaggaguucaagaccagccugggcaacguaaugagacugucucuuaaagaaaaccaaaaaacaaaacuacuuccuggguuaaacuucacagaagggugucuuuguaggccgggcgagguggcucaugccuguaauccaagcacuuugggaggccgaggcgggcgaucaccugagaucaggaguucaagaccagccuggacaacauuguggaaccccgucucuacuaaaaauagaaaaauuagcagggcgcgguggcaucugccuguaaucccagcuacucgggaggcugaggcaggagaauugcuugaaccugggaggcagaaguugcagugagccgagauacugccacugcacuccagccugggugacaaagggagacuccgucucaagaaaaaaaaaaaaaaaaaaagaguaucuuuguaauuucuuucuuuuucuuuuuugaaauagggucucgcucugucauccaggcuggagugcacgggagcaaucacugcucacugcagucucgaucuccuaggcucaagugauccucccaucucagccuccugaguagcuggaaccacaggcacauaccaccacgccuggcuaauuuaaaaaaaaaaugguagagaugaugucucauuaugugcucaggcuggucuggaacuccuggccucaagcaaucuucccacucguccucccaaaguacuggcauuacaggcaugagccacugcacccggcccuguaauuucauucucuauccccauuccaccaaaaaaaaaaaaaaaguaacuucauuaccuccaaaguuagggcccaacucuugccaguucaaaucuggccccccaccauacuugccugucuuuaucacuacuucuuuauuuuuuucuuuuuggagacagagucuugcuccaucauccaggcuggagugcaguggcacaaucuuggcucacugcagccuccaccuggcagguucaagcgagucuccugccucagucucccuaguagcugggauuacaggcgcaugccauggcgcccggcuaauuuuuggauuuuuuguagagacgggguuucaccauguuggccagacuggucuuaaacuccugaccuaaagugauucacccgccuaggccucccaaagugcugggauuacaggcaugagccacggagccugaccacaucaauacuucuuaguauguacucucuaucauugucccccgaaaaugugcuggguuuugguuuuuuaaaacaguuccaagccuuuucauuuaacaaacagcauggugcuuccucuaagacacuuuacaaauauuagcucauuuagucuuccgaacacccuccugagauuuguagaugaggaaaaugaggcacaauuaagugacuugcccagguggcagagccaggauucaauguggguuggucuggauccaaggucaacauguuuaacaaugaaaaauguuaucuuugguccgaaaguauucaccaucugaaauaucaauccuuuuccucuacuguuugaauuuuacuacucauccuucaagacacaacucaaauaacuucuuacacgaaguucuaccauagugauuccaucccauagucuucucucuugcucuguccggcacuacaccagauauuauuucaaugaccgguauaugucaucuccccaacuagacaguggccacuuccuauauagaugcuauguccaaauaaacccauuguaaacugaaaauaucguuaagucgaaacugcauuuaauacccugauaaacccaucauaaagucaaaaaaccguaaguugaaccaugcuuaaguccagaugcuccucgacugacaugggguuaggucucauuaaacccaucauaaagucgaaaaauuguaagucgaaccauugugagggguaagucggggaccauccguacuuuucauacccaacagagccccuuuuauaguacaauccaagagguaagugcucaauaaauacuuguuaaaugaauauguaagcugaaucuuugaaacaggcacauuguauguucugcaugcagccaaaacauuauuuccaauuuagcuuauaucuggcagagucaaaacacuuauuuacacucagccccucacccuacucccauaacugaaaguucugcuuagcagacuucucuucccagaaaguccgagaagcacgaacgcuuuuugcuaacauccugcucccaagcacagaaaccacagcaggagacuguguguaucuguagcaccugguauacagcaucuaggacacacaacugaacuaauaaauaaaggugacaggcgggaagaagagcgcagaauuacuuguccaggaaacggguugggugggaaagagccggcaacugguaaaagauggaaguacacgccggaucugggaagccagguuccgcgccucggacucauggaaaaacuggaucuggaucacugcaaaagaaucaggaaggcuucgguaucaaguaacugguguccuaaaaccaaaaaacaaagugcgaugccggggcuacgcuguugugagaugcuguuaucaguucucgucaccaacacagcggcagcaccaggcacaaccgccaaucaaagcggccccacgagucccuccuugaacagguuccuuaacucguucaguccaacacugugccacaaacucgcgaaaaccggcuaccuagagccagcgucuuugcgagcuugcggccagcuagugcaugcgcaaauccucucgccgugcggaccaaucgcaaugcggcagcgagugcuacgccugcgcaguaggccuccggucgccguuccccuuccccggcucuagcaggccggcuucucuguccaaugcccacccggagcugggaggaggagucugcguaaugugcgugugaagagacugggggagcuggccggggcucacgguguuugacccgucggucgugcgugagaggaaagggaaggaggaggucccgaauagcggucgccgaaauguuccgguguggaggccuggcggcgggugcuuugaagcagaagcuggugcccuuggugcggaccgugugcguccgaagcccgaggcagaggaaccggcucccaggugacugacccauuccaggcaaccuccaaguccgagggccuggcgccuuaggcucccugugccuugcagcccucuacccccgcguccccgcgagaaacuuaacacauagucacgugaauuccaaauuggcagacuccgaacccugagucuugcaagcggaggaauuggcucagccaugccgaccugaccuucaagagauuugaacccaguagucggcuugaggccuuuucccgggagcguuugcuguucagggaucccagaacaacuggcugucggcgccuccccggcauccccaccccccaccccccuuuuuagagcaaugaggucaaguagacuuugucauuuaccgauugagacuuuaaacaggacguuuaagcccuacgccuaaguuucuuguguaaaugaggguguuaucugcucagccuuccaaaccacagaugagauccauggauuugaaugcccagugaaacagaaacggugcagggcaaguaaggagucgguugguuguguaccagacacccagagaauuggcccagacuuaauuggagaugccugagccguguacuucuugguggucuuuaaggcuucaaagaaacaguuugcagaacgcauuguauuuuguucuccauuaaguuguuucaucaaauuuuagagcuggaagggauuuugugguaaaggucaacccacucauuuuauagauaauaaacugaggcacagagaggugaaauuacuugccaaaggucacauaguuaauuaauagguagagcuaaggauaguuugcuagccuccagguccuuaaucccuucgcugcaacuccauacugcuuccuaaaguugaccucaaaaaguuaagaaugaauucgggucucuucccaguaauuagcccauuguacaucagauauccgugaauuuaucugagcauggcuugagccugcuucuuuucguacugcguuacuucaugggggcaaugaaugauccaccuguaggaguugcuuugaaaaaaaaaucaguaauccuucaauguccaccccuagggcauuugcaaugucagaaguuauccuugaggcuuuuacaauacagaaacaccugggugcuuuaaaaauaaaaaguggaaaauauuuuccuuggguuguuagggucuuugcaaaugugcauuugaacaguuuuuccaguugcuaugcacaaugaaaauguuuccugauagguguauuugaguuauguccugggacauacugcucuuggaacuuaaaaccucugcuuagcuuuuaaacuaaugccuuaucaauggaugucaucuuugaggguuuuguguauugaaaugauggugcucugugcuuguugcacagaaauugagauaaccugaauuuuuuuuuuuuuuuuuuuugagacggagucucgcuuugucgcccaggcuggagugcaguggcgcgaucucggcucacugcaaucuccgccucccggauucacgccauucuucugccucagccuccagaguagcugggacuacaggcacccgccaccacgcccggcuaauuuuuuuuuuuuuuuuuuuguauuuuuaguagagacaagguuucaccauguuaaccaggauggucucgaucuccugaccucgugauccgcccaccucggccucccaaagcgcugggauuacaggcgugagccaccgcgcccggcgauaaccugaauuuuuucauccacacuggccuuucaaacuuugaguaguuguuuugcuuaagucucacaacuuuuaccagcauucuaaagucugaccaaaaguucucaucaauuaaauaugcauuugcaaaguuaaguugauuuauuagacauuggaaagugguugguguuguuagaacuacugaaaaauacagacucaaaugguuuuuuccacugcaugucuuuguuugaaggcagucuacuguagaauauauucggacuuccugacauauccauccaucucuuugcauacacuuguucuuuguccuuuggccgugcaccaaaguaugacaucaucugccuuuaaaaaugggugaggguaguguuaaauuuucaaaaagaaguucugauacucucauuuuaggaauuaacucuguuuuguggcuugauuccuaacugcuuuuaaucugauuucuuuuucauguaguagcaucuaccguguguuuuugcacaggugggaaagagcaagguucguuuauacaccauuucucccuccaccuuaccuuuaaacuuuuuuuuuuuuuuuuuuuugaggcggagucucgcucaguuucccagagugcaguggcacgaucuuggcucacugcaaccucugccugcuggguucaagcaauucuccugcgucagccucccaaguagcugggacuacaggcaugcaccaccacgccgggcuaauuuuuuguauuuuuaguagagacgggguuucaccaugcuggccaggcuggucucaaacuccugaccuugugauccaccugcuucagccucccaaaccuuuaaacuuuaaaccugccuugcaacuaucucguugacaucugucaccauugucagguucauuuccauuauauguugcauucugccuuaaaaccaugauagcuacuauuuguuuauuuacuuuauuuauuuggaugcucugccuccuuccagagaugauugaagguaacucauagucaucacucuaugucugcauucagacacagaggagcagauagguuagauaauagacauuuucuguucuauaauauuuuguuuggucaccaaacagugcugcccauguuaucaaacugaucaccgacucccugacuuuagguucaaauguuugaacguuuuucucuauuuggaauccuucucaccucuuuaaaaaggaaacugagcuccuugugggcaaggauccuggcuuccuggacacugccaaaugugacuucguuuugaagccuaaaagaugagucuucccccguuguuucugcugagacaaggcuuugcagaagaaauucuuuggcagcucagcccuuucuguaaccaguuaauaaguuacauuuucuagaaauguucuaacuuuuugagggaguuacugcaugucuuagcuuucuucuagaucauguuuccaaaaguugccugcucaugugaaucgaguagagaaccaguuccuaaccuucuccaggagauaauucugggaaucuguauuuuaacaagccccuugacauucauaugaucagacaaguuugguauauacuguuuuggaugaguagugacucuuccccuucuguuuugcugacguaaggauuaaaaaaccaaacugagcaaucuggagucucuugugauuuguaucaagcucauuuucucauauucagaauaguagcagccauucuccuaaauuaaacacuaccugaggacauggauuauguccuauuuauuuuuguguccuuagcaucuuguaccaucucuggcacaugguaaauucucgugacugaacccuaguacagcauugugaaggacuuaacuuugcagaagagagauuuuauuuuguuaucuaaauaauuuuuccuugugugucuuucaucagaaugguucacgcuguacuauaguuauuacuacucuguuucuucuaaaauuccagcaaggguugauauuaaaaaauuaaaaaaggcugauagcuaggcgugguggcucacgccuguaaucccagcacuuugguaugccaaggugggcagaucacuugagguuggaaguucaagaccagccugaccaacauggagaaaccccgucucuacuaaaaaucaaaaauuagccaagcgugguggcacaugccuguaaucccugcuacucgggaggcugaggcaggagaauugcuugaacccgggaaguggagguugcggugaaccgagaucacaccacugcacuccagccuggacgacagagcgagaaucugucucaaaaaaaaaaaaaaaaggcugauaaauaguuguuggaucccuuguaaagaaucauuuaucuacaauggacagacuaucuaggcuuguccuguguuuuuuuuuuuuuuuuuuucuucaaacagagucuugcucuguugcccaggcuggagugcagugacacaaucucagcucacugcaaccucugucuccuggguucaagugauucuccugccucagccucccgaguagcugggauuacaggcaccugccaccacgcccagcuaauuuuuguauuuuuaguggagacgggguuucacuguauuggccaggcuggucucgaacuccugaccucgugauccgcccaccucggccucccaaagugcugggauuacaagugugagccaccgcaccuggcuguccuguguuuucuccaugcuggaaaaaucaguuugacccucaggaaacaagucucaagaacguauagaucucuuaaccauuuaggaucccugggugccucaauugugaaguuguguuuuuggaaaacgccuuuugggaguauggaaaaacaggaaaucacaaaaccuacagaaaugaacuugcuaguuuagcuacuauucuaaugcuggucuaugguguuugagguuacucauuuaugauuaagcaaccuaaaauaaauggaaucuggcuaaagcuuuuuuuaaaaaaaacucuuaaguuuauuuuuucauuuuauuuauuuauuuauuuauuuauuuauuuauuuuuaaguagagacgggguuucaccauguuggccaggcuggucucaaacucguggucucaagugauccaccaaccucggccucccaaggugcugggauuacagaugugagccaccgcgccugcccuggcuaaaauuucuuugcaaagaauuauuuaaaauguucaguuauccgggcacgauggugcaugccuguagucccagcuauucuggaggcuaagguggaaggaucacuugagcccaggaguuugagucuagucugggcaacauacugauaccuuuucauuuaaaaaaaauuuuaauaguaauaagaauguucagucaauaucaauagaauuaggaagaauuucuauuuccuuccuucauuaauucaacaaauauuuauugagcaaacaucugugugucgucuggcgcuguugcacaggucaaacuggcuucuuaagaaugaaauccuaagugugaggaagaaauugcauuguauguguggucugacugcagaaaaccuaaaauaaguaaacugcugccaugaugaaaagucaaggaguaaguuggcuuuuccauguuaguaagacaagugaaaaggcauguuucagucacgauguaauauuuccuaaaauuuugaagcuauggggagaaagguuugggaggaauuucauagggaaaagaaaauguggggagggggaauguaagcaaacaauacuuaguacauuuuacaaaauuaaagucacuuuguagguauauaaaaaguuuuaaaaguugguuuauuaaugagaguaguguauuacauuucuuuucaagcaguaguuuaaauauuaaccaguuuacuuuuuuuuaaagucaauuuacuuuuccagccuggacaacauggugaaaccucguaucuacaaaaaauagaaaaauuagcugggcguugguggcucacgccuguagucccagcuacacaggaggcugaggcuggugaauggcuugagcccaggaagcauagguugcagugagccgagauugugccacugcacuccagcuuggggacagagugagacccugucucaaaaaaaaaaaguccauuuacuuuuaaaugcuuuuuucuuuuuuuuuuggcaaauugagacaaaagcugcugaacuuuccuaaaucuacacuguuaguauuaucaguuugugaaaagcaagcagaaggagaauaaacaugaguaugauauuaaaacaaauuuguuauaaugucuguauuuagggucuucuggaggaauaaacagaauuaaaaaaaagaaaaacaaaaacaaaaaaaauuuauuuuuaguaaaugaaccagggguagagguggaggacaaacuaaauucauugaacuaaaucacauggaacuuuuccuaaccaguuucauuuucuaagcucugagaguuaccacuuucuacuucugaugguucauuauuuuuguaagcuucugaaaaucaaaagcuugcccagauugagauaaguuucugccccgcucacguuuuuauuuucaugauuugucauuauuuccaaaucucaaccauuuuauuucauguggugaugaagaguucuaaaagcagguaagaagaacaguaaagaaaaauacauuuccuuuucuaagaguguagaucuaaagucucuuaucuguaauucagaaauugaaauuguagaaugaccaaaauuuaagacuaucaaguuuucauaacucauuugccaguaaaaccugaccugaacuggagagaggcuacuuuauaaucuuuuuaaaauaucacuuagcgugauuggucauauuaauauguuuaacuaugaauugcugcccuuuaccuugcuaggugucacuaugugguauaugccccauauacuuaagaccagauaauucaaaguuccaaauuauacaugguccccaggauuucagaugagagaccacagauccacauugggcuuguuuuuacccgucuguggccuaacguuaugaaagcaagggggaaauuccuucucuaaucucugcaaguauacaugggaugcuacuaccaguguccauucuguuugucuuuuaaagccuagacaggacagggacauaaguaucagccucuagacuaagcuuguccaaccugcagcccaacacaaauuuguaaacuuucuuaaaacauuaugagauuuuuuugcgauuuuuuuuuuuuuuuuuuuuuuuuuuuuagcucaucagcuaugguuaguguuaguguauuuuauauguggcccaggacaauucuucuucuucccauguggcucggggaagccaaaagauaggauauaccugcucuagacagaugguucucaaugugugguccccacccuaacagcagcagcagcaacagcagcauccccugggaacuuguuagaaaugcacauucuugagccccaucccagaucuauugaaucagaaccucugggccuggggccuggccagcuuuguuuuauaaaaccuucagggcauugggauacacucucaaguuugaaaaccacugcucuagaucggggucugccaacuacagccacaggccaaagccagucagucaccugcuuuuguaugccccaggagccaugaguggguuuugcauuuuuuuucuuuuuucuuuuucucuuuuuuuuucuuugaaauggaguuucgcucucguugcccagucuggagugcgauggcacaaucucggcucacugcaaccuccgccuccuggguucaagcuauucuccugccucagccucccgaguagcugggauuauaggcauaagccaccacgcccggcuaauuuuuuguauuuuuaguagaaacaggguuucuccauguuggucaggcuggucucuaacucccaaccucaggugauucacccuccucggccuuccaaagugcugggauuacaggcgugagccacugcaccuggucuuuuuucuuuucuuuuuuuuuuuuuuugagacggagucucacucuguugccaggcuggagugcaguggugcgaucucggcucacugcaaccuccgccucccggguucaagcgauucuccugccucagccucccgaguagcugggacuacaagcaugccccaccacaccugcccagcuaauuuuuaacgggguuucaccauguuggccaggauggucucgaucucuugaccucgugaucugcccaccuaggccucccaaagugcugggauuacaggcgugagccaccacgccugaccuacauuuuuuaaacggcugaaaaaaaaaagaauuucgugacacaugaaaauuauauaaaauuuaaacuucaguguccauaaaguuuuauuggaacauggccacauccauucauuuauguauugucuuuggcugcuuuuaugcagcaucaguggaauugaguaguugcagcagacaccaaauggcccagaaagcugaaaauauuuaccaucugguucuuugcagaaaaaauuugcugcucuagguugauagucaacaaacacgaggaguaaucacagaauaaucagagacugagaccuuccuuuaucugaaaaugucagcgucucccuagaaaaagaaaucuacagaacucuuauauuucuauguacaggugcuguuaugaucaucacaucauuacauagcucugcauaguuuuacgucaaaauaaccuuuguauuauuuuggaggaguaagagucaaggaguugcuggacacuucacauuuugucauuauaaaaaauauuucauaguccaaaauuuuuuaguucuuugggggagagaaacucauuaaaauuuuuuuuucugauuuucuucugagcuuuaacauuucuguauuccaggacacauuaccuuucaugcaagauugaacuguguccugguuagaguguugcguuuuauuuugugcaagauuggaaccaucuagauuacuccuuaaaugguuguuauaaugucccagguagcccaugguuaacuuuguauaucuaccuauucagucaucucucuguguuuacuuaauuuaugggaaagacaugaaggaagagguauuugaugaacuguucguguuuuucaugaucuuuucuggaagcugaaaauuuucucacuggacagcauuaaauuuuacucuuaaaaacuucagcaacuuaagagcguucauucagcugucuguaguauuuauauaugcaguuuugaugauauuuuucuugaucauuuaacggugaauaucugugggcaauaagucuuguacagugcauugacauuuaaucauaaauauguauuaacuauuuuauuuuuguaugugugugucuuaauaaauuauguuucuuaggcaacuuguuccagcgauggcauguuccucuagaacuccagaugacaagacaaauggcuagcucuggugcaucagggggcaaaaucgauaauucuguguuaguccuuauugugggcuuaucaacaguaggagcuggugccuauguaaguagaaaagcagcguguauaaagaagcugccaaacagcucccauuaauagacucgauaguauucugcuuuaaaacuuuugcaacuaauuccccuuucuccuuuuggaaaaauuuucaaaaagccuucucuuaagugccugcugccuaauaucuuaugggagccaauucuggaaugacugaaauuuaaucucauguugauugauuucugcucuuuucacuugucuuuuucuucuuuacuugaaagccacuauguuuuccuagauucgaguaacccacaaaauuguaccuguuuucuuggaugucacacacuaaccugugaauaaagucaaaauccauugcagcuccuuagcacaauauuugauuuugaccuauuugucagacauuuuauuuccucagcuugagguucacauuaaaaaaacaacagccuucaaucaaaaauauuaaguguuccuaaaaggaaagcuaucccugaaucuuacccaaaacuaaauuacagaaacagggcuaguaucacugauuuuagaauggaguuuguuugaggugagaaauaugguguuuaauugcuauguaguauuagcaccauuauaucuccuuaaaugaacuccgaucagcuuagcaggucacagaggaauuauuuuguggguguuuuuuuccuaacuuggcaggguuuacugugacuaagccgaucagucuaaaguuggauccuguaagguugagugaaccaacuuagauaacaccuaguaacacccuugauugaaggaagcuguuuguuuuacuuaagccauuacaaguuuagggguuuuuuucuacauugguaagacaaugaauuuaucuuuguuccuugguugcuagcuuaaagaaagggacaugaaaauuauuugaagcuaccuauauccucauccccugaugugacucccaaacggacaagaaaaguagauaguucuugccuauugugagucaaaucagaguaagaaauaggcgagagcugucugauaaugugguuugaugaaauacacauucugcaauccuggagcagcauuuuuuucuuuuuccuuuuuuagcacaggguaaccaaaacugcuucucugccuuuguauugaauguuucuucauuaauacuuaguacucuguuuccuuuuguuucucucuuggccuuaucuuuaccuacaguugugcagucucaucaccuaggauccccuucuagaucacuagcaucuacaggugcuucugggaaagauggcagcaaccuaguguacuucuuaauuguaggagcaacagucacuggggcaggaguuuauuauguaagaugcuuacacuaaaacauauuuugggguagggugggugagcccauggcacuaaugaaaacuugauacauuagaauauaguaaaauauucacagcaugugcuuucucuagguguuuauuaaagggacauugucagucacuagagaguccucaaaucucauucuucaaacuguugaaguccuaccagauauagcuaaagccacaagucuaaugaugaucacaaauccucaucauuaacucuuucuuugaaacuuuugccaauuuuauaaugauuuuguaugauaccaaauuauauugugcuuuagugcugcauaucuaacaagacagucucagaguaaauguuaaauaagcaaauaaagguaaugugaacaucauccauuuuugaaucauuuuagguaaaauguaauguuuguguuuugugggaaacgaucaaccagacuuugacuaugaaaaggcauuuuauugaaugcuucugaggagauccaaaaagccauagaaacugcaauauucuccccauccaccuuuccacccacagccucuauuucaaaguaaauucauuuggcagugucccuuuguaaucucuaauuuggucaaacuaguggcugaagcgguacaagcuaacacauucauguagauugcuuucuguaaugccucucauucguaauucagauacuacccucugagccuuacuuuuugcauuucauaucucucaacuuuucccaucaguuccaccccauucauucaaaaauagauuuaaagccuuuguguucaguauguugguaacaauuuaaaccugauaaauuccugguccguguugcuguaccagaguuggauggccuccacagaguugaccaugcaaauuuucuugaugccaagcuacaagacagggcuggucacuguuccuuucuccugccuuagaaauaucuaagaagcacaaguuccucucaagucauucauuuaaaugccucauuguacucuguguuuauccaacacugguaauaauaaagcuaccguauuauaaagugguuccagguuaaaugauaagcuuuugucuaccuacaacuguuauugaacuguuauguacaguuuuguuuuagguucuaaauuauugaaaacuugaucugagguggcuuaguuuuuuuguccgaaauugguauuagucucaagagaacuaugaacuuaaaaucaguguucagauuugaugagauauagcuguaaguuguugaacguuuguauuaguuucuugggcugccauaacaaaacaccacggacugaguggcuuaaacaacagagguuuauuuucucauaguucugaaggcuggaaaggccaagaucaaggucacacaggguucaguuucuggugagggcucucuucuuagcuuucagacagccuacccucuugcuguguccucacaugguuuugcggggugggggacggagagggagaaagagugagcaagggaacuccggugucuuccccuuccuguaugagcuccagcucuaucugauuagggccccacccuuaagacuucauucaaucauuaucaccuccccaaugccccauugccaaauaccaucacauaguggguuaaggcuucaauauaggaauaggaaacauucaguccauaacagugaauagcguuucuucguaacuuuuuucugucauuugaagaaauguuccuaacuuaaguauaacuauuacuuuggcaauuccuguauugggagcucuuuaccucccucccacuuuacccuccaaaaaaagggaguaaacugccgacuuuuuuuuuuuuuuuuuuuuuugaaacggagucucucugugucgcccaggcuggagugcaguggcgcgaucucggcuaacugauacguccgccucccggguucaugccauuuuccugccucagccucccgaggaguagcugggacuacaggcgccugccaccaugcccggcuaauuuuuuuuuuuuuuuuuuuuuuguauuuuuaguagagacgggguuucacuguguuagccagaauggucuccaucuccugaccucgggugauccacccgccucggccucccaaagugcugggauuacaggcgugagccaccgugcccagccuaaacugucgacuuuuaaaaauuuuuaccaugaucugcagugagaaauacauuucuuuuacaacccauuuuaugacuacaaauacauaaaaagaaacaaagcuucaaaaacuacucuuacuagguaucauacacuuacucuagcuucuguucucuucuauuuguguuugcgucuaaugcugguugcagccuacuaaauugacuucacagcccacuaauggcaugcaaccacaguuugaaaaacacugauuucaacagugcuucugcugcucggauuguaaauaugaacuucugauucgcauugaugggagaguuuuuccucuuuuugcugguaacuuucccuaggaccugaggcagauucccaaaucucaguccucuauuuuuuguuggugggcagagccaaaguggccuuuagaauaguuaaugagauuuaguauuugggcccuuugcuauuguuaagcuauaggauugcauugccucacucagaaaaugaccuguuuccuuucaaaucccauuaaguugaauaaaugccaccauauucaucuguuuagaaaaguugucuucacuaauauuuuucauaaauuuguagucuuucuuaaccugacauguauucaugucauuaauuggaaaucugugcaaacuaggaguacagaaacccuugggggaaagguaaagaaauaaauacauuuauauauauauaucagacagaucgaccucauucuugcccuuuccccacuaaaccucuagauauuucuuggucugcucuucccuucaugugugagccauuagcaagugugagcugggcuuaggcuauuuugggauauuccucucaaugaacauggccccuguuuauuucucuuuucauucauguugaccagaguaagccaucuuuuuagguaaaacuuuucuuuuuuuucuuuucuuuuuucuuuucuuuucucuucucuucucuucucuucccuuuuuuggaaaagcuuuccccucuagguuuuuuuuguuguguuuuuguuuuugagacagagucucgcucugucgcccaggcuggagugcaguggugcaaucucggcucacugcagccgccaccucagggguucaggugguucucgugucucagccucccuaguagcugggauuacaggcgugccccaccacacccagguacuuuuuguauuuuuaauagagacggguuugcucuuuuggccaggcuagucucgaacuccuggccucaagugaucuccacaacuuggccucccaaagugcuggaauuauaggcaucagccacugcgccuggcuaaagucccuuucuuaaaagaaauguuuuuaagauaugaguaaauacuggacuuguguauaguaucugauaccaagauaaaaacucuuccugaaauuaauguuaauugaauucauuuauucgauacauuuaguaguaaauucaaggaguaacuauugucuuuucccauacaguacuuaacuuucuacuucauuugucacaacguuaaaugcuuccagguugaacccagcucucaggguucagguuccucaauugcagcacauugccugaugggcuguucuggaaggaagucauagaaguauucuuagaauauguuuuauggggccgggugugguggcucacgcauguaaucccagcacuuugggaggccaagguggguggaucacaaggucaggaguucaagaccagccuggccaacauagugaaaccccaccucuacuaaaaauacaaaaauuagcugggcaugguggcgugugccuguagucccagcuacucaggaggcugaggcagcagaaucgcuugaacccaggaggcagagguuguaguaagccgagaucacgccacugcacuccagccugggcaacagagugagacuacaucucaaaaaaaaaaagaaaagaauauguuuuaugauaguuccucugauugucuuuacuuucuccuacaauuaaucugagauuucauuugacauauguucaccuaaauuccuguuuuguugacccugugggguacaaaagagcaaaagcauuguagguuuuucuuuucuuuuuuuuuuuuuuuuuugagacagagucucacucuaucgcccaggcuggagugcagugaugugaucucagcucacugcugcaaccuccaccuccuggguucaagcaauucccaugccucaaccucccaaguagcugggacuacaggcgugcaucaccucacccagcuaauuuuuguauuuuuaguagagaugggguuucaccauguuggccaggcuggucucaaacuccucaccucagguggucugcccaccucagccucccaaagugcugggauuacaggugugagucaccaugcccggccaaaagcauuguaauguuaagucauucuugccuaccuuuucuuuaaaaagucuccaauaggccgggcgcgguggcucacgccuguaaucccagcacuuugggaggccgaggcgggcagaucacgaggucaggagaucgagaccaucccggcuaaaacggugaaaccccgucucuacuaaaaauacaaaaaauuagccgggcauaguggcgggcgccuguagucccagcuacuugggaggcugaggcaggagaauggcgugaacccgggaggcagagcuugcagugagccgagaucccgccacugcacuccagccugggcaacagagcgagacuccgucucaaaaaaaaaaaaaaaaaaaaaaaaaaagucuccaauaaacucugguacuguauguuaaaaaagaacaacacacaacuggucauaaugguaaaauuacccuuuuccaauuugaaaggauagagaagauagaauauuugaaauguaacagguguguuuaagcaagguguuugacccccuaguaaauaucuguguguaguuuuucugaaugagauuccuucuaccucgugaguuuaagaaaaggauagaccauugagggaaugauggguaacucucuaaaaauagaauacaggcagccauguuucugaccacugugugaguacuuagcaaaagccggaauguugaccaggaaaacuuaugucccagcuuccuacccgggacccuauagauugauuucacagcuaguguccagcguaguccaaaccccguuucugugcuucauauauagauuagcccuuucuagcacuuuauucuucuaguauaaaaugauuuuuucuuuuuucuuaaacuguaccuucagaauaaaauauggggagaauucuuuauagagagccuaaaaaucugaaacuggaauauuuucaucugcuuacacauauuuuuuccauaccaagcaugugcacacccaguauuuuuuauuucuuaagaaaacaacuuugucuuagugguuuugacauagaggaacuaacaucagauagacaaaagcuucucauuuaauugaaagauaauauuacuuacaguaugagcuagcuguauggugaaauaaacuuucuccauguuuggauccgcaggccuacaagacuaugaaagaggaugaaaaaagauacaaugaaagaauuucaggguuagggcugacaccagaacagaaacagaaaaaggccgcguuaucuggugaguauucccuuaagucuugcuaugauuugagacucacaaagggaaaguuauaaacaguuugggugcugugauuuauggaugucuuguagaagcaauggugguaugagauugcaagcaucuagaaaguaugguauuacccuagaacugggagugauuuaaagcauuuggcugaaauuuggguuugagaauaaagcuagugauaauuaugauugguuguuuaucuguauauuaauauuagucucuuggcugggcacgguggcucacgccugucaucccagcacuuugugaggccgagaugugcgggucagcugaggucaggagcucaagaccagccuggccaacaugguaaaaccccaucuauacuaaaaauacaaaaauuagccaggcgugguggugcacgccuguaaucccuggugcucgggaggcugaggcaugagaaucucuugaacugaaguggcggagguugcagugagccaagaucacgcugcugcacuccagcuugggugacagagcaagacucugucuaaaaaaaaaaaaaaaaaagucucuuaaaaggcaagcuuagcaaggaaaacuauuggaaaagauggaaaagagaugaaaaccuuuuuuuuuuuuuuuuuuuuuuuuuugagauggaguuucacucuuuuugcccaggcuggagugcaguggcccgaucucaucucacugcaaccuccgccuccuggguucaagcaauucucccgccucagccucuggaguagcuaggauuacaggugugugccaccaugccuggcuaauuuuguauguuuaguagagacaggguuucaccauguuggccaggcuggucucaaaccccugaccucaggugauccgccugcuucggccucccaaagugcugggauuacaggugggagccaccacgcccagccgaaagcuguuuuuuaaaugaggaaauucuucuagucuguuuuguuccccuuuugagucuuugcaguuucgaguugcuaaagguauauuugcuuuccuaaagcacauacccuagccaucacuuccauuucacaugauucacuucaauuuucagagaggacuguuuuaauccuuuaauaagccccacaacucugggugggcaauuuguucugcuuuuuucaaaagcacccccuuauucuugaacauuguaugauaauccccaauugaccuccuggauuuucucccuuuguugcuaacggaaggugaaacugagccugauauuuuccuggugaucacuaggaaauugaugggaagggcaaaagccuacugauguauacuuucuaaauguuuuagaaguaacuaaauauuuaagcuauguccuaguaccaguucagaccugaugaaugaaugacauuggugaaaucauucuccuauuuuucacuuaugaaaugaaagggauacuugcuuuuccucucccaucaggaugcugugaagauuguuaagauuagcguaggucauauguuuugcuagcuuuauguggaggauugagacaagugcaaggugauuuuuuuuuaacaguggcaaagaaucaucugagacuucaagaagauucauccagucuguucuguugcuuucagcuucagaaggagaggaaguuccucaagacaaggcgccaagucauguuccuuuccugcuaauugguggaggcacagcugcuuuugcugcagccagauccauccgggcucgggauccuggggccaggguaaggugcauguuuuuuugcuuggcacagaggguacagucugcaagcauuuagcuaaugugaaugcuuugacauuugccccuuaaaugacuuggcucugauaagcgucaugauuuuuaugucugaagguacugauuguaucugaagauccugagcugccguacaugcgaccuccucuuucaaaagaacugugguuuucagaugacccaaaugucacaaagacacugcgauucaaacaguggaauggaaaagagagaagguguguuugcuuauguaaaaugagccuaucaacuucagcuaagcacagagaauagguuaggauuuugccacugacuguguacaguaauaggagggauggcuuggcuguccacuagagucuacugugguccacacuugguacagcuuagagauaacagucuacaaagggcaagaguccuggauucuguuaccagaucuaccaacaguugaugguguaauguuggccucugaaauacuaaugcuccuauuucuggaaccuuuauguuaagcuucuuuaggugaagaucaacuuggccuguauugucacuucuuuuuuuauuuuuauuuuuugagauggagucuugcugcucugucaccaggcuggagugcaguggcgcaaucucagcucacugcaaccuccaccucccggguucaagcaauuccccugccucagcuucucaaguagcugggauuacaagcacguaccaccacacccggcuaauuuuuuguauuuuauaguagagaugggguuuuaucacauuggccaagauggucucgaucuccugaccucaugauccgccuuccucggccucccaaauugcugggauuacaggcgugagccacugcccccagccaucacuucuuuauacuugccuagacauguccuacaagagcagaagaaaagaaacuuuuuaacggcacucucuuugacagccuagcaggcauuuagaauuucaggaguagaguaggaaggcuguaaggaagagccuguguuagaauuuuugcacgacagacuuggagauacagguccagaagcuuuuuccuuuugauggacaacuuagaucucaauucuaguaccauguucuuuggguuccaauuuuuuuucucauuagugaccccuuugauaccugaccaaauuuuacaaacuuacccuuuucccucacccccacuaguuccauuuucaaacaggauguauacuuucaauuaaguuaguggcuaacuuuauauguauacauaugcauacacacacacacacacacacacacacacacacacacacacauauuuugagagacagggucuggcucugucacccaugcuggagugcaguggccgaaucauagcucacugcagccucaaacuccugggcucaagugauccucccaccucagccucccgaguagcuaggacuacaggugcguaccaccacgugccuuuuauuaauuaaaaaaauuuuuuucuagagacgagauguugcuauguugcccaaucuggucucaaacuccuggccucaagugauccucccaacuugggcucccaaagcacugggguuauagaccugagccacugcacucagccaauauuaauauauuaacuaauuaauauuaauauaucauaguugauaacugcuugaggcagagucuucucaggagcuauaauuaguuguuccauugaagagcaccauucuggacaacccauuuggguggauaugugaauaccagcucuuugggugcuccacuuguucuuacuuugaaaugaaccuaaaucuagagcaggauccucagccucagcacuauugacauuuggagcaggauaacgcuuugcuggggguggggagcuguccagugcaucauaggauguuuagcagcaucccuggccauuacccacuggauaugaguagcaucccuacccaaguuauuacaacccagauugucucuggacacuggcaaacauccccugggagcaaaauugccccaaguugagaaccacugaucuggauaccuguauguaagcaagucaugaccaugauuuaauagacuuggagacuuacuuuggaaaacgucccuuaaaguuucugauaauggaaacaguuuuauuaaagcuacgggggaagcugauaacaguuccacaugcuuauaauauucucccucucuucuccauacagcauauauuuccagccaccuucuuucuaugucucugcucaggaccugccucauauugagaauggugguguggcuguccucacugggaagaaggugagcuaguagaccgcuucuuuugucaggcucuacguacuugcccaccagccaguauggugauguguguuuccauuaccauuuaugucuguccugccauuguaguucaucaaagaaggaucgagcugcuuuagguuuaauaaugcugagugugucuuucuggggaaagcacuaguaucaaagccuagguuagcaugcugacucaacuugacccuaaaagcuguuaucucuccuauuugcucuucugcccuuccucauccuuccuguuuucccacacuaacuucucucugggauuaucgaugagaaaagauugacaaauauguauuacucauaguaaaauaauuugggcauaacucagcacggaauauauuguuagacuuuaaaaggugagugucugaguaauaaggucaguuauuagcagguauuuguggagucccaggaugguuuuguuauauuuuauuguuguuaauggcagguacuagaguguguguguaaacuaauggcaguguuccaauagggacgcauucucugaaggagcaaagcccagaguagaugagauacacagcauaaguggaaggauuguccuucguuaggaacauacucacuucuccuguaaggggacauuagacagagaagauggauauagguuuguugauaagccgguaaugagacauuuaguguccccuauguguaaacaacauucaggcccugcccucuaggggcuaacuguauuaggcagaaacauaaauacauaaucauaacacauagguguguaguaagagagaucugcgcaguauguugugggaaauacugggaagggugcccaguagagugaugacaucaggaaaggcuuucuggaggagaaggucuuacagaaugggcaaucuuauggaaugaagaggcauucaccagacuagagaagacugaagagcauccaaguaaaaaagaacagcauaagcaaaagcacaagggcacaaaaaagcauguuuggugccaggaaauagaagcagcucgauacugauagagcaguuagguacaaguuaggaaguggcaagagaugaaccugagaaguuaugcaaggggccugauuguggagggcuuugcgugaaagagcuuuuucugcacuggggagcuguugcauuuuaggcaauugaauuuuaaauaaucaccauuggccgugaggaggauggauuucagugagacaagacuagagagagaccauuucagagauuauugcaauaaucuaggcaagagaugaugagagcccaaauuagaauaguagugguaugaugaugaugaagaagaagaagaaaguaagagguaaaauuuguauaguaccuauucuaaucuuguaagcacaguucuuaaaugcuuuaugugcaccaucucauuuuauccucccaauaaucuuaugagguagguauuauuucccucuuacagagaaauaaguugaaauuuuuaaaaauaaauaaauuuuaaauaauuugccuaaacucacauagcuaguaagugguagagagagaauuugagcccgggucugucugagccacagaauuggaacccagcuauucugauuccagagccuaagcuauuaauaacaucaguguacaguguacaguacuuuuuuuuuuugagacagauucucacucugucgcccaggcuggaguacgguggcaugaucucagcucgcugcaaccucugccucccagguucaagcgauucuccugccucagccucccaaguagcugcaugcgccaccaugccuggcuauuuuuuuuuuuugucuuuuuaguagagaugggguuuuaccauguaggccagguuggucucgaacuccugaccucaggugauccacccaccucggcuucccaaagugcugagauuacaggcaugagccaucguguccagccaguauuacuucuugauagaaaggugaugagaaguagggaacacacuugaggcaugcuuaggagucaugcuugaugaggcuuggugguugguuaaagguagaagaugaaggagauggaggaggcaaagaugauuuucuaauuucuagccugcaugucugaguggauggcaguguacccacagcugagaaagacauuacaagaggaagagcuaguuuaagggggaagauaaaauucaguuuuggaccauuaaguaugaaguggaauaucugcgugaaggugucuucugggcaguuggacauaugacugccacgcccaggggacuugggcucagauagagagcugagaaucaucugcauauguguagaaguugaaaccaugagaguaggugaagccucccagggagaacugaucuggugagaagaggaggaaggcaaggauagagcccuggggaaccccaauuuuuaggaagcaggcuuaagaagaacccacaaaggagacuaggaaagaacuuaaagagcaguaugaggaaaccugaggacaggagccaagguuguagggaguuucaagaaaaagaaugugauccacaguguuaccguggcagaggaaucugggaagaaaagaaccguaaaaugcacugugagauuuggcgguucagauaccuuugggaggcugaggcagguggaucacuugaggucuggaguuagagaccagccuggccaacauggugaaaacacaucucuacuaaaaauacaaaaauuagccaggugugguggcgcacaccuguaaucccagcuacucaggaggcugaagcacgagaaucgcuugaacccaggaggcggagguugcagugagccaagauugcaucagugcacuccagccugggugacagaacaagacuccauuucaaaaaauuaauaaaauaaaacagauaccauugggaaguuagaaaagaggguaaagcacucuuucaaaagauuuaaaugagaaaagagagauggcaaucggauaaaagcgugaagaggacauagaaucaaaggugggaccuauuggaugggacaagcauguuaauaggcuggacgggggugguggggagcccucaugccucaugggaagcuauggaagaucacaucuaauggcuucauuuguuuuugcaauacaauagaacauaagaugguuaucugagagcgaacaccgugaggguugaguagcgggauuggauugaagagggagcuuaccaaggacaaaucaaaggaggcuaaagaagcugcuuauccaucagaucucaguucaugucauugccucuagaaagcuuuacccaacccaaccugacuagauugcacaugucauauguucccagcgcuaccugcacuguucuuaccacuuacaucacauuugucacucuugauuauuguuagugcuuguuaaauugucuuggccacuaaacucugaaagcagcaaggaucacugucucaacuugauacauaguaggugcuuaauugaauggucucagcuaguaaagaguggugcaaagacuggggcccuauucucucugacuccaaagcucaagcucuuaaccauaagaaggaguagggugcaagggaauuaaagguacuggcaaaagaacaguuuggguguucuaccauuggcccaaauuaguuagaauggagcagcuagucaaauaaacagagaaaauugaaagcaagcauaggagacagacugagcgaaagcugaagggauggaaaauugugaccaacaaguagaauaauugagguaggaggagagguuuaggagauaacaagaugaggaaaaguaugagccagguuccaaggucuucagugaaucaggaggaguagccaggagguggcucaaaacagugauucguaggaauauaggacuccucugaugucccucagaagagaaugaaaguacaagaaucuggaagcagcagaccaguaaccucaagaagcuugcagaaugccaacaccuccuccuggccuugugauguggagugugggggaacgaacagccucuauguguaagcucuccuuaagagagagccaaguuuccgugaaggcuacaaguuggagaaagcauucuguaaaaauguuguagauguaggagacuuauuaauaaaguaauaauaaguaauuccaaacagccauauaagaaaggcuguuccgauucuccuuuuccacacaugggucagggcuuugggacugucaugacuugcucuaauguugccugccuucucauugccaauuuccaacauaugacugccuaaaaaaacuggguaccagaaacugugguucccaugauuacuuggauaugguuucuuaaggaucgcuuuaggucaagaacucauucuucuuauugggcugacaacuuuuuuuguuuuuguuuuuguuuguuuuuguuguugugguuuugggguuuuuuuguuuuguuuuguuuuugagacagaaucuugcucuguugcccaggcuggagugcaguggcaugaucucggcucacugcaaccucugccucccagguucaagcgauucuccugccucagccuccccaguagcugggaccacaggcauaugccgccacaccuggccaauuuuuguauuuuuaguagagacgggguuucgccauguuggccaggcuggucucaaacucguggccucagugaucugccugccucagccucccaaaguguugggauuacaggcaugagucacugugccuguccugggcugacaacuucuuauugaccuggaguuuugggguggugauggaaauguucugaaaucagauaguggugaugguggcacaaccuugugaauauacugaaauccacagaauuccacacuuuaaaauggugaauuugaugugaauuauaucucaauaaaacuuuuucaaugcuaauucaucucuaccucuuuuguguaugugugugacuguaccagguaguacagcuggaugugagagacaacauggugaaacuuaaugauggcucucaaauaaccuaugaaaagugcuugauugcaacaggugagcauuucuggagauggcuuucuucccugauacagcucauucaaguuuuagaguccagccuucucuauggaaggcauuacuacuuaagaaaauggaaacccagacucucugaagugagugucuucucuugguacaaaagcuggcugugucaaagcauccuggaucaccagcccuucuggaugauccuugcuguucucccgguagaggcaugaagaaguugcccuuuuuucucucccugcuuaacccucacccugugcccugugccuugaaagugaugucguuuguggcuucauugccaguugcaaucagaaaccaagagaggagacagaagcaauuuaucaaacccauguagcuaugcuagcuggcaaauccucaugagaaacuagaagagaacauggaagccaaaaguaaggccuuuuggccaccuaggggcaggguguaccccuugaagacagacucucaaaucugcuucucaaaggaaacugacagaaagccugcugugaggcaagcugaaggcaaacaaagccuugguauccuauccuguuguugccgccauggugcuaagugaagagggcuccaccuuugugugguggagggaguauuguuugggcuggcuccugcuuguugggcuaaaggguuuuccuucucuuauuuccaggagguacuccaagaagucugucugccauugauagggcuggagcagaggugaagaguagaacaacgcuuuucagaaagguaauugucugcuuuaguguuuuccuuguguuguuuuugaagaaguaguauaaucuugcaguccccaagugcccacccgggacuugggagauccaaguucuauuuauggcucuucuccagacuuguuaucuggccuugaacaagucacuuccucucucugcaccucagauaccucacucaaggguuuuaagcuccuagggaaaaaauggaguguuuguauugcuugcaauagauccuucugauugcucuuccauaguuguuuuuuccugauguguuugauucauuggaaccccuuacagccucuuggcauuuuucauugcaagugcuguguagagacuucugagaaaaaaguuaagaguaccuaaauaaaaagcaaggagguguucugcuucuuaacacugugcuuauaaaaacugcugucauuuuucagggauaagauuuguccugucuuuuuuuuuuuuucgagacugaaucucgcucuaucacccaggcuggagugcgguggugcgaucuuggcucacugcaaccuccgccucccggguucaagcgauucuugugccucagccuuccaaguagcuagaauuacaggcaugugccaccacgaccggcuaauuuuuuuuuuuuuuguauuuuuaguagggacguuuuacccuguuggccaggcuguguacugucuuuuaaguucuuccuagaacaaggcuugucagccucugcaguauuggcauuuugagcuggauaauuguagugggggcugucuuaugccauuguaguauguuagcagcauccuggccucugcacacuaaaugcugggagcaccuacuugcccugacaaccaaaaaugucuucagauauugccagauguccuccuggggaagauagggacaaaacugccaccaauugagaaccacuguuuauagaaggaauuuuaccaugaagaaauaaauuugcauuaauaacauagaaguuauaauugagucacuuuauacaaggagaaaauuuacuuuugccaaagauuuagaagaaacuacuuucuaguauuauuauccuaugccccuuuuggaaauuaauggacuaaacugaugugauccugcagauuggagacuuuagaagcuuggagaagauuucacgggaagucaaaucaauuacgauuaucggugggggcuuccuugguagcgaacuggccugugcucuuggcagaaagggugaguauugaggagugaccuugauuuucuuucucuagucuuauauagcuuuucugugaaucccagagauguguuuggcaggaucaguaggaagaguuuaauuaagguuuauuuauuuauuuuuuuuugagauggagucucgcucugucacccaggcuggagugcaguggcgcgaucucggcucacugcaagcuccgcuucccggguucaggccauucuccugccucagccucccgaguagcugggacuacaggcgccuguaaccacgccuggcuaauuuuuuguauuuuuaguagagaugggguuucaccguguuagccaggacugucucgaucuccugaccuggugauccgcccaccuuggccucccaaagugcugggauuacaggcgugagccaccacacccagccuaauuaagguuuauauagugaaaagcuaaacacugagauuaguucuggugagggaucccuuggugaccaaaaagcugucaccugagcaacuuaacagcgaugcuuuuuuuuuuuuuuuuuugagauggaguuucacucuuguugcccaggcuggagugcaauggugugaucucugcucaccacaaccuccgccucccagguucaagcgauucuccugucucagccucuggaguagcugggauuacaggcaugcaccaccacaccuggcuaauuuuguauuuuugguagagacaggguuucuccauguuggucaggcuggucuugaacucccaaccucaggugauccacccaccucggccacccaaagugcugggauuauaggugugagucacugcaccuggccaacagcaauacuuucuuuccuuucuuuuccucuacccucuaugccaggacuccuuagaaauaaaauauuaaggaaagugaguuaugaagaugauaagggcaaugcagacuacagaauuaugggugucuuugaacugcugcuuccuguaaaaugccaaaaacuucuuugggcacaugaugguucccagcuugagagaucugugagcuccaguuggaauguuucauggcaacuaguuuucuuaauguucuuuuucagauauaugaaaucagggcaucuuuucaggaggaugcuuccuauucagagguugcaaagcacuuauguaagccuuaggugacugcauggguggaagugcacagaguucaccaucugaagcuuaaucuggggccagcaguucugauaccuguuguauuugcguuacaaaugaacuugagcaccgaggcccucaugcccacuguccuguaagugggcgcucggccuggauugcagcucugcccugucuguagugagggcugccugcugcuccuuuacuucucuuccuguauuccuaggauugacuuuugcuuccugcuguaacuacucuguuucuucuucccagcucgagccuugggcacagaagugauucaacucuuccccgagaaaggaaauaugggaaagauccuccccgaauaccucagcaacuggaccauggaaaaagucagacgagguagagagacuguuucuauaugcugccacucuauuuccuuugagugugaccuaaggcaaacuucgcuucuauaggaacccccuugacauaagcccuaucaccuggccuguaaaauguuuccaccauucuccagucagcuaaguucaucuagguguucugaaucagaugccccaaauuccuggaagugcugaaaaugaaccauggguguagguucuugcagcucuccaaaacugccuguguacugauaauugguuuuaccguggaggagaccgcuggucagcuuuccuacuucccaugaaagugauagccuuguaggcucacucucaggucuuguuugccuuuacagaggggguuaaggugaugcccaaugcuauugugcaauccguuggagucagcaguggcaaguuacuuaucaagcugaaagacggcaggaagguaaggaaggaaaagauagucugccaagaggccuuccaguucuccacuccccuugccucauuuuuacuccuucauuugacaccaguagauuaguuuuccuggcaguugccauuaaccugauauaauuuuccgaauuaaccaucccuccauuaaaacagaaugaugagagccagaguaggcuccugugaaccacuuucccuuagccccauucuaucugucucacagaguuuugaguccuggcuaggguggcagauuucuguucgaaugacaugggggaugugcaugggauggggugguggaggcuuaugaaauagaacuuaaaauccauuuaucagagguaaguuaacccaugauuuuuuaaagucccaauucuuaauggcaugaagggccauuguuacgccuguaggcauaaauggaaacugugguaauugacugaauuauuucuuuuuugccucagguagaaacugaccacauaguggcagcugugggccuggagcccaauguugaguuggccaagacugguggccuggaaauagacucagauuuugguggcuuccggguaaaugcagagcuacaagcacgcucuaacaucugggugguaagugugcuacagcaugaccaggcauaauucauucucccuagccugugaacaagucugcccgguggugugcuaaagcucaucaacagccuaaccaaauagggucagaguguuuggaggcugaggguacagaauagaaaugugugaacugcuugauucagaagaccagguauggccucaucugcaagcuaguggcagaugaaaugaacagugugcaugccugcagggguagagcucuuccgguucuacuuauuggcagcagcuacuggcauaaccccuggugggcaugcacauaagccuucagauggaucugcuguucccuuugcucaaacuugaauccggaggauggaggaugaagcaauguuauaaccuguucccuagaaaggaaaauuacucuguuuucauuuuccuugaguacuauuuuuagcuguuuuuuacaaucuauuaugacauaaacaagacuauaguauguaggaaccaugagguaauuuccccauugcuaguuacaaguguauuguguuuguuuauggacucugcaacuaaggacguagguaccuuggaggaauuuuuuucccccuccaaaccuuguuuuuuuuuuuuuuuuuaaaaaaaaaaagauguacuggaucuuuuuaaccuguuauaaaaguaauacgugggccaggagaaguggcuuacaccuguaaucccagcacuuugggaggcugaggcagguggaucacuugagaucaggaguuugagaccagccuggcuaacauggugaaacccugucucuccuaaaaauacaaaaauuagccgggugugguggcacaggccuguaaucccagcuacuugggaggcugagugaggcaggagaaucacuugaacuaaggaggcagaggcugcagugaguggagaucaugccacugcccuccagccugggcaacaacagagcaagacucagucucaaaaaaaaaaaaaaaguaauauguggucaauguagaagacagacaagaaggagagaggagaggaaagucaccugcagcaaccauuaauauuuugguguauuuccuucccuguguuuccuugcauguagguuuuauuguugguuuguuuuauucguggcaagcauacuauauauaauauucugcucuuuuccacuuaacaccauaaauguaagcauuuucuauguugcuucagacuuuguaaacaguuuaaugacuauauauuccauuaagcgaauuucacaguuuacgguugcucacucguuggauuuuuagguugcuuugggggagucuaaauagccacaaagaugaacaaaggguuagagagcucaaaugccacauccuucaugaagcugguccaguucacccccggcuggagguucucgcccucugcuugaaauacuugacuccuuuaaucuguaccucucauauggcacacuacuguuuacauugcucuguaguugugagcaaggcuguaucuuucuguacuagguuguaugcuccucauagucaagguccaugucaguuuugucucagcaacccggacaacauaauacuuuuguauauaauaaguacuccauaaauauuugucgaaugaaugaauacugagugacaaaaagaaaucuaagaaaacauuucuaggugagaggcagucacauccaaaaacugguuucuacauauagaaaagaauauucugcaaaucaugguuauuaaauauccugucuguuaaggaaagaacaggaaguagacauaaguaaacaaaacuauagaagauuuagguuagcuuuauggaagcagaauagauuuuuuuuucuuuuuuuuuuugaggcggugucucgcucuguuucccagucuggaguucaguggcacgaucucagcucacugcaaccuccgccuccuggguucaagccauucuccugucucagccucccaaguagcugggauuacaggcgcuugccaccacacacgccuaauuuuuuguauuuuuaguagagaugggguuucaccauauuggccaggcuugucucgaacuccuugugauccacccaccuuggucucccaaagugcugggauuacgggcauuugccacugcaccuggccuggaauagauguuuuaaaaugagaucucaggccaggcguggugacucaugccuguaaucccagcacuuuggaaggcugaggcaggcacauugcuugagcccaggaguucaaaaccagccugcgcaacauggcaacaccccaucucuaccaaaaaaaaaaaaaaaauuuagccaggcaugguggugcauuccuguagucccagcuacuugggaggcugaggcgggaggaucaucugagccuggagguccaggcuguggugagccaugaucgcaccacugcacuccagcccaggcaauagagugagacccugucuaaaagaaaaaaaaaaaauuuaaauggguuaucagcuguuuuuguuaguuuaaguacaacucuggccuguagauggaaaacaugaauuaguuaccauuacaaguguucuuugagcccccaaaguuuauauuuugucuuuaacuugcuuuuuuuuuuuuuaucauguguucauguuauguauuuguuuccacaggcaggagaugcugcaugcuucuacgauauaaaguugggaaggaggcggguagagcaccaugaucacgcuguugugaguggaagauuggcuggagaaaauaugacuggagcugcuaagccguacuggcaucagucaauguucugguaauaguggugugccuuggagacccaacugauuacaacucaguaucucuaggaccauaacacagaguuaugguuugguuuuauuaugagccaguuagcuucauacagaagggaaaaaaguccaucuuauguccacacauucuacccucagguagccaucuggcagaaguguccuguuuaguuuuucaccaaacugauccuuuuguaaaacauuaaaagagaaaaaaauuauuuuaaguguucugucuggcguauguuagacuaggugaaugaauggagauggcaccagcacuuccggcaaaauaggucagaggccgaggugggcggaucacgaggccaggaguuugagaccagccugaccaacauggugaaaccccgucucuacuaaaaauacaaaaauuagcuggacgugguggugcaugccuguaaucccagcuacucgguaggcugaggcaggagaauugcuuggacccaggagguggagguugcagugagccgagaucacaccacugcacuccggccugggugacagagcgagacuccgucucaaaaaaaaaaaaaaaaaaaaaaggagugucagaaagcauuccaguccuaaaagaugaaggcuggucugguaugguugcucaugccucuaaucccagcacuuugggaggccaaggccgggggauugcuugagcccagaaguucgagaccaaccuggacaacauagcaagagcucgucugaauuuuuuaaauaaaaaguuuuuaaaaguuaaaaaaaagaaaaguggaggcuaaggggaaauacuguagguuaaugaagccauaaaacaucucaaauucugaauuccauaaauguggaacacucuuuaaagcuucaaaaagggaauuucaagacaaaaguagugaauagcaaaagugggaaccucaucacuuuccaaauguggcaugggauaaaagcacgaauaaauucaagaacguuucaaucaccgcauggauauguggucguguauaauggcuuuuuaaggaaaagucaaagcuauuaggguuaaucuuacuuucucauggucaucccuagaugcucuagcaacagcagaucaguuggcaucucucgugaucugcauacuaaguucuuugguuggcauaagagugcgguguuggucgggugcgguggcucacaucuguaaucccugcacuuugggaggccaaggcgggcagauuacuugaggucaggaguucaagaccagccuggccaacaugguaaaaccccgucucuacuaaaaauacaaaaauuagccagggugguagugggugccuguaaucccagcuacucaggaggcugaggcuggagaaucacuugaacccaggagggagagguugcaaugaacugaguucgcacccauugcacuccagccugggcaacgagugaaacuccgucucaaaaaaaaaaaaaugcagugucauggagaauaugugcuaccgugucauuccuuacagucccuugacagaacacccucuucucucuucuuaggagugauuugggccccgauguuggcuaugaagcuauuggucuuguggacaguaguuugcccacaguugguguuuuugcaaaagcaacugcacaagacaaccccaaaucugccacagagcagucagguaagaaaguccuagcacuccucuuggagaguguugagaagcagugguccagauucuccugaacaagggguuucuguauuggccagaggggcuugucagugaaagccucucuucauguugugcuuuaaaagaaaccaaaccccaaguccucacucuuuaguggucugagauuuggcaaaaucagguauccuggucaaagcauagauucaaauauuguggguaucuguccuagacaguggacaguggcuagcucaaugacacugcuguuuugugugucucugggaagaccuuucuaaggaagaaaacaagaaaaccugaacuuuuuagauugcguuuuuauuuuucuuucuuucaguugucauuuuuauuauuuugcuucaggcgaaucucaagaacacggccugauaggcuuagcuuaagacuggcuauccuccauggguccugcgcagggaggaacugggcugaguaguuauuuagcugccucccauuccauuuggcagaucuuagugccagguuuucuuuagaugggaggcaccucucuuggaauggacuucucucccacacaugucucuuucauuaacuccgagaccuuauuccuugaccuuagcucaaguuauuuaacuucugcauccuuuugccagaggugucucaagggcaaggugcuguuuaagaaggagaaagcaagacauuauauggauauguagguccuuuuccuguguaauucuaauguauuccauauuccuuaauucugaucucuccuaguaaccuaguaaguggauucaugucacugcuuugucgacuggacaguauuauuuggaggcuggugguucucagcaaggugcccccuuccuaugccacccuucccuuccccucuuucucuaggaagaaaugccuccacuaugguuuuuccaaauggaagugccuucugcuuugucuaaaguaccugucuaauagcacuguccaauagaacuuucugcugcgauggaaauguuccaucucugcucuguccaguacguuagccaccagccacauguggcuuuugagcucaugaaacauggugaguacagauaaggaacugaauuuuacaucuuacucaguuugaaaugauguucauuuacauggcuguggcuaguggcuacuguauuuggaccaugcagcucuagaauuauuucuuagaggacaagaaccagccuucugcaguuugaagaaauccagauaccaggaaauauucauagcaugaauuuaaaaugagauaauaagggagggaaguuuagggucagacugacccugugcccaggagcuggcaaggaagaccuuuccuuggcuuugucacuggagaggggcuggugaaggccaggguuuacugagggggcauagagaaauaaauccucuagaaguagcuugaagcaggccucgaaagacuguuggcuucuagaauuucccaagcucauaauaacugaaguuuugauuuugcuuccauguuuauuuguuuugggggcuggccacaggaacugguauccgaucagagagugagacagaguccgaggccucagaaauuacuauuccucccagcaccccggcaguuccacaggcucccguccagggggaggacuacggcaaaggugucaucuucuaccucagggacaaaguggucguggggauugugcuauggaacaucuuuaaccgaaugccaauagcaaggaagguaggugccugucauaacucuuagaggaagaugggaaguacggcuuagaaacauuccuguaacuucaucgggugcccugagaugcauugucccccggccaggucaaauugugccugagcagaacaaagguauagccuuggcucaggaacauucuuuuucacuugggacuuggcugggugaccugggaguuggcaggcugcuuguuugggguuaguagagaacuguucccacaacucccucccagugugauauggggacugccccagguagccccauugugugggcauggccugaacgcaauggaguaaguuagggaccuauuguuacucucucucccucagaucauuaaggacggugagcagcaugaagaucucaaugaaguagccaaacuauucaacauucaugaagacugaagccccacaguggaauuggcaaacccacugcagccccugagaggaggucgaauggguaaaggagcauuuuuuuauucagcagacuuucucuguguaugagugugaaugaucaaguccuuugugaauauuuucaacuauguagguaaauucuuaauguucacauagugaaauaaauucugauucuucuaaa

SEQ ID NO: 18976 - RNA, 13132 nt, Homo sapiens
gagggcgcacacaggcagaaggcucgcggcucguccacucuccucccucucuccuccucucccuggcuuuuguguuggugccuccgagcugcaaggagggugcgcuggaggaggaggaggggggcccggagugagaggcacccccuucacgcgcgcgcgcgcacacggugccggcgcacgcacacacgggcggacacacacacacgcgcgcacacacacacgcacagagcucgcucgccucgagcgcacgaacguggacguucucuuuguguggagcccucaagggggguuggggccccgguucgguccgggggagauggcgcagcccauccugggccaugggagccugcagcccgccucggccgcuggccuggcgucccuggagcucgacucgucgcuggaccaguacgugcagauucgcaucuucaaaauaaucgugauuggggacuccaacgugggcaagaccugccugaccuuccgcuucugcggggguaccuucccagacaagacugaagccaccaucggcguggacuucagggagaagaccguggaaaucgagggcgagaagaucaaggugauccagggggucagguccaggaagggugggacccgggaggggaccucgcccgaggcauagcucuagcgguugucgucguccagcguccagcgcguggcgguuucgccucuugcugagccgaggacccucggcuccuccucaccccuuuucaccucucucagcggggccccguccccacuucacucaguuuuuuagggcgguugagaaugggguugcauucuuacccuuagccccugccugacagguccugccaggaaaagcauguuggauucccauccaugaccccuaccccgagcagcggcaccugugggcagagggaggcaggaggcaucuguggguccuagucucugggauggaucccaaagcacuuuacacauccugaugucucuucuacugcuugggugccgauaggcugcaaaaccccacuuuggcuaagccucaaggcguuagagggaaggaaaugauggaaauccauggagaaugaaaaagcugcuuuauuuuaaauugcaguuuauaguuaaaaaauuagggcugaguugagauggcgguggaguggggugguucuggcagaaagccaugagcccuuuuaaagaaauugaggcaggguccagcccuucguaauagacaaaacuuguuuuuuuguaacagccccccuggaaugauaucuucuuuacuugucuggggcaucuaauacaugaacugcuccuuauucauucuguugguauugucuucaggucuuuguaaaaaugcagugacuuaaccgagggccaggggaauguucaauccucccccuccaugaguuuauguaauaggcuaagugcaaauauucuugucugaccauuugugcucaccuuuaauucagaaaagguagaaaccugauaugacaggaauaugucaaugugcaggggauggcgggagggaggacauaacaagggcaacuucuugugucauggggagcagaggggggccucuauaaaggcacugggaucacugaagacaacuccucuaggcucacagcuggccuuuccuugagcguaugguuggaccuuagacagagucaggggugacaguaagccuccuucuugcuggucaaacugccaaagugaccacaaggccccuccucugagugacguggagagaagggcugaguaacugaugaaacugaugaaacacuugaaacugugcgagacuccugacuccuugauuauuaaaaugaacguguucuaaaaauggcuucagaaacuaggccaacucacuagaugucaggaagauggacagcucaguacugauaagggagagccccaggguaggaagauagaacauuauuuugaaaucgugaucuuuuuugccccuugcauuuuggaagggaagugcuacauuuccuuuuaaagucaaaggcgguaucugucucuguccuuuccuggggcuguugacauuugcuugguuaagacuuccucuagugugucuagcuucuuuaauguaaggcuauaagauucuagaauuucuaaaacaugacuuuguaauccaaaguagaaauaucuuuacagaugggcucuuaaaccucaaaaaccuaaugcucccauuugcuuaaaaucaagugcuacagugagccaaagaguucccuggauuuaaaaggugggaaauaaguccaucugaaauuuagauggaaaaaaugaaguguuugggaaucuaaagaaggagggaggaagaagcuagaaagugagggaugacagaugaacacgaguggaagagucaccacccaguggccuugaaggaauuuuuaaacuauuccuucucuucuaacaccccaguacuuagccaaacuggacuuuacagucucuggcaaagauuccagacuuuuucccagagggcagagccugugacagugugacucacuagaaacagagcucagcacaacaccacgugcagauaagugcuuaauacaggcuuuuuuggggaagaugauauuuucaaggggacaaagccuugugacacugcucauggaggaguccucugagggcagauuccaaaggagcucagaguggcgugugggaguggggagauggugacccugcuucuuguaaagcugcugcaaucucaggaccaugcuggcaggcgagagaccagcaugucugugggaagauggcagagccuggcggcuagcacgugaucuagauaagagaagauuuggccucgcacucuggcuagccugaaguuguucaaggaauacaugccaaagccaugcuuggagaugacugccaagggcuucguccuuugcgagagagagaaaaguccagugugacaguccgaggucuggccuagaccauggccagcaauagaaggcuuuugggcuguaacauaccagcccuuggaggagagugguagagaggucucagccagcucuucucagucuaagagcaaggguguggccucuucugggcugccugccugugucccgggguagcacauacaugaaccccugcuagggacaacugauuugguguaguuagagccacacuguaauuaauuaucaaggccaucccuaggguauugaagccccauuugcugucuccaaucauuauguuccccacccucaccccaucaaagcauuuacaauugaguccugaugaacucaauuguaugaacaucaagaaaagccuccaaugaguaggcaauaauaauaauaauaauaacaacuauguauugaauaagcaaagagcccaggcuaggcacuuuacaugcauuaucuuauuuacuccucacagcagcuuuaugaaaucagcaguauuguuaucauucccauuuuauagauaaggagacugaggcuaagagagaugaaauaacccaguggcacauggaucugagcuucagccuuugacucuugagcccaagcacuucgccaccucacuauccuaccuuuccuguuacagggccacgauuucaacccagauucagagaccaugcccuuuaccacugcauuucacucuacaggacaauauucaguccccuagauugggggaguuugacagggggagauagaaugccaggcagccagucuugcucuuucuucuaggccagggacuuaggguuauagcccaaggcccccaggagccuuucagaugucuccuucaauuuguauccaggacacacagaacucaacuggguuuacuuuuuuuuuuuuuuuuuuuuugagagggaguuucacucuuguugcccaagcuggagugcaauggcacgaucucagcucacugcaaccucggccuccuggguucaagcaguucuccugccucagccuccugaguagcugggauuauaggcaccugccaugaugcccagcuaauuuuuauauuuuuaguagagaugggguuucaccauguuagccaggcuggucucgaacuccugaccucaggugauccaccugccucgaccucccaaagugcugggauuacaggcgggagcccuggguuuacuuuuugcaccuugauuaucucaacucaggugugagaugcagaaaauguucagagauaaaagagauguuacagauucugugauccaguguccuccucuugcagauaggaaacugagacucagagagggaaagugacuugcccaagaucacacagggccaggccuagaacucaugucuccuaauucccuuucuggugcucuuuccacacaucaugcugccuggcacaaaauccucucuccagccuagcuccaugguccauccaacccacaaggccaccuaugacaagaauccagagggacaucauaagagauagcugacagucuuuccugacaucagccuaggaaggguggaggcaucccccagcccccaaaggaagaguggagcuucccuuaaugacuaugaugugucugucaccuacagauguagcuaaauuuauugagucugucuccuaaaugcauuggaaaaugccgaauagggguguguguguguguguagagagggaggguauguaguagaggggaggcuaagaaacuaauuuuugaaucauucuuuguauauuugcauggaagcuucacuucugucuauaauaguuugguuccucccacaggcugggcacucccugugccccagcccuggggacaagacaaacugcaggucagcuguggcuaugggcagguacagcucaggacugugaguuucuguuccucuacugaucacugggggaaaaaaaauaccuuccuguguuacauuaucaaguggauggaggcugagcuaaguguuccuuggaagcugccugcagucagaaugacaucauuucuuccuuagggcuucugagcuucuaucuucugccaguuaacuuaaugguuaauuauccaucaguguaaguuucucugucucccuugcugcuucuuucugugugugaguuucucuuugucucuguccuccuuugccauucucugugucagcuuuguguguggaucuuagaugcagaugggacaguccagcuaguugaaaacagguuucuuuuaaacuuuucccaucauccacuggggcaugcuccagagguuacagauguauuugucuccuuuuuuugcacuucuacccucccccaucggccuccaacaaaagcacauucaugccucaucuauagaaagaugccaguuaauguuuccuagggaaaagaaaucccccugucagcuaagagcacaugcaggggguugggggcuugcugaagcucgcccagaaaauaguucaaaagguuagauaucucuuuggcaguuccccaugcugugccccuccauccuccuccagcaccccaucaguucgggccugcccccggccacccauggcauguugccaguauuccucucuccacccccuccccacuggauggccuuuagcucugucucaccuucgagaagccaagcuuucugugauuuccaggaugagagaccaauggacccaaggaaccauaccaacaggagagggcuugauggccuuucugagaccagagcaacaacuaauauuugcagagugcuugacauuuuccaaaaguccuuucucauguguuauuucacuggaucaucccagcaaccauaggaggaucaaggucccauugcagagaugagaaaaacaaggcucaguucagggagguuaaaagacuugucuggcauuuacucagcuucugagcagaagagcugggaugcuugcugccuuuccaacagugcuugcucaaguuguugcccaucuagacuuaaugguggagguuucaggccaugaaagaagggagaguguauauuaggcacugggucacauacuuacaaggacuacuaauccucauagcaucccuaccugauuacuauuguuaucaucacuuuccagaugaggacacugaagucagagaaaguaacuuaccuaaggacaccuaacuuaucuaaggacaccuaacaagucauguacuaacaugacuugggccgagaucugcacccaaguugauuugacuccacuauaccccauuggccaucugacagaaacaaggaucugggguacauguauguggcuguggcuaagaggcagucuucacccccauccacuguauggauauggugcccacaggaaaggaggaaagggugagaggagaggcagcugcgaaagaggaaggagaugcuuucacugcuuggcaggggccagggguuuaugaagaugcugagaaaggaacaccuaacucucaaacaaaaugagaucacugcuagguaagguggcuugccagcacuuugggaggccgaggcaggaugauugcuugagcccaggagauccagaccagccugggcaacauaaggaggaccccaucucuaugaaauaaaaaaaauaugaaaauuaguugggugugcuggugcgugccuguagucccaguuacuccgaaggcugaagagggaggauugcuugcgccuaggagguugaggcugcagugagccaugauugcacugcugcacuccagccugggugacacaaugagaucuugucuggaaaagagagagagagagagagagaaagagaccaggcgugguggcucacaccuagagucccagcacuuugggaggcccaggugggcagaucacuugagccuaggaauuugagaccagccugggcaacauggggaaaccccaucucuacaaaaaauacaaaaauuagccgggugugguggugcaugccuguagucccagcuacucgggaggccaaggugggaggaucaccugagccuggggaaguugaggcugcaaugagccgagaucaugccacugcacuccaaccugggugacugagcgagaccaugucugauuuuuuaaaauuaauuaauuaauuuauuuauuuauuuuugagacagagucuugcucugucgcccaggcuggagugcaguggcgccaucucgacucacugcaagcuccgccucccagguucacgccauucuccugucucagccucccgaguagcugggacuacaggcguccaccaccacgcccagcuaauuuuuuguauuuuuuaguagagacaggguuucaccgcguuagccaggauggucucgaucuccugaccuugugauccaccugccucggccucccaaagugcugggauuacaggcgugagccaccgcgcccggcgauuuuuuuuuuuuuuuuaaugagaucauuucauguguuuagggagccugccugcugugaucuuccuuucugaugguucugaggccacaccacugguucuucuauuuucugcugcgagcagccugcuuccuggcuccccucucacgacagacacgucugcaaagaacucagggugggguuuacaaagagcuggaagggagcagugccugcaguuuaaauucggagccuccaaauaaaagcuucaaggcucccaauaguguuggaaagacagaggaggucuccagcagagagggcccuccuggcaguuccggcaauuugggcggcauacgcaauuaugaagccaaagaaaagccaaauggccaaccucacucagccucaaacaccucacacacucccacccguguuccugcuaguggcagguauuuuuagaguccugagcucaugguguuaaagcaucugccacaugccugagggcugguagggauucagacuucuucagaggcaaaaggcaagagugaagacuccugggggguggggggaguggggaucaggagccaagugguaaugauauuccugggcuaugccugcugucuuccuacugaccuccauuccuccuguggucugcucucccuuucuuccuguucggaacaccacggagagguggaagaaaugaaaauauuuucugucucuugcuugcagaagcaaaucagucuuugaggacuuauguuuuuucugugugaucacagucagacguucucucugaaauccccuuggcacauaucuaggaugccagacugcuuguaguuuuagugguucaggccaucacugccuuuugauaaugugucugcugcugauaaugaugaugaugacaaccucagugacgaguguggucugaugcagaaaaagacugcuuacagucuugcuggagagaugccaagagcacugacgagacaauuagaaaacauaaaucuauucaaaaugguaugaugcagacucaaagugcaacagagauuccuaagaaaagagaauugaagggaaguuggcgaagguuugaggaagaagccugaggcgugagcuuaaccuugaagaaugggugagauuuggauagggcaaugagggggcagcugauucuauaggggaggaguggacuagcaugacccaaaguacagaggagggaaucaaccagguguagcugaguaguuugaaaccagguugggaagggucaaauuauggcagacagaauuccacauguggaauccaugugaugccacauacaguagagggcugcagucguuuccugaagaggugaauggcaugcugauacaagcagggauugacuaaagcuagucagaaagccaguauucagagaucgggcacuggggcucacgccuguaaucccagcacuuucaggggcugaggcagguggaucggcagugauugggccucccaacaugcugggauuacaggagugagccacuauacucagacuccaauuuauuuuuauuuauuuauuuuuuauuuugagauggaguuuagcucuguugcccaggcuggagugcuguggcaccaucucggcucacugcaagcuccgucuuccgggcucaugccauucucuggccucagccucccgaguagcugggacuacaggcaccugccaccacacccagcuaauuuuuuuauauuuuuugguagagacgggguuuaacuguguuagccaguauggucucgaucuccugaucucgugauccgcccgccucagccucccaaaaugcugggauuacaggcgugagccacugcgcccuggccuccaauuuauuuuuaaguucacuuuuuuguuaccuaaggucaggaguuugagaccagccuggccaacacggcaaaaccccaucucuacuaaaaauacaaaaauuagccaggcgcaguggcacacgccuguuaucccagcuacuugggaggcugaggcaggagaaucgcuugaaccugggagguggagguugcagugagcugagauugcaccacugcacuccagccugggcaacagagcaacaguccaucucaaaaaaaaaaaaaaaaaaaaaaaaaaagcaagcaagcgagcaguguucaggagacccugcaauggaaacauccacaauccaaaauacuuugcucuaguccaggagugaggagaggagaggcuggccgagggccgagggacacagaaaucagaauagaagaaggguucaaucugaaggucuugccagaggaacuuggaagcugugucaauagagggagaugacggggagccuggacaaugaaaacugauauucggaaugaugacucuagggcccuguaaaaucuucacucagccgacagauucaauuauauuuacuagauuauacuuacugacugcuaacuccaaauaaaggcuauacuucguuuuaagagccauagcagucaauuaguggccauaaucaaauuuucuuugauaacugagaauuguauagggccuugggaccaucauucugagcaugaaucucccuuguccaagacguuggauauauaaagggaaauagauugggcugaauguauaucuccugggaguuaugucuuugcauauguuacagauagcagcuuuuucuucauaauuuggccuuuaucccaaaagcugagauacagaagaaaaauccagugaauuaaguuccuuuuacauaaccaaaaagugaacuuaaaaauaaauuggaggcugggcaugguggcucacgccuguaaucccagcacuuugggaggcucgaucauuugaggucaggaauucaagacuagccuggccaacauggugaaaccccaucucuacuaaaaauacaaaaauuagcugggcaugguggcgcacgacuguaaucccagcuccucagaaggcugaagugguagaaucucuugaacccaggauguggagguugcagugagcugagaucacaccacugcacuccagccugggcgacagaacaagacucucaucucaaaauaauaaauaaauaaauaaauagggcuugaaggugagauuuuaauacuaacuuuguuuucuuuaaaaaguuauucaggcuaguggcucaugccuguaaucccagcacauuuugaggccgaggcaggaggauugcuugaggccaagaguucgagacuagccuaggcaacauaacaagauucugucucuacaaaaaaaaaaaaaaaaaaauauauauauauauauauauauauacacauauauauaacauauauacacacaauauauauaacauauauauguaauauauauaacauauacacuauauauaacauauauguaauauauauaacauauauaugcauacuuguagaagaaaauauggaaaaauauuuaaaaagaagaaaauaaauaucacuauagucucauugcugauaaauaaccauuaauguucugauguguacacuuccagucugugcuuugcauauguuuauguuuaacguuucuuaaaaaaaacugggaccauagcauaugaaaacuuuugaggcugggcgugguggcucaugccuguaaucccagcucuuugggaagccgaggcaggcggaucaccugagaucgggaguucaagaccagccugaccaacauggagaaacuccgucucuacuaaaaauauaaaauuagccgggcgugguggcacaugccuguaaugccagcuacucaggagucugaggugggagaauugcuugaacccagguggcagagguugcagugagccgagaucgugccauuucacucuagccugggcaacaggaacgaaauucugucucaaaaaaaaaauaaaagaaaagaaaaaagaaaaauucuguauucugcauuuucacuuacuuguauuuugugagcguuucucuuacaauuuagucuuugaaaacauuauuuuuaauggcugcauaauaucccacuguacggauauauuuucauuuuuguuuauucuuuuugagacggagucucacuguguugcccaggcugaagugcaguggcccgaucucggcuuacugcaaccaccgccucccggguucaagcaauucuugugucucagccucccgaguagcugggacuauagguacacaccaccaggccuggcuaauuuuuuuuguauuucuaguagagaugggauuucaccauguuggccaggcuggucucgaacuccugaccucagaugauccaccugccucagccucccaaagugcugggauuacaggcaugagccacuguaccugaccccacuguauagacaugaacuuuagcuauuccuuuucugaugagcauuuagguuuuuccuguuuuaaaaaaauucucaguggcucaagccaguaaucccagcacuuugggaggcugaggcaggcggaucacgaggugaggagaucgagaccauccuggcuaacacagugaaaccccaucucuacuaaaaauacaaaaaauuauccaggcgugguggcgggcaccuguggucccagcuacuugggaggcugaggcaggagaauggcgugaaccugggaggcggagcuugcagugagccgagauggcgccacugcaccccagccugggugacagagcgagacacggucucaaaaaaaaaaauucuaaauaacacuguaagauauuaguacagaauuuugaccacaucccuauuucuuuuguauagauuucuggaagugagauuucagguccuaagaguuaugaacauuuuugagguucuugauaauauugccaaauugcucuccagaaaaguugaccaauuuacauccaguuuuucaacuaaaaaucuuaagauuuuuuucaacucaagauuuucaguuaacaaucuuaagaaaaacuugacaaauccugaaacuucucuuuaugcuuugauaaguccauucugcucaucugucaaagaaccacuuccugugucacggcuugucacuuuuuuuauuuuuuuugaaauggaguuuugcucuuuuugcccaggcuggagugcaauggcgugaucucggcucacugcaaccuccgacucccugguucaagcaauucucuugccucagccucccccguagcugggauuacaggcaugcaccaccaugcccggcuaauuuuguauuuuuaguagaguugagguuucuccauguuggucaggcuggucucaaauuccugaccucaggugaucugcccgccucagcuucccaaagugcugggauuauaggcgugagccaccgcacccguccugucacuucauuuuuauagugcuacagaaccauguuuucuccucucuguucauguucccuuuucugacuccaccuuuggguuuuuguaucuuccagguucaggugugggacacagcaggucaggaacguuuccgcaaaagcauggucgagcauuacuaccgcaacguacaugccguggucuucgucuaugacgucaccaagaugacaucuuucaccaaccucaaaauguggauccaagaaugcaaugggcaugcugugcccccacuaguccccaaagugcuugugggcaacaagugugacuugagggaacagauccaggugcccuccaacuuagcccugaaauuugcugaugcccacaacaugcucuuguuugagacaucggccaaggaccccaaagagagccagaacguggagucgauuuucaugugcuuggcuugccgauugaaggcccagaaaucccugcuguaucgugaugcugagaggcagcaggggaaggugcagaaacuggaguucccacaggaagcuaacaguaaaacuuccuguccuuguugaaaccaaacgauauaaauacaagauaaauuaucacuggaguuuuuucuuucccuuuuuucugugccugcauaaugcugacaccugcuuguuuccauacaaauugauaucaaaauaaaauuuguauagauuaucacaugg

SEQ ID NO: 18977 - RNA, 1334 nt, Homo sapiens
ccagcuuccucuauuauaacugcucuuaauugcuuguuggcugccugugaaaaugauugaaguaacucaaauguuccuaacaaaacuagucauagccacccaugcuguucugcccacuguagccggccccguaacagccacucacugacuggcucuccaggccacuguaaguggccugggcagcagacacccccaugccuugcaucaccuggcugcuauacgccccauugcuggccccuguuguugaauucaagaagaguucuauauaucugugcugcauauuggcccugucuuuggacauagcugccacagcuucuucaugaguagcaaacucaacaucugcuucacccgucacucuuccaucugggccaaucucaauauggacucucacaggguugagaggagagaagaaguuguaaaugucguucucggucgcuuuguacggcaggccccucauguggacacaguggccuguggugcucugcacugugaacucacugucgccguaucuguggucauacauuccggagagacaguagcugaggucucucccgaacaggucgguggugaagccguagccaucacugaggccacuguacuccucguagcccccguagccugugcuguaggcaccaggccucauccuuuccaggccugccugcuucacgaugccaauguaccuccuggcagucccgggccggucauagggcccuggccgcugcacggacaugaacuucagagggggaucugaguaugaccuaacuuccuccuggcugcucuuaaacaccucaauguaccugugcccuauccucuccuuguguuucccuagagccuucucagcuaacuccugcgaggcaaacugcacgaacgcuuccccuguaaucuugccuucgggguccacaggcaaugugaucccguuuggcacaauuuccaacccugagaagaacugaacaauuucuuccuuugugcauccaaaugggaguccucgaagccgcacgaagccaucguuggcgcugucggcacuguugggaccacugugcuucaacacccaauccaucucgguucugugggacuugaacaccucaauguaccggugucccaugcuuucccugucuuuuuucagggccauuuuuacaucaucuucugauccaaguucaacaaaagccucaccacucugccugcccucucuaguguagaugaaauggacaccugcggccccaucaugaaucgugcagucagagaggaaguucugcacguccucaacagagcaggaccagggcaggccacggagcuugaccacaaagccuucaccucccucagggcccagcaucaug

SEQ ID NO: 18978 - RNA, 15170 nt, Homo sapiens
auuuaauuuaauauuucaaaauuuaauuguauugcuuaauauugucugaaaucugggcugggcaugguggcucaccccuguaauccaagcacuuugggaggccaaggcaggaggguuguuuaaccccaggaguuugaggccagccugggcaacauagugagacccccccaaucucuacaaaaaaauggaaaaauuagcugggcgugguggcaagccucuguagucccaguuucucaagaggcuggggcaggaggaucacuugauccuagaaguucgagguugaagugagcuaugauugugccacugcacuccagccugagugacagagcaagauugccuccaaaaaaauauauugucugaaauauuuuauacauggacaauucccagugaacaaauuugucauuuggccacuuucugcauguagaucagguuauacauaucauucauuuucagccauugucuauaauuucuauaauauauaauauauaauuucuauaucauucucaguuuucccccaaaauaugccagaaugguaacuaaggaaacaggcgaaugaauguuuaacuuuguuuaaacauguacugcaauacacaugaucauuuugauaaaaaguaaugauuuucaguuuugagaaagauuuauaaguuagcaaauccagaacaugaagcaauacaccaaauaauuaaagaaaccaaccucaguaauacagaugucuauuuuauuaaaaaaguuacaaacagguggacugcagggucgucuuacaaaaugacaagaaugaaaucuauuggaaaaauuuuacuuuuacaaaucuuuauagguaauuguucaauguuuguacuuguuauuugagauuuuaccuuucacugauaaaguuacaguacauuagauccaugauaauagguuacauuauuuuauuugcagagcccuacugcagugauuugaacaacuccuaaauagaugccauaauaaagacaagacauauauugcauuuaauauuaauuuauuauccuaauaagcaacaugcaaucuauugaggaagcuaaaauaacuuuuggucccuuuucuuaaaaugugcuggagaaaccaccuuuaaaaucacuuuccccugauuccugcgauccuaagugaauucaagucaaauuugcugcugaggucaaugacaaugaacacuguaauuuugagagagagagagagagagagagagagagagagagagagagagagagagagagagaaacaagaacacaaucuacaggaaagaaacauuauaaaaaaaucaaaaucucuagaaaauuuaaaucaugaugaauuauuugauuccuuuagaauuucacaaagccacaaagcuaauaacaaugauccaugaucacuuaaccuacuuuuaaaugaguguuugguuuuaaguuugguauuaaagugcaaacuuaaauuaaguauucacuucaagcaguucauaaauaaggaacaauguuucaauugccucuaucuuuacaaucucaccauaaaauucaaaauuuaagaacaagaguucacuuugagggaauuugcucaggaaucaaaugcaacacgauuuaaaaaaaggaaaucaaaguuuagucaauuucuacucaguaauuaauggucaugcugacccauaaaucacaugaauguagauaccacuuuauuugaacaucacacacaauauaaauuuaaaauugccacacccuuucauaaaccaucacugcauauauuagagcuuuccuugacaaaguuauugagcucuuauuauagaucaaaaguauaguuuugguuuuguuuuauuuuauuuagaagcauguucaaaugacuaaagcugggcuccuaaaaucgagaacuuuggugcaguaggugagcugcaguuacuaacuucugcaaaugaaaagcacacaacuaaaaucaaauaaaaacccaacaauaaaauacugucaaacuuacacaauuuaaaaaucauugcuagaaaaagcccucauugucacgauguuaaaacugaaccaaaauauuacucugcauaaguuuccuuucugauucuacaccugcguuacuguuaaaauguucaaguauucagacaaaaauaugcugauuagguaaacaacauggaaggcaauggcuauuagaaagcacauuugcaaaaauaaaaaauagcccagagacuuggcgcuauucucccuccuguuacacagauuuugucucuaauacgaacaugcuucuugagaaauaacuaaaaagcaauugugauagugcaagaaaacuuuaacaaauauugcuuuaaacuauuauucagaaagacaaauauuaagaacuagaaaguguguaugauuuuauuugaauucaauuuuacaugugcagaagucuacuagaugucaauuacaagccugauaggcaaagaugagcuaucucuguuuagguauacaauuaauuuaccauggauacaauaucccuuuucaaaggcauugcuaaauaggucauaacuaaauuuagaacuucacagaaaggaaaauguuacugccgcaauucaaugcuguaaaugagauuaacacaugugaaaaccuaauggaacugaaugcuuaacucuucaacuaaaugcucuacagucaauuucaaauaucaauuguaaccuucagaacauguuaauuacaaaaaaaaaaaaaaaaaaacaaaacacaucacaaacugcacuugaagaaaagggauauuccauccauacagguaaaaugugaucuuuaguuucuuuuuacaacacugccacacguaaacaaagucucaaaguauuaaccaauaauuuuaaaggagaaagauuuuacaaauaggaugaagcacugguacgagguaauauacagaaguaaccauuuguuuaaggcucaauuuuuucuccauuauaacuuucuuuuaaaaggcauugaguagguaauacugaguuugaguauuuaauaaauacaagucgagaaacugauuaaagaaaucaauuaaaauauuaaaaauuaacccuuguauauuagccaucaauaagaacuuagaaagcuauaaaaggacugauugauaaagaauggauuuuaaacguaugguaaacgugcuaagcauuccuguuuaaggucgauggaucuugaaggccaaagaccuuaugcacuuaaauagauguauggcaacaugcuguaauagagacagguuuaccaaggcucaguucugcaacccagguuguaaaguucuccaaagcagcaucugugcaaauuuccucugaguuuuaucugcaauuaagauaaacaugucauaaaaauguagaaauacauaguuuaaaaagagaacacugacaacagaucuauauacacagagaagugguaacaagaauaacaaacuucaguuaaaguagaaaguuaauuuucccucguccugauaagucauuaaaaaaaaauagaaacacagaagugaugcauuggauauaauguacuuugugugugcgugugugugcguguguguagcuauucuagcuuauuucuauaauauuauuaugccuuguacuuguauuauacuuaugcaauauuaaaaauguccuuacugguuuaaaugaucuuacaguauaaaaguuguugcaaaugcugcuucuacuuugaacuugaucucuucacauuuuaacuggaaaugguauuguuaucaaaugcauguuaauuaugaguuaauuggcaguauguuagacuuuuccuaaauuuaguuuuuugagagauuaaaauaagaaaacgucauucaggccgggcacagugguucaugucuguaaucccagcacucuaggaggccaaggugggaggacugcagaaagaaaaaagaaaagaaaggaaaagaaaaaagaaaagagaagaaagagggagggagggaggaaggaaggaaggaaauucaaucaaggucuagauauugagcaccuacuaggugccuagguaaggucagaugcuaggugauagcagcaguucacauuuuccacuugggucugcccuuuuuuggggauguccucccaaccacgggaucuucuuuuaugacugggauuccucauucccugcucuuauagcguacagauuucugcccuuccagcuaauacuagggaaaaaaaaucuaucguucagacagauagagcguccuucaacugugcugaaucaccaaauagcuucuaggggaauagaguuauguuuguuuuugaacgcaugagauaaaaaauguuaucauaaagccagaaacaaaaguagaacagcaacuaugaaagaaugccaagggaaaccaguuuauaaucauuuaagggcucuaccaauguuuauaaaugcauaauuuuaauuucauuugacagcuacacuucuauuagugcucaaagagccugagauaaugcuuuauuagcagcuauaucauaaaaaugauuacuauuaaagaacaucacucugcucauuauugaaauucugcuaccuaaacacauuaggaaaaaauagaacaaaagucugccucuuuagaaauuauuauagaaacauucuuccaauuaaaagacauuuugcauuaaauuguuaauuaggacaccaguuauuuaagcuuuggcaaguccgguuuccucaucaucgaaaaagggauaaaaauacuuucuucacaggguuguuguaaauuuguuuuccauuuccaacuauguuauaaauuucuagacuaccaggauuguaauuuugauauccagacuaaggagcuuuauauuuuuuagccuagcuggaauuucuauaccuacuugaacacaacaguauuucauuauauaugcaguauuaugaauaaaaauuauucauuaugaauacuuuuuaguaauuuagaaagacuuccuucaauuaguuugaauuaaugaauuugcuauaaauuuucauuuccuuuuuuaaaucaaacaauuauaaagagguugggauuuucaaaaauaauuauuucucuuaaauauuaaagaccucuucaagcauucucuaaaaucaaauugagaaaguaguuauuauuuauuucuagccaaaauaaauauuaauaaucaaaucauuuuacuaaccauaaucuauauggaauaaaacaugauauauuaaucaccuccuacccucuaaaaaccuggguaacauuuggucuauccacauccacaggaugacaauacuccugugaaaucaagagauauagauaaauccugaguuaggcucuacaauauuaacauuaggcauaccuuuaagcaaacaaaguauuaauacuagcuacuuuucaagagaguaauaaauuauaauuaucugcaguaauaaauccugaaguaaaaugcuugcauuaaacaaaaacaacagucucuuucagguuagaauuucaaguguaaauguucuugcuccccagugacagcaaaauuuucaauauacuaacacuuucauuuacguaaaaauaaaucgcugaagguuuaaaagcagcuggucaaaucaguacuuuuuaacuugcaggauaucacauucaagcacguugcaaauguauaacuugcagcuuucaagauagaacacaaguuauccucgaccucacucucaaguuuccagcaagacacucaacaaaucuuaucucuggaagcuucuauucaaacucuuacuuaauuguuugguuuuacuuuuuagcuuuuuacuaaugcaauauuauaggaaaguacaaaaaaaaaaccacacacacacacacuaauccaaagcuuuugcucaggaaauuaugaaauaaauagggucucccaagucggguaaauugguauacgagaguaccaaacacagaacaaaaggaacaaagaucauuauuuaugucagccugaagaaaaaaaggggauucuugauucaagacuagcacaucauuucacauggcagcagaaugccugguauguuaacaaaggcuccugaaaggcuuagcaguuuaugaaugucuuuuuagcuuaacuggacuuaccuuaucuaaauacaaugguauuuacuagcauugucucucucucucucucacaaauacuaguguguaaucauaaucacuuuuaauuuuuuucuaguuuuagggauaugauauucuugggauuuaaccaaaauacuuuuuuugaaaaugaauuuccuuucauauuuaauuagcauuuuauuuacaaguuaaaaguuaguuguauuagcaaaacaucaggcugcaauuauaauuuuaauaaauuguuauuuuaauaaugauguuaauaaaucaucaaaagugcuauuuuaauaaaacauuaaauuauuuuaguaauaauuuuaauaaaacauuaaauuauuuuaauaauuuuaauaaaacauuaaaauuauuauuuuaauaauaauuuuaauuucagagacaggaucuugcucugucauccaggcuggagugcaguagugcaauuguggcuuacugcaaccuggaauuccugggcucaggggauccuccuaccccagccucuugaaccgcuaguacuacaggcacacaccaccauacccagcuaaguuuuuuauuuuuauuuuuuguagagucggggucucauuacauagcccaggcuggucucgaacuccuggccucaagugauccuuccaccucggcuucccaaagugcugggaugacagguaugagccacugcaucuggccucaggcuggaauuccucugauacagguuauguuuuuguuaaauaucuuuuguuuuguuucucuauccuaaugugcauaauacucaugaagcuuacuaggguuggagugggaggacuagaucuuuaaacguguucacugucacccauuaaacacagagagcaaaagcggaaccuauggcauagaauccuugaauggagguggaaucacacaugaaggaaagcaagcucacuaaauguuuauagugaacccaggguagaagggaugggauuagcuauauuucuuauguacuagaccuaaaaucucugaauguuuaaauuaauaugauuaguucaauucugagaucucacauauuauaaccaaguccagugauaauaaacaacagugugagcccaaugauacaauuccagcugcuagcuuugaauuagaccagauaaguuaguacuccccucaacucuaaauugcuuuuucugaauuugauguuucuaagauuggcuaauuaaaacuacuugggaguauguuuuugauuggauauguuuuucuaacagcugacaggacuuaaguuuuucuuacugauauuaucuucugaauuguagaauucuacugagaaguaaucccauggggagaaucuuuucuguaguauggcuagaacacuuccuugguggcaauucuccaacucuaugaugcaauuuuuguuaauucuacugauaguucauucuaagccagagagguaauggaguaaaacugaauggcucauaugcauuuuauuaugcaauaaaagccuaaucuugagguuaaaaggaagcaauuaaagagggaacagauauacaaagagucauucuaaucaccagacaccuccacauccagagcaggucuaacuaggcaccuguccacucucaagucucaaaccaugaaccaacccuaugaauucagugaaggucugggagaauuaggaguaguagaaagggcaaggugguuuuguuuuucccuuuuacccaagguucgcugagggccuuuaugguacauaccacccccaaagcaugcuucuucuuccauucaacuccucugcuccacuuugacucaccaugugaacuggaugacagaugagcauuuuaaauaagccauuuuccccauucaaagugauaugcaaauagagcagugggaaaaaaagaacuaucuaacaaaacuauaacuucuacaacagaauuccaccccagcauuuuacugauauuauuaauauuuaccuuguauaggaaauuuuaaguaugugaugugauuugaggauuuuucuccucacauuugcuaaacccccagcauaccauaaaaauuaaaaacuaaaauuaaaaguuaaaaaaauuaaaaaccauucugauucuauauuuuauuuuaaaaaacccugaaaauguuuaucaauuccacuguauuuaggaauaguaagucuagcuagacuaaaaugauguucaaauagaguuuagucuuucaguagccuuuguuagcaucccaggcauucugcugccauguaaaaugacgugcuagucuugaaccaagaaucucccuuuuucuucaggcugaaauauauaaugaacuggggcugacauaaauaaugaucuuuguccuuucaguuugcuucccuguguuugguacucuuaugcaccauuuacucuaguugggagaaccuguuccacaguacacugagaaaaaugguauaaaaucuuacaggagaccuucaaaccacagugaauaacaccuuuucccccauuuucuuucuuuaucacuuucaucaauacuggacugacauaaaggaauccuugaaaaaucaucuuuaaaauauucuauuugccaaaaggauauaucaaacugucacauuuaagagacaccuuuacugcacuucccccuuacuauuagggaaucaacagaauauuuuaggauaugauuaugcuccuucuuggcauucuuucuguuugaaggucaacacugacaccccccaccccuaccaccaguccccucaaguccuauccaucuucaaagccugauucaaaugcuauugcucccaauaucucuaacucgguggcgcuuaaccaagggcaauuuuuguccccagggggcauuuggcaauuucuggagauauucuugucauaaugggggaugaggaagaugcuacugucaucuaguggguaaaagcuagggaugcuguuaaacaucugacaaugcacaggacagccccaaacagcaaagaucccagaauguuaagaaacucuguuccaguugguuguggucucuccuuucccugaacucccacaggacagugauuuacuucuuuuauaguacuaugagauuauuaacaaaacaucaauccuucucaacaaaaauauacccaaacagugaacugccaauaauuuauaccagcacagaagagcuaugauauagugaaugaaaccagaacagggugacaaugcugacccggguuuccauuauacugcugccauacagcaaaagaagucccuucaaagcacuugaucauacgcuccucagaucaguaaagaaaucaggaugauggcagcguauaaggaaucugguuaugcuuccaaacuuacacuaaaguuacugccaaugggaggguaaaaggugaggaaacaauccugggagccacgcagauaaacagguguuaggcacgaggccugugacccaaauugaaagauguuaagacauaaaugugaggaauuaucagaagcaauucuuagagcauuaauaaauuuucccucucaguuaaaaacaaccaauuaacaacaauaacaguguuucugauuuacauccuauuauuucuaacuuggacaagguacucuucuaaauauuagcgacaaacauuucucaaaucaacuuuaccugucaaaguuugauauucaauuuagaucugggucugacagauuucaaagcuccaugacucaagcuauaggauucaaaauccaccaucuauuuucuucucuucuuagguaaauggugagcaaggacaaccacaaauuuuacuagccucagauuagagauucccauauaugggaaucaguucaauuuuauuugaugucagaaaaaaaaaaaaccugcauauagugcacuuuguucuaaaagaucuuggucagggaguuccccuuaauauuuuuagaaauucaguuuauuggauauuuuauuucaaggcuaauaucuucauuuauauauucugcuuacaaaaacaaacaaaaaccuacacagagaacuugacccacuacuauaaaaaugaauauagguauuaauaauuuccauuuuuaguauguuaauuaacaaaaaauacaaauauaguuggcuugagauacuaaaaaaaaucuauguacucauuccuguagguaacuaaauagguuaaaaauaauucagaucacaaaaaguuaccaaaugaaauaaacucagaaaugauucagaagaagagguucaaaaauagcuuuagaaauuauucaccugccaauuuggcugagagagcuggcucucuacauguaugagaccaauuuuauucaguuaaccuccuauagcugucuacacuaaugauggaaggaaaacugggaacauuucgugggaguugguuaauuuuuaaaaagaugauaaaacuaacacaaaauguguauagacacuuacguuaucugcccaguaagugucagguagaaaaauagagcaaaacaguaaagacacaaucaccacacagaacuuguucaauugugaagcuggcuuacaauuuaaggagagagauuacagcagcaagaauaugggacuugauccauaagccucuccccuccucaaaagacuauacugcaaguacaaugcuaucaaccaaacacaagcuggacuauggucugaaaagugacuuuauaaaauaauagauguagcuagacauaagaaaauaaaugaguuuucaucauauucugguaugcuaaaggcugaugagugaaagcauuuuaaauaaagcauuguugucauccuucauuuucaaagaugacacuaucugacaggagaccuugucugaaaagauaaauuagggaccguuagucuuuucuccggggagcauacacaaagccagacccuugauuaggaaucauugcuccaaucugaaaugccuguugccauuugcaacacugccuccuagacucgaggucagccuuggcucaggaagaucaauuucauuccugauacugucaggcuagucuggcauuugcugcgguuucucagucauucacaauauugguuguuuuaucuuauuaucuaaguguuacugucuaagugagacuauuugcucaauuacaaucuagacuaaaagaucauggcauaaauaaucuuguuuuaaaugcuucguaaguuuuacauaaucuuacuuuuaaaaaaguaugaguuuuaaaaaaaaacucauucauuaaaaaaaacuuguaaguuaucauuuaacucagugaaaggccugaagguuuguuacuguuccuauuaaucucauaauuuauuaaauugaauaaauuuuuuuaugcaugaaacuguuccuucuaacacaucacagauaauucaacuagauuaucuuuuggaccguauauuuauaaugaagucaggguacacuguggcacuauaauuuguuauuaucagaggucacuuaagucccucaaguguuagguacagaugaauuugcuuaaauaauuguacuguuaaucaagcacuuggugauuaguaaauuggugauuuuaauugcagcaauuugcuugcucaggacauaaaaacauaaaaguacagaaaauaccacaaaacuucugaaauuauuacucagugcucuccugugcauucuggaugcuaaaucagaagaacagggaaaaaguguauuaugguuuaacucaacccaaagaaauauuaccaauaaagcagagaaggaagaacaauaacucacuuaaaauccuggugaugggaauauaagcaauuucuuaucuccgcuuugcuuaucugcauuuaaaaaaauuuucuucauugaauguugacuauuuugugugauggaaaauguuauuuuaaaaauaaagaaauuuaaggcagugccauauguauuaacacuaaccagcuuuuuguuuuacuugaucaaaaaacaaaacacuaccugauucauacaguuccaucaaaaacuaaccugcucgguauggccaugauugagguuaucuucuuuacuggacgacacaaguuguacaacacugaucuugcuucuccggcagggaugaauaguucauuugccugacgaucucagcaaaaaguucauccaccauugauuuacuuuuugccgaugucuccaugaaaggacagccccauucuugagccagagcucugccuucugaagacauaaccucucuuucugguuccagauccacuuuauuuccuacuaggauuagugggacuuuuucauaucucuucacucugacaauuugaucucucauuggcuugauauccuauucaagcaaucacaaagagaaagaaaaacauuaugcuguuuguauaaccauaacagaaauauuacaguauuacaaaaagucauaccucagugaguauacaaagcugaauccaaaaugaaaucacaccuaaacagagaaaucgucaucauuuuguccacugaaguaagaacuagauaauuuccagagacccuaccugcuggguuugucaagaauauaaaacauggguugcacacuaaccuugacucauauaaucacuuuuacccacccccagucuauacugauuaaaaaagcaaguuuccaaaugauuaauccauucguacauaaggauguuuggccaucucccuaaaccugccugcuugucaucacuccuuguaacaccuguuauccuagcacaggauugcagcaucuaugcauuccuagccauguagcaagagggcuugagugaaaguguuuuaagugggaaaaaaaaccacuuuguaaugccuagaauaaaagaguuacaaccagauggauacacuuaaauguuuuauuuuaaauugaaugguaugcauuuauuccaguaaaaucaaacaccuuacaauacacuuaaauucacuagaaacuacuguaacagugagcaacuccugggaaggacagugcaaggggagucugggugggaagaagucauuuuuuuuuuuuuugccuguguuuguuuuuacuacuuguuuccccaugcguauuacuuuuuccaaguaguuacaacgaauuacaaaagauaagagcguuagcaauucuccaguagcaucaguuuugggaggugggggcaaguauugauuuaauacaauauuauagacuuaauuauaaaaaucaccauuuucgguaauauuucauaauuuuaaaaguuugccuuaaauagaaaauguaugcuuaauuggaagucauaguaaguacagaauauucacaugugggccuacggaaaagcaagggacuaugaaaaucuauaaaaauauaguuauuugauauuugcaucaauuugguuugauaauauaucaacucagauuucuagguuacgcuuauuucccauugucuuuauggaaacauaaguucagcugaaaauccaaacuuagggcauuugggcucaaaagaguuuacaccuccacugaaauaacggcacaguuuuucacucccaauucaugucuauaacacaaauggauauaacagaaaucuuaugaaacacccuucaaaagacucucagccuccagagaguaagcugauagaauaacaaaucuccugaggauccuuuagggaaaaaaugccugucaaacagcaccuucaguacuuugguacuuucugggggaaaaugcuuuuaugauacuauuguuugggaauuuaugccuacauaaaaugaauuuaguuuggucucaauagcuuugauuuauuuccccagaauuuaucaucuuaaaaaaaaaaaaucccugaaguuguucuaucagguuacugggaaaguucacuauaguacuuuaauuuaaaauacuaaagaaaguggaauuagcacauuguauuggcuaaagcacuuaaggucucuuaaguaagcuacauuaagugcauaccuuuaaaugcagaaaaaauauauccauuuccuaaaucaauggaggucaauauaaugggucaauaugagguuauucauuuucaagggauaaauagaaacauacauugcauauccuaaaauaacguuaaaccuucagucuguuucccagugaaggacaggacagauuuucuaagagauuggaccacauccaguuuggccacccagccggaguaagaaaucugcacuuguucaguguucccagacccacguauuuucuguaaauacaggcaauguuaccagaaacaauuuggaucaacugcagaaaaagagucauuccugauuuuuguugguuauuaauucuagguacuagucuuuucuauuaguaacuuuucuuccuacuacacgccccaaguaauuaaguaaaaugccuagaaggcaggucuugaguucuucgucuugcaacacuaagauuuaugaaucuaguugagaaacuugagagagaaggggagggcggcgggaggggguguuggggggugggaggggaaggugugggugggacagacacagaggacuuaucugugcaacagauaaucggcuccaaauaauuuuuucaaagugcucuauuuacccgagauuauuuguuagauguuuugucguguaaguuaaucaauacuuguugaauugagcaagcaacuucagaagguuauauuccaggcgaaauauacacagacugacauuucuuuuucacuuuucuuucacuuaaaaauagcuuuaaaauauuuguugacgcuuguuacuuuuuacuacgcucuauagaaacaacccgauagucuuccauggcaggaguaaccucaaaaaugcgucaugucuaacuuucaaaagcaaagcacagucauuaaugcacgguucaagcaacccagaagucgaugucggauuaccacacccccuucuaacaaauuacaagacuugguuugguuaccugaaaagacuguugauuaaccaggcuauaaaccaggaugaaaccuuggccguuuuugauguagagaucucucauggaggcaaacugcucaguuccugcgguguccagaauuuccagcacggagggggaagaguccacuucgaucucuuugcgguagaaaucuucaaugguggggucauauuucucaaugaaagucccagugacaaacugcacaguaagggcagauuugccaaccccuccacucccuaacaccacuaccuuguauucccucaugagucucaccuucaccaacuccuaccagagggggggaaagaucaccccgcuagcuguggcgcggcuagacgaggcggaaggugggcggaaaucugcgaacuggggaggagagugcagaggagcagagggcccaaccggggaagaagaggaaguuacaggagggggaggggaaagagcguagagucggggaggguggggaagggaugguaaugcccuuccuauaggaacu

SEQ ID NO: 18979 - RNA, 429 nt, Homo sapiens
gcacuccucccccgcccuucacacaaaggggcccagggaccccgcuuccugcucgcgcagcccagccggcucaggccugagggcuccguuccaguuaccgcugcccgggcggguuucugggccccggcucccgcgggggucguccggccugugaaggggagaaggacgcacauuacccggcugacccccgccccgaaccugcggcgccggccgccgccucccccaacucccacccggaucaagcuacugccgcuuaccccgccguccgcacccgcccggccgccggggaggcucugucacgccaaggccauggccacccgcuggcuccucugucucuccgcugccccagcgcugcugcucgccgcggggaaagaagcgggggccuuccgcggcggccgcagggacuccaggcgaacccaccucuuuuuu

SEQ ID NO: 18980 - RNA, 1713 nt, Homo sapiens
uucucaauuaacccaugcagcaaaugcuacgcaucugcugaguccguuuagaagcauuugcgguggacgauggaggggcccgacucgucguacuccugcuugcuaauccacaucugcuggaagguggacagugaggccaggauggagccaccgauccacaccgaguacuugcgcucugggggugcgaugaucugcaaagacagccaggcacggcuucagcucacagagcgccccccagucagcucucccgagccaggcagagggccaccaaccccucgacucaccuugaucuucauggugcugggcgccagggcggugaucuccuucugcauccugucggcaaugcccggguacaugguggugccgcccgacagcaccguguuggcguacaggucuuugcggauguccacgucacacuucaugauggaguugaagguggucucguggaugccgcaagauuccauaccuaggggacagagcccucccuuagugaugcugugucaccgaggauguaagaguagaaaccuuuagcucacaacaccuacccaggaaggaaggcuggaacagcgccuccggacaccggaaccgcucauugccaauggugaugaccuggccaucgggcagcucguagcucuucuccagagaagaggaggaugcggcgguggccaucuccugcucgaaguccagggcgacguagcacagcuucuccuugaugucgcgcacgauuucccgcucggccgugguggugaagcuguagccucgcucagugaggaucuucaugagguagucggucaggucccggccagccagguccagacgcaggauggcgugggggagggcguagcccucguagaugggcaccgugugggugaccccgucuccagaguccaugacaaugccaguggugcgcccagaggcguagagggacagcacggccuggauggccacguacauggccgggguguugaaggucucaaacauaaucugagaagggacaaggggcggcuuagucagggacagagacccacggccaccccaugcucacacgccacaacaugcugcaugccagugugauguguggagaaaagaaaagaacgcaggcagaaaccaaaugagaaaccuggaggcuucagggaggaaaugccgggagaggaacagagccuggaacagcgaaagaaacacuuaaaugucagaaaucaagccgggcagaaaaugacuggggaaaggacgggaggagcacgggcgucggccgagccucaccugagucaucuucucucuguuggccuugggguucaggggggccucggucagcagcacugggugcuccuccggggccacgcgcagcucguuguagaagguguggugccagaucuucuccaugucgucccaguuggugacgaugccaugcucaaugggguacuucagggucaggaugccacgcuugcucugggccucgucgcccacguaggaguccuucuggcccaugcccaccaugacgcccugcaggggacgacccgucagccucgccggcgacaccgaacccaccccgcaacgcagaacccaggagccccgcggcgccauccacucaccuggugucuggggcgcccgacgauggaaggaaacacggcucggggagcgucguccccagcaaaaccagcuuugcacaugccggagccauugucaaugaccagcgcggcgaucucuucuuccauu
